(12) United States Patent
Djonovic et al.

(10) Patent No.: US 10,750,711 B2
(45) Date of Patent: Aug. 25, 2020

(54) STREPTOMYCES ENDOPHYTE COMPOSITIONS AND METHODS FOR IMPROVED AGRONOMIC TRAITS IN PLANTS

(71) Applicant: INDIGO AG, INC., Boston, MA (US)

(72) Inventors: Slavica Djonovic, Malden, MA (US); Elizabeth Alexa McKenzie, Milton, MA (US); Gerardo V. Toledo, Belmont, MA (US); Craig Sadowski, Somerville, MA (US); Geoffrey Von Maltzahn, Boston, MA (US); Karen V. Ambrose, Cambridge, MA (US); Xuecheng Zhang, Newton, MA (US); David Morris Johnston, Cambridge, MA (US); Trudi A. Gulick, Topsfield, MA (US)

(73) Assignee: INDIGO AG, INC., Boston, MA (US)

( * ) Notice: Subject to any disclaimer, the term of this patent is extended or adjusted under 35 U.S.C. 154(b) by 0 days.

(21) Appl. No.: 15/580,616

(22) PCT Filed: Jun. 8, 2016

(86) PCT No.: PCT/US2016/036504
§ 371 (c)(1),
(2) Date: Dec. 7, 2017

(87) PCT Pub. No.: WO2016/200987
PCT Pub. Date: Dec. 15, 2016

(65) Prior Publication Data
US 2019/0059390 A1     Feb. 28, 2019

Related U.S. Application Data

(60) Provisional application No. 62/172,748, filed on Jun. 8, 2015, provisional application No. 62/172,750, filed on Jun. 8, 2015, provisional application No. 62/172,755, filed on Jun. 8, 2015, provisional application No. 62/316,386, filed on Mar. 31, 2016.

(51) Int. Cl.
| | |
|---|---|
| *A01N 63/00* | (2020.01) |
| *A01H 17/00* | (2006.01) |
| *A01C 1/06* | (2006.01) |
| *A01N 63/30* | (2020.01) |
| *A01G 7/00* | (2006.01) |
| *A01G 22/40* | (2018.01) |
| *A01G 22/20* | (2018.01) |

(52) U.S. Cl.
CPC .............. *A01H 17/00* (2013.01); *A01C 1/06* (2013.01); *A01G 7/00* (2013.01); *A01N 63/00* (2013.01); *A01N 63/30* (2020.01); *A01G 22/20* (2018.02); *A01G 22/40* (2018.02)

(58) Field of Classification Search
None
See application file for complete search history.

(56) References Cited

U.S. PATENT DOCUMENTS

| | | |
|---|---|---|
| 2,200,532 A | 5/1940 | Sherman |
| 4,940,834 A | 7/1990 | Hurley et al. |
| 5,041,290 A | 8/1991 | Gindrat et al. |
| 5,113,619 A | 5/1992 | Leps et al. |
| 5,229,291 A | 7/1993 | Nielsen et al. |
| 5,292,507 A | 3/1994 | Charley |
| 5,415,672 A | 5/1995 | Fahey et al. |
| 5,730,973 A | 3/1998 | Morales et al. |
| 5,919,447 A | 7/1999 | Marrone et al. |
| 5,994,117 A | 11/1999 | Bacon et al. |
| 6,072,107 A | 6/2000 | Latch et al. |
| 6,077,505 A | 6/2000 | Parke et al. |
| 6,337,431 B1 | 1/2002 | Tricoli et al. |
| 6,495,133 B1 | 12/2002 | Xue |
| 6,602,500 B1 | 8/2003 | Kharbanda et al. |
| 6,681,186 B1 | 1/2004 | Denisov et al. |
| 6,689,880 B2 | 2/2004 | Chen et al. |
| 6,823,623 B2 | 11/2004 | Minato et al. |
| 7,037,879 B2 | 5/2006 | Imada et al. |
| 7,084,331 B2 | 8/2006 | Isawa et al. |
| 7,335,816 B2 | 2/2008 | Kraus et al. |
| 7,341,868 B2 | 3/2008 | Chopade et al. |

(Continued)

FOREIGN PATENT DOCUMENTS

| | | |
|---|---|---|
| CA | 1041788 | 11/1978 |
| CA | 1229497 | 11/1987 |

(Continued)

OTHER PUBLICATIONS

Li et al. Antitumour and antimicrobial activities of endophytic streptomycetes from pharmaceutical plants in rainforest. Lett Appl Microbiol. Dec. 2008;47(6):574-80. (Year: 2008).*
Ikeda et al. Complete genome sequence and comparative analysis of the industrial microorganism Streptomyces avermitilis. Nat Biotechnol. May 2003;21(5):526-31. Epub Apr. 14, 2003. (Year: 2003).*
Bently et al. Complete genome sequence of the model actinomycete Streptomyces coelicolor A3(2). Nature. May 9, 2002;417(6885):141-7. (Year: 2002).*
Lee et al. *Streptomyces koyangensis* sp. nov., a novel actinomycete that produces 4-phenyl-3-butenoic acid. Int J Syst Evol Microbiol. Jan. 2005;55(Pt 1):257-62. (Year: 2005).*

(Continued)

*Primary Examiner* — Cynthia E Collins
(74) *Attorney, Agent, or Firm* — Goodwin Procter LLP

(57) ABSTRACT

This invention relates to methods and compositions for providing a benefit to a plant by associating the plant with a beneficial endophyte of the genus *Streptomyces*, including benefits to a plant derived from a seed or other plant element treated with said endophyte. For example, this invention provides purified endophytes, synthetic combinations comprising endophytes, and methods of making and using the same. In particular, this invention relates to compositions and methods of improving soybean and maize plants.

10 Claims, 7 Drawing Sheets

Specification includes a Sequence Listing.

(56) References Cited

U.S. PATENT DOCUMENTS

| | | |
|---|---|---|
| 7,485,451 B2 | 2/2009 | VanderGheynst et al. |
| 7,555,990 B2 | 7/2009 | Beaujot |
| 7,632,985 B2 | 12/2009 | Malven et al. |
| 7,763,420 B2 | 7/2010 | Stritzker et al. |
| 7,906,313 B2 | 3/2011 | Henson et al. |
| 7,977,550 B2 | 7/2011 | West et al. |
| 8,143,045 B2 | 3/2012 | Miansnikov et al. |
| 8,455,198 B2 | 6/2013 | Gao et al. |
| 8,455,395 B2 | 6/2013 | Miller et al. |
| 8,465,963 B2 | 6/2013 | Rolston et al. |
| 8,728,459 B2 | 5/2014 | Isawa et al. |
| 8,975,489 B2 | 3/2015 | Craven |
| 9,049,814 B2 * | 6/2015 | Marx ..................... A01C 1/06 |
| 9,113,636 B2 | 8/2015 | von Maltzahn et al. |
| 9,277,751 B2 | 3/2016 | Sword |
| 9,288,995 B2 | 3/2016 | von Maltzahn et al. |
| 9,295,263 B2 | 3/2016 | von Maltzahn et al. |
| 9,364,005 B2 | 6/2016 | Mitter et al. |
| 9,408,394 B2 | 8/2016 | von Maltzahn et al. |
| 9,532,572 B2 | 1/2017 | von Maltzahn et al. |
| 9,532,573 B2 | 1/2017 | von Maltzahn et al. |
| 9,545,111 B2 | 1/2017 | Sword |
| 9,622,485 B2 | 4/2017 | von Maltzahn et al. |
| 9,652,840 B1 | 5/2017 | Shriver et al. |
| 9,687,001 B2 | 6/2017 | Vujanovic et al. |
| 9,756,865 B2 | 9/2017 | Sword |
| 10,058,101 B2 | 8/2018 | von Maltzahn et al. |
| 10,076,120 B2 | 9/2018 | von Maltzahn et al. |
| 10,104,862 B2 * | 10/2018 | Vujanovic ............ A01N 63/00 |
| 2005/0072047 A1 | 4/2005 | Conkling et al. |
| 2006/0046246 A1 | 3/2006 | Zeng et al. |
| 2007/0028318 A1 | 2/2007 | Livore et al. |
| 2007/0055456 A1 | 3/2007 | Raftery et al. |
| 2007/0142226 A1 | 6/2007 | Franco |
| 2007/0292953 A1 | 12/2007 | Mankin et al. |
| 2008/0229441 A1 | 9/2008 | Young et al. |
| 2008/0289060 A1 | 11/2008 | De Beuckeleer et al. |
| 2009/0155214 A1 | 6/2009 | Isawa et al. |
| 2010/0064392 A1 | 3/2010 | Yang et al. |
| 2010/0095396 A1 | 4/2010 | Voeste et al. |
| 2010/0205690 A1 | 8/2010 | Biasing et al. |
| 2010/0227357 A1 | 9/2010 | Redman et al. |
| 2011/0182862 A1 | 7/2011 | Green et al. |
| 2012/0108431 A1 | 5/2012 | Williams et al. |
| 2012/0131696 A1 | 5/2012 | Aayal et al. |
| 2012/0144533 A1 | 6/2012 | Craven |
| 2012/0149571 A1 | 6/2012 | Kloepper et al. |
| 2012/0178624 A1 | 7/2012 | Kaminskyj et al. |
| 2012/0324599 A1 | 12/2012 | Kerns et al. |
| 2013/0031673 A1 | 1/2013 | Grandlic et al. |
| 2013/0071425 A1 | 3/2013 | Vidal et al. |
| 2013/0079225 A1 | 3/2013 | Smith et al. |
| 2013/0150240 A1 | 6/2013 | Newman et al. |
| 2013/0233501 A1 | 9/2013 | Van Zyl et al. |
| 2014/0020136 A1 | 1/2014 | Van Der Wolf et al. |
| 2014/0109249 A1 | 4/2014 | Turner et al. |
| 2014/0115731 A1 | 4/2014 | Turner et al. |
| 2014/0147425 A1 | 5/2014 | Henn et al. |
| 2014/0342905 A1 | 11/2014 | Bullis et al. |
| 2015/0020239 A1 | 1/2015 | von Maltzahn et al. |
| 2015/0033420 A1 | 1/2015 | Rodriguez et al. |
| 2015/0126365 A1 | 5/2015 | Sword |
| 2015/0230478 A1 | 8/2015 | Vujanovic et al. |
| 2015/0242970 A1 | 8/2015 | Avey et al. |
| 2015/0335029 A1 | 11/2015 | Mitter et al. |
| 2015/0366217 A1 | 12/2015 | Vujanovic et al. |
| 2015/0368607 A1 | 12/2015 | Arnold et al. |
| 2015/0370935 A1 | 12/2015 | Starr |
| 2015/0373993 A1 | 12/2015 | von Maltzahn et al. |
| 2016/0021891 A1 | 1/2016 | von Maltzahn et al. |
| 2016/0150796 A1 | 6/2016 | von Maltzahn et al. |
| 2016/0174570 A1 | 6/2016 | Vujanovic et al. |
| 2016/0192662 A1 | 7/2016 | Sword |
| 2016/0205947 A1 | 7/2016 | Sword |
| 2016/0235074 A1 | 8/2016 | von Maltzahn et al. |
| 2016/0255844 A1 | 9/2016 | Mitter et al. |
| 2016/0260021 A1 | 9/2016 | Marek |
| 2016/0286821 A1 | 10/2016 | Sword |
| 2016/0290918 A1 | 10/2016 | Xu et al. |
| 2016/0316760 A1 | 11/2016 | Ambrose et al. |
| 2016/0316763 A1 | 11/2016 | Sword |
| 2016/0330976 A1 | 11/2016 | Mitter et al. |
| 2016/0338360 A1 | 11/2016 | Mitter et al. |
| 2016/0366892 A1 | 12/2016 | Ambrose et al. |
| 2017/0020138 A1 | 1/2017 | von Maltzahn et al. |
| 2017/0164619 A1 | 6/2017 | von Maltzahn et al. |
| 2017/0164620 A1 | 6/2017 | von Maltzahn et al. |
| 2017/0215358 A1 | 8/2017 | Franco et al. |
| 2017/0223967 A1 | 8/2017 | Mitter et al. |
| 2018/0020677 A1 | 1/2018 | Ambrose et al. |
| 2018/0092365 A1 | 4/2018 | Sword |
| 2018/0153174 A1 | 6/2018 | Riley et al. |
| 2018/0177196 A1 | 6/2018 | Sword |
| 2018/0213800 A1 | 8/2018 | Djonovic et al. |
| 2018/0249716 A1 | 9/2018 | Riley |
| 2018/0251776 A1 | 9/2018 | Riley |

FOREIGN PATENT DOCUMENTS

| | | |
|---|---|---|
| CA | 2562175 | 1/2013 |
| CN | 1604732 | 4/2005 |
| CN | 101311262 A | 11/2008 |
| CN | 101423810 A | 5/2009 |
| CN | 101570738 | 11/2009 |
| CN | 101693881 A | 4/2010 |
| CN | 102168022 A | 8/2011 |
| CN | 102352327 A | 2/2012 |
| CN | 102010835 B | 4/2012 |
| CN | 102533601 B | 10/2013 |
| CN | 103642725 A | 3/2014 |
| CN | 104560742 A | 1/2015 |
| CN | 104388356 A | 3/2015 |
| EP | 0192342 | 8/1986 |
| EP | 0223662 | 5/1987 |
| EP | 0378000 | 7/1990 |
| EP | 0494802 | 7/1992 |
| EP | 0818135 | 1/1998 |
| EP | 1621632 | 2/2006 |
| EP | 1935245 | 6/2008 |
| EP | 2676536 | 12/2013 |
| JP | 2009/072168 | 4/2009 |
| KR | 20100114806 A | 10/2010 |
| KR | 101091151 | 12/2011 |
| KR | 20130023491 | 3/2013 |
| WO | WO 1988/009114 | 1/1988 |
| WO | WO 1994/016076 | 7/1994 |
| WO | WO 2000/029607 | 5/2000 |
| WO | WO 2001/083697 | 11/2001 |
| WO | WO 2001/083818 | 11/2001 |
| WO | WO 2002/065836 | 8/2002 |
| WO | WO 2004/046357 | 6/2004 |
| WO | WO 2005/003328 | 1/2005 |
| WO | WO 2007/021200 | 2/2007 |
| WO | WO 2007/107000 | 9/2007 |
| WO | WO 2008/103422 | 8/2008 |
| WO | WO 2009/012480 A2 | 1/2009 |
| WO | WO 2009/078710 A1 | 6/2009 |
| WO | WO 2009/126473 A1 | 10/2009 |
| WO | WO 2010/109436 | 9/2010 |
| WO | WO 2010/115156 | 10/2010 |
| WO | WO 2011/001127 | 1/2011 |
| WO | WO 2011/082455 | 7/2011 |
| WO | WO 2011/112781 | 9/2011 |
| WO | WO 2011/117351 | 9/2011 |
| WO | WO 2012/034996 | 3/2012 |
| WO | WO 2013/016361 | 1/2013 |
| WO | WO 2013/029112 | 3/2013 |
| WO | WO 2013/090628 | 6/2013 |
| WO | WO 2013/122473 | 8/2013 |
| WO | WO 2013/177615 | 12/2013 |
| WO | WO 2013/190082 | 12/2013 |
| WO | WO 2014/046553 | 3/2014 |
| WO | WO 2014/082950 | 6/2014 |
| WO | WO 2014/121366 | 8/2014 |

(56) References Cited

FOREIGN PATENT DOCUMENTS

| | | |
|---|---|---|
| WO | WO 2014/206953 | 12/2014 |
| WO | WO 2014/210372 | 12/2014 |
| WO | WO 2015/035099 | 3/2015 |
| WO | WO 2015/069938 | 5/2015 |
| WO | WO 2015/100431 | 7/2015 |
| WO | WO 2015/100432 | 7/2015 |
| WO | WO 2015/192172 | 12/2015 |
| WO | WO 2015/200852 | 12/2015 |
| WO | WO 2015/200902 | 12/2015 |
| WO | WO 2016/090212 | 6/2016 |
| WO | WO 2016/109758 | 7/2016 |
| WO | WO 2016/179046 | 11/2016 |
| WO | WO 2016/179047 | 11/2016 |
| WO | WO 2016/200987 | 12/2016 |
| WO | WO 2016/057991 | 3/2019 |

OTHER PUBLICATIONS

PCT International Search Report and Written Opinion for PCT/AU2018/050387, dated Apr. 27, 2018, 8 pages.
PCT International Search Report and Written Opinion for PCT/US2018/051467, dated Feb. 4, 2019, 22 pages.
Abello, J., et al., "Agrobacterium-mediated transformation of the endophytic fungus *Acremonium implicatum* associated with Brachiaria grasses", Mycological Research, pp. 407-413, vol. 112, Pt 3.
Al-Askar AA, "Microbiological studies on the in vitro inhibitory effect of Streptomyces collinus albescens against some phytopathogenic fungi", African Journal of Microbiology Research, 2012, 6: 3277-3283 & GenBank Accession No. AB184101, May 20, 2008.
Ardakani, M.R. et al., "Absorption of N, P, K through triple inoculation of wheat (*Triticum aestivum* L.) by Azospirillum brasilense, *Streptomyces* sp., Glomus intraradices and manure application," Physiol Mol Biol Plants, 2011, vol. 17, No. 2, pp. 181-192.
Bandara, W.M.M.S., et al., "Interactions among endophytic bacteria and fungi: effects and potentials", Journal of Biosciences, Dec. 2006, vol. 31, No. 5, pp. 645-650.
Barnett, S., et al., "Selection of microbes for control of Rhizoctonia root rot on wheat using a high throughput pathosystem", Biological Control, Jul. 6, 2017, 113: 45-57.
Bashan, Yoav Ed, et al., "Inoculants of plant growth-promoting bacteria for use in agriculture," Biotechnology Advances, Elsevier Publishing, Barking, GB, vol. 16, No. 4, Jul. 1, 1998, pp. 729-770, XP004123985.
Bashan, Yoav E., et al., "Alginate Beads as Synthetic Inoculant Carriers for Slow Release of Bacteria that Affect Plant Growth," Applied and Environmental Microbiology, pp. 1089-1098, May 1986.
Bragantia, et al: "Identificaqao e Avaliaqao de Rizobacterias Isoladas de Raizes de Milho," Jan. 1, 2010, pp. 905-911, Retrieved from the Internet: URL:http://www.scielo.br/pdf/brag/v69n4/v69n4a17.pdf (With English Abstract).
Chenhua Li, et al., "Change in deep soil microbial communities due to long-term fertilization," Soil Biology and Biochemistry, vol. 75, Mar. 5, 2014, pp. 264-272, XP055530941.
Cheow, W.S., et al., "Biofilm-like Lactobacillus rhamnosus Probiotices Encapsulated in Algiinate and Carrageenan Microcapsules Exhibiting Enhanced Thermotolerance and Freeze-drying Resistance," Biomacromolecules 2013, vol. 14(9):3214-3222.
De Medeiros, L., et al., "Evaluation of Herbicidal Potential of Depsides from Cladosporium uredinicola an Endophytic Fungus found in Guava Fruit," J. Braz. Chem. Soc., 2012, vol. 23, No. 8, p. 1551-1557.
De Santi, M. et al., "A combined morphologic and molecular approach for characterizing fungal microflora from a traditional Italian cheese (Fossa cheese)," Inter. Dairy J., 2010, vol. 10, No. 7, pp. 465-471.
Fatima Z et al, "Antifungal activity of plant growth-promoting rhizobacteria isolates against Rhizoctonia solani in wheat", African Journal of Biotechnology, 2009, 8: 219-225.

GenBank Accession No. KY643705, Feb. 27, 2017.
GenBank Accession No. KF951483, Jan. 5, 2014.
GenBank Accession No. KJ152029, May 6, 2015.
GenBank Accession No. KJ162248, Apr. 8, 2014.
NCBI, GenBank Accession No. XP_002568042, Aug. 14, 2009, 4 Pages, Berg, V.D., et al., "Genome sequencing and analysis of the filamentous fungus," Nat. Biotechnol. 26 (10), 1161-1168 (2008).
Goudjal, Y., et al., "Biocontrol of Rhizoctonia solanidamping-off and promotion of tomato plant growth by endophytic actinomycetes isolated from native plants of Algerian Sahara", Microbiological Research, 2014, vol. 169, No. 1, pp. 59-65.
Guo, X., et al., "Red Soils Harbor Diverse Culturable Actinomycetes That Are Promising Sources of Novel Secondary Metabolites", Applied and Environmental Microbiology, Feb. 27, 2015, vol. 81, No. 9, pp. 3086-3103.
Hain, T., et al., "Chitinolytic transgenes from Streptomyces albidoflavus as phytochemicals defences against herbivorous insects, use in transgenic plants and effect in plant development", International Journal of Systematic Bacteriology, Jan. 1997, vol. 47, No. 1, pp. 202-206.
Hanshew, A., et al., "Characterization of Actinobacteria Associated with Three Ant-Plant Mutualisms", Microbial Ecology, Aug. 6, 2017, vol. 69, No. 1, pp. 192-203.
Hjort, K., et al., "Chitinase genes revealed and compared in bacterial isolates, DNA extracts and a metagenomic library from a phytopathogen-suppressive soil", FEMS Microbiology Ecology, Feb. 2010, vol. 71, No. 2, pp. 197-207.
Iverson, C., et al, "The taxonomy of Enterobacter sakazakii: proposal of a new genus *Cronobacter* gen. nov. and descriptions of Cronobacter sakazakii comb. nov. *Cronobacter sakazakii* subsp. *sakazakii*, comb. nov., *Cronobacter sakazakii* subsp. *malonaticus* subsp. nov., *Cronobacter turicensis* sp. nov., *Cronobacter muytjensii* sp. nov., *Cronobacter dublinensis* sp. nov. and *Cronobacter* genomospecies I", BMC Evolutionary Biology 2007, Apr. 17, 2017, 11 pages.
Joe, M.M. et al., "Development of alginate-based aggregate inoculants of *Methylobacterium* sp. and Azospirillum brasilense tested under in vitro conditions to promote plant growth," Journal of Applied Microbiology 2013, 116(2):408-423, XP055225426, Nov. 22, 2013.
Li, M., et al., "ATP Modulates the Growth of Specific Microbial Strains", Current Microbiology, May 30, 2010, vol. 62, No. 1, pp. 84-89.
Manoharan, M. J. et. Al., "Survival of flocculated cells in alginate and its inoculatin effect on growth and yield of maize under water deficit conditions," EP J of Siil Biology, Gauthier-Villars, Montrouge, FR, vol. 50, Mar. 7, 2012, pp. 198-206, XP028421147.
Murali, Gopal, et al., "Microbiome Selection Could Spur Next-Generation Plant Breeding Strategies," Frontiers in Microbiology, vol. 7, Dec. 7, 2016, XP055531064.
United States Patent Office, Non-Final Office Action, U.S. Appl. No. 14/766,065, dated Oct. 27, 2017, 11 Pages.
United States Patent Office, Non-Final Office Action, U.S. Appl. No. 14/964,429, dated Aug. 9, 2016, 6 Pages.
United States Patent Office, Final Office Action, U.S. Appl. No. 14/964,429, dated May 31, 2017, 9 Pages.
United States Patent Office, Non-Final Office Action, U.S. Appl. No. 15/212,038, dated Sep. 21, 2016, 10 Pages.
United States Patent Office, Non-Final Office Action, U.S. Appl. No. 15/063,350, Nov. 10, 2016, 18 Pages.
United States Patent Office, Final Office Action, U.S. Appl. No. 14/614,193, Dec. 22, 2016, 13 Pages.
United States Patent Office, Final Office Action, U.S. Appl. No. 14/614,193, dated Jul. 18, 2017, 14 Pages.
United States Patent Office, Final Office Action, U.S. Appl. No. 14/614,193, dated May 3, 2018, 10 Pages.
United States Patent Office, Non-Final Office Action, U.S. Appl. No. 15/107,973, dated Apr. 10, 2017, 39 Pages.
United States Patent Office, Final Office Action, U.S. Appl. No. 15/107,973, dated Jan. 26, 2018, 20 Pages.
United States Patent Office, Final Office Action, U.S. Appl. No. 14/410,537, dated May 5, 2017, 9 Pages.
United States Patent Office, Non-Final Office Action, U.S. Appl. No. 15/034,862, dated May 19, 2017, 8 Pages.

(56) References Cited

OTHER PUBLICATIONS

United States Patent Office, Final Office Action, U.S. Appl. No. 15/034,862, dated Jan. 12, 2018, 14 Pages.
United States Patent Office, Non-Final Office Action, U.S. Appl. No. 15/436,592, dated Aug. 30, 2017, 17 Pages.
United States Patent Office, Non-Final Office Action, U.S. Appl. No. 15/436,609, dated Aug. 30, 2017, 21 Pages.
United States Patent Office, Non-Final Office Action, U.S. Appl. No. 14/916,514, dated Sep. 20, 2017, 31 Pages.
United States Patent Office, Non-Final Office Action, U.S. Appl. No. 15/143,398, dated Sep. 22, 2017, 17 Pages.
United States Patent Office, Non-Final Office Action, U.S. Appl. No. 15/143,394, dated Sep. 25, 2017, 15 Pages.
United States Patent Office, Non-Final Office Action, U.S. Appl. No. 15/107,965, dated Jun. 21, 2018, 27 Pages.
Ogbo, F., et al., "Some Characteristics of a Plant Growth Promoting iEnterobacter/isp. Isolated from the Roots of Maize", Advances in Microbiology, Jan. 1, 2012, vol. 02, No. 03, pp. 368-374.
Orakçi GE et al, "Selection of antagonistic actinomycete isolates as biocontrol agents against root-rot fungi", Fresenius Environmental Bulletin, 2010, 19: 417-424 & GenBank Accession No. GQ475299, Oct. 5, 2009.
Partida-Martinez, L.P., et al., "Endosymbiont-Dependent Host Reproduction Maintains Bacterial-Fungal Mutualism", Current Biology, May 1, 2007, vol. 17, No. 9, pp. 773-777.
"Sequence Alignment of JQ047949 with Instant SEQ ID No. 2," Search conducted on Jan. 2, 2019. 2 pages.
Sharma et al., "Detection and identification of bacteria intimately associated with fungi of the order Sebacinales", Cellular Microbiology, Aug. 5, 2008, pp. 2235-2246, vol. 10, No. 11.
Wang, L. et al. Application of Bioorganic Fertilizer Significantly Increased Apple Yields and Shaped Bacterial Community Structure in Orchard Soil.
Whelehan, et al., "Microencapsulation using vibrating technology," Journal of Microencapsulation 2011, vol. 28(8), pp. 669-688.
Yashiro et al., "Effect of Streptomycin Treatment on Bacterial Community Structure in the Apple Phyllosphere," PLOS ONE, May 21, 2012, vol. 7, No. 5, 10 pages.
Zhao, Jun, et al., "Effects of organic-inorganic compound fertilizer with reduced chemical fertilizer application on crop yields, soil biological activity and bacterial community structure in a rice-wheat cropping system," Applied Soil Ecology, vol. 99, Nov. 28, 2015, pp. 1-12, XP055530937.
PCT Invitation to Pay Additional Fees, PCT Application No. PCT/CA2013/000091, dated Mar. 27, 2013, 2 Pages.
PCT International Search Report and Written Opinion for PCT/CA2013/000091, dated Sep. 20, 2013, 17 Pages.
PCT International Search Report and Written Opinion for PCT/EP2013/062976, dated Dec. 22, 2014, 9 Pages.
PCT International Search Report, Application No. PCT/US2014/044427, dated Dec. 3, 2014, 9 Pages.
PCT International Search Report and Written Opinion, Application No. PCT/US2014/054160, dated Dec. 9, 2014, 21 Pages.
PCT Invitation to Pay Additional Fees, PCT Application No. PCT/US2014/064411, dated Feb. 5, 2015, 2 Pages.
PCT International Search Report and Written Opinion, International Application No. PCT/US2014/064411, dated Mar. 27, 2015, 15 Pages.
PCT Invitation to Pay Additional Fees, PCT Application No. PCT/US2014/072399, dated Apr. 14, 2015, 2 Pages.
PCT International Search Report and Written Opinion, International Application No. PCT/US2014/072399, dated Jun. 26, 2015, 22 Pages.
PCT Invitation to Pay Additional Fees, PCT Application No. PCT/US2014/072400, dated Apr. 16, 2015, 6 Pages.
PCT International Search Report and Written Opinion, Application No. PCT/US2014/072400, dated Jul. 8, 2015, 38 Pages.
PCT International Search Report and Written Opinion, Application No. PCT/AU2014/000360, dated Aug. 5, 2015, 12 Pages.
PCT Invitation to Pay Additional Fees, PCT Application No. PCT/US2015/038110, dated Sep. 22, 2015, 8 Pages.
PCT Invitation to Pay Additional Fees, PCT Application No. PCT/US2015/038187, dated Oct. 14, 2015, 5 Pages.
PCT International Search Report and Written Opinion, PCT Application No. PCT/US2015/038110, dated Dec. 11, 2015, 36 Pages.
PCT International Search Report and Written Opinion, PCT Application No. PCT/US2015/038187, dated Jan. 22, 2016, 36 Pages.
PCT Invitation to Pay Additional Fees, PCT Application No. PCT/US2015/068206, dated Apr. 12, 2016, 5 Pages.
PCT International Search Report and Written Opinion, PCT Application No. PCT/US2015/068206, dated Jun. 27, 2016, 20 Pages.
PCT International Search Report and Written Opinion, PCT Application No. PCT/US2016/030292, dated Aug. 12, 2016, 20 Pages.
PCT International Preliminary Report on Patentability, PCT Application No. PCT/US2016/030292, dated Aug. 2, 2017, 23 Pages.
PCT International Search Report and Written Opinion, PCT Application No. PCT/US2016/030293, dated Aug. 11, 2016, 23 Pages.
PCT International Search Report and Written Opinion, PCT Application No. PCT/US2016/036504, dated Nov. 4, 2016, 18 Pages.
PCT International Search Report and Written Opinion, PCT Application No. PCT/US2016/039191, dated Nov. 29, 2016, 20 Pages.
PCT International Search Report and Written Opinion, PCT Application No. PCT/US2016/068144, dated May 18, 2017, 30 Pages.
PCT Invitation to Pay Additional Fees, PCT Application No. PCT/US2017/064351, dated Feb. 9, 2018, 18 Pages.
PCT International Search Report and Written Opinion, PCT Application No. PCT/US2017/064351, dated Apr. 9, 2018, 25 Pages.
PCT Invitation to Pay Additional Fees, PCT Application No. PCT/US2017/064361, dated Mar. 7, 2018, 18 Pages.
PCT International Search Report and Written Opinion for PCT/US2017/064361, dated May 11, 2018, 22 Pages.
PCT Invitation to Pay Additional Fees, PCT Application No. PCT/US2017/064292, dated Mar. 5, 2018, 15 Pages.
PCT International Search Report and Written Opinion, PCT Application No. PCT/US2017/064292, dated May 11, 2018, 20 Pages.
PCT International Search Report and Written Opinion, PCT Application No. PCT/USS2017/068255, dated Mar. 19, 2018, 14 Pages.
Canadian Patent Office, Office Action, Canadian Patent Application No. CA 2,953,466, dated Dec. 11, 2017, 7 Pages.
Canadian Patent Office, Office Action, Canadian Patent Application No. 2,916,678, dated Feb. 8, 2017, 8 Pages.
Canadian Patent Office, Office Action, Canadian Patent Application No. 2,935,218, dated Jun. 13, 2017, 5 Pages.
Canadian Patent Office, Office Action, Canadian Patent Application No. 2,935,218, dated May 8, 2018, 5 Pages.
Canadian Patent Office, Office Action, Canadian Patent Application No. CA 2,953,697, dated Oct. 12, 2017, 6 Pages.
Canadian Patent Office, Office Action, Canadian Patent Application No. CA 2,952,057, dated Oct. 12, 2017, 4 Pages.
Canadian Patent Office, Office Action, Canadian Patent Application No. CA 2,929,487, dated Dec. 7, 2017, 4 Pages.
Chinese Patent Office, Office Action, Chinese Patent Application No. 201480072142.7, dated Apr. 25, 2017, 14 Pages (with English translation).
Chinese Patent Office, 2nd Office Action for Chinese Patent Application No. CN 201480072142.7, dated Oct. 30, 2017, 13 Pages, (with English translation).
European Patent Office, Supplementary Partial European Search Report, European Patent Application No. 13874703.5, dated Jun. 21, 2016, 3 Pages.
European Patent Office, Supplementary European Search Report, European Patent Application No. 13874703.5, dated Oct. 21, 2016, 16 Pages.
European Patent Office, Communication Pursuant to Article 94(3) EPC for European Patent Application No. 13874703.5, dated Jan. 5, 2018, 4 Pages.
European Patent Office, Supplementary European Search Report, European Patent Application No. 14860187.5, dated May 24, 2017, 9 Pages.
European Patent Office, Supplementary European Search Report, European Patent Application No. 14874589.6, dated Jul. 11, 2017, 9 Pages.

(56) References Cited

OTHER PUBLICATIONS

European Patent Office, Communication Pursuant to Article 94(3) EPC for European Patent Application No. EP 14748326.7, dated Feb. 15, 2018, 7 Pages.
European Patent Office, Examination Report, European Patent Application No. 14748326.7, dated Jul. 19, 2017, 4 Pages.
European Patent Office, Examination Report for European Patent Application No. EP 14777213.1, dated Oct. 20, 2017, 12 Pages.
European Patent Office, Supplementary European Search Report, European Patent Application No. EP 15809264.3, dated Dec. 4, 2017, 16 Pages.
European Patent Office, Communication Pursuant to Article 94(3) EPC for European Patent Application No. 15810847.2, dated Nov. 17, 2017, 17 Pages.
European Patent Office, Supplementary European Search Report for European Patent Application No. 15810847.2, dated Feb. 28, 2018, 19 Pages.
European Patent Office, Supplementary European Search Report, European Patent Application No. EP 15812324.0, dated Nov. 2, 2017, 19 Pages.
European Patent Office, Extended European Search Report, European Patent Application No. EP 15812324.0, dated Feb. 21, 2018, 23 Pages.
European Patent Office, Extended European Search Report, European Patent Application No. EP 15809264.3, dated Mar. 12, 2018, 14 Pages.
European Patent Office, Extended European Search Report, European Patent Application No. EP 15876324.3, dated Jun. 12, 2018, 9 Pages.
Intellectual Property Australia, Examination Report for Australian Patent Application No. 2016202480, dated Apr. 28, 2016, 2 Pages.
Intellectual Property Australia, Examination Report for Australian Patent Application No. 2014346664, dated Nov. 24, 2016, 3 Pages.
Intellectual Property Australia, Examination Report for Australian Patent Application No. 2014315191, dated Jul. 15, 2017, 6 Pages.
Intellectual Property Australia, Examination Report for Australian Patent Application No. 2015279600, dated Jul. 21, 2017, 7 Pages.
Intellectual Property Australia, Examination Report for Australian Patent Application No. 2015278238, dated Jul. 24, 2017, 3 Pages.
Intellectual Property Australia, Examination Report No. 1 for Australian Patent Application No. AU 2017254880, dated Nov. 15, 2017, 2 Pages.
Intellectual Property Australia, Examination Report No. 1 for Australian Patent Application No. AU 2017201009, dated Apr. 4, 2018, 3 Pages.
Intellectual Property Australia, Examination Report No. 1 for Australian Patent Application No. AU 2017210482, dated May 15, 2018, 4 Pages.
New Zealand Intellectual Property Office, First Examination Report, New Zealand Patent Application No. 715728, dated May 10, 2016, 4 Pages.
New Zealand Intellectual Property Office, First Examination Report, New Zealand Patent Application No. 715728, dated Dec. 5, 2016, 3 Pages.
New Zealand Intellectual Property Office, First Examination Report, New Zealand Patent Application No. 727449, dated Jun. 8, 2017, 7 Pages.
New Zealand Intellectual Property Office, First Examination Report, New Zealand Patent Application No. 726116, dated Jun. 29, 2017, 2 Pages.
New Zealand Intellectual Property Office, First Examination Report, New Zealand Patent Application No. 726116, dated Sep. 26, 2017, 5 Pages.
New Zealand Intellectual Property Office, Further Examination Report, New Zealand Patent Application No. 726116, dated Feb. 27, 2018, 6 Pages.
New Zealand Intellectual Property Office, First Examination Report, New Zealand Patent Application No. 728495, dated Jul. 12, 2017, 5 Pages.
New Zealand Intellectual Property Office, First Examination Report for New Zealand Patent Application No. NZ 728483, dated Dec. 8, 2017, 2 Pages.
Russian Patent Office, Office Action for Russian Patent Application No. RU 2017127214, dated Nov. 22, 2017, 4 Pages, (with English translation).
Russian Patent Office, Office Action for Russian Patent Application No. RU 2015137613, dated Jun. 7, 2017, 14 Pages (with English translation).
Russian Patent Office, Office Action for Russian Patent Application No. RU 2017141758, dated Apr. 17, 2018, 4 Pages (with Concise Explanation of Relevance).
Russian Patent Office, Office Action for Russian Patent Application No. RU 2017141632, dated Apr. 17, 2018, 4 Pages (with Concise Explanation of Relevance).
Ukraine Patent Office, Office Action for Ukrainian Patent Application No. a201508515, dated May 19, 2017, 14 Pages (with English translation).
Ukraine Patent Office, Office Action for Ukrainian Patent Application No. a201508515, dated Feb. 20, 2018, 9 Pages (with English translation).
Office Action for Israel Patent Application No. IL 255682, dated Mar. 15, 2018, 2 Pages (Translation).
Office Action for Israel Patent Application No. IL 255684, dated Mar. 19, 2018, 2 Pages (Translation).
Office Action for Israel Patent Application No. IL 255685, Mar. 20, 2018, 2 Pages (Translation).
Office Action for Israel Patent Application No. IL 255688, dated Mar. 22, 2018, 2 Pages (Translation).
Office Action for Israel Patent Application No. IL 245385, dated Apr. 23, 2018, 3 Pages (With Concise Explanation of Relevance).
Abarenkov, K., et al., "PlutoF—A Web Based Workbench for Ecological and Taxonomic Research, with an Online Implementation for Fungal ITS Sequences," Evol Bioinform Online, 2010, pp. 189-196, vol. 6.
Abarenkov, K., et al., "The Unite Database for Molecular Identification of Fungi—Recent Updates and Future Perspectives," New Phytol., 2010, pp. 281-285, vol. 186.
Abdellatif, L., et al., "Endophytic hyphal compartmentalization is required for successful symbiotic Ascomycota association with root cells," Mycological Research, 2009, pp. 782-791, vol. 113.
Abdellatif, L., et al., "Characterization of virulence and PCR-DGGE profiles of Fusarium avenaceum from western Canadian Prairie Ecozone of Saskatchewan,"Canadian Journal of Plant Pathology, 2010, pp. 468-480.
Abdou, R., et al., "Botryorhodines A-D, antifungal and cytotoxic depsidones from Botryosphaeria rhodina, an endophyte of the medicinal plant *Bidens pilosa*," Phytochemistry, 2010, vol. 71, pp. 110-116.
Abou-Shanab, R. A., et al: "Characterization of Ni-resistant bacteria in the rhizosphere of the hyperaccumulator Alyssum murale by 16S rRNA gene sequence analysis", World Journal of Microbiology and Biotechnology, vol. 26, No. 1, Aug. 15, 2009, pp. 101-108.
Adhikari, M., et al., "A New Record of Pseudeurotium bakeri from Crop Field Soil in Korea," The Korean Journal of Mycology, 2016, pp. 145-149, vol. 44.
Ahmad, F., et al., "Screening of Free-Living Rhizospheric Bacteria for Their Multiple Plant Growth Promoting Activities," Microbiol Res., 2008, pp. 173-181, vol. 163.
Alvarez-Perez, S., et al., "Zooming-in on floral nectar: a first exploration of nectar-associated bacteria in wild plant communities," FEMS Microbiol. Ecol., 2012, vol. 80, No. 3, pp. 591-602.
Amann, R., et al., "The Identification of Microorganisms by Fluorescence in Situ Hybridisation," Curr Opin Biotechnol., 2001, pp. 231-236, vol. 12.
Amatuzzi, R.F., et al., "Univers1dade Federal Do Parana," Jan. 1, 2014, 52 Pages. (With English Abstract).
Amatuzzi, R.F., et al., "Potential of endophytic fungi as biocontrol agents of Duponchelia fovealis (Zeller) (Lepidoptera:Crambidae)," Brazilian Journal of Biology, Nov. 9, 2017, 7 Pages.
Apel, K., et al., "Reactive Oxygen Species: Metabolism, Oxidative Stress, and Signal Transduction," Annu Rev Plant Biol., 2004, pp. 373-399, vol. 55.

(56) References Cited

OTHER PUBLICATIONS

Arendt, K. R., et al., "Isolation of endohyphal bacteria from foliar Ascomycota and in vitro establishment of their symbiotic associations," Appl. Environ. Microbiol., 2016, pp. 2943-2949, vol. 82, No. 10.

Ashrafuzzaman, M., et al., "Efficiency of plant growth-promoting rhizobacteria (PGPR) for the enhancement of rice growth," African Journal of Biotechnology, 2009, pp. 1247-1252, vol. 8, No. 7.

Aveskamp, M., et al., "DNA phylogeny reveals polyphyly of Phoma section Peyronellaea and multiple taxonomic novelties," Mycologia, 2009, vol. 101, No. 3, pp. 363-382.

Bacon, C. W., et al., "Isolation, in Planta Detection, and Uses of Endophytic Bacteria for Plant Protection," Manual of Environmental Microbiology, 2007, pp. 638-647.

Baker, K. F., et al., "Dynamics of Seed Transmission of Plant Pathogens," Annu Rev Phytopathol., 1966, pp. 311-334,vol. 4.

Baltruschat, H., et al., "Salt tolerance of barley induced by the root endophyte Piriformospora indica is associated with a strong increase in antioxidants," New Phytologist., 2008, pp. 501-510, vol. 180.

Bensch, K., et al., "Species and ecological diversity within the Cladosporium cladosporioides complex (Davidiellaceae, Capnodiales)," Studies in Mycology, 2010, pp. 1-94, vol. 67.

Bethlenfalvay, G., et al., "Mycorrhizal fungi effects on nutrient composition and yield of soybean seeds", Journal of Plant Nutrition, vol. 20, No. 4-5, Apr. 1, 1997, pp. 581-591.

Bing, LA, et al., "Suppression of Ostrinia nubilalis (Hubner) (Lepidoptera: Pyralidae) by endophytic Beauveria bassiana (Balsamo) Vuillemin", Environmental Entomol, Entomological Society of America, College Park, MD, US, vol. 20, Jan. 1, 1991, pp. 1207-1211.

Block, C. C., et al., "Seed Transmission of Pantoea stewartii in Field and Sweet Corn," Plant Disease, 1998, pp. 775-780, vol. 82.

Brinkmeyer, R., et al., "Uncultured Bacterium Clone ARKMP-100 16S Ribosomal RNA Gene, Partial Sequence," NCBI GenBank Accession No. AF468334, Submitted Jan. 14, 2002.

Brodie, E.L., et al., "Uncultured Bacterium Clone BANW722 16S Ribosomal RNA Gene, Partial Sequence," NCBI GenBank Accession No. DQ264636, Submitted Oct. 25, 2005.

Bulgarelli, D., et al., "Structure and Functions of the Bacterial Microbiota of Plants," Annu Rev Plant Biol., 2013, pp. 807-838, vol. 64.

Buttner, D., et al., "Regulation and secretion of Xanthomonas virulence factors," FEMS Microbiology Reviews, 2010, pp. 107-133, vol. 34, No. 2.

Caporaso, J.G., et al., "Ultra-High-Throughput Microbial Community Analysis on the Illumina HiSeq and MiSeq Platforms," ISME J., 2012, pp. 1621-1624, vol. 6.

Castillo, D., et al., "Fungal Entomopathogenic Endophytes: Negative Effects on Cotton Aphid Reproduction in Greenhouse and Field Conditions," Power Point Presentation dated Mar. 23, 2013.

Castillo, D., et al., "Fungal Endophytes: Plant Protective Agents Against Herbivores," Power Point Presentation dated Aug. 4, 2013.

Cavalier-Smith, T., "A Revised Six-Kingdom System of Life," Biol Rev Camb Philos Soc., 1998, pp. 203-266, vol. 73.

Cha, C., et al., "Production of Acyl-Homoserine Lactone Quorum-Sensing Signals by Gram-Negative Plant Associated Bacteria," Mol Plant Microbe Interact., 1998, pp. 1119-1129, vol. 11, No. 11.

Chagas, F., et al., "A Mixed Culture of Endophytic Fungi Increases Production of Antifungal Polyketides," J. Chem Ecol., Oct. 2013, pp. 1335-1342, vol. 39.

Chernin, L. S., et al., "Chitinolytic Activity in Chromobacterium violaceum: Substrate Analysis and Regulation by Quorum Sensing," J Bacteriol., 1998, pp. 4435-4441, vol. 180, No. 17.

Clark, E. M., et al., "Improved Histochemical Techniques for the Detection of Acremonium coenophilum in Tall Fescue and Methods of in vitro Culture of the Fungus," J. Microbiol Methods, 1983, pp. 149-155, vol. 1.

Clarridge, J., "Impact of 16S rRNA Gene Sequence Analysis for Identification of Bacteria on Clinical Microbiology and Infectious Diseases," Clinical Microbiology Reviews, Oct. 2004, pp. 840-862, vol. 17, No. 4.

Clay, K., "Effects of fungal endophytes on the seed and seedling biology of Lolium perenne and Festuca arundinacea," Oecologia, 1987, pp. 358-362, vol. 73.

Clough, S. J., et al., "Floral Dip: A Simplified Method for Agrobacterium-mediated Transformation of Arabidopsis thaliana," Plant J., 1998, pp. 735-743, vol. 16, No. 6.

Compant, S., et al., "Endophytes of Grapevines Flowers, Berries, and Seeds: Identification of Cultivable Bacteria, Comparison with Other Plant Parts, and Visualization of Niches of Colonization," Microbial Ecology, 2011, pp. 188-197, vol. 62.

Compant, S., et al., "Endophytic colonization of Vitis vinfera L. By Burkholderia phytofirmans strain PsJN: from the rhizosphere to inflorescence tissues," FEMS Microbiol Ecol, 2008, pp. 84-93, vol. 63.

Coombs, J. T., et al., "Isolation and Identification of Actinobacteria from Surface-Sterilized Wheat Roots," Applied and Environmental Microbiology, 2003, pp. 5603-5608, vol. 69, No. 9.

Conn, V. M., "Effect of Microbial Inoculants on the Indigenous Actinobacterial Endophyte Population in the Roots of Wheats as Determined by Terminal Restriction Fragment Length Polymorphism," Applied and Environmental Microbiology, 2004, pp. 6407-6413, vol. 70, No. 11.

Cottyn, B., et al., "Phenotypic and genetic diversity of rice seed-associated bacteria and their role in pathogenicity and biological control," Journal of Applied Microbiology, 2009, pp. 885-897, vol. 107.

Cox, C. D., "Deferration of Laboratory Media and Assays for Ferric and Ferrous Ions," Methods Enzymol., 1994, pp. 315-329, vol. 235.

Craine, J. M., et al., "Global Diversity of Drought Tolerance and Grassland Climate-Change Resilience," Nature Climate Change, 2013, pp. 63-67, vol. 3.

Dalal, J.M., et al., "Utilization of Endophytic Microbes for Induction of Systemic Resistance (ISR) in Soybean (Glycine max (L) Merril) Against Challenge Inoculation with R. solani," Journal of Applied Science and Research, 2014, pp. 70-84, vol. 2, No. 5.

Danhorn, T., et al., "Biofilm Formation by Plant-Associated Bacteria," Annu Rev Microbiol., 2007, pp. 401-422, vol. 61.

Daniels, R., et al., "Quorum Signal Molecules as Biosurfactants Affecting Swarming in Rhizobium etli," PNAS, 2006, pp. 14965-14970, vol. 103, No. 40.

Darsonval, A., et al., "Adhesion and Fitness in the Bean Phyllosphere and Transmission to Seed of Xanthomonas fuscans subsp. fuscans," Molecular Plant-Microbe Interactions, 2009, pp. 747-757, vol. 22, No. 6.

Darsonval, A., et al., "The Type III Secretion System of Xanthomonas fuscans subsp. fuscans is involved in the Phyllosphere Colonization Process and in Transmission to Seeds of Susceptible Beans," Applied and Envioronmental Mirobiology, 2008, pp. 2669-2678, vol. 74, No. 9.

Dbget, "Orthology: K14454," 2005, 2 pages, can be retrieved at <URL:http://www.genome.jp/dbget-bin/www_bget?ko:K14454>.

De Freitas, J. R., et al., "Phosphate-Solubilizing Rhizobacteria Enhance the Growth and Yield but not Phosphorus Uptake of Canola (Brassica napus L.)," Biol Fertil Soils, 1997, pp. 358-364, vol. 24.

De Lima Favaro, L. C., et al., "Epicoccum nigrum P16, a Sugarcane Endophyte, Produces Antifungal Compounds and Induces Root Growth," PLoS One, 2012, pp. 1-10, vol. 7, No. 6.

De Melo Pereira, G. V., et al. "A Multiphasic Approach for the Identification of Endophytic Bacterial in Strawberry Fruit and their Potential for Plant Growth Promotion," Microbial Ecology, 2012, pp. 405-417, vol. 63, No. 2.

De Souza, J. J., et al., "Terpenoids from Endophytic Fungi," Molecules, 2011, pp. 10604-10618, vol. 16, No. 12.

Dennis, C., et al., "Antagonistic Properties of Species Groups of Trichoderma," Trans Brit Mycol Soc, 1971, pp. 25-39, vol. 57, No. 1.

(56) References Cited

OTHER PUBLICATIONS

Desiro, A., et al., "Detection of a novel intracellular microbiome hosted in arbuscular mycorrhizal fungi," ISME Journal, 2014, pp. 257-270, vol. 8.
Djordjevic, D., et al., "Microtiter Plate Assay for Assessment of Listeria monocytogenes Biofilm Formation," Annl Environ Microbiol., 2002, pp. 2950-2958, vol. 68, No. 6.
Don, R. H., et al., "Properties of Six Pesticide Degradation Plasmids Isolated From Alcaligenes Paradoxus and Alcaligenes eutrophus," J Bacteriol., 1981, pp. 681-686, vol. 145, No. 2.
Dunbar, J, et al., "Uncultured Bacterium Clone NT42a2_20488 16S Ribosomal RNA Gene, Partial Sequence," NCBI GenBank Accession No. JQ378705. Submitted Nov. 8, 2012, 1 Page.
Eberhard, A., et al., "Structural Identification of Autoinducer of Photobacterium fischeri Luciferase," Biochem., 1981, pp. 2444-2449, vol. 20.
Edgar, R. C., "Search and Clustering Orders of Magnitude Faster than Blast," Bioinformatics, 2010, pp. 2460-2461, vol. 26, No. 19.
Edgar, R. C., "UPARSE: Highly Accurate OTU Sequences From Microbial Amplicon Reads," Nat Methods, 2013, pp. 996-998, vol. 10, No. 10.
Ek-Ramos, M. J., "Ecology, Distribution and Benefits of Fungal Endophytes Isolated from Cultivated Cotton (*Gossypium hirsutum*) in Texas," Power Point Presentation dated Nov. 7, 2012, 27 Pages.
Ek-Ramos, M. J., et al., "Spatial and Temporal Variation in Fungal Endophyte Communities Isolated from Cultivated Cotton (*Gossypium hirsutum*)," PLoS ONE, 2013, vol. 8, No. 6, 13 Pages, e66049.
Ek-Ramos, M. J., et al., "Spatial and Temporal Variation in Fungal Endophyte Communities Isolated from Cultivated Cotton (*Gossypium hirsutum*)," Power Point Presentation dated Jan. 7, 2013, 18 Pages.
El-Shanshoury, A. R., "Growth Promotion of Wheat Seedlings by Streptomyces atroolivaceus," Journal of Agronomy and Crop Science, 1989, pp. 109-114, vol. 163.
Emerson, D., et al., Identifying and Characterizing Bacteria in an Era of Genomics and Proteomics, BioScience, 2008, pp. 925-936, vol. 58, No. 10.
Endre, G., et al., "A Receptor Kinase Gene Regulating Symbiotic Nodule Development," Nature, 2002, pp. 962-966, vol. 417.
Faria, D. C., et al., "Endophytic Bacteria Isolated from Orchid and Their Potential to Promote Plant Growth," World J Microbiol Biotechnol., 2013, pp. 217-221, vol. 29.
Ferrando, L., et al., "Molecular and Culture-Dependent Analyses Revealed Similarities in the Endophytic Bacterial Community Composition of Leaves from Three Rice (*Oryza sativa*) Varieties," FEMS Microbiol Ecol., 2012, pp. 696-708, vol. 80.
Fiehn, O., et al., "Metabolite Profiling for Plant Functional Genomics," Nature Biotechnol., 2000, pp. 1157-1161, vol. 8.
Fierer, N., et al., "Cross-Biome Metagenomic Analyses of Soil Microbial Communities and Their Functional Attributes," Proc Natl Acad Sci USA, 2012, pp. 21390-21395, vol. 109, No. 52.
Fincher, G. B., "Molecular and Cellular Biology Associated with Endosperm Mobilization in Germinating Cereal Grains," Annu Rev Plant Physiol Plant Mol Biol., 1989, pp. 305-346, vol. 40.
Fisher, P. J., et al., "Fungal saprobes and pathogens as endophytes of rice (*Oryza sativa* L.)," New Phytol., 1992, pp. 137-143, vol. 120.
Fisher, P. R., et al., "Isolation and Characterization of the Pesticide-Degrading Plasmid pJP1 from Alcaligenes paradoxus," J Bacteriol., 1978, pp. 798-804, vol. 135, No. 3.
Franco, C., et al., "Actinobacterial Endophytes for Improved Crop Performance," Australasian Plant Pathology, 2007, pp. 524-531, vol. 36.
Fulthorpe, R. R., et al., "Distantly Sampled Soils Carry Few Species in Common," ISME J., 2008, pp. 901-910, vol. 2.
Gantner, S., et al., "Novel Primers for 16S rRNA-based Archaeal Community Analyses in Environmental Samples," J Microbiol Methods, 2011, pp. 12-18, vol. 84.
Gao, Z., et al., "Quantitation of Major Human Cutaneous Bacterial and Fungal Populations," J Clin Microbiol., 2010, pp. 3575-3581, vol. 48, No. 10.
Garazzino, S., et al., "Osteomyelitis Caused by Enterobacter cancerogenus Infection following a Traumatic Injury: Case Report and Review of the Literature," J Clin Microbiol., Mar. 2005, vol. 43, No. 3, pp. 1459-1461.
Gasser, I., et al., "Ecology and Characterization of Polyhydroxyalkanoate-Producing Microorganisms on and in Plants," FEMS Microbiol Ecol., 2010, pp. 142-150, vol. 70.
Gavrish, E, et al., "*Lentzea* sp. MS6 16S Ribosomal RNA Gene, Partial Sequence," NCBI GenBank Accession No. EF599958. Submitted May 9, 2007, 1 Page.
Gebhardt, J., et al., "Characterization of a single soybean cDNA encoding cytosolic and glyoxysomal isozymes of aspartate aminostransferase," Plant Molecular Biology, 1998, pp. 99-108, vol. 37.
GenBank: AF034210.1 "Glycine max aspartate aminotransferase glyoxysomal isozyme AAT1 precursor and aspartate aminotransferase cytosolic isozyme AAT2 (AAT) mRNA, complete cds," NCBI, May 26, 1998, 2 Pages, can be retrieved at <URL:https://www.ncbi.nlm.nih.gov/nuccore/AF034210>.
GenBank: JN210900.1, "*Enterobacter* sp. W/S05 16S ribosomal RNA gene, partial sequence," NCBI, Sep. 24, 2012, 1 Page, can be retrieved at <URL:https://www.ncbi.nlm.nih.gov/nuccore/jn210900>.
GenBank: NP_001237541.1, "aspartate aminotransferase glyoxysomal isozyme AAT1 precursor [Glycine max]," NCBI, Oct. 29, 2016, 2 Pages, can be retrieved at <URL:https://www.ncbi.nlm.nih.gov/protein/NP_001237541.1>.
NCBI GenBank: CP000653.1 "*Enterobacter* sp. 638, complete genome" Jan. 28, 2014, 5 Pages, Can be retrieved at <URL:https://www.ncbi.nlm.nih.gov/nuccore/CP000653.1>.
NCBI GenBank: CP000653.1 "*Enterobacter* sp. 638, complete genome" ASM1632v1, Apr. 18, 2007, 2 Pages, Can be retrieved at <URL:https://www.ncbi.nlm.nih.gov/assembly/GCA_000016325.1>.
NCBI GenBank: EU340965.1 "*Enterobacter* sp. 638 16S ribosomal RNA gene, partial sequence" Jan. 30, 2009, 1 Page, Can be retrieved at <URL:https://www.ncbi.nlm.nih.gov/nuccore/EU340965.1>.
NCBI GenBank: EBI accession No. EM STD:JQ759988, "*Dothideomycetes* sp. genotype 226 isolate FL0175 internal transcribed spacer 1, partial sequence; 5.85 ribosomal RNA gene and internal transcribed spacer 2, complete sequence; and 28S ribosomal RNA gene, partial sequence," May 17, 2012, 2 Pages.
NCBI GenBank: EBI accession No. EM STD:GU055658, "Uncultured Periconia clone NG R 806 18S ribosomal RNA gene, partial sequence; internal transcribed spacer 1, 5.8S ribosomal RNA gene, and internal transcribed spacer 2, complete sequence; and 28S ribosomal RNA gene, partial sequence," Oct. 27, 2009, 2 Pages.
GenEmbl Database, GenEmbl Record No. KF673660, Sandberg, et al., "Fungal endophytes of aquatic macrophytes: diverse host-generalists characterized by tissue preferences and geographic structure," 2013, 35 Pages.
GenEmbl Database, GenEmbl Record No. KP991588, Huang, et al., "Pervasive effects of wildfire on foliar endophyte communities in montane forest trees," Mar. 2015, 35 Pages.
GenEmbl Database, GenEmbl Record No. JN872548, 38 Pages, Alvarez-Perez, S., et al., "Zooming-in on floral nectar: a first exploration of nectar-associated bacteria in wild plant communities," FEMS Microbiol. Ecol., 2012, vol. 80, No. 3, pp. 591-602.
GenEmbl database, GenEmbl Record No. EU 977189, Jan. 21, 2009, 4 pages, Smith, S.A., et al., "Bioactive endophytes warrant intensified exploration and conservation," PloS ONE 3(8):E3052, 2008.
GenEmbl database, GenEmbl Record No. KF011597, Paenibacillus strain No. HA 13, Aug. 26, 2013, 5 Pages, Park, H.J., et al., "Isolation and characterization of humic substances—degrading bacteria from the subarctic Alaska grasslands," J Basic Microbiol, 2013.
Database Geneseq Database accession No. BAP97938 "Pantoea dispersa strain KACC91642P 16S rDNA sequence, SEQ ID 1." Aug. 15, 2013, 1 Page.

(56) References Cited

OTHER PUBLICATIONS

Database EMBL [Online] Oct. 1, 2001, 2 Pages, "Setosphaeria monoceras 28S ribosomal RNA gene, partial sequence," XP002777918, retrieved from EBI accession No. EM_STD:AY016368 Database accession No. AY016368 sequence.
Gilmour, S. J., et al., "Overexpression of the *Arabidopsis* CBF3 Transcriptional Activator Mimics Multiple Biochemical Changes Associated with Cold Acclimation," Plant Physiol., 2000, pp. 1854-1865, vol. 124.
Giraldo, A., et al., "Phylogeny of Sarocladium (Hypocreales)," Persoonia, 2015, pp. 10-24, vol. 34.
Gitaitis, R., et al., "The Epidemiology and Management of Seedborne Bacterial Diseases," Annu Rev Phytopathol., 2007, pp. 371-397, vol. 45.
Grondona, I., et al., "TUSAL®, a commercial biocontrol formulation based on Trichoderma," Bulletin OILB/SROP, 2004, pp. 285-288, vol. 27, No. 8.
Gu, O., et al., "*Glycomyces sambucus* sp. nov., an endophytic actinomycete islolated from the stem of Sambucus adnata Wall," International Journal of Systematic and Evolutionary Microbiology, 2007, pp. 1995-1998, vol. 57.
Haake, V., et al., "Transcription Factor CBF4 is a Regulator of Drought Adaptation in *Arabidopsis*," Plant Physiol., 2002, pp. 639-648, vol. 130.
Haas, D., et al., "R Factor Variants with Enhanced Sex Factor Activity in Pseudomonas aeruginosa," Mol Gen Genet., 1976, pp. 243-251, vol. 144.
Hahm, M-S., et al., "Biological Control and Plant Growth Promoting Capacity of Rhizobacteria and Pepper Under Greenhouse and Field Conditions," The Journal of Microbiology, the Microbiological Society of Korea, Heidelberg, Jun. 30, 2012, pp. 380-385, vol. 50, No. 3.
Hallman, J., et al., "Bacterial Endophytes in Agricultural Crops," Canadian J Microbiol., 1997, pp. 895-914, vol. 43.
Hamayun, M., et al., "Cladosporium sphaerospermum as a new plant growth-promoting endophyte from the roots of Glycine max (L.) Merr," World Journal of Microbiology and Biotechnology, Kluwer Academic Publishers, Feb. 15, 2009, pp. 627-632, vol. 25, No. 4.
Hanson, L.E., "Reduction of Verticillium Wilt Symptoms in Cotton Following Seed Treatment with Trichoderma virens," The Journal of Cotton Science, 2000, pp. 224-231, vol. 4, No. 4.
Hanson, L.E., "Reduction of Verticillium Wilt Symptoms in Cotton Following Seed Treatment with Trichoderma virens," Proceedings Beltwide Cotton Conferences, 2000, vol. 1. (Abstract), 1 Page.
Hardegree, S. P. et al., "Effect of Polyethylene Glycol Exclusion on the Water Potential of Solution-Saturated Filter Paper," Plant Physiol., 1990, pp. 462-466, vol. 92.
Hardoim, P. R., et al., "Assessment of Rice Root Endophytes and Their Potential for Plant Growth Promotion," In: Hardoim, P.R., Bacterial Endophytes of Rice—Their Diversity, Characteristics and Perspectives, Groningen, 2011, pp. 77-100.
Hardoim, P. R., et al., "Dynamics of Seed-Borne Rice Endophytes on Early Plant Growth Stages," PLoS ONE, 2012, vol. 7, No. 2, 13 Pages.
Harman, G.E., et al., "Symposium: biocontrol and biotechnological methods for controlling cotton pests," Proceedings of the Beltwide Cotton Production Research Conf., 1989, Memphis, Tennessee, USA, pp. 15-20. (Abstract).
Hepler, P. K., et al., "Polarized Cell Growth in Higher Plants," Annu Rev Cell Dev Biol., 2001, pp. 159-187, vol. 17.
Hiatt, E. E., et al., "Tall Fescue Endophyte Detection: Commerical Immunoblot Test Kit Compared with Microscopic Analysis," Crop Science, 1999, pp. 796-799, vol. 39.
Hibbett, D. S., et al., "A Higher-Level Phylogenetic Classification of the Fungi," Mycol Res., 2007, pp. 509-547, vol. 111.
Hill, N. S., et al., "Endophyte Survival during Seed Storage: Endophyte-Host Interactions and Heritability," Crop Sci., 2009, pp. 1425-1430, vol. 49.

Hill N. S., et al., "Endophyte Survival during Seed Storage: Endophyte-Host Interactions and Heritability," PowerPoint, Dept. Crop Soil Sciences, University of Georgia, Nov. 16, 2012, 3 Pages.
Hinton, D. M., et al., "Enterobacter cloacae is an endophytic symbiont of corn," Mycopathologia, 1995, pp. 117-125, vol. 129.
Hoffman, M., et al., "Diverse Bacteria Inhabit Living Hyphae of Phylogenetically Diverse Fungal Endophytes," Applied and Environmental Microbiology, Jun. 2010, p. 4063-4075, vol. 76, No. 12.
Hoffman, M., et al., "Endohyphal Bacterium Enhances Production of Indole-3-Acetic Acid by a Foliar Fungal Endophyte," PLOS One, Sep. 24, 2013, pp. 1-8, vol. 8, Issue 9, e73132.
Howell, C.R., et al., "Induction of Terpenoid Synthesis in Cotton Roots and Control of Rhizoctonia solani by Seed Treatment with Trichoderma virens," Phytopathology, 2000, pp. 248-252, vol. 90, No. 3.
Hubbard, M., et al., 2011. "Agricultural Potential of Fungal Endophytes of Grasses, Cereals and Wheat," In: Wheat: Genetics, Crops and Food Production. Nova Science Publishers Hauppauge, NY, USA. pp. 333-345.
Hubbard, M., et al., "Fungal Endophytes Improve Wheat Seed Germination Under Heat and Drought Stress," Botany, 2012, pp. 137-149, vol. 90.
Humann, J., et al., "Complete genome of the onion pathogen Enterobacter cloacae EcWSU1," Standard in Genomic Sciences, Dec. 31, 2011, vol. 5, No. 3, pp. 279-286.
Hung, P.Q., et al., "Isolation and Characterization of Endophytic Bacteria in Soybean (*Glycine* Sp.)," Omonrice, 2004, pp. 92-101, vol. 12.
Idris, A., et al., "Efficacy of Rhizobacteria for Growth Promotion in Sorghum Under Greenhouse Conditions and Selected Modes of Action Studies," J Agr Sci., 2009, pp. 17-30, vol. 147.
Ikeda, S., et al., "The Genotype of the Calcium/Calmodulin-Dependent Protein Kinase Gene (CCaMK) Determines Bacterial Community Diversity in Rice Roots Under Paddy and Upland Field Conditions," Applied and Environmental Microbiology, 2011, pp. 4399-4405, vol. 77, No. 13.
Imoto, K., et al., "Comprehensive Approach to Genes Involved in Cell Wall Modifications in *Arabidopsis thaliana*," Plant Mol Biol., 2005, pp. 177-192, vol. 58.
Impullitti, A.E., et al., "Fungal endophyte diversity in soybean", Journal of Applied Microbiolog, vol. 114, No. 5, May 1, 2013, pp. 1500-1506.
Jalgaonwala, R., et al., "A Review on Microbial Endophytes from Plants: A Treasure Search for Biologically Active Metabolites," Global Journal of Research on Medicinal Plants & Indigenous Medicine, 2014, pp. 263-277, vol. 3, No. 6.
Janda, J. M., et al., "16S rRNA Gene Sequencing for Bacterial Identification in the Diagnostic Laboratory: Pluses, Perils, and Pitfalls," Journal of Clinical Microbiology, 2007, pp. 2761-2764, vol. 45, No. 9.
Johnston-Monje, D., et al., "Conservation and Diversity of Seed Associated Endophytes in *Zea* Across Boundaries of Evolution, Ethnography and Ecology," PLOS ONE, vol. 6, No. 6, Jun. 3, 2011, p. e20396, 22 Pages.
Johnston-Monje, D., et al., "Plant and Endophyte Relationships: Nutrient Management," Comprehensive Biotechnol., 2011, pp. 713-727, vol. 4.
Johnston-Monje, D., "Microbial Ecology of Endophytic Bacteria in *Zea* Species as Influenced by Plant Genotype, Seed Origin, and Soil Environment," Thesis, University of Guelph, 2011, 230 Pages.
Jones, K.L., "Fresh Isolates of Actinomycetes in which the Presence of Sporogenous Aerial Mycelia is a Fluctuating Characteristic," J Bacteriol., 1949, pp. 141-145, vol. 57, No. 2.
Jung, C., et al., "The Effects of Endohyphal Bacteria on Anti-Cancer and Anti-Malaria Metabolites of Endophytic Fungi," Honors Thesis, University of Arizona, May 2012, 15 Pages.
Kaga, H., et al., "Rice Seeds as Sources of Endophytic Bacteria," Microbes Environ., 2009, pp. 154-162, vol. 24, No. 2.
Kalns, L., et al., "The Effects of Cotton Fungal Endophytes in the Field on Arthropod Community Structure," Power Point Presentation dated Jan. 7, 2013.

(56) References Cited

OTHER PUBLICATIONS

Kang, B. H., et al., "Members of the *Arabidopsis* Dynamin-Like Gene Family, ADL1, are Essential for Plant Cytokinesis and Polarized Cell Growth," Plant Cell, 2003, pp. 899-913, vol. 15.
Kasana, R. C., et al., "A Rapid and Easy Method for the Detection of Microbial Cellulases on Agar Plates Using Gram's Iodine," Curr Microbiol., 2008, pp. 503-507, vol. 57.
Khan, A.L., et al., "Salinity Stress Resistance Offered by Endophytic Fungal Interaction Between Penicillium minioluteum LHL09 and Glycine max. L," J. Microbiol. Biotechnol., 2011, pp. 893-902, vol. 21, No. 9.
Kim, M., et al., "Towards a taxonomic coherence between average nucleotide identity and 16S rRNA gene sequence similarity for species demarcation of prokaryotes", Int J Systematic Evolutionary Microbial., 2014, vol. 64, pp. 346-351.
Klaubauf, S., et al., "Molecular diversity of fungal communities in agricultural soils from Lower Austria," Fungal Diversity, Aug. 13, 2010, pp. 65-75, vol. 44, No. 1.
Knapp, D., et al., "Inter- and intraspecific functional diversity of fungal root endophytes of semiarid sandy grasslands," Acta Microbiologica et Immunologica Hungarica, Nov. 2017, pp. 1-101, vol. 64, Issue Supplement 1.
Kruger, M., et al., "DNA-Based Species Level Detection of Glomeromycota: One PCR Primer Set for All Arbuscular Mycorrhizal Fungi," New Phvtol., 2009, pp. 212-223, vol. 183.
Kuklinsky-Sobral, J., et al., "Isolation and Characterization of Endophytic Bacteria from Soybean (*Glycine max*) Grown in Soil Treated with Glyphosate Herbicide," Plant and Soil, 2005, pp. 91-99, vol. 273.
Kuklinsky-Sobral, J., et al., "Isolation and characterization of soybean-associated bacteria and their potential for plant growth promotion," Environmental Microbiology, 2004, pp. 1244-1251, vol. 6, No. 12.
Kumar, S., et al., "MEGA7: Molecular Evolutionary Genetics Analysis version 7.0 for bigger datasets," Molecular Biology and Evolution, Mar. 22, 2016, vol. 33, pp. 1870-1874.
Kumar, A., et al., "Bio-control potential of *Cladosporium* sp. (MCPL-461), against a noxious weed *Parthenium hysterophorus* L.," J. Environ Biol., Mar. 2009, pp. 307-312, vol. 30, Issue 2.
Kusari, S., et al. "Chemical ecology of endophytic fungi: origins of secondary metabolites," Cell Press, Chem & Biol., 2012, pp. 792-798, vol. 19.
Labeda, D.P., et al., "Phylogenetic study of the species within the family Streptomycetaceae," Antonie van Leeuwenhoek, 2012, vol. 101, pp. 73-104, Springer.
Lanver, D., et al., "Sho1 and Msb2-Related Proteins Regulate Appressorium Development in the Smut Fungus *Ustilago aydis*," Plant Cell, 2010, pp. 2085-2101, vol. 22.
Laus, M. C., et al., "Role of Cellulose Fibrils and Exopolysaccharides of Rhizobium leguminosarum in Attachment to and Infection of Vicia sativa Root Hairs," Mol Plant Microbe Interact., 2005, pp. 533-538, vol. 18, No. 6.
Le, X.H., et al., "Effects of endophytic Streptomyces on the lucerne (*Medicago sativa* L.) symbiosis at different levels of nitrogen," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 66-67.
Le, X.H., et al., "Isolation and characterisation of endophytic actinobacteria and their effect on the early growth and nodulation of lucerne (*Medicago sativa* L.)," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 134-136.
Lehman, S.G., "Treat Cotton Seed," Review of Applied Mycology, 1945, 24, 369, 16 Pages.
Lehman, S.G., "Treat Cotton Seed," Research and Farming III, Progr. Rept., 1945, 3, 5, 16 Pages.
Leonard, C. A., et al., "Random Mutagenesis of the Aspergillus oryzae Genome Results in Fungal Antibacterial Activity," Int J Microbiol., 2013, vol. 2013, Article ID 901697, 6 Pages.

Li, H. M., et al., "Expression of a Novel Chitinase by the Fungal Endophyte in Poa ampla," Mycologia, 2004, pp. 526-536, vol. 96, No. 3.
Li, H., et al., "Endophytes and their role in phytoremediation," Fungal Diversity, 2012, pp. 11-18, vol. 54.
Li, Q., "Agrobacterium tumefaciens Strain TA-AT-10 16S Ribosomal RNA Gene, Partial Sequence: GenBank: KF673157.1," Submitted Sep. 17, 2013.
Liu, M., et al., "A Novel Screening Method for Isolating Exopolysaccharide-Deficient Mutants," Appl Environ Microbiol., 1998, pp. 4600-4602, vol. 64, No. 11.
Liu, Y., et al., "Investigation on Diversity and Population Succession Dynamics of Endophytic Bacteria from Seeds of Maize (*Zea mays* L., Nongda108) at Different Growth Stages," Ann Microbiol., 2013, pp. 71-79, vol. 63.
Liu, D., et al., "Osmotin Overexpression in Potato Delays Development of Disease Symptoms," Proc Natl Acad Sci USA, 1994, pp. 1888-1892, vol. 91.
Liu, Y., et al., "Phylogenetic relationships among ascomycetes: evidence from an RNA polymerase II subunit," Mol. Biol. Evol. 1999. vol. 16, No. 12, pp. 1799-1808.
Liu, Y., et al., "Study on Diversity of Endophytic Bacterial Communities in Seeds of Hybrid Maize and their Parental Lines," Arch Microbiol., 2012, pp. 1001-1012, vol. 194.
Long, H. H., et al., "The Structure of the Culturable Root Bacterial Endophyte Community of Nicotiana attenuata is Organized by Soil Composition and Host Plant Ethylene Production and Perception," New Phytol., 2010, pp. 554-567, vol. 185.
Lopez-Lopez, A., et al., "Phaseolus vulgaris Seed-Borne Endophytic Community with Novel Bacterial Species such as *Rhizobium endophyticum* sp. nov.," Systematic Appl Microbiol., 2010, pp. 322-327, vol. 33.
Lorck, H., "Production of Hydrocyanic Acid by Bacteria," Physiol Plant, 1948, pp. 142-146, vol. 1.
Lugtenberg, B., et al., "Plant-Growth-Promoting Rhizobacteria," Ann. Rev. Microbiol., 2009, pp. 541-556, vol. 63.
Lundberg, D. S., et al., "Defining the Core *Arabidopsis thaliana* Root Microbiome," Nature, 2012, pp. 86-90, vol. 488, No. 7409.
Lundberg, D. S., et al., "Practical Innovations for High-Throughput Amplicon Sequencing," Nat Methods, 2013, pp. 999-1002, vol. 10, No. 10.
Ma, Y., et al., "Plant Growth Promoting Rhizobacteria and Endophytes Accelerate Phytoremediation of Metalliferous Soils," Biotechnology Advances, 2011, pp. 248-258, vol. 29.
Madi, L. et al., "Aggregation in Azospirillum brasilense Cd: Conditions and Factors Involved in Cell-to-Cell Adhesion," Plant Soil, 1989, pp. 89-98, vol. 115.
Mandyam, K., et al., "Mutualism-parasitism paradigm synthesized from results of root-endophyte models", Frontiers in Microbiology, Jan. 12, 2015, pp. 1-14, vol. 5.
Mannisto, M.K., et al., "Characterization of Psychrotolerant Heterotrophic Bacteria From Finnish Lapland," Svst Appl Microbiol., 2006, pp. 229-243, vol. 29.
Mano, H., et al., "Culturable Surface and Endophytic Bacterial Flora of the Maturing Seeds of Rice Plants (*Oryza sativa*) Cultivated in a Paddy Field," Microbes Environ., 2006, vol. 21, No. 2.
Manter, D. K., et al., "Use of the Its Primers, ITSIF and ITS4, to Characterize Fungal Abundance and Diversity in Mixed-Template Samples by qPCR and Length Heterogeneity Analysis," J Microbiol Methods, 2007, pp. 7-14, vol. 71.
Mao, W., et al., "Seed Treatment with a Fungal or a Bacterial Antagonist for Reducing Corn Damping-off Caused by Species of *Pythium* and *Fusarium*," Plant Disease, 1997, pp. 450-454, vol. 81, No. 5.
Marasco, R., et al., "A Drought Resistance-Promoting Microbiome is Selected by Root System Under Desert Farming," PLoS ONE, 2012, vol. 7, No. 10, 14 Pages.
Marquez, L. M., et al., "A Virus in a Fungus in a Plant: Three-Way Symbiosis Required for Thermal Tolerance," Science, 2007, pp. 513-515, vol. 315.
Mastretta, C., et al., "Endophytic Bacteria from Seeds of Nicotiana Tabacum Can Reduce Cadmium Phytotoxicity," Intl J Phytoremediation, 2009, pp. 251-267, vol. 11.

(56) References Cited

OTHER PUBLICATIONS

Mateos, P. F., et al., "Cell-Associated Pectinolytic and Cellulolytic Enzymes in Rhizobium leguminosarum biovar trifolii," Appl Environ Microbiol., 1992, pp. 816-1822, vol. 58, No. 6.
McDonald, D., et al., "An Improved Greengenes Taxonomy with Explicit Ranks for Ecological and Evolutionary Analyses of Bacteria and Archaea," ISME J., 2012, pp. 610-618, vol. 6.
McGuire, K.L., et al., "Digging the New York City Skyline: Soil Fungal Communities in Green Roofs and City Parks," PloS One, 2013, vol. 8, No. 3, 13 Pages.
Medina, P., et al., "Rapid Identification of Gelatin and Casein Hydrolysis Using TCA," J Microbiol Methods, 2007, pp. 391-393, vol. 69.
Mehnaz, S., et al., "Growth Promoting Effects of Corn (Zea mays) Bacterial Isolates Under Greenhouse and Field Conditions," Soil Biology and Biochemistry, 2010, pp. 1848-1856, vol. 42.
Mehnaz, S., et al., "Isolation and 16S rRNA sequence analysis of the beneficial bacteria from the rhizosphere of rice," Canada Journal of Microbiology, 2001, pp. 110-117, vol. 47, No. 2.
Mei, C., et al., "The Use of Beneficial Microbial Endophytes for Plant Biomass and Stress Tolerance Improvement," Recent Patents on Biotechnology, 2010, pp. 81-95, vol. 4.
Michel, B. E., et al., "The Osmotic Potential of Polyethylene Glycol 6000," Plant Physiol., 1973, pp. 914-916, vol. 51.
Misk, A., et al., "Biocontrol of chickpea root rot using endophytic actinobacteria", Biocontrol, vol. 56, No. 5, Mar. 12, 2011, pp. 811-822, XP036215297.
Miyoshi-Akiyama, T., et al., "Multilocus Sequence Typing (MLST) for Characterization of Enterobacter cloacae," PLoS ONE, 2013, vol. 8, No. 6, 10 Pages, e66358.
Moe, L. A., "Amino Acids in the Rhizosphere: From Plants to Microbes," American Journal of Botany, 2013, pp. 1692-1705, vol. 100, No. 9.
Mohiddin, F. A., et al., "Tolerance of Fungal and Bacterial Biocontrol Agents to Six Pesticides Commonly Used in the Control of Soil Borne Plant Pathogens," African Journal of Agricultural Research, 2013, pp. 5331-5334, vol. 8, No. 43.
Mousa, W. K., et al., "The Diversity of Anti-Microbial Secondary Metabolites Produced by Fungal Endophytes: an Interdisciplinary Perspective," Front Microbiol., 2013, vol. 4, No. 65, 18 Pages.
Mundt, J.O., et al., "Bacteria Within Ovules and Seeds," Appl Environ Microbiol., 1976, pp. 694-698, vol. 32, No. 5.
Naik, B. S., et al., "Study on the diversity of endophytic communities from rice (Oryza sativa L.) and their antagonistic activities in vitro," Microbiological Research, 2009, pp. 290-296, vol. 164.
Nassar, A., et al., "Promotion of plant growth by an auxin-producing isolate of the yeast Williopsis saturnus endophytic in maize (Zea mays L.) roots", Biology and Fertility of Soils; Cooperating Journal of International Society of Soil Science, Springer, Berlin, DE, vol. 42, No. 2, Nov. 1, 2005, pp. 97-108.
Naveed, M., "Maize Endophytes—Diversity, Functionality and Application Potential," University of Natural Resources and Life Sciences, 2013, pp. 1-266 and 81-87; Tables 1-3; Figure 2.
Nejad, P. et al., "Endophytic Bacteria Induce Growth Promotion and Wilt Disease Suppression in Oilseed Rape and Tomato, " Biological Control, 2000, pp. 208-215, vol. 18.
Neslon, E.B., "Microbial Dynamics and Interactions in the Spermosphere," Ann. Rev. Phytopathol., 2004, pp. 271-309, vol. 42.
Nikolcheva, L.G., et al., "Taxon-Specific Fungal Primers Reveal Unexpectedly High Diversity During Leaf Decomposition in a Stream," Mycological Progress, 2004, pp. 41-49, vol. 3, No. 1.
Nimnoi, P., et al., "Co-Inoculation of Soybean (Glycin max) with Actinomycetes and Bradyrhizobium Japonicum Enhances Plant Growth, Nitrogenase Activity and Plant Nutrition," Journal of Plant Nutrition, 2014, pp. 432-446, vol. 37.
Nishijima, K.A., et al., "Demonstrating Pathogenicity of Enterobacter cloacae on Macadamia and Identifying Associated Volatiles of Gray Kernel of Macadamia in Hawaii," Plant Disease, Oct. 2007, vol. 91, No. 10, pp. 1221-1228.
Normander, B., et al., "Bacterial Origin and Community Composition in the Barley Phytosphere as a Function of Habitat and Presowing Conditions," Appl Environ Microbiol., Oct. 2000, pp. 4372-4377, vol. 66, No. 10.
O'Hanlon, K., et al., "Exploring the potential of symbiotic fungal endophytes in cereal disease suppression", Biological Control, vol. 63, No. 2, Sep. 5, 2012, pp. 69-78.
Okunishi, S., et al., "Bacterial Flora of Endophytes in the Maturing Seeds of Cultivated Rice (Oryza sativa)," Microbes and Environment, 2005, pp. 168-177, vol. 20, No. 3.
Op De Beeck, M., et al., "Comparison and Validation of Some Its Primer Pairs Useful for Fungal Metabarcoding Studies," PLOS ONE, Jun. 2014, vol. 9, Issue 6, e97629, pp. 1-11.
Orole, O. O., et al., "Bacterial and fungal endophytes associated with grains and roots of maize," Journal of Ecology and the Natural Enviornment, 2011, pp. 298-303, vol. 3, No. 9.
Partida-Martinez, L.P., et al., "The Microbe-Free Plant: Fact or Artifact?" Front Plant Sci., 2011, vol. 2, No. 100, 16 Pages.
Pearson, W.R., et al., "Rapid and Sensitive Sequence Comparison With FASTP and FASTA," Methods Enzymol., 2011, pp. 63-98, vol. 183.
Pedraza, R. O., et al., "Azospirillum inoculation and nitrogen fertilization effect on grain yield and on the diversity of endophytic bacteria in the phyllosphere of rice rainfed crop," European Journal of Soil Biology, 2009, pp. 36-43, vol. 45.
Perez-Fernandez, M. A., et al., "Simulation of Germination of Pioneer Species Along an Experimental Drought Gradient," J Environ Biol., 2006, pp. 669-685, vol. 27, No. 4.
Perez-Miranda, S., et al., "O-CAS, A Fast and Universal Method for Siderophore Detection," J Microbiol Methods, 2007, pp. 127-131, vol. 70.
Petti, C. A., "Detection and Identification of Microorganisms by Gene Amplification and Sequencing," Clinical Infectious Diseases, 2007, pp. 1108-1114, vol. 44.
Phalip, V., et al., "A Method for Screening Diacetyl and Acetoin-Producing Bacteria on Agar Plates," J Basic Microbiol., 1994, pp. 277-280, vol. 34.
Philippot, L., et al., "Going Back to the Roots: The Microbial Ecology of the Rhizosphere," Nat Rev Microbiol., Nov. 2013, pp. 789-799, vol. 11.
Philrice Batac, Philippine Rice R&D Highlights, 2012, Area-Based R&D Projects, 52 Pages, [online][Retrieved Aug. 11, 2016] Retrieved from the Internet <URL:http://www.philrice.gov.ph/2012-rd-highlights/>.
Pillay, V. K., et al., "Inoculum Density, Temperature, and Genotype Effects on in vitro Growth Promotion and Epiphytic and Endophytic Colonization of Tomato (Lycopersicon esculentum L.) Seedlings Inoculated with a Pseudomonad Bacterium," Can J Microbiol., 1997, pp. 354-361, vol. 43.
Powell, W. A., et al., "Evidence of Endophytic Beauveria Bassiana in Seed-Treated Tomato Plants Acting as a Systemic Entomopathogen to Larval Helicoverpa zea (Lepidoptera: Noctuidae)," J. Entomol. Sci., 2009, pp. 391-396, vol. 44, No. 4.
Quadt-Hallmann, A., et al., "Bacterial Endophytes in Cotton: Mechanisms of Entering the Plant," Can J Microbiol., 1997, pp. 577-582, vol. 43.
R Core Team, "R: A Language and Environment for Statistical Computing," R Foundation for Statistical Computing, Vienna, Austria, May 2013, ISBN: 3-900051-07-0. Available online at http://www.R- 25 project.org/, 3604 Pages.
Rae, R., et al., "A subset of naturally isolated Bacillus strains show extreme virulence to the free-living nematodes Caenorhabditis elegans and Pristionchus pacificus", Environmental Microbiology, 2010, pp. 3007-3021, vol. 12, No. 11.
Rasmussen, S., et al., "Grass-endophyte interactions: a note on the role of monosaccharide transport in the Neotyphodium lolii-Lolium perenne symbiosis," New Phytologist, 2012, pp. 7-12, vol. 196.
Ravel, C., et al., "Beneficial effects of Neotyphodium lolii on the growth and the water status in perennial ryegrass cultivated under nitrogen deficiency or drought stress," Agronomie, 1997, pp. 173-181, vol. 17.

(56) References Cited

OTHER PUBLICATIONS

Redman, R. S., et al., "Thermotolerance Generated by Plant/Fungal Symbiosis," Science, Nov. 2002, vol. 298, 1 Page (with 4 pages of supplemental material).
Reiter, B., et al., "Response of Endophytic Bacterial Communities in Potato Plants to Infection with *Erwinia carotovora* subsp. *atroseptica*," Appl Environ Microbiol., 2001, pp. 2261-2268, vol. 68, No. 5.
Ren, Y., et al., "Complete Genome Sequence of *Enterobacter cloacae* subsp. *cloacae* Type Strain ATCC 13047," J. Bacteriol. May 2010, vol. 192, No. 9, pp. 2463-2464.
Riess, K., et al., "High genetic diversity at the regional scale and possible speciation in Sebacina epigaea and S. incrustans," BMC Evolutionary Biology, 2013, vol. 13, No. 102, 17 Pages.
Riken, GI No. GMFL01-01-D03, 2 Pages, [online] [Retrieved on Dec. 18, 2017] Retrieved from the internet <URL:http://spectra.psc.riken.jp/menta.cgi/rsoy/datail?id=GMFL01-01-D03>.
Rodriguez, H., et al., "Expression of a Mineral Phosphate Solubilizing Gene From Erwinia herbicola in Two Rhizobacterial Strains," J Biotechnol., 2001, pp. 155-161, vol. 84.
Rodriguez, R.J., et al., "Stress Tolerance in Plants via Habitat-Adapted Symbiosis," ISME J., 2008, pp. 404-416, vol. 2.
Rodriguez-Navarro, D., et al., "Soybean Interactions with Soil Microbes, Agronomical and Molecular Aspects," Agronomy for Sustainable Development, 2011, pp. 173-190, vol. 31, No. 1.
Roessner, U., et al., "Metabolic Profiling Allows Comprehensive Phenotyping of Genetically or Environmentally Modified Plant Systems," Plant Cell, 2001, pp. 11-29, vol. 13.
Rosado, A. S., et al., "Phenotypic and Genetic Diversity of Paenibacillus azotofixans Strains Isolated from the Rhizoplane or Rhizosphere Soil of Different Grasses," J App Microbiol., 1998, pp. 216-226, vol. 84.
Rosenblueth, A., et al., "Seed Bacterial Endophytes: Common Genera, Seed-to-Seed Variability and Their Possible Role in Plants," Acta Hort., 2012, pp. 39-48, vol. 938.
Rosenblueth, M., et al., "Bacterial Endophytes and Their Interactions With Host," Molecular Plant-Microbe Interactions, 2006, pp. 827-837, vol. 19, No. 8.
Ross, P.L., et al., "Multiplexed Protein Quantitation in *Saccharomyces cerevisiae* Using Amine-Reactive Isobaric Tagging Reagents," Mol Cell Proteomics, 2004, pp. 1154-1169, vol. 3, No. 12.
Saleem, M., et al., "Perspective of Plant Growth Promoting Rhizobacteria (PGPR) Containing ACC Deaminase in Stress Agriculture," J Ind Microbiol Biotechnol., Oct. 2007, pp. 635-648, vol. 34.
Samac, D.A., et al., "Recent Advances in Legume-Microbe Interactions: Recognition, Defense Response, and Symbiosis from a Genomic Perspective," Plant Physiol., 2007, pp. 582-587, vol. 144.
Samways, M.J., et al., "Assessment of the Fungus *Cladosporium oxyspoum* (Berk. and Curt.) As a Potential BioControl Agent Against Certain Homoptera," Elsevier Science Publioshers B.V., Jan. 1, 1986, pp. 231-239.
Sardi, P., et al., "Isolation of Endophytic Streptomyces Strains from Surface Sterilized Roots," Applied and Environmental Microbiology, 1992, pp. 2691-2693, vol. 58, No. 8.
Sarwar, M., et al., "Tryptophan Dependent Biosynthesis of Auxins in Soil," Plant Soil, 1992, pp. 207-215, vol. 147.
Saunders, M., et al., "Host-Synthesized Secondary Compounds Influence the In Vitro Interactions between Fungal Endophytes of Maize", Applied and Environmental Microbiology, Nov. 9, 2007, pp. 136-142, vol. 74 , No. 1.
Schmieder, R., et al., "Quality Control and Preprocessing of Metagenomic Datasets," Bioinformatics, 2011, pp. 863-864, vol. 27, No. 6.
Schneider, C., et al., "Endophytes for plant protection: the state of the art Proceedings," DPG Spectrum Phytomedizin, Proceedings of the 5th International Symposium on Plant Protection and Plant Health in Europe, May 26-29, 2013, 347 Pages.

Schoch, C. L., et al., "Nuclear Ribosomal Internal Transcribed Spacer (ITS) Region as a Universal DNA Barcode Marker for Fungi," Proc Natl Acad Sci USA, 2012, pp. 6241-6246, vol. 109, No. 16.
Schwyn, B. et al., "Universal Chemical Assay for the Detection and Determination of Siderophores," Analytical Biochemistry, 1987, pp. 47-56, vol. 160.
Senthilkumar, M., et al., "Biocontrol Potential of Soybean Bacterial Endophytes Against Charcoal Rot Fungus, *Rhizoctonia batatiola*," Current Microbiology, 2009, vol. 58, pp. 288-293.
Sessitsch, A., et al., "*Burkholderia phytofirmans* sp. Nov., a novel plant-associated bacterium with plant-beneficial properties," International Journal of Systematic and Evoluntary Microbiology, 2005, pp. 1187-1192, vol. 55.
Shapiro-Ilan, D.I., et al., "The Potential for Enhanced Fungicide Resistance in Beauveria Bassiana Through Strain Discovery and Artificial Selection," Journal of Invertebrate Pathology, 2002, pp. 86-93, vol. 81.
Shankar, M., et al.,"Root colonization of a rice growth promoting strain of Enterobacter cloacae," Journal of Basic Microbiology, 2011, pp. 523-530, vol. 51.
Shiraishi, A., et al., "Nodulation in black locust by the ammaproteobacteria *Pseudomonas* sp. and the *Betaproteobacteria burkholderia* sp", Systematic and Applied Microbiology, Aug. 2010, pp. 269-274, vol. 33, No. 5.
Simola, L., et al., "The Effect of Some Protein and Non-Protein Amino Acids on the Growth of Cladosporium herbarum and Trichotheeium roseum," Effect of Amino Acids on Fungi, Physiologia Plantarum, 1979, pp. 381-387, vol. 46.
Singh, A. K., et al., "Uncultured *Actinomyces* sp. Clone EMLACT 80 IV (New) 16S Ribosomal RNA Gene, Partial Sequence," NCBI GenBank Accession No. JQ285908. Submitted Dec. 13, 2011.
Soares, M. M. C. N., et al., "Screening of Bacterial Strains for Pectinolytic Activity: Characterization of the Polygalacturonase Produced by *Bacillus* Sp," Revista de Microbiolgia, 1999, pp. 299-303, vol. 30.
Soe, K.M., et al., "Effects of endophytic actinomycetes and Bradyrhizobium japonicum strains on growth, nodulation, nitrogen fixation and seed weight of different soybean varieties," Soil Science and Plant Nutrition, 2012, pp. 319-325, vol. 58, No. 3.
Soe, K.M., et al., "Low-Density Co-Inoculation of Myanmar Bradyrhizobium yuanmingense MAS34 and Streptomyces griseoflavus P4 to Enhance Symbiosis and Seed Yield in Soybean Varieties," American Journal of Plant Sciences, 2013, pp. 1879-1892, vol. 4.
Sogonov, M.V., et al., "The hyphomycete *Teberdinia hygrophila* gen. nov., sp. nov. and related anamorphs of *Pseudeurotium* species," Mycologia, May 2005, pp. 695-709, vol. 97, No. 3.
Song, M., et al., "Effects of Neotyphodium Endophyte on Germination of Hordeum brevisubulatum under Temperature and Water Stress Conditions," Acta Agrestia Sinica, 2010, pp. 834-837, vol. 18, No. 6. (English Abstract).
Souleimanov, A., et al., "The Major Nod Factor of Bradyrhizobium japonicum Promotes Early Growth of Soybean and Corn," J. Exp. Bot., 2002, pp. 1929-1934, vol. 53, No. 376.
Spiekermann, P., et al., "A Sensitive, Viable-Colony Staining Method Using Nile Red for Direct Screening of Bacteria that Accumulate Polyhydroxyalkanoic Acids and Other Lipid Storage Compounds," Arch Microbiol., 1999, pp. 73-80, vol. 171.
Staudt, A. K., et al., "Variations in Exopolysaccharide Production by Rhizobium tropici," Arch Microbiol., 2012, pp. 197-206, vol. 194.
Stielow, J.B., et al., "One fungus, which genes? Development and assessment of universal primers for potential secondary fungal DNA barcodes," Persoonia: Molecular Phylogeny and Evolution of Fungi, 2015, vol. 35, pp. 242-263.
Strobel, G. A., "Endophytes as Sources of Bioactive Products," Microbes and Infection, 2003, pp. 535-544, vol. 5.
Sturz, A. V., et al., "Weeds as a Source of Plant Growth Promoting Rhizobacteria in Agricultural Soils," Can J Microbiol., 2001, pp. 1013-1024, vol. 47, No. 11.
Surette, M. A., et al. "Bacterial Endophytes in Processing Carrots (*Daucus carota* L. var. *sativus*): Their Localization, Population Density, Biodiversity and Their Effects on Plant Growth," Plant and Soil, 2003, pp. 381-390, vol. 253, No. 2.

(56) References Cited

OTHER PUBLICATIONS

Suto, M., et al., "Endophytes as Producers of Xylanase," J Biosci Bioeng., 2002, pp. 88-90, vol. 93, No. 1.
Sword, G., "Manipulating Fungal Endophytes to Protect Plants from Insects and Nematodes," Power Point Presentation dated Aug. 7, 2013.
Sword, G., et al., "Manipulating Fungal Endophytes for the Protection of Cotton in the Field," Power Point Presentation dated Jan. 7, 2013.
Sword, G., et al., "Field Trials of Potentially Beneficial Fungal Endophytes in Cotton," Power Point Presentation dated Jan. 7, 2013.
Sword, G., "Fungal Endophytes to Protect Cotton from Insects and Nematodes," Power Point Presentation dated Dec. 7, 2012, 20 Pages.
Sword, G., "Natural Enemies—The Forgotten Basis of IPM?," Power Point Presentation dated Sep. 6, 2013.
Taghavi, S., et al., "Genome Survey and Characterization of Endophytic Bacteria Exhibiting a Beneficial Effect on Growth and Development of Poplar Trees," Applied and Environmental Microbiology, 2009, pp. 748-757, vol. 75, No. 3.
Taghavi, S., et al., "Genome Sequence of the Plant Growth promoting Endophytic Bacterium *Enterobacter* sp. 638", PLoS Genet., May 2010, pp. 1-15, vol. 6, Issue 5, e1000943.
Tamura, K., et al., "Estimation of the number of nucleotide substitutions in the control region of mitochondrial DNA in humans and chimpanzees," Molecular Biology and Evolution, 1993, vol. 10, No. 3, pp. 512-526.
Taylor, A. G., et al., "Concepts and Technologies of Selected Seed Treatments," Annu. Rev. Phytopathol., 1990, pp. 321-339, vol. 28.
Teather, R. M., et al., "Use of Congo Red-Polysaccharide Interactions in Enumeration and Characterization of Cellulolytic Bacteria from the Bovine Rumen," Appl Environ Microbiol., 1982, pp. 777-780, vol. 43, No. 4.
Thakur, A., et al., "Detrimental effects of endophytic fungus *Nigrospora* sp. on survival and development of Spodoptera litura," Biocontrol Science and Technology, Feb. 1, 2012, pp. 151-161, vol. 22, No. 2.
Thakur, A., et al., "Enhanced Resistance to Spodoptera litura in Endophyte Infected Cauliflower Plants," Environmental Entomology, Apr. 1, 2013, pp. 240-246, vol. 42, No. 2.
Thakur, A., et al., "Suppression of Cellular Immune Response in Spodoptera litura (Lepidoptera: Noctuidae) Larvae by Endophytic Fungi *Nigrospora oryzae* and *Cladosporium uredinicola*,", Annals of the Entomological Society of America, May 1, 2014, pp. 674-679, vol. 107, No. 3.
Theis, K. R., et al., "Uncultured Bacterium Clone GM2GI8201A64RC 16S Ribosomal RNA Gene, Partial Sequence," NCBI GenBank Accession No. JX051943, Submitted May 14, 2012.
Thomas, L., et al., "Development of Resistance to Chlorhexidine Diacetate in Pseudomonas aeruginosa and the Effect of a "Residual" Concentration," J Hosp Infect., 2000, pp. 297-303, vol. 46.
Thomashow, M. F., "So What's New in the Field of Plant Cold Acclimation? Lots!," Plant Physiol., 2001, pp. 89-93, vol. 125.
Tokala, R. T., et al., "Novel Plant-Microbe Rhizosphere Interaction Involving Streptomyces Lydicus WYEC108 and the Pea Plant (*Pisum sativum*)," Applied and Environmental Microbiology, May 2002, pp. 2161-2171, vol. 68, No. 5.
Trichoderma definition, 2016, 6 Pages, [online] [Retrieved on Sep. 16, 2016,] Retrieved from the Internet <URL:https://en.wikipedia.org/wiki/Trichoderma>.
Trotel-Aziz, P., et al., "Characterization of New Bacterial Biocontrol Agents Acinetobacter, Bacillus, Pantoea and *Pseudomonas* spp. Mediating Grapevine Resistance Against Botrytis cinerea," Environmental and Experimental Botany, 2008, pp. 21-32, vol. 64.
Truyens, S., et al., "Changes in the Population of Seed Bacteria of Transgenerationally Cd-Exposed *Arabidopsis thaliana*," Plant Biol., 2013, pp. 971-981, vol. 15.
U'Ren, J.M., et al., "Host and geographic structure of endophytic and endolichenic fungi at the continental scale," American Journal of Botany, May 1, 2012, pp. 898-914, vol. 99, No. 5.

Usadel, B., et al., "The Plant Transcriptome—From Integrating Observations to Models," Front Plant Sci., 2013, pp. 1-3, vol. 4., Article 48, 3 Pages.
Vacheron, J., et al., "Plant Growth-Promoting Rhizobacteria and Root System Functioning," Frontiers Plant Sci., 2013, vol. 4, Article 356, 19 Pages.
Valencia, C. U., et al., "Endophytic Establishment as an Unintended Consequence of Biocontrol with Fungal Entomopathogens," Power Point Presentation dated Jan. 7, 2013, 10 Pages.
Valencia, E., et al., "Mini-review: Brazilian fungi diversity for biomass degradation," Fungal Genetics and Biology, 2013, pp. 9-18, vol. 60.
Van Der Lelie, D., et al., "Poplar and its Bacterial Endophytes: Coexistence and Harmony," Critical Rev Plant Sci., 2009, pp. 346-358, vol. 28.
Verkley, G., et al., "Paraconiothyrium, a new genus to accommodate the mycoparasite *Coniothyrium minitans*, anamorphs of Paraphaeosphaeria, and four new species," Studies in Mycology, 2004, pp. 323-335, vol. 50.
Vining, K., et al., "Methylome Reorganization During in vitro Dedifferentiation and Regeneration of Populus trichocarpa," BMC Plant Biol., 2013, vol. 13, No. 92, 15 Pages.
Viruel, E., et al., "Pseudomonas thiveralensis Strain IEHa 16S Ribosomal RNA Fene, Partial Sequence," NCBI GenBank Accession No. GQ169380.1, Submitted May 15, 2009.
Visagie, C.M., et al., "Identification and nomenclature of the genus *Penicillium*," Studies in Mycology, Jun. 2014, pp. 343-371, vol. 78.
Vujanovic, V., et al., "Viability Testing of Orchid Seed and the Promotion of Colouration and Germination," Annals of Botany, Mar. 17, 2000, pp. 79-86, vol. 86.
Vujanovic, V., et al., "Endophytic hyphal compartmentalization is required for successful mycobiont-wheat interaction as revealed by confocal laser microscopy," The proceedings of the Soils and Crops conference in Saskatoon (2008) published 2009, 7 Pages.
Vujanovic, V., et al., "A comparative study of endophytic mycobiota in leaves of Acer saccharum in eastern North America," Mycological Progress, May 2002, pp. 147-154, vol. 1, Issue 2.
Vujanovic, V., et al.,"Orchid seed viability testing by fungal bioassays and molecular phylogeny," Floriculture, ornamental and plant biotechnology, 2006, vol. 63, pp. 563-569.
Vujanovic, V., et al., "Mycovitality—a new concept of plant biotechnology," Canadian Journal Plant Pathol, 2007, vol. 29, p. 451.
Vujanovic, V., et al., "19th International Conference on *Arabidopsis*. Research Proceedings—ICAR13," Jul. 23-27, 2008, 264 Pages, Montreal, QC, Canada.
Vujanovic, V., et al., "Mycovitality and mycoheterotrophy: where lies dormancy in terrestrial orchid and plants with minute seeds?" Symbiosis, 2007, vol. 44, pp. 93-99.
Vujanovic, V., et al., "Seed endosymbiosis: a vital relationship in providing prenatal care to plants," Can. J. Plant Sci., NRC Research Press, Feb. 6, 2017, pp. 972-981, vol. 97.
Vujanovic, V., et al: "Fungal communities associated with durum wheat production system: A characterization by growth stage, plant organ and preceding crop", Crop Protection, Elsevier Science, GB, vol. 37, Feb. 19, 2012, pp. 26-34.
Waller, F., et al., "The Endophytic Fungus *Piriformospora indica* Reprograms Barley to Salt-Stress Tolerance, Disease Resistance, and Higher Yield," PNAS, 2005, pp. 13386-13391, vol. 102, No. 38.
Wang, B., et al., "Fungal endophytes of native *Gossypium* species in Australia," Mycological Research, 2007, pp. 347-354, vol. 111, No. 3.
Wang, K., et al., "Monitoring in Planta Bacterial Infection at Both Cellular and Whole-Plant Levels Using the Green Fluorescent Protein Variant GFPuv," New Phytol., 2007, pp. 212-223, vol. 174.
Wang, Q., et al., "Naive Bayesian Classifier for Rapid Assignment of rRNA Sequences into the New Bacterial Taxonomy," Appl. Environ. Microbiol., 2007, pp. 5261-5267, vol. 73, No. 16.
Waqas, M., et al., "Endophytic Fungi Produce Gibberellins and Indoleacetic Acid and Promotes Host-Plant Growth during Stress," Molecules, 2012, pp. 10754-10773, vol. 17.
Weaver, P.F., et al., "Characterization of Rhodopseudomonas capsulata," Arch Microbiol., 1975, pp. 207-216, vol. 105.

(56) References Cited

OTHER PUBLICATIONS

Weindling, R., "Relation of dosage to control of cotton seedling diseases by seed treatment," Plant Disease Reporter, 1943, 27, pp. 68-70.
Welty, R.E., et al., "Influence of Moisture Content, Temperature, and Length of Storage on Seed Germination and Survival of Endophytic Fungi in Seeds of Tall Fescue and Perennial Ryegrass," Phytopathyol., 1987, pp. 893-900, vol. 77, No. 6.
White, J. F., et al., "A Proposed Mechanism for Nitrogen Acquisition by Grass Seedlings Through Oxidation of Symbiotic Bacteria," Symbiosis, 2012, pp. 161-171, vol. 57.
Wiegand, I., et al., "Agar and Broth Dilution Methods to Determine the Minimal Inhibitory Concentration (MIC) of Antimicrobial Substances," Nature Protocols, 2008, pp. 163-175, vol. 3, No. 2.
Xu, M., et al., "Bacterial Community Compositions of Tomato (*Lycopersicum esculentum* Mill.) Seeds and Plant Growth Promoting Activity of ACC Deaminase Producing Bacillus subtilis (HYT-12-1) on Tomato Seedlings," World J Microbiol Biotechnol., 2014, pp. 835-845, vol. 30.
Xu, Y., et al., "Biosynthesis of the Cyclooligomer Despipeptide bassianolide, an Insecticidal Virulence Factor of Beauveria bassiana," Fungal Genetics and Biology, 2009, pp. 353-364, vol. 46.
Xue, Q.Y., et al., "Evaluation of the Strains of Acinetobacter and Enterobacter as potential Biocontrol Agents Against Ralstonia Wilt of Tomato," Biological Control, 2009, vol. 48, pp. 252-258.
Yandigeri, M. S., et al., "Drought-tolerant endophytic actinobacteria promote growth of wheat (*Triticum aestivum*) under water stress conditions," Plant Growth Regulation, 2012, pp. 411-420, vol. 68.
Yennamalli, R., et al., "Endoglucanases: insights into thermostability for biofuel applications", Biotech Biofuels, 2013, vol. 6, Issue 136, pp. 1-9.
Yezerski, A., et al., "The Effects of the Presence of Stored Product Pests on the Microfauna of a Flour Community," Journal of Applied Microbiology, 2005, pp. 507-515, vol. 98.
You, Y., et al., "Analysis of Genomic Diversity of Endophytic Fungal Strains Isolated from the Roots of Suaeda japonica and S. maritima for the Restoration of Ecosystems in Buan Salt Marsh," Korean Journal of Microbiology and Biotechnology, 2012, pp. 287-295, vol. 40, No. 4. (with English Abstract).
Youssef, Y.A., et al., "Production of Plant Growth Substances by Rhizosphere Myoflora of Broad Bean and Cotton," Biologia Plantarum, 1975, pp. 175-181, vol. 17, No. 3.
Zhang, Y., et al., BcGs1, a glycoprotein from Botrytis cinerea, elicits defence response and improves disease resistance in host plants. Biochemical and biophysical research communications, Biochemical and Biophysical Research Communications, 2015, vol. 457, No. 4, pp. 627-634.
Zhang, W., et al., Host range of Exserohilum monoceras, a potential bioherbicide for the control of *Echinochloa* species, Canadian Journal of Botany/ Journal Canadien de Botan, National Research Council, Ottawa, CA, vol. 75, Jan. 1, 1997, pp. 685-692.
Zhang, J., et al: "Isolation and Characterization of Plant Growth-Promoting Rhizobacteria from Wheat Roots by Wheat Germ Agglutinin Labeled with Fluorescein Isothiocyanate", The Journal of Microbiology, Apr. 27, 2012, vol. 50, No. 2, pp. 191-198, GenBank Accession No. JN210900.
Zhao, J.H., et al., "Bioactive secondary metabolites from *Nigrospora* sp. LLGLM003, an endophytic fungus of the medicinal plant *Moringa oleifera* Lam." World Journal of Microbiology and Biotechnology, Kluwer Academic Publishers, Feb. 12, 2012, pp. 2107-2112, vol. 28, No. 5.
Zhou, W., et al., "Effects of the Fungal Endophyte *Paecilomyces* sp. in Cotton on the Roo-Knot Nematode Meloidogyne incognita," poster dated Jan. 7, 2013.
Zhu et al., Helminthosporium velutinum and *H. aquaticum* sp. nov. from aquatic habitats in Yunnan Province, China. Phytotaxa, 2016, vol. 253, No. 3, pp. 179-190.
Zimmerman, N.B., et al., "Fungal Endophyte Communities Reflect Environmental Structuring Across a Hawaiian Landscape," Proc Natl Acad Sci USA, 2012, pp. 13022-13027, vol. 109, No. 32.
Zuccaro, A., et al., "Endophytic Life Strategies Decoded by Genome and Transcriptome Analyses of the Mutualistic Root Symbiont Piriformospora indica," PLOS Pathogens, 2011, vol. 7, No. 10, e1002290.
Zuniga, A., et al., "Quorum Sensing and Indole-3-Acetic Acid Degradation Play a Role in Colonization and Plant Growth Promotion of *Arabidopsis thaliana* by Burkholderia phytofirmans PsJN," Mol Plant Microbe Interact., 2013, pp. 546-553, vol. 26, No. 5.
Antony-Badu, S., et al., "Multiple *Streptomyces* species with distinct secondary metabolomes have identical 16S rRNA gene sequences." Scientific Reports 7.1, Sep. 2017, No. 7, 11089, pp. 1-8.
Artursson, V., et al., "Interactions between arbuscular mycorrhizal fungi and bacteria and their potential for stimulating plant growth", Environmental Microbiology, vol. 8, No. 1, Jan. 1, 2006, pp. 1-10.
Azcon, R., et al., "Selective interactions between different species of mycorrhizal fungi and Rhizobium meliloti strains, and their effects on growth, N2-fixation (15N) and nutrition of Medicago sativa L.," New PhytoL., 1991, vol. 117, pp. 399-404.
NCBI GenBank: Accession No. JX880250.1, "Enterobacteriaceae bacterium Clerol 16S ribosomal RNA gene, partial sequence," NIH, Jun. 24, 2015, 2 Pages, can be retreived at <URL:https://www.ncbi.nlm.nih.gov/nucleotide/JX880250.1?report=genbank&log$=nuclalign&blast_rank=80&RID=KWUPBV08015>.
NCBI, GenBank Accession No. KX641980.1, Jul. 29, 2017, Scott, M., et al., "*Dothideomycetes* sp. isolate FT14-6 internal transcribed spacer 1, partial sequence; 5.8S ribosomal RNA gene and internal transcribed spacer 2, complete sequence; and large subunit ribosomal RNA gene, partial sequence," 2 Pages, Can be retrieved at <URL:https://www.ncbi.nlm.nih.gov/nuccore/KX641980>.
Fox, G., et al., "How close is close: 16S rRNA sequence identity may not be sufficient to guarantee species identity." International Journal of Systematic and Evolutionary Microbiology 42.1, 1992, pp. 166-170.
Kanbar, A., et al., "Relationship between Root and Yield Morphological Characters in Rainfed Low Land Rice (*Oryza sativa* L.)," Cereal Research Communications, 2009, vol. 37, No. 2, pp. 261-268.
Sarkar, S., et al., "New report of additional enterobacterial species causing wilt in West Bengal, India," Canadian Journal of Microbiology, 2015, vol. 61, No. 7, pp. 477-486.
Bently, S.D., et al, "Complete genome sequence of the model actinomycete *Streptomyces* coelicolor A3(2)," Nature. May 9, 2002;417(6885):141-7. (Year: 2002).
Gabor, J., et al., "Mycorrhizal fungi effects on nutrient composition and yield of soybean seeds," Journal of Plant Nutrition, 20:4-5, 581-591, 1997.
Gopalakrishnan, S. et al., "Plant growth-promoting activities of *Streptomyces* spp. In sorghum and rice", SpringerPlus, 2/1/574, pp. 1-8, http://www.springerplus.com/content/2/1/574, 2013.
Groppe, K., et al., "Interaction between the endophytic fungus *Epichloë bromicola* and the grass *Bromus erectus*: effects of endophyte infection, fungal concentration and environment on grass growth and flowering," Mol Ecol., 8:1827-1835, 1999.
Hubbard, M., "Fungal Endophytes that Confer Heat and Drought Tolerance to Wheat," Doctoral dissertation, University of Saskatchewan, 2012.
Ikeda, H., et al., "Complete genome sequence and comparative analysis of the industrial microorganism *Streptomyces* avermitilis," Nat Biotechnol. May 2003;21 (5) :526-31. Epub Apr. 14, 2003. (Year: 2003).
Langille, M., et al., "Predictive functional profiling of microbial communities, using 16S rRNA marker gene sequences", Nature Biotechnology, vol. 31, No. 9, Sep. 2013, 11 pages.
Lee, J., et al., "*Streptomyces koyangensis* sp. nov., a novel actinomycete that produces 4-phenyl-3-butenoic acid," Int J Syst Evol Microbial. Jan. 2005;55(Pt 1):257-62. (Year: 2005).
Pacovsky, R., "Carbohydrate, protein and amino acid status of Glycine-Glomus-Bradyrhizobium symbioses," Physiologia Pantarium; 75:346-354, 1989).
Wiebold, M., et al., "Agriculture Experiment Station, College of Agriculture, Food & Natural Resources, University of Missouri, Special Report 589, pp. 1-124)."

(56) References Cited

OTHER PUBLICATIONS

Govindarajan, M. et al., "Effects of the Inoculation of Burkholderia vietnamensis and Related Endophytic Diaztrophic Bacteria on Grain Yield of Rice", Mircobial Ecology, Apr. 4, 2007, 17 pages.

Lind, A., et al., "Drivers of genetic diversity in secondary metabolic gene clusters within a fungal species", PLOS Biology, Nov. 17, 2017, 26 pages.

Sha, T. et al., "Genetic diversity of the endemic gourmet mushroom *Thelephora ganbajun* from southwestern China", Microbiology (2008), 154, 3460-3468.

Sugita, T. et al., "Intraspecies Diversity of Cryptococcus laurentii as Revealed by Sequences of Internal Transcribed Spacer Regions and 28S rRNA Gene and Taxonomic Position of C. laurentii Clinical Isolates", Journal of Clinical Microbiology, Apr. 2000, p. 1468-1471.

Chaves, J., et al., "Identification and Phylogeny of Streptomyces Based on Gene Sequences", Research Journal of Microbiology, vol. 13, No. 1, Dec. 15, 2017, pp. 13-20, XP055675917.

Girard, G., et al., "A novel taxonomic marker that discriminates between morphologically complex actinomycetes", Open Biology, vol. 3, No. 10, Oct. 2013, p. 130073, XP055675916.

Guo, Y., et al. "A multi locus phylogeny of the Streptomyces griseus 16S rRNA gene Glade: use of multilocus sequence analysis for streptomycete systematics", International Journal of Systematic and Evolutionary Microbiology, vol. 58, No. 1, 2008, pp. 149-159, XP055675936.

\* cited by examiner

FIG. 1: Culture plate of Strain A
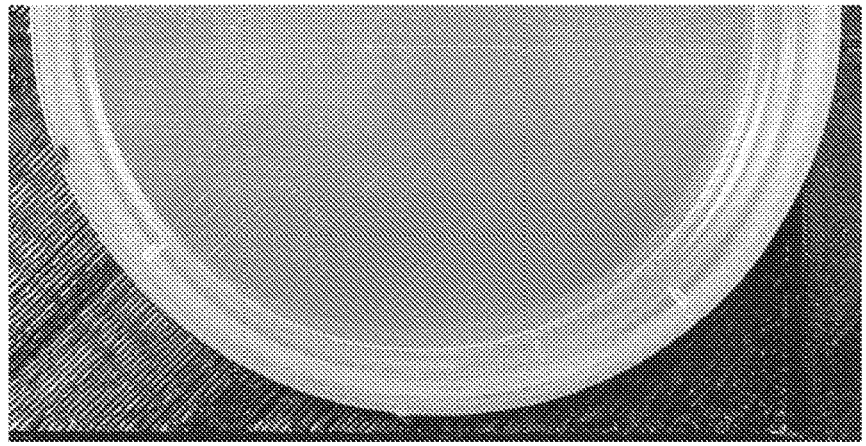
FIG. 2: Culture plate of Strain B
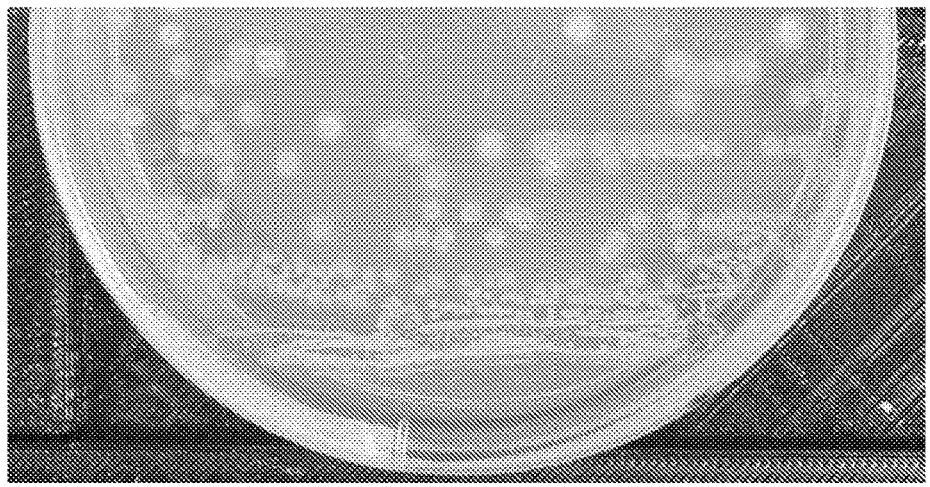
FIG. 3: Culture plate of Strain C
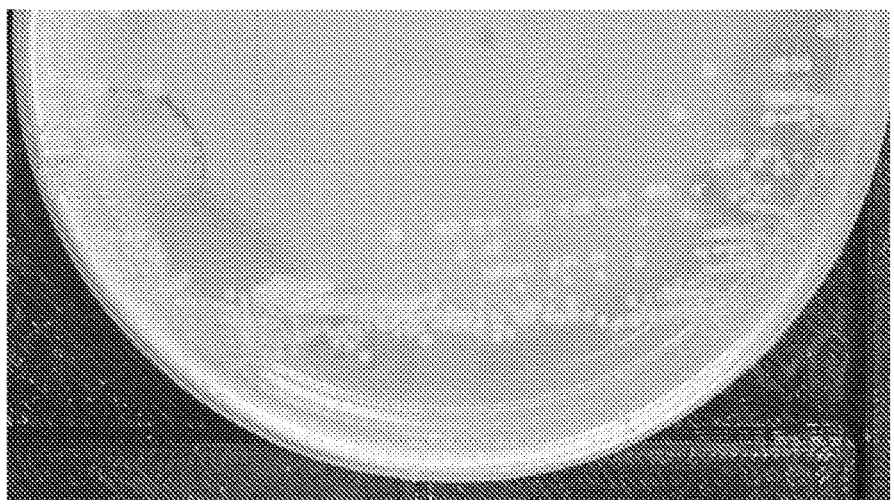

FIG. 4: Greenhouse phenotypes of Strain C-treated plants under normal watering conditions
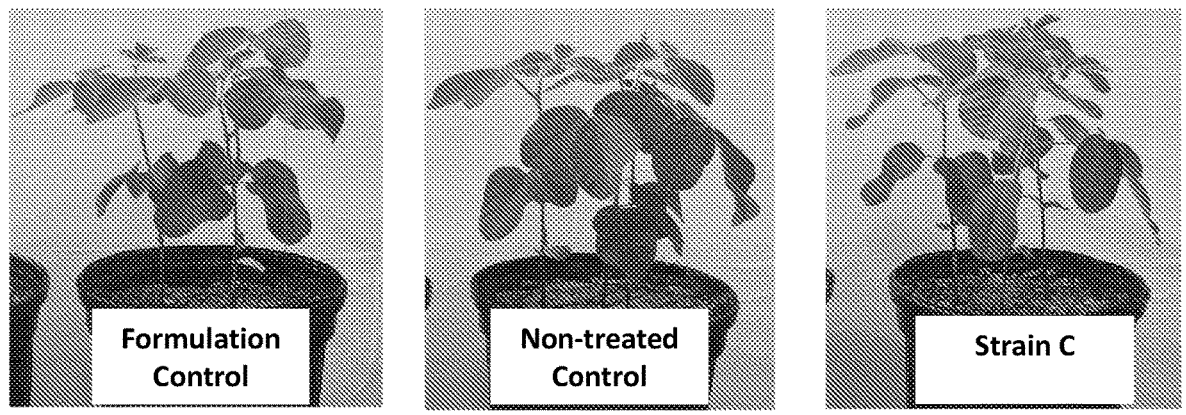
FIG. 5: Greenhouse phenotypes of Strain C-treated plants under water-limited conditions
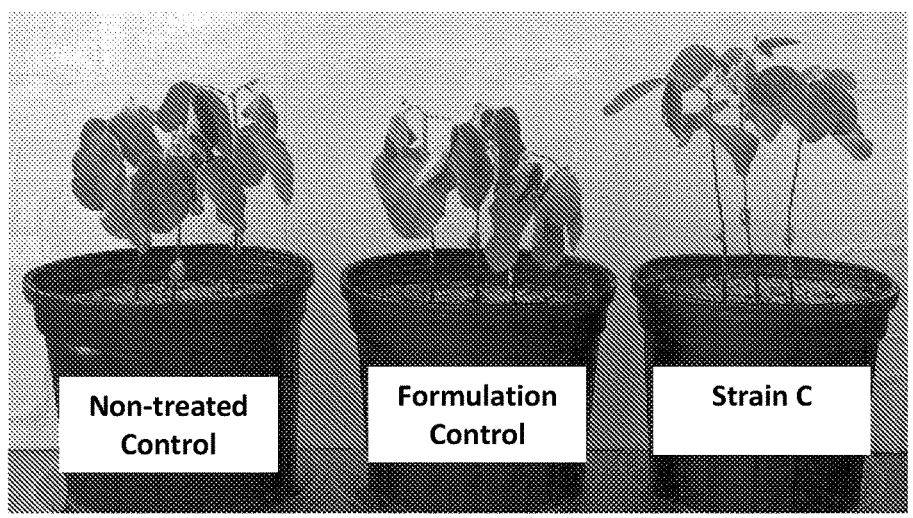

FIG. 6: Greenhouse phenotypes of plants grown from seeds treated with *Streptomyces* strains
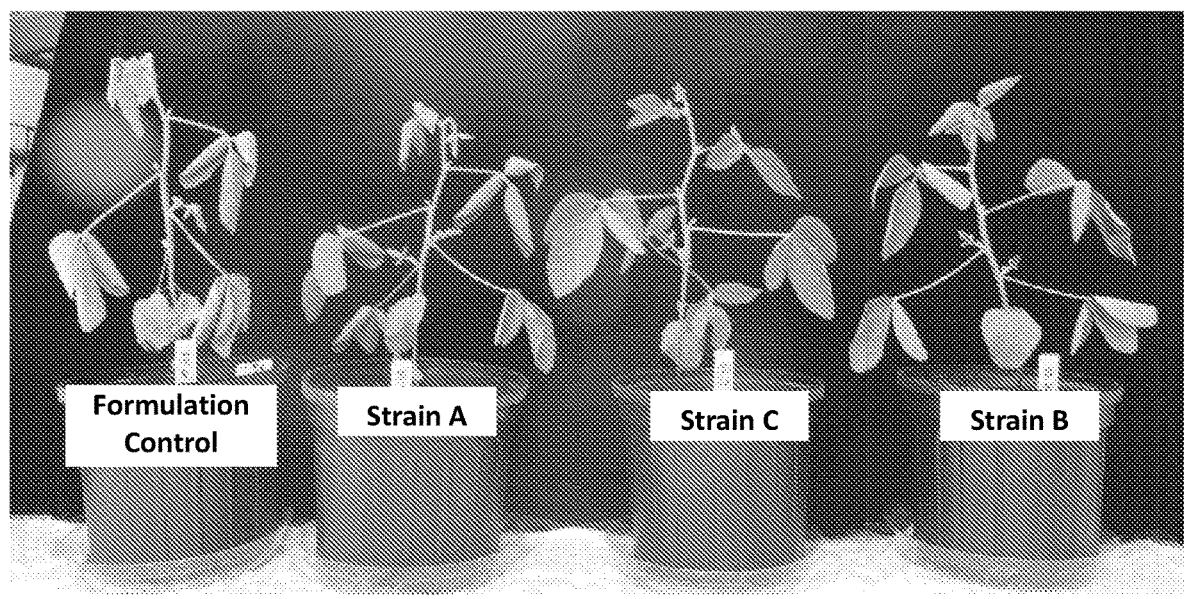

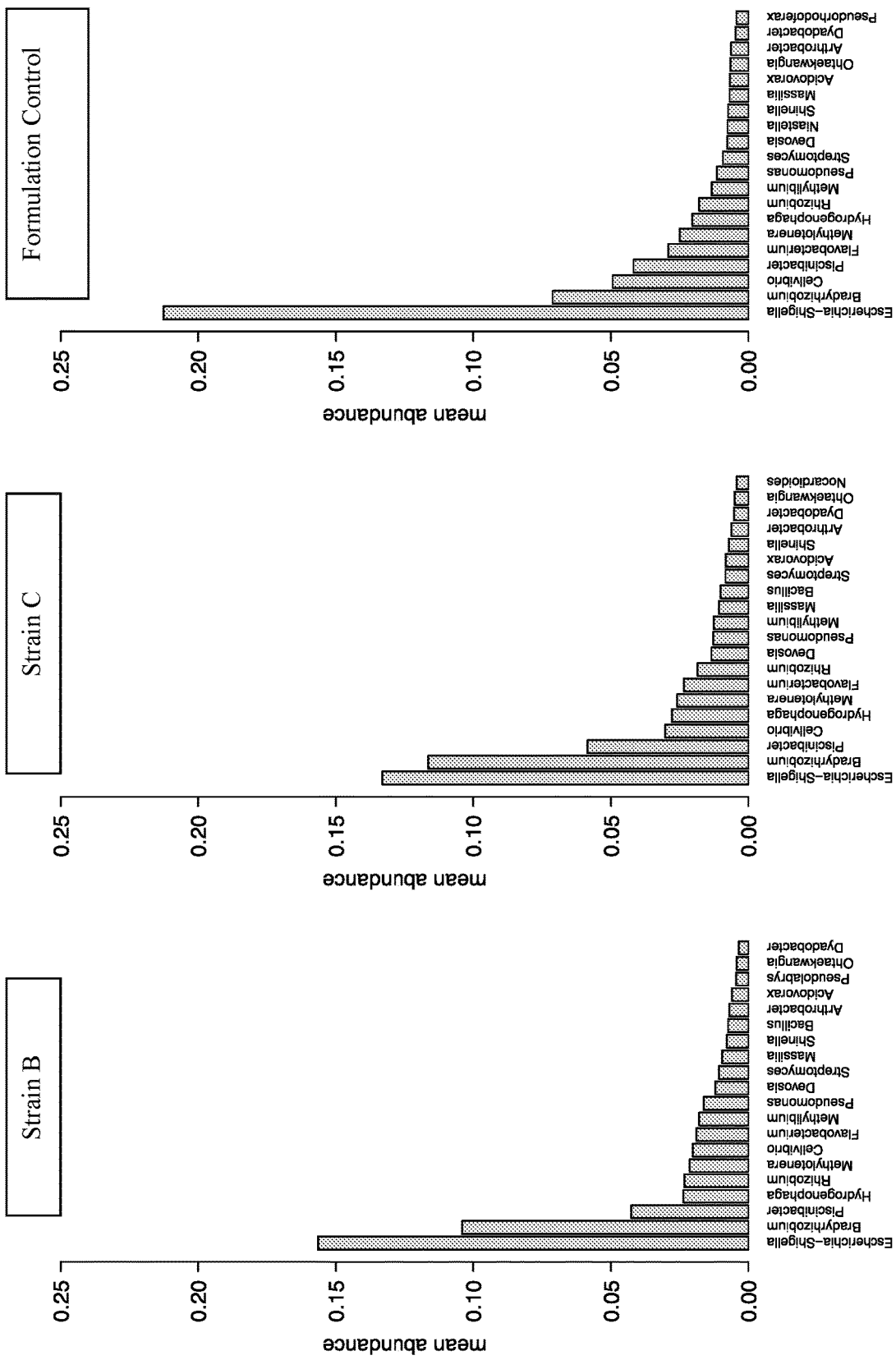
FIG. 7: Community Sequencing

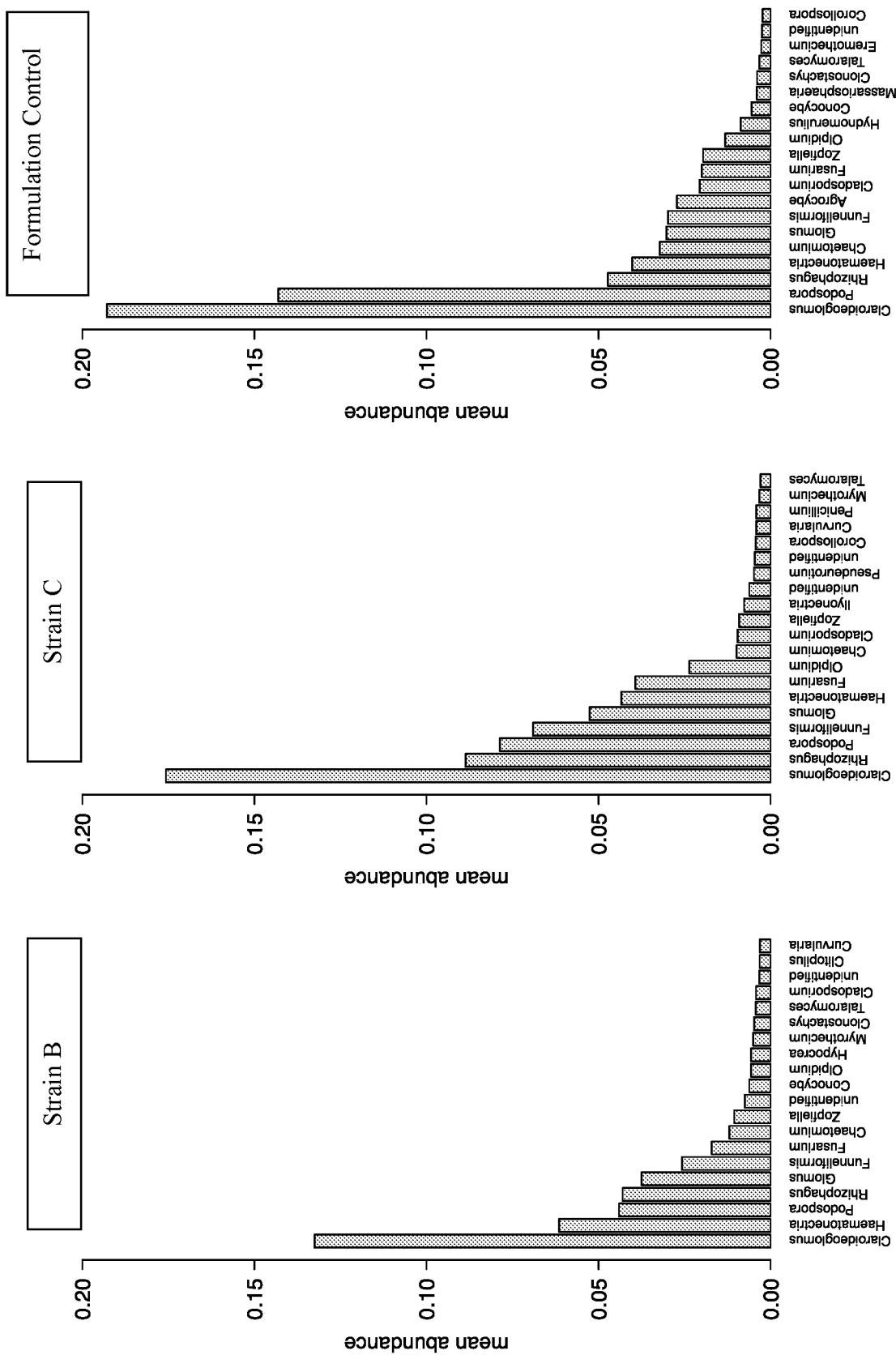
FIG. 8: Community Sequencing

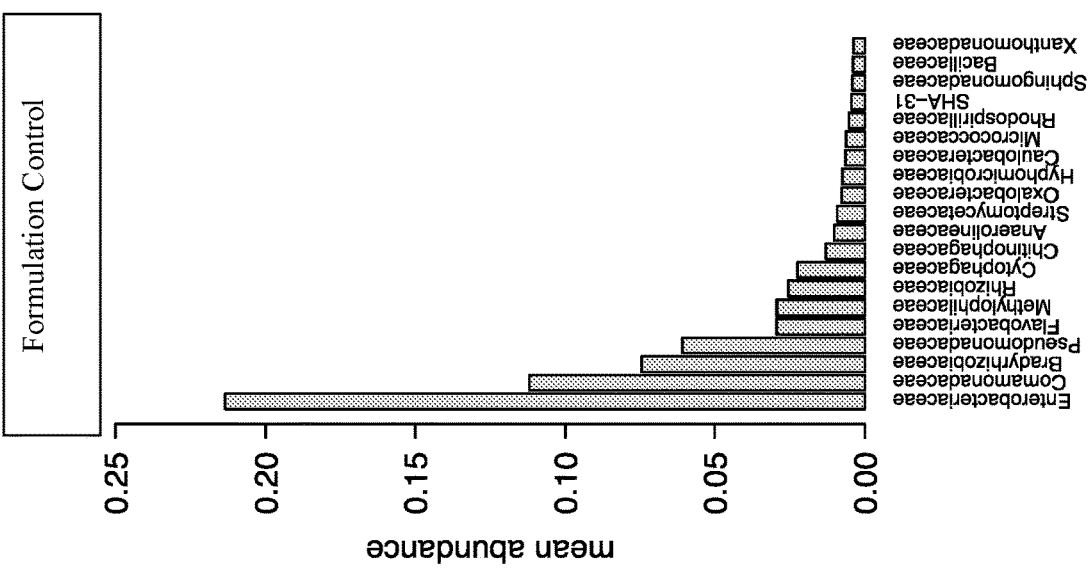
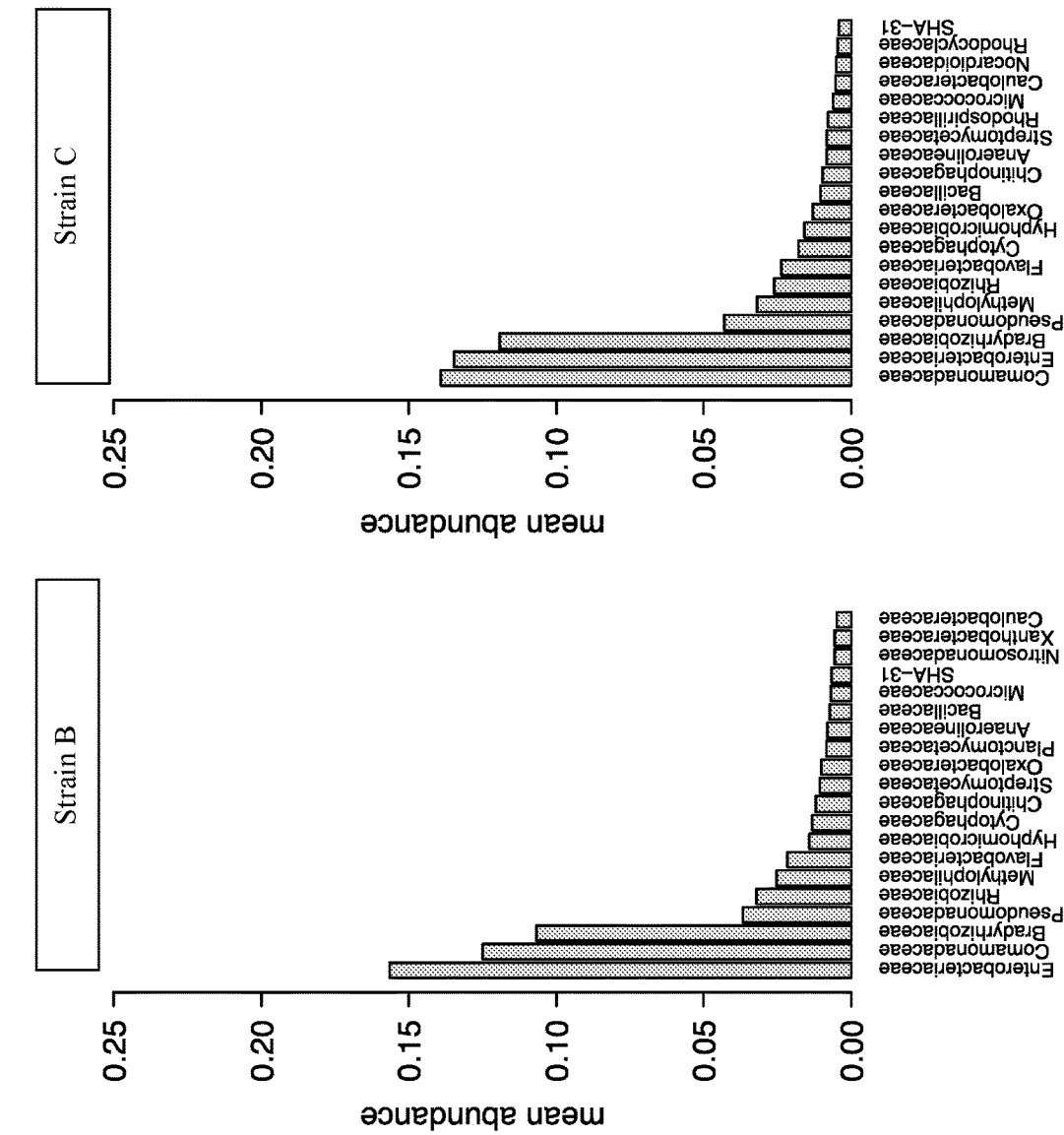
FIG. 9: Community Sequencing

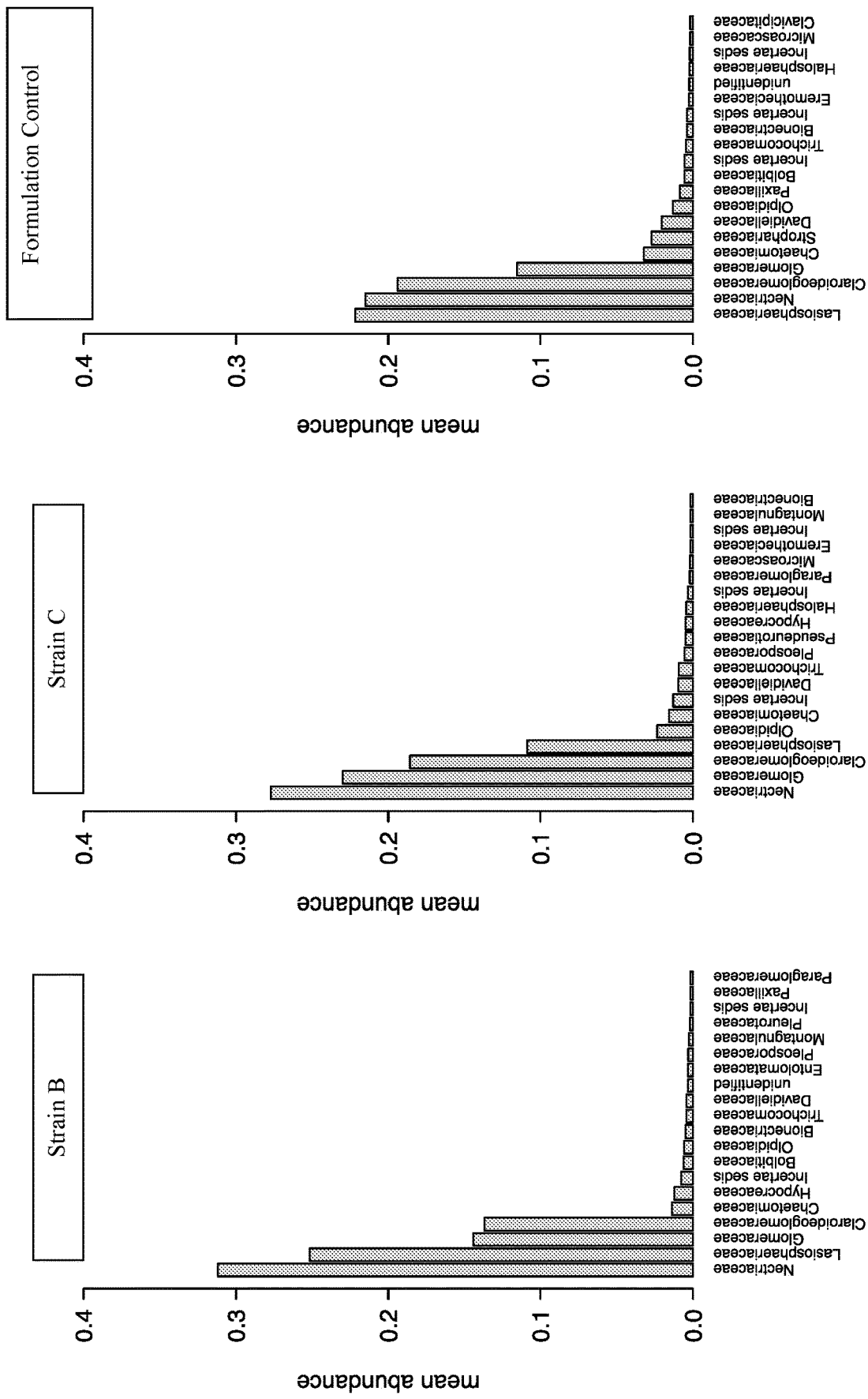
FIG. 10: Community Sequencing

STREPTOMYCES ENDOPHYTE COMPOSITIONS AND METHODS FOR IMPROVED AGRONOMIC TRAITS IN PLANTS

CROSS-REFERENCE TO RELATED APPLICATIONS

This application is the National Stage of International Application No. PCT/US2016/036504, filed 8 Jun. 2016, which claims the benefit of and priority to U.S. Provisional Application No. 62/172,748 filed 8 Jun. 2015, and of U.S. Provisional No. 62/172,750 filed on 8 Jun. 2015, and of U.S. Provisional Application No. 62/172,755 filed on 8 Jun. 2015, and of U.S. Provisional Application No. 62/316,386 filed on 31 Mar. 2016, all of which are hereby incorporated by reference in their entireties.

SEQUENCE LISTING

The instant application includes a Sequence Listing with 4779 sequences which has been submitted via EFS-Web and is hereby incorporated by reference in its entirety. Said ASCII copy, created on Jun. 8, 2016, is named 33897PCT_sequencelisting.txt, and is 8.83 MB in size.

FIELD OF THE INVENTION

This invention relates to compositions and methods for improving the cultivation of plants, particularly agricultural plants, such as soybeans and maize. For example, this invention describes bacteria, such as strains of the genus *Streptomyces*, that are capable of living in or otherwise associated with a plant, which may be used to impart improved agronomic traits to plants. The disclosed invention also describes methods of improving plant characteristics by introducing bacteria to those plants. Further, this invention also provides methods of treating seeds and other plant elements with *Streptomyces* bacteria that are capable of living within or otherwise associated with a plant, to impart improved agronomic characteristics to plants, particularly agricultural plants, for example soybeans or maize.

BACKGROUND OF THE INVENTION

According the United Nations Food and Agricultural Organization (UN FAO), the world's population will exceed 9.6 billion people by the year 2050, which will require significant improvements in agricultural to meet growing food demands. At the same time, conservation of resources (such as water, land), reduction of inputs (such as fertilizer, pesticides, herbicides), environmental sustainability, and climate change are increasingly important factors in how food is grown. There is a need for improved agricultural plants and farming practices that will enable the need for a nearly doubled food production with fewer resources, more environmentally sustainable inputs, and with plants with improved responses to various biotic and abiotic stresses (such as pests, drought, disease).

Today, crop performance is optimized primarily via technologies directed towards the interplay between crop genotype (e.g., plant breeding, genetically-modified (GM) crops) and its surrounding environment (e.g., fertilizer, synthetic herbicides, pesticides). While these paradigms have assisted in doubling global food production in the past fifty years, yield growth rates have stalled in many major crops and shifts in the climate have been linked to production instability and declines in important crops, driving an urgent need for novel solutions to crop yield improvement. In addition to their long development and regulatory timelines, public fears of GM-crops and synthetic chemicals have challenged their use in many key crops and countries, resulting in a lack of acceptance for many GM traits and the exclusion of GM crops and many synthetic chemistries from some global markets. Thus, there is a significant need for innovative, effective, environmentally-sustainable, and publically-acceptable approaches to improving the yield and resilience of crops to stresses.

Improvement of crop resilience to biotic and abiotic stresses has proven challenging for conventional genetic and chemical paradigms for crop improvement. This challenge is in part due to the complex, network-level changes that arise during exposure to these stresses.

Like humans, who utilize a complement of beneficial microbial symbionts, plants have been purported to derive a benefit from the vast array of bacteria and fungi that live both within and around their tissues in order to support the plant's health and growth. Endophytes are symbiotic organisms (typically bacteria or fungi) that live within plants, and inhabit various plant tissues, often colonizing the intercellular spaces of host leaves, stems, flowers, fruits, seeds, or roots. To date, a small number of symbiotic endophyte-host relationships have been analyzed in limited studies to provide fitness benefits to model host plants within controlled laboratory settings, such as enhancement of biomass production (i.e., yield) and nutrition, increased tolerance to stress such as drought and pests. There is still a need to develop better plant-endophyte systems to confer benefits to a variety of agriculturally-important plants such as soybean and maize, for example to provide improved yield and tolerance to the environmental stresses present in many agricultural situations for such agricultural plants.

Thus, there is a need for compositions and methods of providing agricultural plants with improved yield and tolerance to various biotic and abiotic stresses. Provided herein are novel compositions including bacteria that are capable of living within a plant, formulations comprising these compositions for treatment of plants and plant elements, and methods of use for the same, created based on the analysis of the key properties that enhance the utility and commercialization of an endophyte composition.

SUMMARY OF THE INVENTION

In an aspect, the invention provides a method for preparing a plant reproductive element composition, comprising contacting the surface of a plant reproductive element of a plant with a formulation comprising a purified microbial population that comprises a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO: 2 through SEQ ID NO:18. In another aspect, the invention provides a method for preparing a plant reproductive element composition, comprising contacting the surface of a plant reproductive element of a plant with a formulation comprising a purified microbial population that comprises a *Streptomyces* endophyte that is heterologous to the plant reproductive element and comprises a strain deposit IDAC Deposit ID 081111-06. In yet another aspect, the invention provides a method for preparing a plant reproductive element composition, comprising contacting the surface of a plant reproductive element of a plant with a formulation comprising a purified microbial population that comprises a *Streptomyces* endophyte that is heterologous to the plant reproductive element and comprises a *Streptomyces* species selected from the group consisting of: *albidoflavus, albus, aureofaciens, ginsengisoli, griseus, lydicus, mutabilis, neyagawaensis, praecox*, and SMCD2215; wherein in any of the preceding methods the endophyte is present in the formulation in an amount capable of modulating at least one of: trait of agronomic importance, transcription of a gene, level of a transcript, the expression of a protein, level of a hormone, level of a metabolite, and population of endogenous microbes; in plants grown from the plant reproductive elements, as compared to isoline plants grown from plant reproductive elements not contacted with the formulation.

In certain aspects the invention provides for any of the preceding methods, wherein the *Streptomyces* endophyte is optionally present in the plant reproductive element in an amount capable of providing a benefit to a plant derived from the plant reproductive element, as compared to a plant derived from a plant reproductive element not treated with said *Streptomyces* endophyte.

An embodiment of the invention is a plant derived from the composition of any of the preceding methods, wherein the plant comprises in at least one of its plant elements said *Streptomyces* endophyte. Another embodiment of the invention comprises the progeny of the plant derived from the composition of any of the preceding methods, wherein the progeny comprises in at least one of its plant elements the *Streptomyces* endophyte.

Another embodiment of the invention is a plurality of plant reproductive element compositions prepared according to any of the proceeding methods, wherein the compositions are confined within an object selected from the group consisting of: bottle, jar, ampule, package, vessel, bag, box, bin, envelope, carton, container, silo, shipping container, truck bed, and case.

In an aspect, the invention provides a method of modulating a trait of agronomic importance in a plant derived from a plant reproductive element, comprising treating the plant reproductive element with a formulation comprising a *Streptomyces* endophyte that comprises at least 2× higher acetoin production as compared to the strain represented by SEQ ID NO: 1. In an aspect, the invention provides a method of modulating a trait of agronomic importance in a plant derived from a plant reproductive element, comprising treating the plant reproductive element with a formulation comprising a *Streptomyces* endophyte that comprises at least 1.5× higher siderophore production as compared to the strain represented by SEQ ID NO: 1. In an aspect, the invention provides a method of modulating a trait of agronomic importance in a plant derived from a plant reproductive element, comprising treating the plant reproductive element with a formulation comprising a *Streptomyces* endophyte that comprises greater utilization of a primary carbon source selected from the group consisting of: D-Galactose, Glycerol, alpha-D-Glucose, Sucrose, beta-methyl-D-glucoside, D-cellobiose, L-alanine, L-alanyl-glycine, mono methyl succinate, glycyl-L-proline, L-lyxose, as compared to the strain represented by SEQ ID NO: 1. In an aspect, the invention provides a method of modulating a trait of agronomic importance in a plant derived from a plant reproductive element, comprising treating the plant reproductive element with a formulation comprising a *Streptomyces* endophyte that secretes at least one protein listed in Table 5C with at least a 0.4× higher rate, as compared to the strain represented by SEQ ID NO: 2. In an aspect, the invention provides a method of modulating a trait of agronomic importance in a plant derived from a plant reproductive element, comprising treating the plant reproductive element with a formulation comprising a *Streptomyces* endophyte that secretes at least one protein selected listed in Table 5D with at least a 0.7× lower rate, as compared to the strain represented by SEQ ID NO: 2. In an aspect, the invention provides a method of modulating a trait of agronomic importance in a plant derived from a plant reproductive element, comprising treating the plant reproductive element with a formulation comprising a *Streptomyces* endophyte that comprises at least 3 arabinose transporter genes in its genome. In another aspect, the invention provides a method of modulating a trait of agronomic importance in a plant derived from a plant reproductive element, comprising treating the plant reproductive element with a formulation comprising a *Streptomyces* endophyte that secretes at least one protein selected from Table 5A. In yet another aspect, the invention provides a method of modulating a trait of agronomic importance in a plant derived from a plant reproductive element, comprising treating the plant reproductive element with a formulation comprising a *Streptomyces* endophyte that does not secrete a protein selected from the proteins listed in Table 5B.

In an aspect, the invention also provides a method of using a beneficial *Streptomyces* endophyte that confers a trait of agronomic importance to a plant, wherein the endophyte comprises at least 97% identity to at least 600 nucleotides of SEQ ID NO: 3. In another aspect, the invention also provides a method of using a beneficial *Streptomyces* endophyte that confers a trait of agronomic importance to a plant, wherein said endophyte comprises at least 2× higher acetoin production as compared to the strain represented by SEQ ID NO: 1. In an aspect, the invention provides a method of using a beneficial *Streptomyces* endophyte that confers a trait of agronomic importance to a plant, wherein the endophyte comprises at least 1.5× higher siderophore production as compared to the strain represented by SEQ ID NO: 1. In another aspect, the invention provides a method of using a beneficial *Streptomyces* endophyte that confers a trait of agronomic importance to a plant, wherein the endophyte comprises greater utilization of a primary carbon source selected from the group consisting of: D-Galactose, Glycerol, alpha-D-Glucose, Sucrose, beta-methyl-D-glucoside, D-cellobiose, L-alanine, L-alanyl-glycine, mono methyl succinate, glycyl-L-proline, L-lyxose, as compared to the strain represented by SEQ ID NO: 1. In an aspect, the invention provides a method of using a beneficial *Streptomyces* endophyte that confers a trait of agronomic importance to a plant, wherein the endophyte secretes at least one protein listed in Table 5C with at least a 0.4× higher rate, as compared to the strain represented by SEQ ID NO: 2. In an aspect, the invention provides a method of using a beneficial *Streptomyces* endophyte that confers a trait of agronomic importance to a plant, wherein the endophyte secretes at least one protein listed in Table 5D with at least a 0.7× lower rate, as compared to the strain represented by SEQ ID NO: 2. In an aspect, the invention provides a method of using a beneficial *Streptomyces* endophyte that confers a trait of agronomic importance to a plant, wherein the endophyte comprises at least 3 arabinose transporter genes in its genome. In another aspect, the invention provides a method of using a beneficial *Streptomyces* endophyte that confers a trait of agronomic importance to a plant, wherein the endophyte secretes at least one protein selected from Table 5A. In yet another aspect, the invention provides a method of using a beneficial *Streptomyces* endophyte that confers a trait of agronomic importance to a plant, wherein the endophyte does not secrete a protein selected from the proteins listed in Table 5B.

In a certain aspect, the invention provides a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO: 2 through SEQ ID NO:18, and modulating at least one characteristic of said plant as compared to an isoline plant not grown from reproductive elements treated with said *Streptomyces* endophyte, wherein the characteristic comprises modulation of transcription of at least one gene involved in a pathway selected from the group consisting of: symbiosis enhancement, resistance to biotic stress, resistance to abiotic stress, growth promotion, cell wall composition, and developmental regulation. In an aspect, the invention provides a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO: 2 through SEQ ID NO:18, and modulating at least one characteristic of said plant as compared to an isoline plant not grown from reproductive elements treated with said *Streptomyces* endophyte, wherein the characteristic comprises modulation of at least one hormone involved in a pathway selected from the group consisting of: developmental regulation, seed maturation, dormancy, response to environmental stresses, stomatal closure, expression of stress-related genes, drought tolerance, defense responses, infection response, pathogen response, disease resistance, systemic acquired resistance, transcriptional reprogramming, mechanical support, protection against biotic stress, protection against abiotic stress, signaling, nodulation inhibition, endophyte colonization, fatty acid deoxygenation, wound healing, antimicrobial substance production, metabolite catabolism, cell proliferation, and abscission. In another aspect, the invention provides a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO: 2 through SEQ ID NO:18, and modulating at least one characteristic of said plant as compared to an isoline plant not grown from reproductive elements treated with said *Streptomyces* endophyte, wherein the characteristic comprises modulation of at least one metabolite in at least one of the following plant metabolic pathways: alkaloid metabolism, phenylpropanoid metabolism, flavonoid biosynthesis, isoflavonoid biosynthesis, lipid metabolism, nitrogen metabolism, and carbohydrate metabolism. In yet another aspect, the invention provides a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO: 2 through SEQ ID NO:18, and modulating at least one characteristic of said plant as compared to an isoline plant not grown from reproductive elements treated with said *Streptomyces* endophyte, wherein the characteristic comprises modulation of at least one transcript involved in at least one of the following pathways: symbiosis enhancement, resistance to biotic stress, resistance to abiotic stress, growth promotion, cell wall composition, and developmental regulation.

In an embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises upregulation of at least one gene in root tissue, selected from the upregulated genes listed in Table 8A. In an embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises upregulation of at least one gene in leaf tissue, selected from the upregulated genes listed in Table 8A. In another embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises upregulation of at least one gene in stem tissue, selected from the upregulated genes listed in Table 8A. In an embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises downregulation of at least one gene in root tissue, selected from the downregulated genes listed in Table 8A. In an embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises downregulation of at least one gene in leaf tissue, selected from the downregulated genes listed in Table 8A. In another embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises downregulation of at least one gene in stem tissue, selected from the downregulated genes listed in Table 8A. In another embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises an increase in hormone level in root tissue, selected from the group consisting of: abscisic acid, salicylic acid, cinnaminic acid, traumatic acid. In another embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises a decrease in hormone level in root tissue, selected from the group consisting of: jasmonic acid, jasmonic acid-isoleucine, 12-oxo-phytodienoic acid, 10-oxo-11 phytoenoic acid. In another embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises an increase in hormone level in stem tissue, selected from the group consisting of: jasmonic acid, jasmonic acid-isoleucine, traumatic acid, 12-oxo-phytodienoic acid. In another embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises a decrease in hormone level in stem tissue, selected from the group consisting of: abscisic acid, salicylic acid, cinnaminic acid, 10-oxo-11 phytoenoic acid. In another embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises an increase in hormone level in leaf tissue, selected from the group consisting of: abscisic acid, salicylic acid, cinnaminic acid, jasmonic acid, jasmonic acid-isoleucine, traumatic acid. In an embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises a decrease in hormone level in leaf tissue, selected from the group consisting of: 12-oxo-phytodienoic acid, 10-oxo-11 phytoenoic acid. In another embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises an increase in metabolite level in root tissue, selected from the group consisting of: pipecolic acid, octadecanoic acid. In another embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises a decrease in metabolite level in root tissue, selected from the group consisting of: aspartic acid, glutamic acid, histidine, serine, D-glucopyranose, galactose, galacturonic acid. In another embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises an increase in metabolite level in stem tissue, selected from the group consisting of: galactose, tryptophan, caffeic acid, daidzein, allantoin, glutamine, isoleucine, leucine, proline, tryptophan, trehalose. In another embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises a decrease in metabolite level in stem tissue, selected from the group consisting of: ethanolaminephosphate, hexadecanoic acid, asparagine. In an embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises an increase in metabolite level in leaf tissue, selected from the group consisting of: ethanolaminephosphate, hexadecanoic acid, asparagine, galactose, tryptophan, daidzein, allantoin, glutamine, isoleucine, leucine, proline, tryptophan, trehalose, histidine, D-glucopyranose, octadecanoic acid, phenylalanine, tyrosine, benzoic acid, nicotinic acid, phenylalanine, shikimic acid, quinic acid, sinapic acid, quinic acid, shikimic acid, hesperetin, ethanolamine, sphingosine, glycerol, octadecadienoic acid, dodecanol, campesterol, alanine, phenylalanine, threonine, tyrosine, valine, lyxose, threose, xylose, salicylic acid, vanillic acid, beta tocopherol. In an embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises a decrease in metabolite level in leaf tissue, selected from the group consisting of: sucrose, pyrogallol, lumichrome. In another embodiment, the invention provides for a method of modulating a trait of agronomic importance in a plant derived from a plant reproductive element under normal watering conditions, comprising treating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from reproductive elements treated with said *Streptomyces* endophyte, wherein the characteristic comprises an enrichment of at least one gene described in Table 15A, 15B, 15C, or 15D.

In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO: 2 through SEQ ID NO: 18, and modulating at least one characteristic of said plant as compared to an isoline plant not grown from a reproductive element treated with said *Streptomyces* endophyte, wherein the characteristic comprises modulation of transcription of at least one gene involved in at least one of the following pathways: symbiosis enhancement, resistance to biotic stress, resistance to abiotic stress, growth promotion, cell wall composition, and developmental regulation. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises modulation of transcription of at least one transcript involved in at least one of the following pathways: symbiosis enhancement, resistance to biotic stress, resistance to abiotic stress, growth promotion, cell wall composition, and developmental regulation. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises modulation of levels of at least one hormone involved in a pathway selected from the group consisting of: developmental regulation, seed maturation, dormancy, response to environmental stresses, stomatal closure, expression of stress-related genes, drought tolerance, defense responses, infection response, pathogen response, disease resistance, systemic acquired resistance, transcriptional reprogramming, mechanical support, protection against biotic stress, protection against abiotic stress, signaling, nodulation inhibition, endophyte colonization, fatty acid deoxygenation, wound healing, antimicrobial substance production, metabolite catabolism, cell proliferation, and abscission. In another aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises modulation of at least one metabolite in at least one of the following plant metabolic pathways: alkaloid metabolism, phenylpropanoid metabolism, flavonoid biosynthesis, isoflavonoid biosynthesis, lipid metabolism, nitrogen metabolism, and carbohydrate metabolism. In yet another aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises modulation of microbiome community profile.

In a certain aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises upregulation of at least one gene in root tissue, selected from the upregulated genes listed in Tables 8A, 8B, 8C, 8D, and 8E. In certain other aspects, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO: 2 through SEQ ID NO: 18, and modulating at least one characteristic of said plant as compared to an isoline plant not grown from a reproductive element treated with said *Streptomyces* endophyte, wherein the characteristic comprises upregulation of at least one gene in leaf tissue, selected from the upregulated genes listed in Tables 8A, 8B, 8C, 8D, and 8E. In another aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises upregulation of at least one gene in stem tissue, selected from the upregulated genes listed in Tables 8A, 8B, 8C, 8D, and 8E. In another aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises downregulation of at least one gene in root tissue, selected from the downregulated genes listed in Tables 8A, 8B, 8C, 8D, and 8E. In another aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises downregulation of at least one gene in leaf tissue, selected from the downregulated genes listed in Tables 8A, 8B, 8C, 8D, and 8E. In another aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises downregulation of at least one gene in stem tissue, selected from the downregulated genes listed in Tables 8A, 8B, 8C, 8D, and 8E. In another aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises expression of at least one sugar transporter gene selected from Table 9. In another aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises upregulation of at least one transcript in root tissue, selected from the upregulated transcripts listed in Table 8F. In another aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises upregulation of at least one transcript in leaf tissue, selected from the upregulated transcripts listed in Table 8F. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises upregulation of at least one transcript in stem tissue, selected from the upregulated transcripts listed in Table 8F. In another aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises downregulation of at least one transcript in root tissue, selected from the downregulated transcripts listed in Table 8F. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises downregulation of at least one transcript in leaf tissue, selected from the downregulated transcripts listed in Table 8F. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises downregulation of at least one transcript in stem tissue, selected from the downregulated transcripts listed in Table 8F. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises upregulation of a sugar transporter transcript in leaf tissue or root tissue. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises a decrease in hormone level in root tissue, selected from the group consisting of: abscisic acid, salicylic acid, cinnaminic acid jasmonic acid, jasmonic acid-isoleucine, traumatic acid, 12-oxo-phytodienoic acid, 10-oxo-11 phytoenoic acid. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises an increase in hormone level in stem tissue, selected from the group consisting of: 12-oxo-phytodienoic acid, 10-oxo-11 phytoenoic acid. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises a decrease in hormone level in stem tissue, selected from the group consisting of: abscisic acid, salicylic acid, cinnaminic acid jasmonic acid, jasmonic acid-isoleucine, traumatic acid. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises an increase in hormone level in leaf tissue, selected from the group consisting of: salicylic acid, cinnaminic acid, 12-oxo-phytodienoic acid, 10-oxo-11 phytoenoic acid. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises a decrease in hormone level in leaf tissue, selected from the group consisting of: abscisic acid, jasmonic acid, jasmonic acid-isoleucine, traumatic acid. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises an increase in metabolite level in root tissue, selected from the group consisting of: pipecolic acid, hexadecanoic acid, octadecanoic acid. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises a decrease in metabolite level in root tissue, selected from the group consisting of: tryptophan, tyrosine, benzoic acid, nicotinic acid, tyrosine, quinic acid, sinapic acid, ferulic acid, caffeic acid, quinic acid, daidzein, dodecanol, alanine, allantoin, asparagine, aspartic acid, glutamic acid, glutamine, histidine, leucine, methionine, proline, threonine, tryptophan, tyrosine, valine, D-glucopyranose, salicylic acid, pyrogallol, beta tocopherol, galacturonic acid. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises an increase in metabolite level in stem tissue, selected from the group consisting of: tryptophan, ferulic acid, allantoin, glutamine, histidine, leucine, tryptophan, valine, D-glucopyranose, salicylic acid, hexadecanoic acid, octadecanoic acid, hesperetin, ethanolamine, glycerol, vanillic acid. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises a decrease in metabolite level in stem tissue, selected from the group consisting of: sphingosine. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises an increase in metabolite level in leaf tissue, selected from the group consisting of: lumichrome. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises a decrease in metabolite level in leaf tissue, selected from the group consisting of: sphingosine, tryptophan, ferulic acid, allantoin, glutamine, histidine, leucine, tryptophan, valine, salicylic acid, octadecanoic acid, hesperetin, ethanolamine, vanillic acid, tyrosine, benzoic acid, nicotinic acid, tyrosine, quinic acid, sinapic acid, caffeic acid, quinic acid, daidzein, dodecanol, alanine, glutamic acid, methionine, proline, threonine, tyrosine, phenylalanine, tryptamine, phenylalanine, shikimic acid, shikimic acid, ethanolaminephosphate, octadecadienoic acid, campesterol, β-alanine, isoleucine, phenylalanine, serine, galactose, lyxose, threose, trehalose, gallic acid. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises a reduced abundance of organisms of the *Escherica-Shigella* genera in the plant's leaf microbiome community. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises an increase in abundance of organisms of the *Rhizophagus* genera in the plant's root microbiome community. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises an increase in abundance of organisms of the *Glomus* genera in the plant's root microbiome community. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises a reduced abundance of organisms of the Enterobacteriaceae family in the plant's leaf microbiome community. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises an increase in abundance of organisms of the Nectriaceae family in the plant's root microbiome community. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises an increase in abundance of organisms of the Glomeraceae family in the plant's root microbiome community. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises the presence of at least one OTU described in Table 13A or Table 13B. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises an increase in the presence of at least one OTU selected from Table 13C. In an aspect, the invention provides a method of modulating a trait of agronomic importance in a plant derived from a plant reproductive element under water-limited conditions, comprising associating said plant reproductive element with a formulation comprising a *Streptomyces* endophyte that is heterologous to the plant reproductive element and comprises a 16S nucleic acid sequence that is at least 95% identical, at least 96% identical, at least 97% identical, at least 98% identical, or at least 99% identical over at least 600 nucleotides to a nucleic acid sequence selected from SEQ ID NO:2 through SEQ ID NO:18, and modulating at least one characteristic of said plant as compared to an isoline plant not grown from a reproductive element treated with said *Streptomyces* endophyte, wherein the characteristic comprises an enrichment of at least gene described in Table 15A, 15B, 15C, or 15D.

In certain embodiments, the invention provides for methods of altering the native microbiome community of a plant, comprising deriving the plant from a plant reproductive element treated with a formulation comprising a beneficial *Streptomyces* endophyte. In an aspect, the invention provides for methods of altering the native microbiome community of a plant, comprising deriving said plant from a plant reproductive element treated with a formulation comprising a beneficial *Streptomyces* endophyte, wherein the microbiome community alteration comprises a reduction in abundance of organisms of the *Escherica-Shigella* genera in the plant's leaf microbiome community. In an aspect, the invention provides for methods of altering the native microbiome community of a plant, comprising deriving said plant from a plant reproductive element treated with a formulation comprising a beneficial *Streptomyces* endophyte, wherein the microbiome community alteration comprises an increase in abundance of organisms of the *Rhizophagus* genera in the plant's root microbiome community. In an aspect, the invention provides for methods of altering the native microbiome community of a plant, comprising deriving said plant from a plant reproductive element treated with a formulation comprising a beneficial *Streptomyces* endophyte, wherein the microbiome community alteration comprises an increase in abundance of organisms of the *Glomus* genera in the plant's root microbiome community. In an aspect, the invention provides for methods of altering the native microbiome community of a plant, comprising deriving said plant from a plant reproductive element treated with a formulation comprising a beneficial *Streptomyces* endophyte, wherein the microbiome community alteration comprises a reduction in abundance of organisms of the Enterobacteriaceae family in the plant's leaf microbiome community. In an aspect, the invention provides for methods of altering the native microbiome community of a plant, comprising deriving said plant from a plant reproductive element treated with a formulation comprising a beneficial *Streptomyces* endophyte, wherein the microbiome community alteration comprises an increase in abundance of organisms of the Nectriaceae family in the plant's root microbiome community. In an aspect, the invention provides for methods of altering the native microbiome community of a plant, comprising deriving said plant from a plant reproductive element treated with a formulation comprising a beneficial *Streptomyces* endophyte, wherein the microbiome community alteration comprises an increase in abundance of organisms of the Glomeraceae family in the plant's root microbiome community. In an aspect, the invention provides for methods of altering the native microbiome community of a plant, comprising deriving said plant from a plant reproductive element treated with a formulation comprising a beneficial *Streptomyces* endophyte, wherein the microbiome community alteration comprises a presence of at least one OTU described in Table 13A or Table 13B. In an aspect, the invention provides for methods of altering the native microbiome community of a plant, comprising deriving said plant from a plant reproductive element treated with a formulation comprising a beneficial *Streptomyces* endophyte, wherein the microbiome community alteration comprises an increase in presence of at least one OTU selected from Table 13C.

The invention also provides any of the preceding methods; wherein the plant is optionally soybean or maize; wherein the formulation of any of the preceding methods optionally comprises a purified population of the *Streptomyces* endophyte at a concentration of at least about $10^{\wedge}2$ CFU/ml in a liquid formulation or about $10^{\wedge}2$ CFU/gm in a non-liquid formulation; wherein the *Streptomyces* endophyte is optionally capable auxin production, nitrogen fixation, production of an antimicrobial compound, mineral phosphate solubilization, siderophore production, cellulase production, chitinase production, xylanase production, or acetoin production; wherein the trait of agronomic importance is optionally selected from the group consisting of: disease resistance, drought tolerance, heat tolerance, cold tolerance, salinity tolerance, metal tolerance, herbicide tolerance, chemical tolerance, improved water use efficiency, improved nitrogen utilization, improved nitrogen fixation, pest resistance, herbivore resistance, pathogen resistance, increase in yield, increase in yield under water-limited conditions, health enhancement, vigor improvement, growth improvement, photosynthetic capability improvement, nutrition enhancement, altered protein content, altered oil content, increase in biomass, increase in shoot length, increase in root length, improved root architecture, increase in seed weight, altered seed carbohydrate composition, altered seed oil composition, increase in radical length, number of pods, delayed senescence, stay-green, altered seed protein composition, increase in dry weight of mature plant reproductive elements, increase in fresh weight of mature plant reproductive elements, increase in number of mature plant reproductive elements per plant, increase in chlorophyll content, increase in number of pods per plant, increase in length of pods per plant, reduced number of wilted leaves per plant, reduced number of severely wilted leaves per plant, increase in number of non-wilted leaves per plant, improved plant visual appearance; wherein the *Streptomyces* endophyte is optionally capable of localizing in a plant element of said plant, said plant element selected from the group consisting of: whole plant, seedling, meristematic tissue, ground tissue, vascular tissue, dermal tissue, seed, leaf, root, shoot, stem, flower, fruit, stolon, bulb, tuber, corm, keikis, and bud; wherein the plant reproductive element is optionally a seed or a transgenic seed; wherein the plant reproductive element is optionally placed into a substrate that promotes plant growth and/or wherein the substrate promotes plant growth in soil; wherein the formulation optionally further comprises one or more of the following: a stabilizer, or a preservative, or a carrier, or a surfactant, or an anticomplex agent, or any combination thereof; and wherein the formulation optionally further comprises at least one additional bacterial endophyte.

Certain embodiments of the invention are any of the preceding methods; wherein the *Streptomyces* endophyte is optionally capable of localizing in a plant element of the plant, the plant element selected from the group consisting of: whole plant, seedling, meristematic tissue, ground tissue, vascular tissue, dermal tissue, seed, leaf, root, shoot, stem, flower, fruit, stolon, bulb, tuber, corm, keikis, and bud; and wherein the plant element is optionally a seed; wherein the *Streptomyces* endophyte is optionally present in at least two compartments of the seed, selected from the group consisting of: embryo, seed coat, endosperm, cotyledon, hypocotyl, and radicle.

In certain aspects, the invention provides a synthetic composition comprising a plant reproductive element treated with a formulation comprising a purified *Streptomyces* endophyte population, wherein said *Streptomyces* endophyte is heterologous to the plant reproductive element, and comprises at least 600 nucleotides at least 95% identical to a nucleic acid sequence selected from the group consisting of: SEQ ID NO:2 through SEQ ID NO:18, wherein the endophyte is present in the synthetic combination in an amount capable of modulating at least one of: a trait of agronomic importance, the expression of a gene, the level of a transcript, the expression of a protein, the level of a hormone, the level of a metabolite, the population of endogenous microbes in plants grown from said plant reproductive element, as compared to an isoline plant grown from a plant reproductive element not contacted with the bacterial endophyte. In certain other aspects, the invention provides a synthetic composition comprising a plant reproductive element treated with a formulation comprising a purified *Streptomyces* endophyte population, wherein said *Streptomyces* endophyte is heterologous to the plant reproductive element, and comprises a strain deposit IDAC Deposit ID 081111-06, wherein the endophyte is present in the synthetic combination in an amount capable of modulating at least one of: a trait of agronomic importance, the expression of a gene, the level of a transcript, the expression of a protein, the level of a hormone, the level of a metabolite, the population of endogenous microbes in plants grown from said plant reproductive element, as compared to an isoline plant grown from a plant reproductive element not contacted with the bacterial endophyte. In certain aspects, the invention provides a synthetic composition comprising a plant reproductive element treated with a formulation comprising a purified *Streptomyces* endophyte population, wherein said *Streptomyces* endophyte is heterologous to the plant reproductive element, and comprises a *Streptomyces* species selected from the group consisting of: *albidoflavus, albus, aureofaciens, ginsengisoli, griseus, lydicus, mutabilis, neyagawaensis, praecox*, and SMCD2215, wherein the endophyte is present in the synthetic combination in an amount capable of modulating at least one of: a trait of agronomic importance, the expression of a gene, the level of a transcript, the expression of a protein, the level of a hormone, the level of a metabolite, the population of endogenous microbes in plants grown from said plant reproductive element, as compared to an isoline plant grown from a plant reproductive element not contacted with the bacterial endophyte.

The invention also provides the synthetic composition of any of the preceding claims, wherein the plant is optionally soybean or maize; wherein the formulation optionally comprises a purified population of the *Streptomyces* endophyte at a concentration of at least about $10^2$ CFU/ml in a liquid formulation or about $10^2$ CFU/gm in a non-liquid formulation; wherein the *Streptomyces* endophyte is optionally capable of auxin production, nitrogen fixation, production of an antimicrobial compound, mineral phosphate solubilization, siderophore production, cellulase production, chitinase production, xylanase production, or acetoin production; wherein the trait of agronomic importance is selected from the group consisting of: disease resistance, drought tolerance, heat tolerance, cold tolerance, salinity tolerance, metal tolerance, herbicide tolerance, chemical tolerance, improved water use efficiency, improved nitrogen utilization, improved nitrogen fixation, pest resistance, herbivore resistance, pathogen resistance, increase in yield, increase in yield under water-limited conditions, health enhancement, vigor improvement, growth improvement, photosynthetic capability improvement, nutrition enhancement, altered protein content, altered oil content, increase in biomass, increase in shoot length, increase in root length, improved root architecture, increase in seed weight, altered seed carbohydrate composition, altered seed oil composition, increase in radical length, number of pods, delayed senescence, stay-green, altered seed protein composition, increase in dry weight of mature plant reproductive elements, increase in fresh weight of mature plant reproductive elements, increase in number of mature plant reproductive elements per plant, increase in chlorophyll content, increase in number of pods per plant, increase in length of pods per plant, reduced number of wilted leaves per plant, reduced number of severely wilted leaves per plant, increase in number of non-wilted leaves per plant, improved plant visual appearance; wherein the *Streptomyces* endophyte is optionally capable of localizing in a plant element of a plant grown from said seed, said plant element selected from the group consisting of: whole plant, seedling, meristematic tissue, ground tissue, vascular tissue, dermal tissue, seed, leaf, root, shoot, stem, flower, fruit, stolon, bulb, tuber, corm, keikis, and bud; wherein the plant reproductive element is optionally a seed or a transgenic seed; wherein the plant reproductive element is optionally placed into a substrate that promotes plant growth; wherein the substrate that promotes plant growth is optionally soil; and wherein the substrate that promotes plant growth is soil and wherein a plurality of the plant reproductive elements are optionally placed in the soil in rows, with substantially equal spacing between each seed within each row.

The invention also provides the synthetic composition of any of the preceding claims, wherein the formulation optionally further comprises one or more of the following: a stabilizer, or a preservative, or a carrier, or a surfactant, or an anticomplex agent, or any combination thereof; wherein the formulation optionally further comprises one or more of the following: fungicide, nematicide, bactericide, insecticide, and herbicide; and wherein the formulation optionally further comprises at least one additional bacterial endophyte; wherein the plant reproductive element is optionally a seed or a transgenic seed.

An embodiment of the invention is a plant derived from the synthetic composition of any of the preceding claims, wherein the plant optionally comprises in at least one of its plant elements the bacterial endophyte; and wherein the progeny of the plant optionally comprises in at least one of its plant elements bacterial endophyte.

Another embodiment of the invention is a plurality of synthetic compositions of any of the preceding claims, wherein the compositions are optionally confined within an object selected from the group consisting of: bottle, jar, ampule, package, vessel, bag, box, bin, envelope, carton, container, silo, shipping container, truck bed, and case.

In certain other aspects, the invention provides the synthetic compositions of any of the preceding claims, wherein the *Streptomyces* endophyte is optionally present in the plant reproductive element in an amount capable of providing a benefit to the plant reproductive element or to a plant derived therefrom;

wherein the bacterial endophyte is optionally present in at least two compartments of the seed, selected from the group consisting of: embryo, seed coat, endosperm, cotyledon, hypocotyl, and radicle.

Included with the invention, is a plurality of synthetic combinations of any of the synthetic compositions of the preceding claims, wherein the synthetic combinations are shelf-stable.

An aspect of the invention provides a plant grown from the synthetic combination of any of the synthetic compositions of the preceding claims, wherein the plant comprises modulation of the transcription of at least one gene involved in at least one of the following pathways: symbiosis enhancement, resistance to biotic stress, resistance to abiotic stress, growth promotion, cell wall composition, and developmental regulation. Another aspect of the invention provides a plant grown from the synthetic combination of any of the synthetic compositions of the preceding claims, wherein the plant comprises modulation of the transcription of at least one transcript involved in at least one of the following pathways: symbiosis enhancement, resistance to biotic stress, resistance to abiotic stress, growth promotion, cell wall composition, and developmental regulation. Another aspect of the invention provides a plant grown from the synthetic combination of any of the synthetic compositions of the preceding claims, wherein the plant comprises modulating the level of at least one hormone involved in a pathway selected from the group consisting of: developmental regulation, seed maturation, dormancy, response to environmental stresses, stomatal closure, expression of stress-related genes, drought tolerance, defense responses, infection response, pathogen response, disease resistance, systemic acquired resistance, transcriptional reprogramming, mechanical support, protection against biotic stress, protection against abiotic stress, signaling, nodulation inhibition, endophyte colonization, fatty acid deoxygenation, wound healing, antimicrobial substance production, metabolite catabolism, cell proliferation, and abscission. Yet another aspect of the invention provides a plant grown from the synthetic combination of any of the synthetic compositions of the preceding claims, wherein the plant comprises modulating at least one metabolite in at least one of the following plant metabolic pathways: alkaloid metabolism, phenylpropanoid metabolism, flavonoid biosynthesis, isoflavonoid biosynthesis, lipid metabolism, nitrogen metabolism, and carbohydrate metabolism.

An embodiment of the invention is a plant grown from the synthetic combination of any of the preceding synthetic compositions, wherein the plant comprises at most 18% total microbes from the *Escherica-Shigella* genera in the total microbiome of the plant's root microbiome community. An embodiment of the invention is a plant grown from the synthetic combination of any of the preceding synthetic compositions, wherein the plant comprises at least 5% total microbes from the *Glomus* genera in the total microbiome of the plant's root microbiome community. An embodiment of the invention is a plant grown from the synthetic combination of any of the preceding synthetic compositions, wherein the plant comprises at least 8% total microbes from the *Rhixophagus* genera in the total microbiome of the plant's root microbiome community. An embodiment of the invention is a plant grown from the synthetic combination of any of the preceding synthetic compositions, wherein the plant comprises at most 18% total microbes from the Enterobacteriaceae family of the total microbiome in the plant's leaf microbiome community. An embodiment of the invention is a plant grown from the synthetic combination of any of the preceding synthetic compositions, wherein the plant comprises at least 25% total microbes from the Nectriaceae family in the total microbiome of the plant's root microbiome community. An embodiment of the invention is a plant grown from the synthetic combination of any of the preceding synthetic compositions, wherein the plant comprises at least 5% total microbes from the Glomeraceae family in the total microbiome of the plant's root microbiome community. An embodiment of the invention is a plant grown from the synthetic combination of any of the preceding synthetic compositions, wherein the plant comprises a bacterial or fungal OTU selected from Table 13A. An embodiment of the invention is a plant grown from the synthetic combination of any of the preceding synthetic compositions, wherein the plant comprises a bacterial or fungal OTU selected from Table 13B. An embodiment of the invention is a plant grown from the synthetic combination of any of the preceding synthetic compositions, wherein the plant comprises upregulation of at least one gene in root tissue, selected from the upregulated genes listed in Tables 8A, 8B, 8C, 8D, and 8E. An embodiment of the invention is a plant grown from the synthetic combination of any of the preceding synthetic compositions, wherein the plant comprises upregulation of at least one gene in leaf tissue, selected from the upregulated genes listed in Tables 8A, 8B, 8C, 8D, and 8E. An embodiment of the invention is a plant grown from the synthetic combination of any of the preceding synthetic compositions, wherein the plant comprises upregulation of at least one gene in stem tissue, selected from the upregulated genes listed in Tables 8A, 8B, 8C, 8D, and 8E. An embodiment of the invention is a plant grown from the synthetic combination of any of the preceding synthetic compositions, wherein the plant comprises downregulation of at least one gene in root tissue, selected from the downregulated genes listed in Tables 8A, 8B, 8C, 8D, and 8E. An embodiment of the invention is a plant grown from the synthetic combination of any of the preceding synthetic compositions, wherein the plant comprises downregulation of at least one gene in leaf tissue, selected from the downregulated genes listed in Tables 8A, 8B, 8C, 8D, and 8E. An embodiment of the invention is a plant grown from the synthetic combination of any of the preceding synthetic compositions, wherein the plant comprises downregulation of at least one gene in stem tissue, selected from the downregulated genes listed in Tables 8A, 8B, 8C, 8D, and 8E. An embodiment of the invention is a plant grown from the synthetic combination of any of the preceding synthetic compositions, wherein the plant comprises expression of at least one sugar transporter gene selected from Table 9. An embodiment of the invention is a plant grown from the synthetic combination of any of the preceding synthetic compositions, wherein the plant comprises upregulation of at least one transcript in root tissue, selected from the upregulated transcripts listed in Table 8F. An embodiment of the invention is a plant grown from the synthetic combination of any of the preceding synthetic compositions, wherein the plant comprises upregulation of at least one transcript in leaf tissue, selected from the upregulated transcripts listed in Table 8F. An embodiment of the invention is a plant grown from the synthetic combination of any of the preceding synthetic compositions, wherein the plant comprises upregulation of at least one transcript in stem tissue, selected from the upregulated transcripts listed in Table 8F. An embodiment of the invention is a plant grown from the synthetic combination of any of the preceding synthetic compositions, wherein the plant comprises downregulation of at least one transcript in root tissue, selected from the downregulated transcripts listed in Table 8F. An embodiment of the invention is a plant grown from the synthetic combination of any of the preceding synthetic compositions, wherein the plant comprises downregulation of at least one transcript in leaf tissue, selected from the downregulated transcripts listed in Table 8F. An embodiment of the invention is a plant grown from the synthetic combination of any of the preceding synthetic compositions, wherein the plant comprises downregulation of at least one transcript in stem tissue, selected from the downregulated transcripts listed in Table 8F. An embodiment of the invention is a plant grown from the synthetic combination of any of the preceding synthetic compositions, wherein the plant comprises upregulation of a sugar transporter transcript in leaf tissue or root tissue. An embodiment of the invention is a plant grown from the synthetic combination of any of the preceding synthetic compositions, wherein the plant comprises decrease in hormone level in root tissue, selected from the group consisting of: abscisic acid, salicylic acid, cinnaminic acid jasmonic acid, jasmonic acid-isoleucine, traumatic acid, 12-oxo-phytodienoic acid, 10-oxo-11 phytoenoic acid. An embodiment of the invention is a plant grown from the synthetic combination of any of the preceding synthetic compositions, wherein the plant comprises an increase in hormone level in stem tissue, selected from the group consisting of: 12-oxo-phytodienoic acid, 10-oxo-11 phytoenoic acid. An embodiment of the invention is a plant grown from the synthetic combination of any of the preceding synthetic compositions, wherein the plant comprises a decrease in hormone level in stem tissue, selected from the group consisting of: abscisic acid, salicylic acid, cinnaminic acid jasmonic acid, jasmonic acid-isoleucine, traumatic acid. An embodiment of the invention is a plant grown from the synthetic combination of any of the preceding synthetic compositions, wherein the plant comprises an increase in hormone level in leaf tissue, selected from the group consisting of: salicylic acid, cinnaminic acid, 12-oxo-phytodienoic acid, 10-oxo-11 phytoenoic acid. An embodiment of the invention is a plant grown from the synthetic combination of any of the preceding synthetic compositions, wherein the plant comprises a decrease in hormone level in leaf tissue, selected from the group consisting of: abscisic acid, jasmonic acid, jasmonic acid-isoleucine, traumatic acid. An embodiment of the invention is a plant grown from the synthetic combination of any of the preceding synthetic compositions, wherein the plant comprises an increase in metabolite level in root tissue, selected from the group consisting of: pipecolic acid, hexadecanoic acid, octadecanoic acid. An embodiment of the invention is a plant grown from the synthetic combination of any of the preceding synthetic compositions, wherein the plant comprises a decrease in metabolite level in root tissue, selected from the group consisting of: tryptophan, tyrosine, benzoic acid, nicotinic acid, tyrosine, quinic acid, sinapic acid, ferulic acid, caffeic acid, quinic acid, daidzein, dodecanol, alanine, allantoin, asparagine, aspartic acid, glutamic acid, glutamine, histidine, leucine, methionine, proline, threonine, tryptophan, tyrosine, valine, D-glucopyranose, salicylic acid, pyrogallol, beta tocopherol, galacturonic acid. An embodiment of the invention is a plant grown from the synthetic combination of any of the preceding synthetic compositions, wherein the plant comprises an increase in metabolite level in stem tissue, selected from the group consisting of: tryptophan, ferulic acid, allantoin, glutamine, histidine, leucine, tryptophan, valine, D-glucopyranose, salicylic acid, hexadecanoic acid, octadecanoic acid, hesperetin, ethanolamine, glycerol, vanillic acid. An embodiment of the invention is a plant grown from the synthetic combination of any of the preceding synthetic compositions, wherein the plant comprises a decrease in metabolite level in stem tissue, selected from the group consisting of: sphingosine. An embodiment of the invention is a plant grown from the synthetic combination of any of the preceding synthetic compositions, wherein the plant comprises an increase in metabolite level in leaf tissue, selected from the group consisting of: lumichrome. An embodiment of the invention is a plant grown from the synthetic combination of any of the preceding synthetic compositions, wherein the plant comprises a decrease in metabolite level in leaf tissue, selected from the group consisting of: sphingosine, tryptophan, ferulic acid, allantoin, glutamine, histidine, leucine, tryptophan, valine, salicylic acid, octadecanoic acid, hesperetin, ethanolamine, vanillic acid, tyrosine, benzoic acid, nicotinic acid, tyrosine, quinic acid, sinapic acid, caffeic acid, quinic acid, daidzein, dodecanol, alanine, glutamic acid, methionine, proline, threonine, tyrosine, phenylalanine, tryptamine, phenylalanine, shikimic acid, shikimic acid, ethanolamine-phosphate, octadecadienoic acid, campesterol, β-alanine, isoleucine, phenylalanine, serine, galactose, lyxose, threose, trehalose, gallic acid. An embodiment of the invention is a plant grown from the synthetic combination of any of the preceding synthetic compositions, wherein the plant comprises a reduced abundance of organisms of the *Escherica-Shigella* genera in the plant's leaf microbiome community. An embodiment of the invention is a plant grown from the synthetic combination of any of the preceding synthetic compositions, wherein the plant comprises an increase in abundance of organisms of the *Rhizophagus* genera in the plant's root microbiome community. An embodiment of the invention is a plant grown from the synthetic combination of any of the preceding synthetic compositions, wherein the plant comprises an increase in abundance of organisms of the *Glomus* genera in the plant's root microbiome community. An embodiment of the invention is a plant grown from the synthetic combination of any of the preceding synthetic compositions, wherein the plant comprises a reduced abundance of organisms of the Enterobacteriaceae family in the plant's leaf microbiome community. An embodiment of the invention is a plant grown from the synthetic combination of any of the preceding synthetic compositions, wherein the plant comprises an increase in abundance of organisms of the Nectriaceae family in the plant's root microbiome community. An embodiment of the invention is a plant grown from the synthetic combination of any of the preceding synthetic compositions, wherein the plant comprises an increase in abundance of organisms of the Glomeraceae family in the plant's root microbiome community. An embodiment of the invention is a plant grown from the synthetic combination of any of the preceding synthetic compositions, wherein the plant comprises the presence of at least one OTU described in Table 13A or Table 13B. An embodiment of the invention is a plant grown from the synthetic combination of any of the preceding synthetic compositions, wherein the plant comprises an increase in presence of at least one OTU selected from Table 13C. An embodiment of the invention is a plant grown from the synthetic combination of any of the preceding synthetic compositions, wherein the plant comprises an enrichment of at least one gene described in Table 15A, 15B, 15C, or 15D.

Included with the invention is a plant grown from any of the preceding synthetic combinations, wherein the plant optionally exhibits a trait of agronomic interest, selected from the group consisting of: disease resistance, drought tolerance, heat tolerance, cold tolerance, salinity tolerance, metal tolerance, herbicide tolerance, chemical tolerance, improved water use efficiency, improved nitrogen utilization, improved nitrogen fixation, pest resistance, herbivore resistance, pathogen resistance, increase in yield, increase in yield under water-limited conditions, health enhancement, vigor improvement, growth improvement, photosynthetic capability improvement, nutrition enhancement, altered protein content, altered oil content, increase in biomass, increase in shoot length, increase in root length, improved root architecture, increase in seed weight, altered seed carbohydrate composition, altered seed oil composition, increase in radical length, number of pods, delayed senescence, stay-green, altered seed protein composition, increase in dry weight of mature plant reproductive elements, increase in fresh weight of mature plant reproductive elements, increase in number of mature plant reproductive elements per plant, increase in chlorophyll content, increase in number of pods per plant, increase in length of pods per plant, reduced number of wilted leaves per plant, reduced number of severely wilted leaves per plant, increase in number of non-wilted leaves per plant, improved plant visual appearance; wherein the plant is optionally soybean or maize; and wherein the plant or progeny of the plant, optionally comprises in at least one of its plant elements the *Streptomyces* endophyte.

BRIEF DESCRIPTION OF THE FIGURES

These and other features, aspects, and advantages of the present invention will become better understood with regard to the following description, and accompanying figure, where:

FIG. 1: Culture plate of Strain A
FIG. 2: Culture plate of Strain B
FIG. 3: Culture plate of Strain C
FIG. 4: Greenhouse phenotypes of plants grown from seeds treated with Strain C, under normal watering conditions. Soybean plants grown from Strain C-treated seeds confer improved phenotypes, including a 3.2% increase in seed count, a 0.8% increase in fresh seed weight, a 1.0% increase in dry seed weight, a 9.5% increase in pod conts (>1 cm), and a 51.4% reduction in small pods (<1 cm) count.
FIG. 5: Greenhouse phenotypes of plants grown from seeds treated with Strain C, under water-limited conditions. Soybean plants grown from Strain C-treated seeds exhibit increased tolerance to extreme drought (1st drought cycle: 18 days post watering). NT=plant grown from non-Strain C treated/non-formulation treated seed, Formulation Control=plant grown from seed treated with formulation without Strain C, Strain C treated plant=treated with Strain C microbial endophyte in formulation.
FIG. 6: Greenhouse phenotypes of plants grown from seeds treated with different *Streptomyces* strains, under water-limited conditions. Soybean plants grown from seeds treated with any *Streptomyces* strain demonstrate improved visual phenotype tolerance to water-limited growth conditions, and those treated with Strain C exhibit the most improvement.
FIG. 7: Community sequencing graphs showing average abundance of bacterial genera, as a proportion of the community, in leaf tissue of water stressed soybean plants grown from seeds treated with Strain B (left), Strain C (middle), and untreated controls (right). The average abundance of organisms in the *Eschericia-Shigella* genera are reduced from approximately 21% of the bacterial community of untreated soybean leaves to approximately 13% of the bacterial community in Strain C treated soybean leaves and 16% of the bacterial community in Strain B treated leaves. Treatment with Strain C reduces the abundance of bacteria in the *Eschericia-Shigella* genera on soybean leaves by 37% relative to untreated controls.
FIG. 8: Community sequencing graphs showing the average abundance of fungal genera, as a proportion of the community, in root tissue of water stressed soybean plants grown from seeds treated with Strain B (left), Strain C (middle), and untreated controls (right). The average abundance of fungi in the *Rhizophagus* genera are increased from approximately 4.7% of the fungal community of untreated soybean roots and 4.3% of the fungal community in Strain B treated soybean roots to approximately 8.9% of the fungal community of Strain C treated soybean roots. Treatment with Strain C resulted in a 87.7% increase in the abundance of fungi in the *Rhizophagus* genera in soybean roots relative to untreated controls. Fungi of the genus *Glomus* are also increased in the roots of soybeans treated with Strain C and Strain B treatments relative to untreated controls.
FIG. 9: Community sequencing graphs showing the average abundance of bacterial families, as a proportion of the community, in leaf tissue of water stressed soybean plants grown from seeds treated with Strain B (left), Strain C (middle), and untreated controls (right).
FIG. 10: Community sequencing graphs showing the average abundance of bacterial families, as a proportion of the community, in root tissue of water stressed soybean plants grown from seeds treated with Strain B (left), Strain C (middle), and untreated controls (right).

DEFINITIONS

Terms used in the claims and specification are defined as set forth below unless otherwise specified.

It must be noted that, as used in the specification and the appended claims, the singular forms "a," "an" and "the" include plural referents unless the context clearly dictates otherwise.

An "endophyte" is an organism capable of living within a plant or otherwise associated therewith, and does not cause disease or harm the plant otherwise. Endophytes can occupy the intracellular or extracellular spaces of plant tissue, including the leaves, stems, flowers, fruits, seeds, or roots. An endophyte can be for example a bacterial or fungal organism, and can confer a beneficial property to the host plant such as an increase in yield, biomass, resistance, or fitness. An endophyte can be a fungus or a bacterium.

A "plurality of endophytes" means two or more types of endophyte entities, e.g., of simple bacteria or simple fungi, complex fungi, or combinations thereof. In some embodiments, the two or more types of endophyte entities are two or more strains of endophytes. In other embodiments, the two or more types of endophyte entities are two or more species of endophytes. In yet other embodiments, the two or more types of endophyte entities are two or more genera of endophytes. In yet other embodiments, the two or more types of endophyte entities are two or more families of endophytes. In yet other embodiments, the two or more types of endophyte entities are two or more orders of endophytes.

As used herein, the term "microbe" or "microorganism" refers to any species or taxon of microorganism, including, but not limited to, archaea, bacteria, microalgae, fungi (including mold and yeast species), mycoplasmas, microspores, nanobacteria, oomycetes, and protozoa. In some embodiments, a microbe or microorganism is an endophyte. In some embodiments, a microbe is an endophyte, for example a bacterial or fungal endophyte, which is capable of living within a plant. In some embodiments, a microbe or microorganism encompasses individual cells (e.g., unicellular microorganisms) or more than one cell (e.g., multi-cellular microorganism). A "population of microorganisms" may thus refer to a multiple cells of a single microorganism, in which the cells share common genetic derivation.

As used herein, the term "bacterium" or "bacteria" refers in general to any prokaryotic organism, and may reference an organism from either Kingdom Eubacteria (Bacteria), Kingdom Archaebacteria (Archae), or both. In some cases, bacterial genera or other taxonomic classifications have been reassigned due to various reasons (such as but not limited to the evolving field of whole genome sequencing), and it is understood that such nomenclature reassignments are within the scope of any claimed taxonomy. For example, certain species of the genus *Erwinia* have been described in the literature as belonging to genus *Pantoea* (Zhang and Qiu, 2015).

The term 16S refers to the DNA sequence of the 16S ribosomal RNA (rRNA) sequence of a bacterium. 16S rRNA gene sequencing is a well-established method for studying phylogeny and taxonomy of bacteria.

As used herein, the term "fungus" or "fungi" refers in general to any organism from Kingdom Fungi. Historical taxonomic classification of fungi has been according to morphological presentation. Beginning in the mid-1800's, it was became recognized that some fungi have a pleomorphic life cycle, and that different nomenclature designations were being used for different forms of the same fungus. In 1981, the Sydney Congress of the International Mycological Association laid out rules for the naming of fungi according to their status as anamorph, teleomorph, or holomorph (Taylor, 2011). With the development of genomic sequencing, it became evident that taxonomic classification based on molecular phylogenetics did not align with morphological-based nomenclature (Shenoy, 2007). As a result, in 2011 the International Botanical Congress adopted a resolution approving the International Code of Nomenclature for Algae, Fungi, and Plants (Melbourne Code) (2012), with the stated outcome of designating "One Fungus=One Name" (Hawksworth, 2012). However, systematics experts have not aligned on common nomenclature for all fungi, nor are all existing databases and information resources inclusive of updated taxonomies. As such, many fungi referenced herein may be described by their anamorph form but it is understood that based on identical genomic sequencing, any pleomorphic state of that fungus may be considered to be the same organism. For example, the genus *Alternaria* is the anamorph form of the teleomorph genus *Lewia* (Kwasna 2003), ergo both would be understood to be the same organism with the same DNA sequence. For example, it is understood that the genus *Acremonium* is also reported in the literature as genus *Sarocladium* as well as genus *Tilachilidium* (Summerbell, 2011). For example, the genus *Cladosporium* is an anamorph of the teleomorph genus *Davidiella* (Bensch, 2012), and is understood to describe the same organism. In some cases, fungal genera have been reassigned due to various reasons, and it is understood that such nomenclature reassignments are within the scope of any claimed genus. For example, certain species of the genus *Microdiplodia* have been described in the literature as belonging to genus *Paraconiothyrium* (Crous and Groenveld, 2006).

"Internal Transcribed Spacer" (ITS) refers to the spacer DNA (non-coding DNA) situated between the small-subunit ribosomal RNA (rRNA) and large-subunit (LSU) rRNA genes in the chromosome or the corresponding transcribed region in the polycistronic rRNA precursor transcript. ITS gene sequencing is a well-established method for studying phylogeny and taxonomy of fungi. In some cases, the "Large SubUnit" (LSU) sequence is used to identify fungi. LSU gene sequencing is a well-established method for studying phylogeny and taxonomy of fungi. Some fungal endophytes of the present invention may be described by an ITS sequence and some may be described by an LSU sequence. Both are understood to be equally descriptive and accurate for determining taxonomy.

As used herein with respect to fungi and bacteria, the term "marker gene" refers to an organism's 16S (for bacteria) or ITS (for fungi) polynucleotide sequence, by which a microbe may be specifically identified and assigned taxonomic nomenclature.

The terms "pathogen" and "pathogenic" in reference to a bacterium or fungus includes any such organism that is capable of causing or affecting a disease, disorder or condition of a host comprising the organism.

A "spore" or a population of "spores" refers to bacteria or fungi that are generally viable, more resistant to environmental influences such as heat and bactericidal or fungicidal agents than other forms of the same bacteria or fungi, and typically capable of germination and out-growth. Bacteria and fungi that are "capable of forming spores" are those bacteria and fungi comprising the genes and other necessary abilities to produce spores under suitable environmental conditions.

"Biomass" means the total mass or weight (fresh or dry), at a given time, of a plant tissue, plant tissues, an entire plant, or population of plants. Biomass is usually given as weight per unit area. The term may also refer to all the plants or species in the community (community biomass).

The term "isolated" is intended to specifically reference an organism, cell, tissue, polynucleotide, or polypeptide that is removed from its original source and purified from additional components with which it was originally associated. For example, an endophyte may be considered isolated from a seed if it is removed from that seed source and purified so that it is isolated from any additional components with which it was originally associated. Similarly, an endophyte may be removed and purified from a plant or plant element so that it is isolated and no longer associated with its source plant or plant element.

As used herein, an isolated strain of a microbe is a strain that has been removed from its natural milieu. "Pure cultures" or "isolated cultures" are cultures in which the organisms present are only of one strain of a particular genus and species. This is in contrast to "mixed cultures," which are cultures in which more than one genus and/or species of microorganism are present. As such, the term "isolated" does not necessarily reflect the extent to which the microbe has been purified. A "substantially pure culture" of the strain of microbe refers to a culture which contains substantially no other microbes than the desired strain or strains of microbe. In other words, a substantially pure culture of a strain of microbe is substantially free of other contaminants, which can include microbial contaminants. Further, as used herein, a "biologically pure" strain is intended to mean the strain separated from materials with which it is normally associated in nature. A strain associated with other strains, or with compounds or materials that it is not normally found with in nature, is still defined as "biologically pure." A monoculture of a particular strain is, of course, "biologically pure." As used herein, the term "enriched culture" of an isolated microbial strain refers to a microbial culture that contains more that 50%, 60%, 70%, 80%, 90%, or 95% of the isolated strain.

A "host plant" includes any plant, particularly a plant of agronomic importance, which an endophytic entity such as an endophyte can colonize. As used herein, an endophyte is said to "colonize" a plant or plant element when it can be stably detected within the plant or plant element over a period time, such as one or more days, weeks, months or years, in other words, a colonizing entity is not transiently associated with the plant or plant element. Such host plants are preferably plants of agronomic importance.

A "non-host target" means an organism or chemical compound that is altered in some way after contacting a host plant that comprises an endophyte, as a result of a property conferred to the host plant by the endophyte.

As used herein, a nucleic acid has "homology" or is "homologous" to a second nucleic acid if the nucleic acid sequence has a similar sequence to the second nucleic acid sequence. The terms "identity," "percent sequence identity" or "identical" in the context of nucleic acid sequences refer to the residues in the two sequences that are the same when aligned for maximum correspondence. There are a number of different algorithms known in the art that can be used to measure nucleotide sequence identity. For instance, polynucleotide sequences can be compared using FASTA, Gap or Bestfit, which are programs in Wisconsin Package Version 10.0, Genetics Computer Group (GCG), Madison, Wis. FASTA provides alignments and percent sequence identity of the regions of the best overlap between the query and search sequences. Pearson, Methods Enzymol. 183:63-98 (1990). In some embodiments, sequences can be compared using Geneious (Biomatters, Ltd., Auckland, New Zealand). In other embodiments, polynucleotide sequences can be compared using the multiple sequence alignment algorithm MUSCLE (Edgar R C, 2004).

The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 76%, 80%, 85%, or at least about 90%, or at least about 95%, 96%, 97%, 98% 99%, 99.5% or 100% of the nucleotide bases, as measured by any well-known algorithm of sequence identity, such as FASTA, BLAST, Gap, MUSCLE, or any other method known in the art.

As used herein, the terms "operational taxonomic unit," "OTU," "taxon," "hierarchical cluster," and "cluster" are used interchangeably. An operational taxon unit (OTU) refers to a group of one or more organisms that comprises a node in a clustering tree. The level of a cluster is determined by its hierarchical order. In one embodiment, an OTU is a group tentatively assumed to be a valid taxon for purposes of phylogenetic analysis. In another embodiment, an OTU is any of the extant taxonomic units under study. In yet another embodiment, an OTU is given a name and a rank. For example, an OTU can represent a domain, a sub-domain, a kingdom, a sub-kingdom, a phylum, a sub-phylum, a class, a subclass, an order, a sub-order, a family, a subfamily, a genus, a subgenus, or a species. In some embodiments, OTUs can represent one or more organisms from the kingdoms eubacteria, protista, or fungi at any level of a hierarchal order. In some embodiments, an OTU represents a prokaryotic or fungal order.

In some embodiments, the present invention contemplates the synthetic compositions comprising the combination of a plant element, seedling, or whole plants and an endophyte population, in which the endophyte population is "heterologously disposed." In some embodiments, "heterologously disposed" means that the native plant element, seedling, or plant does not contain detectable levels of the microbe in that same plant element, seedling, or plant. For example if said plant element or seedling or plant does not naturally have the endophyte associated with it and the endophyte is applied, the endophyte would be considered to be heterologously disposed. In some embodiments, "heterologously disposed" means that the endophyte is being applied to a different plant element than that with which the endophyte is naturally associated. For example, if said plant element or seedling or plant has the endophyte normally found in the root tissue but not in the leaf tissue, and the endophyte is applied to the leaf, the endophyte would be considered to be heterologously disposed. In some embodiments, "heterologously disposed" means that the endophyte being applied to a different tissue or cell layer of the plant element than that in which the microbe is naturally found. For example, if endophyte is naturally found in the mesophyll layer of leaf tissue but is being applied to the epithelial layer, the endophyte would be considered to be heterologously disposed. In some embodiments, "heterologously disposed" means that the endophyte being applied is at a greater concentration, number, or amount of the plant element, seedling, or plant, than that which is naturally found in said plant element, seedling, or plant. For example, an endophyte concentration that is being applied is at least 1.5 times greater, between 1.5 and 2 times greater, 2 times greater, between 2 and 3 times greater, 3 times greater, between 3 and 5 times greater, 5 times greater, between 5 and 7 times greater, 7 times greater, between 7 and 10 times greater, 10 times greater, or even greater than 10 times higher number, amount, or concentration than that which is naturally present, the endophyte would be considered to be heterologously disposed. In some embodiments, "heterologously disposed" means that the endophyte is applied to a developmental stage of the plant element, seedling, or plant in which said endophyte is not naturally associated, but may be associated at other stages. For example, if an endophyte is normally found at the flowering stage of a plant and no other stage, an endophyte applied at the seedling stage may be considered to be heterologously disposed. For example, an endophyte that is normally associated with leaf tissue of a cupressaceous tree sample would be considered heterologous to leaf tissue of a maize plant. In another example, an endophyte that is normally associated with leaf tissue of a maize plant is considered heterologous to a leaf tissue of another maize plant that naturally lacks said endophyte. In another example, an endophyte that is normally associated at low levels in a plant is considered heterologous to that plant if a higher concentration of that endophyte is introduced into the plant. In yet another example, an endophyte that is associated with a tropical grass species would be considered heterologous to a wheat plant.

The term "isoline" is a comparative term, and references organisms that are genetically identical, but may differ in treatment. In one example, two genetically identical maize plant embryos may be separated into two different groups, one receiving a treatment (such as transformation with a heterologous polynucleotide, to create a genetically modified plant) and one control that does not receive such treatment. Any phenotypic differences between the two groups may thus be attributed solely to the treatment and not to any inherency of the plant's genetic makeup. In another example, two genetically identical soybean seeds may be treated with a formulation that introduces an endophyte composition. Any phenotypic differences between the plants derived from (e.g., grown from or obtained from) those seeds may be attributed to the treatment, thus forming an isoline comparison.

Similarly, by the term "reference agricultural plant," it is meant an agricultural plant of the same species, strain, or cultivar to which a treatment, formulation, composition or endophyte preparation as described herein is not administered/contacted. A reference agricultural plant, therefore, is identical to the treated plant with the exception of the presence of the endophyte and can serve as a control for detecting the effects of the endophyte that is conferred to the plant.

A "reference environment" refers to the environment, treatment or condition of the plant in which a measurement is made. For example, production of a compound in a plant associated with an endophyte can be measured in a reference environment of drought stress, and compared with the levels of the compound in a reference agricultural plant under the same conditions of drought stress. Alternatively, the levels of a compound in plant associated with an endophyte and reference agricultural plant can be measured under identical conditions of no stress.

A "plant element" is intended to generically reference either a whole plant or a plant component, including but not limited to plant tissues, parts, and cell types. A plant element is preferably one of the following: whole plant, seedling, meristematic tissue, ground tissue, vascular tissue, dermal tissue, seed, leaf, root, shoot, stem, flower, fruit, stolon, bulb, tuber, corm, kelkis, shoot, bud. As used herein, a "plant element" is synonymous to a "portion" of a plant, and refers to any part of the plant, and can include distinct tissues and/or organs, and may be used interchangeably with the term "tissue" throughout.

Similarly, a "plant reproductive element" is intended to generically reference any part of a plant that is able to initiate other plants via either sexual or asexual reproduction of that plant, for example but not limited to: seed, seedling, root, shoot, cutting, scion, graft, stolon, bulb, tuber, corm, keikis, or bud.

A "population" of plants refers to more than one plant, that are of the same taxonomic category, typically be of the same species, and will also typically share a common genetic derivation.

As used herein, an "agricultural seed" is a seed used to grow a plant typically used in agriculture (an "agricultural plant"). The seed may be of a monocot or dicot plant, and may be planted for the production of an agricultural product, for example feed, food, fiber, fuel, industrial uses, etc. As used herein, an agricultural seed is a seed that is prepared for planting, for example, in farms for growing.

"Agricultural plants," or "plants of agronomic importance," include plants that are cultivated by humans for food, feed, fiber, fuel, and/or industrial purposes. Agricultural plants include monocotyledonous species such as: maize (*Zea mays*), common wheat (*Triticum aestivum*), spelt (*Triticum spelta*), einkorn wheat (*Triticum monococcum*), emmer wheat (*Triticum dicoccum*), durum wheat (*Triticum durum*), Asian rice (*Oryza sativa*), African rice (*Oryza glabaerrima*), wild rice (*Zizania aquatica, Zizania latifolia, Zizania palustris, Zizania texana*), barley (*Hordeum vulgare*), Sorghum (*Sorghum bicolor*), Finger millet (*Eleusine coracana*), Proso millet (*Panicum miliaceum*), Pearl millet (*Pennisetum glaucum*), Foxtail millet (*Setaria italica*), Oat (*Avena sativa*), Triticale (*Triticosecale*), rye (*Secale cereal*), Russian wild rye (*Psathyrostachys juncea*), bamboo (*Bambuseae*), or sugarcane (e.g., *Saccharum arundinaceum, Saccharum barberi, Saccharum bengalense, Saccharum edule, Saccharum munja, Saccharum officinarum, Saccharum procerum, Saccharum ravennae, Saccharum robustum, Saccharum sinense*, or *Saccharum spontaneum*); as well as dicotyledonous species such as: soybean (*Glycine max*), canola and rapeseed cultivars (*Brassica napus*), cotton (genus *Gossypium*), alfalfa (*Medicago sativa*), cassava (genus *Manihot*), potato (*Solanum tuberosum*), tomato (*Solanum lycopersicum*), pea (*Pisum sativum*), chick pea (*Cicer arietinum*), lentil (*Lens culinaris*), flax (*Linum usitatissimum*) and many varieties of vegetables.

The term "synthetic composition" means one or more plant elements associated by human endeavor with an isolated, purified endophyte composition, said association which is not found in nature. In some embodiments of the present invention, "synthetic composition" is used to refer to a treatment formulation comprising an isolated, purified population of endophytes associated with a plant element. In some embodiments of the present invention, "synthetic composition" refers to a purified population of endophytes in a treatment formulation comprising additional compositions with which said endophytes are not found associated in nature.

A "treatment formulation" refers to a mixture of chemicals that facilitate the stability, storage, and/or application of the endophyte composition(s). Treatment formulations may comprise any one or more agents such as: surfactant, a buffer, a tackifier, a microbial stabilizer, a fungicide, an anticomplex agent, an herbicide, a nematicide, an insecticide, a plant growth regulator, a rodenticide, a desiccant, a nutrient, an excipient, a wetting agent, a salt.

In some embodiments, an "agriculturally compatible carrier" can be used to formulate an agricultural formulation or other composition that includes a purified endophyte preparation. As used herein an "agriculturally compatible carrier" refers to any material, other than water, that can be added to a plant element without causing or having an adverse effect on the plant element (e.g., reducing seed germination) or the plant that grows from the plant element, or the like.

The compositions and methods herein may provide for an improved "agronomic trait" or "trait of agronomic importance" to a host plant, which may include, but not be limited to, the following: disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, vigor improvement, growth improvement, photosynthetic capability improvement, nutrition enhancement, altered protein content, altered oil content, increased biomass, increased shoot length, increased root length, improved root architecture, modulation of a metabolite, modulation of the proteome, increased seed weight, altered seed carbohydrate composition, altered seed oil composition, altered seed protein composition, altered seed nutrient composition, compared to an isoline plant derived from a seed without said seed treatment formulation.

As used herein, the terms "water-limited condition" and "drought condition," or "water-limited" and "drought," may be used interchangeably. For example, a method or composition for improving a plant's ability to grow under drought conditions means the same as the ability to grow under water-limited conditions. In such cases, the plant can be further said to display improved tolerance to drought stress.

As used herein, the terms "normal watering" and "well-watered" are used interchangeably, to describe a plant grown under typical growth conditions with no water restriction.

Additionally, "altered metabolic function" or "altered enzymatic function" may include, but not be limited to, the following: altered production of an auxin, altered nitrogen fixation, altered production of an antimicrobial compound, altered production of a siderophore, altered mineral phosphate solubilization, altered production of a cellulase, altered production of a chitinase, altered production of a xylanase, altered production of acetoin, altered utilization of a carbon source.

An "increased yield" can refer to any increase in biomass or seed or fruit weight, seed size, seed number per plant, seed number per unit area, bushels per acre, tons per acre, kilo per hectare, or carbohydrate yield. Typically, the particular characteristic is designated when referring to increased yield, e.g., increased grain yield or increased seed size.

"Nutrient" or "seed nutrient" refers to any composition of the associated plant element, most particularly compositions providing benefit to other organisms that consume or utilize said plant element.

"Agronomic trait potential" is intended to mean a capability of a plant element for exhibiting a phenotype, preferably an improved agronomic trait, at some point during its life cycle, or conveying said phenotype to another plant element with which it is associated in the same plant. For example, a plant element may comprise an endophyte that will provide benefit to leaf tissue of a plant from which the plant element is grown; in such case, the plant element comprising such endophyte has the agronomic trait potential for a particular phenotype (for example, increased biomass in the plant) even if the plant element itself does not display said phenotype.

In some cases, the present invention contemplates the use of compositions that are "compatible" with agricultural chemicals, including but not limited to, a fungicide, an anticomplex compound, a bactericide, a virucide, an herbicide, a nematicide, a parasiticide, a pesticide, or any other agent widely used in agricultural which has the effect of killing or otherwise interfering with optimal growth of another organism. As used herein, a composition is "compatible" with an agricultural chemical when the organism is modified, such as by genetic modification, e.g., contains a transgene that confers resistance to an herbicide, or is adapted to grow in, or otherwise survive, the concentration of the agricultural chemical used in agriculture. For example, an endophyte disposed on the surface of a plant element is compatible with the fungicide metalaxyl if it is able to survive the concentrations that are applied on the plant element surface.

As used herein, a "colony-forming unit" ("CFU") is used as a measure of viable microorganisms in a sample. A CFU is an individual viable cell capable of forming on a solid medium a visible colony whose individual cells are derived by cell division from one parental cell.

The terms "decreased," "fewer," "slower" and "increased" "faster" "enhanced" "greater" as used herein refers to a decrease or increase in a characteristic of the endophyte treated plant element or resulting plant compared to an untreated plant element or resulting plant. For example, a decrease in a characteristic may be at least 1%, at least 2%, at least 3%, at least 4%, at least 5%, between 5% and 10%, at least 10%, between 10% and 20%, at least 15%, at least 20%, between 20% and 30%, at least 25%, at least 30%, between 30% and 40%, at least 35%, at least 40%, between 40% and 50%, at least 45%, at least 50%, between 50% and 60%, at least about 60%, between 60% and 70%, between 70% and 80%, at least 75%, at least about 80%, between 80% and 90%, at least about 90%, between 90% and 100%, at least 100%, between 100% and 200%, at least 200%, at least about 300%, at least about 400% or more lower than the untreated control and an increase may be at least 1%, at least 2%, at least 3%, at least 4%, at least 5%, between 5% and 10%, at least 10%, between 10% and 20%, at least 15%, at least 20%, between 20% and 30%, at least 25%, at least 30%, between 30% and 40%, at least 35%, at least 40%, between 40% and 50%, at least 45%, at least 50%, between 50% and 60%, at least about 60%, between 60% and 70%, between 70% and 80%, at least 75%, at least about 80%, between 80% and 90%, at least about 90%, between 90% and 100%, at least 100%, between 100% and 200%, at least 200%, at least about 300%, at least about 400% or more higher than the untreated control.

DETAILED DESCRIPTION OF THE INVENTION

As demonstrated herein, agricultural plants may be associated with symbiotic microorganisms, termed endophytes, particularly bacteria and fungi, which may contribute to plant survival, performance, and characteristics. However, modern agricultural processes may have perturbed this relationship, resulting in increased crop losses, diminished stress resilience, biodiversity losses, and increasing dependence on external chemicals, fertilizers, and other unsustainable agricultural practices. There is a need for novel compositions and methods for generating plants with novel microbiome properties that can sustainably increase yield, improve stress resilience, and decrease fertilizer and chemical use.

Currently, the generally accepted view of plant endophytic communities focuses on their homologous derivation, predominantly from the soil communities in which the plants are grown (Hallman, et al., (1997) Canadian Journal of Microbiology. 43(10): 895-914). Upon observing taxonomic overlap between the endophytic and soil microbiota in *A. thaliana*, it was stated, "Our rigorous definition of an endophytic compartment microbiome should facilitate controlled dissection of plant-microbe interactions derived from complex soil communities" (Lundberg et al., (2012) Nature. 488, 86-90). There is strong support in the art for soil representing the repository from which plant endophytes are derived. New Phytologist (2010) 185: 554-567. Notable plant-microbe interactions such as mycorrhyzal fungi and complex *rhizobia* fit the paradigm of soil-based colonization of plant hosts and appear to primarily establish themselves independently of seed. As a result of focusing attention on the derivation of endophytes from the soil in which the target agricultural plant is currently growing, there has been an inability to achieve commercially significant improvements in plant yields and other plant characteristics such as increased root biomass, increased root length, increased height, increased shoot length, increased leaf number, increased water use efficiency, increased overall biomass, increase grain yield, increased photosynthesis rate, increased tolerance to drought, increased heat tolerance, increased salt tolerance, increased resistance to insect and nematode stresses, increased resistance to a fungal pathogen, increased resistance to a complex pathogen, increased resistance to a viral pathogen, a detectable modulation in the level of a metabolite, and a detectable modulation in the proteome relative to a reference plant.

The inventors herein have conceived of using endophytes that are capable of living within or otherwise associated with plants to improve plant characteristics, as well as methods of using endophytes that are capable of being associated with plants, to impart novel characteristics to a host plant, as well as to distinct plant elements of the host plant. In an embodiment of this invention, endophyte compositions are isolated and purified from plant or fungal sources, and synthetically combined with a plant element, to impart improved agronomic potential and/or improved agronomic traits to the host plant. In another embodiment of the invention, endophytes that are capable of living within plants are isolated and purified from their native source(s) and synthetically combined with a plant element, to impart improved agronomic potential and/or improved agronomic traits to the host plant or the host plant's elements. Such endophytes that are capable of living within plants may be further manipulated or combined with additional elements prior to combining with the plant element(s).

As described herein, beneficial organisms can be robustly obtained from heterologous, homologous, or engineered sources, optionally cultured, administered heterologously to plant elements, and, as a result of the administration, confer multiple beneficial properties. This is surprising given the variability observed in the art in endophytic microbe isolation and the previous observations of inefficient plant element pathogen colonization of plant host's tissues.

In part, the present invention provides preparations of endophytes that are capable of living within plants, and the creation of synthetic compositions of plant elements and/or seedlings with heterologous endophytes, and formulations comprising the synthetic compositions, as well as the recognition that such synthetic compositions display a diversity of beneficial properties present in the agricultural plants and the associated endophyte populations newly created by the present inventors. Such beneficial properties include metabolism, transcript expression, proteome alterations, morphology, and the resilience to a variety of environmental stresses, and any combination of such properties. The present invention also provides methods of using such endophytes to benefit the host plant with which it is associated.

Endophyte Compositions and Methods of Isolation

The endophytes of the present invention provide several unexpected and significant advantages over other plant-associated microbes. Different environments can comprise significantly different populations of endophytes and thus may provide reservoirs for desired endophytes. Once a choice environment is selected, plant elements of choice plants to be sampled can be identified by their healthy and/or robust growth, or other desired phenotypic characteristics.

In some embodiments of the present invention, endophytes may be bacteria identified from a plant source. In some embodiments of the present invention, endophytes are bacteria identified from a non-plant source, yet be capable of living within a plant, to create a new endophyte entity.

Endophyte Selection: Sourcing

In some embodiments of the present invention, endophytes may be isolated from plants or plant elements. In an embodiment of the present invention, endophytes described herein can also be isolated from plants, plant elements, or endophytic fungi of plants or plant elements adapted to a particular environment, including, but not limited to, an environment with water deficiency, salinity, acute and/or chronic heat stress, acute and/or chronic cold stress, nutrient deprived soils including, but not limited to, micronutrient deprived soils, macronutrient (e.g., potassium, phosphate, nitrogen) deprived soils, pathogen stress, including fungal, nematode, insect, viral, and complex pathogen stress.

In one embodiment, a plant is harvested from a soil type different than that in which the plant is normally grown. In another embodiment, the plant is harvested from an ecosystem where the agricultural plant is not normally found. In another embodiment, the plant is harvested from a soil with an average pH range that is different from the optimal soil pH range of the agricultural plant. In one embodiment, the plant is harvested from an environment with average air temperatures lower than the normal growing temperature of the agricultural plant. In one embodiment, the plant is harvested from an environment with average air temperatures higher than the normal growing temperature of the agricultural plant. In another embodiment, the plant is harvested from an environment with average rainfall lower than the optimal average rainfall received by the agricultural plant. In one embodiment, the plant is harvested from an environment with average rainfall higher than the optimal average rainfall of the agricultural plant. In another embodiment, the plant is harvested from a soil type with different soil moisture classification than the normal soil type that the agricultural plant is grown on. In one embodiment, the plant is harvested from an environment with average rainfall lower than the optimal average rainfall of the agricultural plant. In one embodiment, the plant is harvested from an environment with average rainfall higher than the optimal average rainfall of the agricultural plant. In another embodiment, the plant is harvested from an agricultural environment with a yield lower than the average yield expected from the agricultural plant grown under average cultivation practices on normal agricultural land. In another embodiment, the plant is harvested from an agricultural environment with a yield lower than the average yield expected from the agricultural plant grown under average cultivation practices on normal agricultural land. In another embodiment, the plant is harvested from an environment with average yield higher than the optimal average yield of the agricultural plant. In another embodiment, the plant is harvested from an environment with average yield higher than the optimal average yield of the agricultural plant. In another embodiment, the plant is harvested from an environment where soil contains lower total nitrogen than the optimum levels recommended in order to achieve average yields for a plant grown under average cultivation practices on normal agricultural land. In another embodiment, the plant is harvested from an environment where soil contains higher total nitrogen than the optimum levels recommended in order to achieve average yields for a plant grown under average cultivation practices on normal agricultural land. In another embodiment, the plant is harvested from an environment where soil contains lower total phosphorus than the optimum levels recommended in order to achieve average yields for a plant grown under average cultivation practices on normal agricultural land. In another embodiment, the plant is harvested from an environment where soil contains higher total phosphorus than the optimum levels recommended in order to achieve average yields for a plant grown under average cultivation practices on normal agricultural land. In another embodiment, the plant is harvested from an environment where soil contains lower total potassium than the optimum levels recommended in order to achieve average yields for a plant grown under average cultivation practices on normal agricultural land. In another embodiment, the plant is harvested from an environment where soil contains higher total potassium than the optimum levels recommended in order to achieve average yields for a plant grown under average cultivation practices on normal agricultural land. In another embodiment, the plant is harvested from an environment where soil contains lower total sulfur than the optimum levels recommended in order to achieve average yields for a plant grown under average cultivation practices on normal agricultural land. In another embodiment, the plant is harvested from an environment where soil contains higher total sulfur than the optimum levels recommended in order to achieve average yields for a plant grown under average cultivation practices on normal agricultural land. In another embodiment, the plant is harvested from an environment where soil contains lower total calcium than the optimum levels recommended in order to achieve average yields for a plant grown under average cultivation practices on normal agricultural land. In another embodiment, the plant is harvested from an environment where soil contains lower total magnesium than the optimum levels recommended in order to achieve average yields for a plant grown under average cultivation practices on normal agricultural land. In another embodiment, the plant is harvested from an environment where soil contains higher total sodium chloride (salt) than the optimum levels recommended in order to achieve average yields for a plant grown under average cultivation practices on normal agricultural land.

Endophytes can be obtained from a host plant or a plant element of many distinct plants. In an embodiment, the endophyte can be obtained a plant element of the same or different crop, and can be from the same or different cultivar or variety as the plant element to which the composition is heterologously associated.

In another embodiment, endophytes used in a composition or used to make a synthetic composition can be obtained from the same cultivar or species of agricultural plant to which the composition is intended for heterologous association, or can be obtained from a different cultivar or species of agricultural plant. For example, endophytes from a particular corn variety can be isolated and coated onto the surface of a corn plant element of the same variety.

In another embodiment, endophytes used in a composition or used to make a synthetic composition can be obtained from a plant element of a plant that is related to the plant element to which the composition is intended to be association. For example, an endophyte isolated from *Triticum monococcum* (einkorn wheat) can be coated onto the surface of a *T. aestivum* (common wheat) plant element; or, an endophyte from *Hordeum vulgare* (barley) can be isolated and coated onto the plant element of a member of the Triticeae family, for example, plant elements of the rye plant, *Secale cereale*).

In still another embodiment, endophytes used in a composition or used to make a synthetic composition can be obtained from a plant element of a plant that is distantly related to the plant element onto which the endophyte is to be coated. For example, a tomato-derived endophyte can be isolated and coated onto a soybean plant element.

In some embodiments, a purified endophytes population is used that includes two or more (e.g., 3, 4, 5, 6, 7, 8, 9, 10, 15, 20, 25 or greater than 25) different endophytes, e.g., obtained from different families of plant or fungus, or different genera of plant or fungus, or from the same genera but different species of plant or fungus.

In yet another embodiment, endophytes used in a composition or used to make a synthetic composition can be obtained from different individual plants of the same variety, each of which has been subjected to different growth conditions. For example, an endophyte obtained from a drought-affected plant of one variety can be isolated and coated onto the plant element that was derived from a plant of the same variety not subjected to drought. In such cases, the endophyte is considered to be heterologously associated with the plant element onto which it is applied.

The heterologous relationship between the endophyte and the host plant element may result from an endophyte obtained from any different plant or plant element than that which with it becomes associated. In some cases, the endophyte is obtained from a different cultivar of the same species. In some cases, the endophyte is obtained from a different plant species. In some cases, the endophyte is obtained from the same plant species but from two different plants, each exposed to some different environmental condition (for example, differences in heat units or water stress). In some cases, the endophyte is obtained from the same plant individual but from different plant elements or tissues (for example, a root endophyte applied to a leaf).

In some embodiments, compositions described herein comprise a purified endophyte population is used that includes at least two or more, at least 3, at least 4, at least 5, at least 6, at least 7, at least 8, at least 9, at least 10, at least 15, at least 20, at least 25, or more (e.g., 3, 4, 5, 6, 7, 8, 9, 10, 15, 20, 25 or greater than 25) different endophytes, e.g., obtained from different families of plants, or different genera of plant or fungus, or from the same genera but different species of plants.

The different endophytes can be obtained from the same cultivar of agricultural plant (e.g., the same maize, wheat, rice, or barley plant), different cultivars of the same agricultural plant (e.g., two or more cultivars of maize, two or more cultivars of wheat, two or more cultivars of rice, or two or more cultivars of barley), or different species of the same type of agricultural plant (e.g., two or more different species of maize, two or more different species of wheat, two or more different species of rice, or two or more different species of barley). In embodiments in which two or more endophytes are used, each of the endophytes can have different properties or activities, e.g., produce different metabolites, produce different enzymes such as different hydrolytic enzymes, confer different beneficial traits, or colonize different elements of a plant (e.g., leaves, stems, flowers, fruits, seeds, or roots). For example, one endophyte can colonize a first and a second endophyte can colonize a tissue that differs from the first tissue. Combinations of endophytes are disclosed in detail below.

In an embodiment, the endophyte is an endophytic microbe isolated from a different plant than the inoculated plant. For example, in an embodiment, the endophyte is an endophyte isolated from a different plant of the same species as the inoculated plant. In some cases, the endophyte is isolated from a species related to the inoculated plant.

Endophyte Selection: Compatibility with Agrichemicals

In certain embodiments, the endophyte is selected on the basis of its compatibility with commonly used agrichemicals. As mentioned earlier, plants, particularly agricultural plants, can be treated with a vast array of agrichemicals, including fungicides, biocides (anticomplex agents), herbicides, insecticides, nematicides, rodenticides, bactericides, virucides, fertilizers, and other agents.

In some embodiments, the endophytes of the present invention display tolerance to an agrichemical selected from the group consisting of: Aeris®, Avicta® DuoCot 202, Cruiser®, Syntenta CCB® (A), Clariva®, Albaugh, Dynasty®, Apron®, Maxim®, Gaucho®, Provoke® ST, Syngenta CCB®, Trilex®, WG Purple, WG Silver, Azoxystrobin, Carboxin, Difenoconazole, Fludioxonil, fluxapyroxad, Ipconazole, Mefenoxam, Metalaxyl, Myclobutanil, Penflufen, pyraclostrobin, Sedaxane, TCMTB, Tebuconazole, Thiram, Triadimenol (Baytan®), Trifloxystrobin, Triticonazole, Tolclofos-methyl, PCNB, Abamectin, Chlorpyrifos, Clothianidin, Imidacloprid, Thiamethoxam, Thiodicarb.

In some cases, it can be important for the endophyte to be compatible with agrichemicals, particularly those with anticomplex properties, in order to persist in the plant although, as mentioned earlier, there are many such anticomplex agents that do not penetrate the plant, at least at a concentration sufficient to interfere with the endophyte. Therefore, where a systemic anticomplex agent is used in the plant, compatibility of the endophyte to be inoculated with such agents will be an important criterion.

In an embodiment, natural isolates of endophytes that are compatible with agrichemicals can be used to inoculate the plants according to the methods described herein. For example, endophytes that are compatible with agriculturally employed anticomplex agents can be isolated by plating a culture of endophytes on a petri dish comprising an effective concentration of the anticomplex agent, and isolating colonies of endophytes that are compatible with the anticomplex agent. In another embodiment, an endophyte that is compatible with an anticomplex agent is used for the methods described herein.

Bactericide-compatible endophyte can also be isolated by selection on liquid medium. The culture of endophytes can be plated on petri dishes without any forms of mutagenesis; alternatively, endophytes can be mutagenized using any means known in the art. For example, endophyte cultures can be exposed to UV light, gamma-irradiation, or chemical mutagens such as ethylmethanesulfonate (EMS), ethidium bromide (EtBr) dichlovos (DDVP, methyl methane sulphonale (MMS), triethylphosphate (TEP), trimethylphosphate (TMP), nitrous acid, or DNA base analogs, prior to selection on fungicide comprising media. Finally, where the mechanism of action of a particular bactericide is known, the target gene can be specifically mutated (either by gene deletion, gene replacement, site-directed mutagenesis, etc.) to generate an endophyte that is resilient against that particular chemical. It is noted that the above-described methods can be used to isolate endophytes that are compatible with both bacteriostatic and bactericidal compounds.

It will also be appreciated by one skilled in the art that a plant may be exposed to multiple types of anticomplex compounds, either simultaneously or in succession, for example at different stages of plant growth. Where the target plant is likely to be exposed to multiple anticomplex agents, an endophyte that is compatible with many or all of these agrichemicals can be used to inoculate the plant. An endophyte that is compatible with several agents can be isolated, for example, by serial selection. An endophyte that is compatible with the first agent can be isolated as described above (with or without prior mutagenesis). A culture of the resulting endophyte can then be selected for the ability to grow on liquid or solid media comprising the second agent (again, with or without prior mutagenesis). Colonies isolated from the second selection are then tested to confirm its compatibility to both agents.

Likewise, endophytes that are compatible to biocides (including herbicides such as glyphosate or anticomplex compounds, whether bacteriostatic or bactericidal) that are agriculturally employed can be isolated using methods similar to those described for isolating compatible endophytes. In one embodiment, mutagenesis of the endophyte population can be performed prior to selection with an anticomplex agent. In another embodiment, selection is performed on the endophyte population without prior mutagenesis. In still another embodiment, serial selection is performed on an endophyte: the endophyte is first selected for compatibility to a first anticomplex agent. The isolated compatible endophyte is then cultured and selected for compatibility to the second anticomplex agent. Any colony thus isolated is tested for compatibility to each, or both anticomplex agents to confirm compatibility with these two agents.

Compatibility with an antimicrobial agent can be determined by a number of means known in the art, including the comparison of the minimal inhibitory concentration (MIC) of the unmodified and modified endophytes. Therefore, in one embodiment, the present invention discloses an isolated modified endophyte, wherein the endophyte is modified such that it exhibits at least 3 fold greater, for example, at least 5 fold greater, between 5 and 10 fold greater, at least 10 fold greater, between 10 and 20 fold greater, at least 20 fold greater, between 20 and 30 fold greater, at least 30 fold greater or more MIC to an antimicrobial agent when compared with the unmodified endophyte.

In one embodiment, disclosed herein are endophytes with enhanced compatibility to the herbicide glyphosate. In one embodiment, the endophyte has a doubling time in growth medium comprising at least 1 mM glyphosate, for example, between 1 mM and 2 mM glyphosate, at least 2 mM glyphosate, between 2 mM and 5 mM glyphosate, at least 5 mM glyphosate, between 5 mM and 10 mM glyphosate, at least 10 mM glyphosate, between 10 mM and 15 mM glyphosate, at least 15 mM glyphosate or more, that is no more than 250%, between 250% and 100%, for example, no more than 200%, between 200% and 175%, no more than 175%, between 175% and 150%, no more than 150%, between 150% and 125%, or no more than 125%, of the doubling time of the endophyte in the same growth medium comprising no glyphosate. In one particular embodiment, the endophyte has a doubling time in growth medium comprising 5 mM glyphosate that is no more than 150% the doubling time of the endophyte in the same growth medium comprising no glyphosate.

In another embodiment, the endophyte has a doubling time in a plant tissue comprising at least 10 ppm glyphosate, between 10 and 15 ppm, for example, at least 15 ppm glyphosate, between 15 and 10 ppm, at least 20 ppm glyphosate, between 20 and 30 ppm, at least 30 ppm glyphosate, between 30 and 40 ppm, at least 40 ppm glyphosate or more, that is no more than 250%, between 250% and 200%, for example, no more than 200%, between 200% and 175%, no more than 175%, between 175% and 150%, no more than 150%, between 150% and 125%, or no more than 125%, of the doubling time of the endophyte in a reference plant tissue comprising no glyphosate. In one particular embodiment, the endophyte has a doubling time in a plant tissue comprising 40 ppm glyphosate that is no more than 150% the doubling time of the endophyte in a reference plant tissue comprising no glyphosate.

The selection process described above can be repeated to identify isolates of endophytes that are compatible with a multitude of agents.

Candidate isolates can be tested to ensure that the selection for agrichemical compatibility did not result in loss of a desired bioactivity. Isolates of endophytes that are compatible with commonly employed agents can be selected as described above. The resulting compatible endophyte can be compared with the parental endophyte on plants in its ability to promote germination.

The agrichemical compatible endophytes generated as described above can be detected in samples. For example, where a transgene was introduced to render the endophyte compatible with the agrichemical(s), the transgene can be used as a target gene for amplification and detection by PCR. In addition, where point mutations or deletions to a portion of a specific gene or a number of genes results in compatibility with the agrichemical(s), the unique point mutations can likewise be detected by PCR or other means known in the art. Such methods allow the detection of the endophyte even if it is no longer viable. Thus, commodity plant products produced using the agrichemical compatible endophytes described herein can readily be identified by employing these and related methods of nucleic acid detection.

Endophyte Selection: Combinations

Combinations of endophytes can be selected by any one or more of several criteria. In one embodiment, compatible endophytes are selected. As used herein, "compatibility" refers to endophyte populations that do not significantly interfere with the growth, propagation, and/or production of beneficial substances of the other. Incompatible endophyte populations can arise, for example, where one of the populations produces or secrets a compound that is toxic or deleterious to the growth of the other population(s). Incompatibility arising from production of deleterious compounds/agents can be detected using methods known in the art, and as described herein elsewhere. Similarly, the distinct populations can compete for limited resources in a way that makes co-existence difficult.

In another embodiment, combinations are selected on the basis of compounds produced by each population of endophytes. For example, the first population is capable of producing siderophores, and another population is capable of producing anti-fungal compounds. In an embodiment, the first population of endophytes or endophytic components is capable of a function selected from the group consisting of auxin production, nitrogen fixation, and production of an antimicrobial compound, siderophore production, mineral phosphate solubilization, cellulase production, chitinase production, xylanase production, and acetoin production, carbon source utilization, and combinations thereof. In another embodiment, the second population of endophytes or endophytic component is capable of a function selected from the group consisting of auxin production, nitrogen fixation, production of an antimicrobial compound, siderophore production, mineral phosphate solubilization, cellulase production, chitinase production, xylanase production, and acetoin production, and combinations thereof. In still another embodiment, the first and second populations are capable of at least one different function.

In still another embodiment, the combinations of endophytes are selected for their distinct localization in the plant after colonization. For example, the first population of endophytes or endophytic components can colonize, and in some cases preferentially colonize, the root tissue, while a second population can be selected on the basis of its preferential colonization of the aerial parts of the agricultural plant. Therefore, in an embodiment, the first population is capable of colonizing one or more of the tissues selected from the group consisting of a root, shoot, leaf, flower, and seed. In another embodiment, the second population is capable of colonizing one or more tissues selected from the group consisting of root, shoot, leaf, flower, and seed. In still another embodiment, the first and second populations are capable of colonizing a different tissue within the agricultural plant.

In some embodiments, combinations of endophytes are selected for their ability to confer a benefit to the host plant at different points in the life cycle of said host plant. In one example, one endophyte can be selected to impart improved seedling vigor, and a second endophyte can be selected to improve soil nutrient acquisition by roots of the mature plant.

In still another embodiment, combinations of endophytes are selected for their ability to confer one or more distinct fitness traits on the inoculated agricultural plant, either individually or in synergistic association with other endophytes. In another embodiment, one endophyte may induce the colonization of a second endophyte. Alternatively, two or more endophytes may induce the colonization of a third endophyte. For example, the first population of endophytes or endophytic components is selected on the basis that it confers significant increase in biomass, while the second population promotes increased drought tolerance on the inoculated agricultural plant. Therefore, in one embodiment, the first population is capable of conferring at least one trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof. In another embodiment, the second population is capable of conferring a trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, and enhanced soil water retention. In still another embodiment, each of the first and second population is capable of conferring a different trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, and enhanced soil water retention.

The combinations of endophytes can also be selected based on combinations of the above criteria. For example, the first population of endophytes can be selected on the basis of the compound it produces (e.g., its ability to fix nitrogen, thus providing a potential nitrogen source to the plant), while the second population can be selected on the basis of its ability to confer increased resistance of the plant to a pathogen (e.g., a fungal pathogen).

In some embodiments of the present invention, it is contemplated that combinations of endophytes can provide an increased benefit to the host plant, as compared to that conferred by a single endophyte, by virtue of additive effects. For example, one endophyte strain that induces a benefit in the host plant may induce such benefit equally well in a plant that is also colonized with a different endophyte strain that also induces the same benefit in the host plant. The host plant thus exhibits the same total benefit from the combination of different endophyte strains as the additive benefit to individual plants colonized with each individual endophyte of the combination. In one example, a plant is colonized with two different endophyte strains: one provides a 1× increase in biomass when associated with the plant, and the other provides a 2× increase in biomass when associated with a different plant. When both endophyte strains are associated with the same plant, that plant would experience a 3× (additive of 1×+2× single effects) increase in auxin biomass. Additive effects are a surprising embodiment of the present invention, as non-compatibility of endophytes may result in a cancellation of the beneficial effects of both endophytes.

In some embodiments of the present invention, it is contemplated that a combination of endophytes can provide an increased benefit to the host plant, as compared to that conferred by a single endophyte, by virtue of synergistic effects. For example, one endophyte strain that induces a benefit in the host plant may induce such benefit beyond additive effects in a plant that is also colonized with a different endophyte strain that also induces that benefit in the host plant. The host plant thus exhibits the greater total benefit from the combination of different endophyte strains than could be seen from the additive benefit of individual plants colonized with each individual endophyte of the combination. In one example, a plant is colonized with two different endophyte strains: one provides a 1× increase in biomass when associated with a plant, and the other provides a 2× increase in biomass when associated with a different plant. When both endophyte strains are associated with the same plant, that plant would experience a 5× (greater than an additive of 1×+2× single effects) increase in biomass. Synergistic effects are a surprising embodiment of the present invention.

Endophyte Selection: Compositions of the Invention

In some embodiments, the endophyte is selected from the genus *Streptomyces*. In some embodiments, the endophyte comprises a nucleotide sequence that is at least 97% identical to SEQ ID NO: 1. In some embodiments, the endophyte comprises a nucleotide sequence that is at least 97% identical to SEQ ID NO: 2. In some embodiments, the endophyte comprises a nucleotide sequence that is at least 97% identical to SEQ ID NO: 3. In some embodiments, the endophyte comprises a nucleotide sequence that is at least 97% identical to SEQ ID NO: 4. In some embodiments, the endophyte comprises a nucleotide sequence that is at least 97% identical to SEQ ID NO: 5. In some embodiments, the endophyte comprises a nucleotide sequence that is at least 97% identical to SEQ ID NO: 6. In some embodiments, the endophyte comprises a nucleotide sequence that is at least 97% identical to SEQ ID NO: 7. In some embodiments, the endophyte comprises a nucleotide sequence that is at least 97% identical to SEQ ID NO: 8. In some embodiments, the endophyte comprises a nucleotide sequence that is at least 97% identical to SEQ ID NO: 9. In some embodiments, the endophyte comprises a nucleotide sequence that is at least 97% identical to SEQ ID NO: 10. In some embodiments, the endophyte comprises a nucleotide sequence that is at least 97% identical to SEQ ID NO: 11. In some embodiments, the endophyte comprises a nucleotide sequence that is at least 97% identical to SEQ ID NO: 12. In some embodiments, the endophyte comprises a nucleotide sequence that is at least 97% identical to SEQ ID NO: 13. In some embodiments, the endophyte comprises a nucleotide sequence that is at least 97% identical to SEQ ID NO: 14. In some embodiments, the endophyte comprises a nucleotide sequence that is at least 97% identical to SEQ ID NO: 15. In some embodiments, the endophyte comprises a nucleotide sequence that is at least 97% identical to SEQ ID NO: 16. In some embodiments, the endophyte comprises a nucleotide sequence that is at least 97% identical to SEQ ID NO: 17. In some embodiments, the endophyte comprises a nucleotide sequence that is at least 97% identical to SEQ ID NO: 18.

In some embodiments, the endophyte is at least 97% identical to a sequence selected from the group consisting of SEQ ID NO: 1-SEQ ID NO:18. In some embodiments, the endophyte is between 97% and 98% identical, at least 98% identical, between 98% identical and 99% identical, or at least 99% identical to a sequence selected from the group consisting of SEQ ID NO: 1-SEQ ID NO:18.

In some cases, the endophyte, or one or more components thereof, is of monoclonal origin, providing high genetic uniformity of the endophyte population in an agricultural formulation or within a synthetic plant element or plant combination with the endophyte.

In some embodiments, the endophyte can be cultured on a culture medium or can be adapted to culture on a culture medium.

The compositions provided herein are preferably stable. The endophyte may be shelf-stable, where at least 0.01%, of the CFUs are viable after storage in desiccated form (i.e., moisture content of 30% or less) for 1, 2, 3, 4, 5, 6, 7, 8, 9, 10 or greater than 10 weeks at 4° C. or at room temperature. Optionally, a shelf-stable formulation is in a dry formulation, a powder formulation, or a lyophilized formulation. In some embodiments, the formulation is formulated to provide stability for the population of endophytes. In an embodiment, the formulation is substantially stable at temperatures between about −20° C. and about 50° C. for at least about 1, 2, 3, 4, 5, or 6 days, or 1, 2, 3 or 4 weeks, or 1, 2, 3, 4, 5, 6, 7, 8, 9, 10, 11 or 12 months, or one or more years. In another embodiment, the formulation is substantially stable at temperatures between about 4° C. and about 37° C. for at least about 5, 10, 15, 20, 25, 30 or greater than 30 days.

Endophytes and Synthetic Compositions with Plants and Plant Elements

It is contemplated that the methods and compositions of the present invention may be used to improve any characteristic of any agricultural plant. The methods described herein can also be used with transgenic plants comprising one or more exogenous transgenes, for example, to yield additional trait benefits conferred by the newly introduced endophytic microbes. Therefore, in one embodiment, a plant element of a transgenic soybean plant is contacted with an endophytic microbe. In one embodiment, a plant element of a transgenic maize plant is contacted with an endophytic microbe.

For example, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions.

In one embodiment, it is contemplated that the plant of the present invention is soybean (*Glycine max*).

The primary uses for harvested soybean crops include: soybean oil, soybean meal, livestock feed, and uses for human consumption. All parts of a soy plant are utilized, including the starch, flours, oils, and proteins.

The primary uses for harvested maize crops include: livestock feed, food for human consumption, biofuels, high fructose corn syrup, sweeteners, dry distiller grains, plastics, cosmetics, and textiles. All parts of a corn plant are utilized, including the starch, fiber, proteins, and oils.

The endophyte compositions and methods of the present invention are capable of providing improvements of agronomic interest agricultural plants, for example soybeans and maize.

In some embodiments, the present invention contemplates the use of endophytes that can confer a beneficial agronomic trait upon the plant element or resulting plant with which it is associated.

In some cases, the endophytes described herein are capable of moving from one tissue type to another. For example, the present invention's detection and isolation of endophytes within the mature tissues of plants after coating on the exterior of a plant element demonstrates their ability to move from the plant element into the vegetative tissues of a maturing plant. Therefore, in one embodiment, the population of endophytes is capable of moving from the plant element exterior into the vegetative tissues of a plant. In one embodiment, the endophyte that is coated onto the plant element of a plant is capable, upon germination of the plant element into a vegetative state, of localizing to a different tissue of the plant. For example, endophytes can be capable of localizing to any one of the tissues in the plant, including: the root, adventitious root, seminal root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem. In an embodiment, the endophyte is capable of localizing to the root and/or the root hair of the plant. In another embodiment, the endophyte is capable of localizing to the photosynthetic tissues, for example, leaves and shoots of the plant. In other cases, the endophyte is localized to the vascular tissues of the plant, for example, in the xylem and phloem. In still another embodiment, the endophyte is capable of localizing to the reproductive tissues (flower, pollen, pistil, ovaries, stamen, fruit) of the plant. In another embodiment, the endophyte is capable of localizing to the root, shoots, leaves and reproductive tissues of the plant. In still another embodiment, the endophyte colonizes a fruit or plant element tissue of the plant. In still another embodiment, the endophyte is able to colonize the plant such that it is present in the surface of the plant (i.e., its presence is detectably present on the plant exterior, or the episphere of the plant). In still other embodiments, the endophyte is capable of localizing to substantially all, or all, tissues of the plant. In certain embodiments, the endophyte is not localized to the root of a plant. In other cases, the endophyte is not localized to the photosynthetic tissues of the plant.

In some cases, endophytes are capable of replicating within the host plant and colonizing the plant.

As shown in the Examples section below, the endophyte populations described herein are capable of colonizing a host plant. Successful colonization can be confirmed by detecting the presence of the endophyte population within the plant. For example, after applying the fungi to the plant elements, high titers of the fungi can be detected in the roots and shoots of the plants that germinate from the plant elements. Detecting the presence of the endophyte inside the plant can be accomplished by measuring the viability of the endophyte after surface sterilization of the plant element or the plant: endophyte colonization results in an internal localization of the endophyte, rendering it resistant to conditions of surface sterilization. The presence and quantity of endophyte can also be established using other means known in the art, for example, immunofluorescence microscopy using microbe-specific antibodies, or fluorescence in situ hybridization (see, for example, Amann et al. (2001) Current Opinion in Biotechnology 12:231-236, incorporated herein by reference in its entirety). Alternatively, specific nucleic acid probes recognizing conserved sequences from an endophyte can be employed to amplify a region, for example by quantitative PCR, and correlated to CFUs by means of a standard curve.

In some cases, plants are inoculated with endophytes that are isolated from the same species of plant as the plant element of the inoculated plant. For example, an endophyte that is normally found in one variety of a plant is associated with a plant element of a plant of another variety of that plant that in its natural state lacks said endophyte. For example, an endophyte that is normally found in one variety of *Glycine max* (soybean) is associated with a plant element of a plant of another variety of *Glycine max* that in its natural state lacks said endophyte. In an embodiment, the endophyte is obtained from a plant of a related species of plant as the plant element of the inoculated plant. For example, an endophyte that is normally found in one species of a plant is applied to another species of the same genus, or vice versa. In some cases, plants are inoculated with endophytes that are heterologous to the plant element of the inoculated plant. In an embodiment, the endophyte is obtained from a plant of another species. For example, an endophyte that is normally found in dicots is applied to a monocot plant, or vice versa. In other cases, the endophyte to be inoculated onto a plant is obtained from a related species of the plant that is being inoculated. In one embodiment, the endophyte is obtained from a related taxon, for example, from a related species. The plant of another species can be an agricultural plant. In another embodiment, the endophyte is part of a designed composition inoculated into any host plant element.

In another embodiment, the endophyte is disposed, for example, on the surface of a reproductive element of an agricultural plant, in an amount effective to be detectable in the mature agricultural plant. In one embodiment, the endophyte is disposed in an amount effective to be detectable in an amount of at least about 100 CFU between 100 and 200 CFU, at least about 200 CFU, between 200 and 300 CFU, at least about 300 CFU, between 300 and 400 CFU, at least about 500 CFU, between 500 and 1,000 CFU, at least about 1,000 CFU, between 1,000 and 3,000 CFU, at least about 3,000 CFU, between 3,000 and 10,000 CFU, at least about 10,000 CFU, between 10,000 and 30,000 CFU, at least about 30,000 CFU, between 30,000 and 100,000 CFU, at least about 100,000 CFU or more in the mature agricultural plant.

In some cases, the endophyte is capable of colonizing particular plant elements or tissue types of the plant. In an embodiment, the endophyte is disposed on the plant element or seedling in an amount effective to be detectable within a target tissue of the mature agricultural plant selected from a fruit, a seed, a leaf, or a root, or portion thereof. For example, the endophyte can be detected in an amount of at least about 100 CFU, at least about 200 CFU, at least about 300 CFU, at least about 500 CFU, at least about 1,000 CFU, at least about 3,000 CFU, at least about 10,000 CFU, at least about 30,000 CFU, at least about 100,000 CFU or more, in the target tissue of the mature agricultural plant.

Beneficial Attributes of Synthetic Compositions of Plant Elements and Endophytes Improved Attributes Conferred by Endophytes The present invention contemplates the establishment of a relationship between a symbiont and a plant element. In one embodiment, endophyte association results in a detectable change to the plant element, or the whole plant. The detectable change can be an improvement in a number of agronomic traits (e.g., improved general health, increased response to biotic or abiotic stresses, or enhanced properties of the plant or a plant element, including fruits and grains). Alternatively, the detectable change can be a physiological or biological change that can be measured by methods known in the art. The detectable changes are described in more detail in the sections below. As used herein, an endophyte is considered to have conferred an improved agricultural trait whether or not the improved trait arose from the plant, the endophyte, or the concerted action between the plant and endophyte. Therefore, for example, whether a beneficial hormone or chemical is produced by the plant or the endophyte, for purposes of the present invention, the endophyte will be considered to have conferred an improved agronomic trait upon the host plant, as compared to an isoline plant that has not been associated with said endophyte.

In some embodiments, provided herein, are methods for producing a plant element of a plant with a heritably altered trait. The trait of the plant can be altered without known genetic modification of the plant genome, and comprises the following steps. First, a preparation of an isolated endophyte that is heterologous to the plant element of the plant is provided, and optionally processed to produce an endophyte formulation. The endophyte formulation is then contacted with the plant. The plants are then allowed to go to seed, and the seeds are collected.

Improved General Health

Also described herein are plants, and fields of plants, that are associated with beneficial endophytes, such that the overall fitness, productivity or health of the plant or a portion thereof, is maintained, increased and/or improved over a period of time. Improvement in overall plant health can be assessed using numerous physiological parameters including, but not limited to, height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof. Improved plant health, or improved field health, can also be demonstrated through improved resistance or response to a given stress, either biotic or abiotic stress, or a combination of one or more abiotic stresses, as provided herein.

Other Abiotic Stresses

Disclosed herein are endophyte-associated plants with increased resistance to an abiotic stress. Exemplary abiotic stresses include, but are not limited to: drought, heat, salt content, metal content, low nutrient conditions, cold, excess water conditions.

Drought and Heat Tolerance.

In some cases, a plant resulting from seeds or other plant elements treated with an endophyte can exhibit a physiological change, such as a compensation of the stress-induced reduction in photosynthetic activity. Fv/Fm tests whether or not plant stress affects photosystem II in a dark adapted state. Fv/Fm is one of the most commonly used chlorophyll fluorescence measuring parameter. The Fv/Fm test is designed to allow the maximum amount of the light energy to take the fluorescence pathway. It compares the dark-adapted leaf pre-photosynthetic fluorescent state, called minimum fluorescence, or Fo, to maximum fluorescence called Fm. In maximum fluorescence, the maximum number of reaction centers have been reduced or closed by a saturating light source. In general, the greater the plant stress, the fewer open reaction centers available, and the Fv/Fm ratio is lowered. Fv/Fm is a measuring protocol that works for many types of plant stress. For example, there would be a difference in the Fv/Fm after exposure of an endophyte treated plant that had been subjected to heat shock or drought conditions, as compared to a corresponding control, a genetically identical plant that does not contain the endophytes grown in the same conditions. In some cases, the endophyte-associated plant as disclosed herein can exhibit an increased change in photosynthetic activity $\Delta Fv$ ($\Delta Fv/Fm$) after heat-shock or drought stress treatment, for example 1, 2, 3, 4, 5, 6, 7 days or more after the heat-shock or drought stress treatment, or until photosynthesis ceases, as compared with corresponding control plant of similar developmental stage but not comprising endophytes. For example, a plant having an endophyte able to confer heat and/or drought-tolerance can exhibit a $\Delta Fv/Fm$ of from about 0.1 to about 0.8 after exposure to heat-shock or drought stress or a $\Delta Fv/Fm$ range of from about 0.03 to about 0.8 under one day, or 1, 2, 3, 4, 5, 6, 7, or over 7 days post heat-shock or drought stress treatment, or until photosynthesis ceases. In some embodiments, stress-induced reductions in photosynthetic activity can be compensated by at least about 0.25% (for example, at least about 0.5%, between 0.5% and 1%, at least about 1%, between 1% and 2%, at least about 2%, between 2% and 3%, at least about 3%, between 3% and 5%, at least about 5%, between 5% and 10%, at least about 8%, at least about 10%, between 10% and 15%, at least about 15%, between 15% and 20%, at least about 20%, between 20$ and 25%, at least about 25%, between 25% and 30%, at least about 30%, between 30% and 40%, at least about 40%, between 40% and 50%, at least about 50%, between 50% and 60%, at least about 60%, between 60% and 75%, at least about 75%, between 75% and 80%, at least about 80%, between 80% and 85%, at least about 85%, between 85% and 90%, at least about 90%, between 90% and 95%, at least about 95%, between 95% and 99%, at least about 99% or at least 100%) as compared to the photosynthetic activity decrease in a corresponding reference agricultural plant following heat shock conditions. Significance of the difference between endophyte-associated and reference agricultural plants can be established upon demonstrating statistical significance, for example at $p<0.05$ with an appropriate parametric or non-parametric statistic, e.g., Chi-square test, Student's t-test, Mann-Whitney test, or F-test based on the assumption or known facts that the endophyte-associated plant and reference agricultural plant have identical or near identical genomes (isoline comparison).

In some embodiments, the plants comprise endophytes able to increase heat and/or drought-tolerance in sufficient quantity, such that increased growth or improved recovery from wilting under conditions of heat or drought stress is observed. For example, an endophyte population described herein can be present in sufficient quantity in a plant, resulting in increased growth as compared to a plant that does not contain endophytes, when grown under drought conditions or heat shock conditions, or following such conditions. Increased heat and/or drought tolerance can be assessed with physiological parameters including, but not limited to, increased height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, wilt recovery, turgor pressure, or any combination thereof, as compared to a reference agricultural plant grown under similar conditions. For example, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions.

In various embodiments, endophytes introduced into the plant can confer in the resulting plant thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased protein content, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof. A difference between the endophyte-associated plant and a reference agricultural plant can also be measured using other methods known in the art.

Salt Stress.

In other embodiments, endophytes able to confer increased tolerance to salinity stress can be introduced into plants. The resulting plants comprising endophytes can exhibit increased resistance to salt stress, whether measured in terms of survival under saline conditions, or overall growth during, or following salt stress. The physiological parameters of plant health recited above, including height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof, can be used to measure growth, and compared with the growth rate of reference agricultural plants (e.g., isogenic plants without the endophytes) grown under identical conditions. For example, the endophyte may provide an improved benefit or tolerance to a plant that is of at least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions. In other instances, endophyte-associated plants and reference agricultural plants can be grown in soil or growth media comprising different concentration of sodium to establish the inhibitory concentration of sodium (expressed, for example, as the concentration in which growth of the plant is inhibited by 50% when compared with plants grown under no sodium stress). Therefore, in another embodiment, a plant resulting from plant elements comprising an endophyte able to confer salt tolerance described herein exhibits an increase in the inhibitory sodium concentration by at least 10 mM, between 10 mM and 15 mM, for example at least 15 mM, between 15 mM and 20 mM, at least 20 mM, between 20 mM and 30 mM, at least 30 mM, between 30 mM and 40 mM, at least 40 mM, between 40 mM and 50 mM, at least 50 mM, between 50 mM and 60 mM, at least 60 mM, between 60 mM and 70 mM, at least 70 mM, between 70 mM and 80 mM, at least 80 mM, between 80 mM and 90 mM, at least 90 mM, between 90 mM and 100 mM, at least 100 mM or more, when compared with the reference agricultural plants.

High Metal Content.

Plants are sessile organisms and therefore must contend with the environment in which they are placed. Plants have adapted many mechanisms to deal with chemicals and substances that may be deleterious to their health. Heavy metals in particular represent a class of toxins that are highly relevant for plant growth and agriculture, because many of them are associated with fertilizers and sewage sludge used to amend soils and can accumulate to toxic levels in agricultural fields. Therefore, for agricultural purposes, it is important to have plants that are able to tolerate soils comprising elevated levels of toxic heavy metals. Plants cope with toxic levels of heavy metals (for example, nickel, cadmium, lead, mercury, arsenic, or aluminum) in the soil by excretion and internal sequestration. Endophytes that are able to confer increased heavy metal tolerance may do so by enhancing sequestration of the metal in certain compartments away from the seed or fruit and/or by supplementing other nutrients necessary to remediate the stress. Use of such endophytes in a plant would allow the development of novel plant-endophyte combinations for purposes of environmental remediation (also known as phytoremediation). Therefore, in one embodiment, the plant comprising endophytes shows increased metal tolerance as compared to a reference agricultural plant grown under the same heavy metal concentration in the soil.

Alternatively, the inhibitory concentration of the heavy metal can be determined for endophyte-associated plant and compared with a reference agricultural plant under the same conditions. Therefore, in one embodiment, the plants resulting from plant elements comprising an endophyte able to confer heavy metal tolerance described herein exhibit an increase in the inhibitory metal concentration by at least 0.1 mM, between 0.1 mM and 0.3 mM, for example at least 0.3 mM, between 0.3 mM and 0.5 mM, at least 0.5 mM, between 0.5 mM and 1 mM, at least 1 mM, between 1 mM and 2 mM, at least 2 mM, between 2 mM and 5 mM, at least 5 mM, between 5 mM and 10 mM, at least 10 mM, between 10 mM and 15 mM, at least 15 mM, between 15 mM and 20 mM, at least 20 mM, between 20 mM and 30 mM, at least 30 mM, between 30 mM and 50 mM, at least 50 mM or more, when compared with the reference agricultural plants.

Finally, plants inoculated with endophytes that are able to confer increased metal tolerance exhibit an increase in overall metal excretion by at least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions.

Low Nutrient Stress.

Endophytes described herein may also confer to the plant an increased ability to grow in nutrient limiting conditions, for example by solubilizing or otherwise making available to the plants macronutrients or micronutrients that are complexed, insoluble, or otherwise in an unavailable form. In one embodiment, a plant is inoculated with an endophyte that confers increased ability to liberate and/or otherwise provide to the plant with nutrients selected from the group consisting of phosphate, nitrogen, potassium, iron, manganese, calcium, molybdenum, vitamins, or other micronutrients. Such a plant can exhibit increased growth in soil comprising limiting amounts of such nutrients when compared with reference agricultural plant. Differences between the endophyte-associated plant and reference agricultural plant can be measured by comparing the biomass of the two plant types grown under limiting conditions, or by measuring the physical parameters described above. Therefore, in one embodiment, the plant comprising endophyte shows increased tolerance to nutrient limiting conditions as compared to a reference agricultural plant grown under the same nutrient limited concentration in the soil, as measured for example by increased biomass or seed yield of at least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions.

Cold Stress.

In some cases, endophytes can confer to the plant the ability to tolerate cold stress. As used herein, cold stress refers to both the stress induced by chilling (0° C.-15° C.) and freezing (<0° C.). Some cultivars of agricultural plants can be particularly sensitive to cold stress, but cold tolerance traits may be multigenic, making the breeding process difficult. Endophytes able to confer cold tolerance can reduce the damage suffered by farmers on an annual basis. Improved response to cold stress can be measured by survival of plants, production of protectant substances such as anthocyanin, the amount of necrosis of parts of the plant, or a change in crop yield loss, as well as the physiological parameters used in other examples. Therefore, in an embodiment, the plant comprising endophytes shows increased cold tolerance exhibits as compared to a reference agricultural plant grown under the same conditions of cold stress. For example, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions.

Biotic Stress.

In other embodiments, the endophyte protects the plant from a biotic stress, for example, insect infestation, nematode infestation, complex infection, fungal infection, bacterial infection, oomycete infection, protozoal infection, viral infection, and herbivore grazing, or a combination thereof. For example, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions.

Insect Herbivory.

There are an abundance of insect pest species that can infect or infest a wide variety of plants. Pest infestation can lead to significant damage. Insect pests that infest plant species are particularly problematic in agriculture as they can cause serious damage to crops and significantly reduce plant yields. A wide variety of different types of plant are susceptible to pest infestation including commercial crops such as cotton, soybean, wheat, barley, and corn (maize).

In some cases, endophytes described herein may confer upon the host plant the ability to repel insect herbivores. In other cases, endophytes may produce, or induce the production in the plant of, compounds which are insecticidal or insect repellant. The insect may be any one of the common pathogenic insects affecting plants, particularly agricultural plants.

The endophyte-associated plant can be tested for its ability to resist, or otherwise repel, pathogenic insects by measuring, for example, insect load, overall plant biomass, biomass of the fruit or grain, percentage of intact leaves, or other physiological parameters described herein, and comparing with a reference agricultural plant. In an embodiment, the endophyte-associated plant exhibits increased biomass as compared to a reference agricultural plant grown under the same conditions (e.g., grown side-by-side, or adjacent to, endophyte-associated plants). In other embodiments, the endophyte-associated plant exhibits increased fruit or grain yield as compared to a reference agricultural plant grown under the same conditions (e.g., grown side-by-side, or adjacent to, endophyte-associated plants).

Nematodes.

Nematodes are microscopic roundworms that feed on the roots, fluids, leaves and stems of more than 2,000 row crops, vegetables, fruits, and ornamental plants, causing an estimated $100 billion crop loss worldwide and accounting for 13% of global crop losses due to disease. A variety of parasitic nematode species infect crop plants, including root-knot nematodes (RKN), cyst- and lesion-forming nematodes. Root-knot nematodes, which are characterized by causing root gall formation at feeding sites, have a relatively broad host range and are therefore parasitic on a large number of crop species. The cyst- and lesion-forming nematode species have a more limited host range, but still cause considerable losses in susceptible crops.

Signs of nematode damage include stunting and yellowing of leaves, and wilting of the plants during hot periods. Nematode infestation, however, can cause significant yield losses without any obvious above-ground disease symptoms. The primary causes of yield reduction are due to underground root damage. Roots infected by SCN are dwarfed or stunted. Nematode infestation also can decrease the number of nitrogen-fixing nodules on the roots, and may make the roots more susceptible to attacks by other soil-borne plant nematodes.

In an embodiment, the endophyte-associated plant has an increased resistance to a nematode when compared with a reference agricultural plant. As before with insect herbivores, biomass of the plant or a portion of the plant, or any of the other physiological parameters mentioned elsewhere, can be compared with the reference agricultural plant grown under the same conditions. Particularly useful measurements include overall plant biomass, biomass and/or size of the fruit or grain, and root biomass. In one embodiment, the endophyte-associated plant exhibits increased biomass as compared to a reference agricultural plant grown under the same conditions (e.g., grown side-by-side, or adjacent to, the endophyte-associated plants, under conditions of nematode challenge). In another embodiment, the endophyte-associated plant exhibits increased root biomass as compared to a reference agricultural plant grown under the same conditions (e.g., grown side-by-side, or adjacent to, the endophyte-associated plants, under conditions of nematode challenge). In still another embodiment, the endophyte-associated plant exhibits increased fruit or grain yield as compared to a reference agricultural plant grown under the same conditions (e.g., grown side-by-side, or adjacent to, the endophyte-associated plants, under conditions of nematode challenge).

Fungal Pathogens.

Fungal diseases are responsible for yearly losses of over $10 Billion on agricultural crops in the US, represent 42% of global crop losses due to disease, and are caused by a large variety of biologically diverse pathogens. Different strategies have traditionally been used to control them. Resistance traits have been bred into agriculturally important varieties, thus providing various levels of resistance against either a narrow range of pathogen isolates or races, or against a broader range. However, this involves the long and labor intensive process of introducing desirable traits into commercial lines by genetic crosses and, due to the risk of pests evolving to overcome natural plant resistance, a constant effort to breed new resistance traits into commercial lines is required. Alternatively, fungal diseases have been controlled by the application of chemical fungicides. This strategy usually results in efficient control, but is also associated with the possible development of resistant pathogens and can be associated with a negative impact on the environment. Moreover, in certain crops, such as barley and wheat, the control of fungal pathogens by chemical fungicides is difficult or impractical.

The present invention contemplates the use of endophytes that are able to confer resistance to fungal pathogens to the host plant. Increased resistance to fungal inoculation can be measured, for example, using any of the physiological parameters presented above, by comparing with reference agricultural plants. In an embodiment, the endophyte-associated plant exhibits increased biomass and/or less pronounced disease symptoms as compared to a reference agricultural plant grown under the same conditions (e.g., grown side-by-side, or adjacent to, the endophyte-associated plants, infected with the fungal pathogen). In still another embodiment, the endophyte-associated plant exhibits increased fruit or grain yield as compared to a reference agricultural plant grown under the same conditions (e.g., grown side-by-side, or adjacent to, the endophyte-associated plants, infected with the fungal pathogen). In another embodiment, the endophyte-associated plant exhibits decreased hyphal growth as compared to a reference agricultural plant grown under the same conditions (e.g., grown side-by-side, or adjacent to, the endophyte-associated plants, infected with the fungal pathogen). For example, the endophyte may provide an improved benefit to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions.

Viral Pathogens.

Plant viruses are estimated to account for 18% of global crop losses due to disease. There are numerous examples of viral pathogens affecting agricultural productivity. In an embodiment, the endophyte provides protection against viral pathogens such that the plant has increased biomass as compared to a reference agricultural plant grown under the same conditions. In still another embodiment, the endophyte-associated plant exhibits greater fruit or grain yield, when challenged with a virus, as compared to a reference agricultural plant grown under the same conditions. In yet another embodiment, the endophyte-associated plant exhibits lower viral titer, when challenged with a virus, as compared to a reference agricultural plant grown under the same conditions.

Complex Pathogens.

Likewise, bacterial pathogens are a significant problem negatively affecting agricultural productivity and accounting for 27% of global crop losses due to plant disease. In an embodiment, the endophyte described herein provides protection against bacterial pathogens such that the plant has greater biomass as compared to a reference agricultural plant grown under the same conditions. In still another embodiment, the endophyte-associated plant exhibits greater fruit or grain yield, when challenged with a complex pathogen, as compared to a reference agricultural plant grown under the same conditions. In yet another embodiment, the endophyte-associated plant exhibits lower complex count, when challenged with a bacterium, as compared to a reference agricultural plant grown under the same conditions.

Improvement of Other Traits

In other embodiments, the endophyte can confer other beneficial traits to the plant. Improved traits can include an improved nutritional content of the plant or plant element used for human consumption. In one embodiment, the endophyte-associated plant is able to produce a detectable change in the content of at least one nutrient. Examples of such nutrients include amino acid, protein, oil (including any one of Oleic acid, Linoleic acid, Alpha-linoleic acid, Saturated fatty acids, Palmitic acid, Stearic acid and Trans fats), carbohydrate (including sugars such as sucrose, glucose and fructose, starch, or dietary fiber), Vitamin A, Thiamine (vit. B1), Riboflavin (vit. B2), Niacin (vit. B3), Pantothenic acid (B5), Vitamin B6, Folate (vit. B9), Choline, Vitamin C, Vitamin E, Vitamin K, Calcium, Iron, Magnesium, Manganese, Phosphorus, Potassium, Sodium, Zinc. In an embodiment, the endophyte-associated plant or part thereof contains at least one increased nutrient when compared with reference agricultural plants.

In other cases, the improved trait can include reduced content of a harmful or undesirable substance when compared with reference agricultural plants. Such compounds include those which are harmful when ingested in large quantities or are bitter tasting (for example, oxalic acid, amygdalin, certain alkaloids such as solanine, caffeine, nicotine, quinine and morphine, tannins, cyanide). As such, in one embodiment, the endophyte-associated plant or part thereof contains less of the undesirable substance when compared with reference agricultural plant. In a related embodiment, the improved trait can include improved taste of the plant or a part of the plant, including the fruit or plant reproductive element. In a related embodiment, the improved trait can include reduction of undesirable compounds produced by other endophytes in plants, such as degradation of *Fusarium*-produced deoxynivalenol (also known as vomitoxin and a virulence factor involved in *Fusarium* head blight of maize and wheat) in a part of the plant, including the fruit or plant reproductive element.

In other cases, the improved trait can be an increase in overall biomass of the plant or a part of the plant, including its fruit or plant reproductive element.

The endophyte-associated plant can also have an altered hormone status or altered levels of hormone production when compared with a reference agricultural plant. An alteration in hormonal status may affect many physiological parameters, including flowering time, water efficiency, apical dominance and/or lateral shoot branching, increase in root hair, and alteration in fruit ripening.

The association between the endophyte and the plant can also be detected using other methods known in the art. For example, the biochemical, metabolomics, proteomic, genomic, epigenomic and/or transcriptomic profiles of endophyte-associated plants can be compared with reference agricultural plants under the same conditions.

Methods of Using Endophytes and Synthetic Compositions Comprising Endophytes

As described herein, purified endophyte populations and compositions comprising the same (e.g., formulations) can be used to confer beneficial traits to the host plant including, for example, one or more of the following: increased root biomass, increased root length, increased height, increased shoot length, increased leaf number, improved water use efficiency (drought tolerance), increased overall biomass, increase grain yield, increased photosynthesis rate, increased tolerance to drought, increased heat tolerance, increased salt tolerance, increased resistance to nematode stress, increased resistance to a fungal pathogen, increased resistance to a complex pathogen, increased resistance to a viral pathogen, a detectable modulation in the level of a metabolite, and a detectable modulation in the proteome relative to a reference plant. For example, in some embodiments, a purified endophyte population can improve two or more such beneficial traits, e.g., water use efficiency and increased tolerance to drought.

In some cases, the endophyte may produce one or more compounds and/or have one or more activities, e.g., one or more of the following: production of a metabolite, production of a phytohormone such as auxin, production of acetoin, production of an antimicrobial compound, production of a siderophore, production of a cellulase, production of a pectinase, production of a chitinase, production of a xylanase, nitrogen fixation, or mineral phosphate solubilization. For example, an endophyte can produce a phytohormone selected from the group consisting of an auxin, a cytokinin, a gibberellin, ethylene, a brassinosteroid, and abscisic acid. In one particular embodiment, the endophyte produces auxin (e.g., indole-3-acetic acid (IAA)). Production of auxin can be assayed as described herein. Many of the microbes described herein are capable of producing the plant hormone auxin indole-3-acetic acid (IAA) when grown in culture. Auxin plays a key role in altering the physiology of the plant, including the extent of root growth. Therefore, in another embodiment, the endophytic population is disposed on the surface or within a tissue of the seed or seedling in an amount effective to detectably increase production of auxin in the agricultural plant when compared with a reference agricultural plant. In one embodiment, the increased auxin production can be detected in a tissue type selected from the group consisting of the root, shoot, leaves, and flowers.

In some embodiments, the endophyte can produce a compound with antimicrobial properties. For example, the compound can have antibacterial properties, as determined by the growth assays provided herein. In one embodiment, the compound with antibacterial properties shows bacteriostatic or bactericidal activity against *E. coli* and/or *Bacillus* sp. In another embodiment, the endophyte produces a compound with antifungal properties, for example, fungicidal or fungistatic activity against *S. cerevisiae* and/or *Rhizoctonia*.

In some embodiments, the endophyte is a bacterium capable of nitrogen fixation, and is thus capable of producing ammonium from atmospheric nitrogen. The ability of a bacterium to fix nitrogen can be confirmed by testing for growth of the bacterium in nitrogen-free growth media, for example, LGI media, as described herein.

In some embodiments, the endophyte can produce a compound that increases the solubility of mineral phosphate in the medium, i.e., mineral phosphate solubilization, for example, using the growth assays described herein. In one embodiment, the endophyte produces a compound that allows the bacterium to grow in growth media comprising $Ca_3HPO_4$ as the sole phosphate source.

In some embodiments, the endophyte can produce a siderophore. Siderophores are small high-affinity iron chelating agents secreted by microorganisms that increase the bioavailability of iron. Siderophore production by the endophyte can be detected, for example, using any known method in the art.

In some embodiments, the endophyte can produce a hydrolytic enzyme. For example, in one embodiment, an endophyte can produce a hydrolytic enzyme selected from the group consisting of a cellulase, a pectinase, a chitinase and a xylanase. Hydrolytic enzymes can be detected using the methods known in the art.

In some embodiments, metabolites in plants can be modulated by making synthetic compositions of purified endophytic populations. For example, an endophyte described herein can cause a detectable modulation (e.g., an increase or decrease) in the level of various metabolites, e.g., indole-3-carboxylic acid, trans-zeatin, abscisic acid, phaseic acid, indole-3-acetic acid, indole-3-butyric acid, indole-3-acrylic acid, jasmonic acid, jasmonic acid methyl ester, dihydrophaseic acid, gibberellin A3, salicylic acid, upon colonization of a plant.

In some embodiments, the endophyte modulates the level of the metabolite directly (e.g., the microbe itself produces the metabolite, resulting in an overall increase in the level of the metabolite found in the plant). In other cases, the agricultural plant, as a result of the association with the endophytic microbe (e.g., an endophyte), exhibits a modulated level of the metabolite (e.g., the plant reduces the expression of a biosynthetic enzyme responsible for production of the metabolite as a result of the microbe inoculation). In still other cases, the modulation in the level of the metabolite is a consequence of the activity of both the microbe and the plant (e.g., the plant produces increased amounts of the metabolite when compared with a reference agricultural plant, and the endophytic microbe also produces the metabolite). Therefore, as used herein, a modulation in the level of a metabolite can be an alteration in the metabolite level through the actions of the microbe and/or the inoculated plant.

The levels of a metabolite can be measured in an agricultural plant, and compared with the levels of the metabolite in a reference agricultural plant, and grown under the same conditions as the inoculated plant. The uninoculated plant that is used as a reference agricultural plant is a plant that has not been applied with a formulation with the endophytic microbe (e.g., a formulation comprising a population of purified endophytes). The uninoculated plant used as the reference agricultural plant is generally the same species and cultivar as, and is isogenic to, the inoculated plant.

The metabolite whose levels are modulated (e.g., increased or decreased) in the endophyte-associated plant may serve as a primary nutrient (i.e., it provides nutrition for the humans and/or animals who consume the plant, plant tissue, or the commodity plant product derived therefrom, including, but not limited to, a sugar, a starch, a carbohydrate, a protein, an oil, a fatty acid, a mineral, or a vitamin). The metabolite can be a compound that is important for plant growth, development or homeostasis (for example, a phytohormone such as an auxin, cytokinin, gibberellin, a brassinosteroid, ethylene, or abscisic acid, a signaling molecule, or an antioxidant). In other embodiments, the metabolite can have other functions. For example, in one embodiment, a metabolite can have bacteriostatic, bactericidal, fungistatic, fungicidal or antiviral properties. In other embodiments, the metabolite can have insect-repelling, insecticidal, nematode-repelling, or nematicidal properties. In still other embodiments, the metabolite can serve a role in protecting the plant from stresses, may help improve plant vigor or the general health of the plant. In yet another embodiment, the metabolite can be a useful compound for industrial production. For example, the metabolite may itself be a useful compound that is extracted for industrial use, or serve as an intermediate for the synthesis of other compounds used in industry. In a particular embodiment, the level of the metabolite is increased within the agricultural plant or a portion thereof such that it is present at a concentration of at least 0.1 ug/g dry weight, between 0.1 ug/g to 0.3 ug/g, for example, at least 0.3 ug/g dry weight, between 0.3 ug/g to 1.0 ug/g, 1.0 ug/g dry weight, between 1 ug/g and 3 ug/g, 3.0 ug/g dry weight, between 3 ug/g and 10 ug/g, 10 ug/g dry weight, between 10 ug/g and 30 ug/g, 30 ug/g dry weight, between 30 ug/g and 100 ug/g, 100 ug/g dry weight, between 100 ug/g and 300 ug/g, 300 ug/g dry weight, between 300 ug/g and 1 mg/g, 1 mg/g dry weight, between 1 mg/g and 3 mg/g, 3 mg/g dry weight, between 3 mg/g and 10 mg/g, 10 mg/g dry weight, between 10 mg/g and 30 mg/g, 30 mg/g dry weight, between 30 mg/g and 100 mg/g, 100 mg/g dry weight or more, of the plant or portion thereof.

Likewise, the modulation can be a decrease in the level of a metabolite. The reduction can be in a metabolite affecting the taste of a plant or a commodity plant product derived from a plant (for example, a bitter tasting compound), or in a metabolite which makes a plant or the resulting commodity plant product otherwise less valuable (for example, reduction of oxalate content in certain plants, or compounds which are deleterious to human and/or animal health). The metabolite whose level is to be reduced can be a compound that affects quality of a commodity plant product (e.g., reduction of lignin levels).

In some embodiments, the endophyte is capable of generating a complex network in the plant or surrounding environment of the plant, which network is capable of causing a detectable modulation in the level of a metabolite in the host plant.

In a particular embodiment, the metabolite can serve as a signaling or regulatory molecule. The signaling pathway can be associated with a response to a stress, for example, one of the stress conditions selected from the group consisting of drought stress, salt stress, heat stress, cold stress, low nutrient stress, nematode stress, insect herbivory stress, fungal pathogen stress, complex pathogen stress, and viral pathogen stress.

The inoculated agricultural plant is grown under conditions such that the level of one or more metabolites is modulated in the plant, wherein the modulation is indicative of increased resistance to a stress selected from the group consisting of drought stress, salt stress, heat stress, cold stress, low nutrient stress, nematode stress, insect herbivory stress, fungal pathogen stress, complex pathogen stress, and viral pathogen stress. The increased resistance can be measured at about 10 minutes after applying the stress, between 10 minutes and 20 minutes, for example about 20 minutes, between 20 and 30 minutes, 30 minutes, between 30 and 45 minutes, about 45 minutes, between 45 minutes and 1 hour, about 1 hour, between 1 and 2 hours, about 2 hours, between 2 and 4 hours, about 4 hours, between 4 and 8 hours, about 8 hours, between 8 and 12 hours, about 12 hours, between 12 and 16 hours, about 16 hours, between 16 and 20 hours, about 20 hours, between 20 and 24 hours, about 24 hours, between 24 and 36 hours, about 36 hours, between 36 and 48 hours, about 48 hours, between 48 and 72 hours, about 72 hours, between 72 and 96 hours, about 96 hours, between 96 and 120 hours, about 120 hours, between 120 hours and one week, or about a week after applying the stress.

The metabolites or other compounds described herein can be detected using any suitable method including, but not limited to gel electrophoresis, liquid and gas phase chromatography, either alone or coupled to mass spectrometry, NMR, immunoassays (radioimmunoassays (RIA) or enzyme-linked immunosorbent assays (ELISA)), chemical assays, spectroscopy and the like. In some embodiments, commercial systems for chromatography and NMR analysis are utilized.

In other embodiments, metabolites or other compounds are detected using optical imaging techniques such as magnetic resonance spectroscopy (MRS), magnetic resonance imaging (MRI), CAT scans, ultra sound, MS-based tissue imaging or X-ray detection methods (e.g., energy dispersive x-ray fluorescence detection).

Any suitable method may be used to analyze the biological sample (e.g., seed or plant tissue) in order to determine the presence, absence or level(s) of the one or more metabolites or other compounds in the sample. Suitable methods include chromatography (e.g., HPLC, gas chromatography, liquid chromatography), mass spectrometry (e.g., MS, MS-MS), LC-MS, enzyme-linked immunosorbent assay (ELISA), antibody linkage, other immunochemical techniques, biochemical or enzymatic reactions or assays, and combinations thereof. The levels of one or more of the recited metabolites or compounds may be determined in the methods of the present invention. For example, the level(s) of one metabolites or compounds, two or more metabolites, three or more metabolites, four or more metabolites, five or more metabolites, six or more metabolites, seven or more metabolites, eight or more metabolites, nine or more metabolites, ten or more metabolites, or compounds etc., including a combination of some or all of the metabolites or compounds including, but not limited to those disclosed herein may be determined and used in such methods.

In some embodiments, a synthetic composition of a plant and a formulation comprising at least one endophytic microbe will cause an increase in the level of a protein in the plant.

In some embodiments, a synthetic composition of a plant and a formulation comprising at least one endophytic microbe will cause a decrease in the level of a protein in the plant.

In some embodiments, a synthetic composition of a plant and a formulation comprising at least one endophytic microbe will cause an increase in the level of expression of a gene in the plant.

In some embodiments, a synthetic composition of a plant and a formulation comprising at least one endophytic microbe will cause a decrease in the level of expression of a gene in the plant.

In some embodiments, a synthetic composition of a plant and a formulation comprising at least one endophytic microbe will cause an increase in the level of a plant hormone.

In some embodiments, a synthetic composition of a plant and a formulation comprising at least one endophytic microbe will cause a modulation in the concentration or amount of a metabolite.

As shown in the Examples and otherwise herein, endophyte-inoculated plants display increased thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased protein content, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof.

Therefore, in an embodiment, the endophytic population is disposed on the surface or on or within a tissue of the seed or seedling in an amount effective to increase the biomass of the plant, or a part or tissue of the plant derived from the seed or seedling. The increased biomass is useful in the production of commodity products derived from the plant. Such commodity products include an animal feed, a fish fodder, a cereal product, a processed human-food product, a sugar or an alcohol. Such products may be a fermentation product or a fermentable product, one such exemplary product is a biofuel. The increase in biomass can occur in a part of the plant (e.g., the root tissue, shoots, leaves, etc.), or can be an increase in overall biomass when compared with a reference agricultural plant. Such increase in overall biomass can be under relatively stress-free conditions. In other cases, the increase in biomass can be in plants grown under any number of abiotic or biotic stresses, including drought stress, salt stress, heat stress, cold stress, low nutrient stress, nematode stress, insect herbivory stress, fungal pathogen stress, complex pathogen stress, and viral pathogen stress.

In another embodiment, the endophytic population is disposed on the surface or within a tissue of the seed or seedling in an amount effective to increase the rate of seed germination when compared with a reference agricultural plant.

In other cases, the microbe is disposed on the seed or seedling in an amount effective to increase the average biomass of the fruit or cob from the resulting plant when compared with a reference agricultural plant.

Plants inoculated with an endophytic population may also show an increase in overall plant height. Therefore, in an embodiment, the present invention provides for a seed comprising an endophytic population that is disposed on the surface or within a tissue of the seed or seedling in an amount effective to increase the height of the plant. For example, the endophytic population is disposed in an amount effective to result in an increase in height of the agricultural plant when compared with a reference agricultural plant. Such an increase in height can be under relatively stress-free conditions. In other cases, the increase in height can be in plants grown under any number of abiotic or biotic stresses, including drought stress, salt stress, heat stress, cold stress, low nutrient stress, nematode stress, insect herbivory stress, fungal pathogen stress, complex pathogen stress, or viral pathogen stress.

In another embodiment, the plant containing the endophyte is able to grown under nutrient stress conditions while exhibiting no difference in the physiological parameter compared to a plant that is grown without nutrient stress. In some embodiments, such a plant will exhibit no difference in the physiological parameter when grown with 2-5% less nitrogen than average cultivation practices on normal agricultural land, for example, at least 5-10% less nitrogen, at least 10-15% less nitrogen, at least 15-20% less nitrogen, at least 20-25% less nitrogen, at least 25-30% less nitrogen, at least 30-35% less nitrogen, at least 35-40% less nitrogen, at least 40-45% less nitrogen, at least 45-50% less nitrogen, at least 50-55% less nitrogen, at least 55-60% less nitrogen, at least 60-65% less nitrogen, at least 65-70% less nitrogen, at least 70-75% less nitrogen, at least 80-85% less nitrogen, at least 85-90% less nitrogen, at least 90-95% less nitrogen, or less, when compared with crop plants grown under normal conditions during an average growing season. In some embodiments, the microbe capable of providing nitrogen-stress tolerance to a plant is diazotrophic. In other embodiments, the microbe capable of providing nitrogen-stress tolerance to a plant is non-diazotrophic.

The host plants inoculated with the endophytic population may also show improvements in their ability to utilize water more efficiently. Water use efficiency is a parameter often correlated with drought tolerance. Water use efficiency (WUE) is a parameter often correlated with drought tolerance, and is the $CO_2$ assimilation rate per amount of water transpired by the plant. An increase in biomass at low water availability may be due to relatively improved efficiency of growth or reduced water consumption. In selecting traits for improving crops, a decrease in water use, without a change in growth would have particular merit in an irrigated agricultural system where the water input costs were high. An increase in growth without a corresponding jump in water use would have applicability to all agricultural systems. In many agricultural systems where water supply is not limiting, an increase in growth, even if it came at the expense of an increase in water use also increases yield.

When soil water is depleted or if water is not available during periods of drought, crop yields are restricted. Plant water deficit develops if transpiration from leaves exceeds the supply of water from the roots. The available water supply is related to the amount of water held in the soil and the ability of the plant to reach that water with its root system. Transpiration of water from leaves is linked to the fixation of carbon dioxide by photosynthesis through the stomata. The two processes are positively correlated so that high carbon dioxide influx through photosynthesis is closely linked to water loss by transpiration. As water transpires from the leaf, leaf water potential is reduced and the stomata tend to close in a hydraulic process limiting the amount of photosynthesis. Since crop yield is dependent on the fixation of carbon dioxide in photosynthesis, water uptake and transpiration are contributing factors to crop yield. Plants which are able to use less water to fix the same amount of carbon dioxide or which are able to function normally at a low water potential, are more efficient and thereby are able to produce more biomass and economic yield in many agricultural systems. An increased water use efficiency of the plant relates in some cases to an increased fruit/kernel size or number.

Therefore, in one embodiment, the plants described herein exhibit an increased water use efficiency (WUE) when compared with a reference agricultural plant grown under the same conditions. For example, the endophyte may provide an increase in WUE to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with uninoculated plants grown under the same conditions. Such an increase in WUE can occur under conditions without water deficit, or under conditions of water deficit, for example, when the soil water content is less than or equal to 60% of water saturated soil, for example, less than or equal to 50%, less than or equal to 40%, less than or equal to 30%, less than or equal to 20%, less than or equal to 10% of water saturated soil on a weight basis. In some embodiments, the plants inoculated with the endophytic population show increased yield under non-irrigated conditions, as compared to reference agricultural plants grown under the same conditions.

In a related embodiment, the plant comprising endophyte can have a higher relative water content (RWC), than a reference agricultural plant grown under the same conditions.

Formulations for Agricultural Use

The endophyte populations described herein are intended to be useful in the improvement of agricultural plants, and as such, may be formulated with other compositions as part of an agriculturally compatible carrier. It is contemplated that such carriers can include applications such as, but not be limited to: seed treatment, root wash, seedling soak, foliar application, soil inocula, in-furrow application, sidedress application, soil pre-treatment, wound inoculation, drip tape irrigation, vector-mediation via a pollinator, injection, osmopriming, hydroponics, aquaponics, aeroponics. The carrier composition with the endophyte populations, may be prepared for agricultural application as a liquid, a solid, or a gas formulation. Application to the plant may be achieved, for example, as a powder for surface deposition onto plant leaves, as a spray to the whole plant or selected plant element, as part of a drip to the soil or the roots, or as a coating onto the plant element prior to planting. Such examples are meant to be illustrative and not limiting to the scope of the invention.

The formulation useful for these embodiments generally and typically include at least one member selected from the group consisting of a buffer, a tackifier, a microbial stabilizer, a fungicide, an anticomplex agent, an herbicide, a nematicide, an insecticide, a bactericide, a virucide, a plant growth regulator, a rodenticide, a desiccant, and a nutrient.

The carrier can be a solid carrier or liquid carrier, and in various forms including microspheres, powders, emulsions and the like. The carrier may be any one or more of a number of carriers that confer a variety of properties, such as increased stability, wettability, or dispersability. Wetting agents such as natural or synthetic surfactants, which can be nonionic or ionic surfactants, or a combination thereof can be included in a composition of the invention. Water-in-oil emulsions can also be used to formulate a composition that includes the purified population (see, for example, U.S. Pat. No. 7,485,451, which is incorporated herein by reference in its entirety). Suitable formulations that may be prepared include wettable powders, granules, gels, agar strips or pellets, thickeners, biopolymers, and the like, microencapsulated particles, and the like, liquids such as aqueous flowables, aqueous suspensions, water-in-oil emulsions, etc. The formulation may include grain or legume products, for example, ground grain or beans, broth or flour derived from grain or beans, starch, sugar, or oil.

In some embodiments, the agricultural carrier may be soil or a plant growth medium. Other agricultural carriers that may be used include water, fertilizers, plant-based oils, humectants, or combinations thereof. Alternatively, the agricultural carrier may be a solid, such as diatomaceous earth, loam, silica, alginate, clay, bentonite, vermiculite, seed cases, other plant and animal products, or combinations, including granules, pellets, or suspensions. Mixtures of any of the aforementioned ingredients are also contemplated as carriers, such as but not limited to, pesta (flour and kaolin clay), agar or flour-based pellets in loam, sand, or clay, etc. Formulations may include food sources for the cultured organisms, such as barley, rice, or other biological materials such as seed, plant elements, sugar cane bagasse, hulls or stalks from grain processing, ground plant material or wood from building site refuse, sawdust or small fibers from recycling of paper, fabric, or wood. Other suitable formulations will be known to those skilled in the art.

In an embodiment, the formulation can include a tackifier or adherent. Such agents are useful for combining the complex population of the invention with carriers that can contain other compounds (e.g., control agents that are not biologic), to yield a coating composition. Such compositions help create coatings around the plant or plant element to maintain contact between the endophyte and other agents with the plant or plant element. In one embodiment, adherents are selected from the group consisting of: alginate, gums, starches, lecithins, formononetin, polyvinyl alcohol, alkali formononetinate, hesperetin, polyvinyl acetate, cephalins, Gum Arabic, Xanthan Gum, carragennan, PGA, other biopolymers, Mineral Oil, Polyethylene Glycol (PEG), Polyvinyl pyrrolidone (PVP), Arabino-galactan, Methyl Cellulose, PEG 400, Chitosan, Polyacrylamide, Polyacrylate, Polyacrylonitrile, Glycerol, Triethylene glycol, Vinyl Acetate, Gellan Gum, Polystyrene, Polyvinyl, Carboxymethyl cellulose, Gum Ghatti, and polyoxyethylene-polyoxybutylene block copolymers. Other examples of adherent compositions that can be used in the synthetic preparation include those described in EP 0818135, CA 1229497, WO 2013090628, EP 0192342, WO 2008103422 and CA 1041788, each of which is incorporated herein by reference in its entirety.

It is also contemplated that the formulation may further comprise an anti-caking agent.

The formulation can also contain a surfactant, wetting agent, emulsifier, stabilizer, or anti-foaming agent. Non-limiting examples of surfactants include nitrogen-surfactant blends such as Prefer 28 (Cenex), Surf-N (US), Inhance (Brandt), P-28 (Wilfarm) and Patrol (Helena); esterified seed oils include Sun-It II (AmCy), MSO (UAP), Scoil (Agsco), Hasten (Wilfarm) and Mes-100 (Drexel); and organo-silicone surfactants include Silwet L77 (UAP), Silikin (Terra), Dyne-Amic (Helena), Kinetic (Helena), Sylgard 309 (Wilbur-Ellis) and Century (Precision), polysorbate 20, polysorbate 80, Tween 20, Tween 80, Scattics, Alktest TW20, Canarcel, Peogabsorb 80, Triton X-100, Conco NI, Dowfax 9N, Igebapl CO, Makon, Neutronyx 600, Nonipol NO, Plytergent B, Renex 600, Solar NO, Sterox, Serfonic N, T-DET-N, Tergitol NP, Triton N, IGEPAL CA-630, Nonident P-40, Pluronic. In one embodiment, the surfactant is present at a concentration of between 0.01% v/v to 10% v/v. In another embodiment, the surfactant is present at a concentration of between 0.1% v/v to 1% v/v. An example of an anti-foaming agent would be Antifoam-C.

In certain cases, the formulation includes a microbial stabilizer. Such an agent can include a desiccant. As used herein, a "desiccant" can include any compound or mixture of compounds that can be classified as a desiccant regardless of whether the compound or compounds are used in such concentrations that they in fact have a desiccating effect on the liquid inoculant. Such desiccants are ideally compatible with the population used, and should promote the ability of the endophyte population to survive application on the seeds and to survive desiccation. Examples of suitable desiccants include one or more of trehalose, sucrose, glycerol, and methylene glycol. Other suitable desiccants include, but are not limited to, non reducing sugars and sugar alcohols (e.g., mannitol or sorbitol). The amount of desiccant introduced into the formulation can range from about 5% to about 50% by weight/volume, for example, between about 10% to about 40%, between about 15% and about 35%, or between about 20% and about 30%.

In some cases, it is advantageous for the formulation to contain agents such as a fungicide, an anticomplex agent, an herbicide, a nematicide, an insecticide, a plant growth regulator, a rodenticide, a bactericide, a virucide, or a nutrient. Such agents are ideally compatible with the agricultural plant element or seedling onto which the formulation is applied (e.g., it should not be deleterious to the growth or health of the plant). Furthermore, the agent is ideally one which does not cause safety concerns for human, animal or industrial use (e.g., no safety issues, or the compound is sufficiently labile that the commodity plant product derived from the plant contains negligible amounts of the compound).

In the liquid form, for example, solutions or suspensions, endophyte populations of the present invention can be mixed or suspended in water or in aqueous solutions. Suitable liquid diluents or carriers include water, aqueous solutions, petroleum distillates, or other liquid carriers.

Solid compositions can be prepared by dispersing the endophyte populations of the invention in and on an appropriately divided solid carrier, such as peat, wheat, bran, vermiculite, clay, talc, bentonite, diatomaceous earth, fuller's earth, pasteurized soil, and the like. When such formulations are used as wettable powders, biologically compatible dispersing agents such as non-ionic, anionic, amphoteric, or cationic dispersing and emulsifying agents can be used.

The solid carriers used upon formulation include, for example, mineral carriers such as kaolin clay, pyrophyllite, bentonite, montmorillonite, diatomaceous earth, acid white soil, vermiculite, and pearlite, and inorganic salts such as ammonium sulfate, ammonium phosphate, ammonium nitrate, urea, ammonium chloride, and calcium carbonate. Also, organic fine powders such as wheat flour, wheat bran, and rice bran may be used. The liquid carriers include vegetable oils (such as soybean oil, maize (corn) oil, and cottonseed oil), glycerol, ethylene glycol, polyethylene glycol, propylene glycol, polypropylene glycol, etc.

In an embodiment, the formulation is ideally suited for coating of a population of endophytes onto plant elements. The endophytes populations described in the present invention are capable of conferring many fitness benefits to the host plants. The ability to confer such benefits by coating the populations on the surface of plant elements has many potential advantages, particularly when used in a commercial (agricultural) scale.

The endophyte populations herein can be combined with one or more of the agents described above to yield a formulation suitable for combining with an agricultural plant element, seedling, or other plant element. Endophyte populations can be obtained from growth in culture, for example, using a synthetic growth medium. In addition, endophytes can be cultured on solid media, for example on petri dishes, scraped off and suspended into the preparation. Endophytes at different growth phases can be used. For example, endophytes at lag phase, early-log phase, mid-log phase, late-log phase, stationary phase, early death phase, or death phase can be used. Endophytic spores may be used for the present invention, for example but not limited to: arthospores, sporangispores, conidia, chlamadospores, pycnidiospores, endospores, zoospores.

The formulations comprising endophyte populations of the present invention typically contains between about 0.1 to 95% by weight, for example, between about 1% and 90%, between about 3% and 75%, between about 5% and 60%, between about 10% and 50% in wet weight of the population of the present invention. It is preferred that the formulation contains at least about $10^3$ CFU per ml of formulation, for example, at least about $10^4$, at least about $10^5$, at least about $10^6$, at least about $10^7$ CFU, at least about $10^8$ CFU per ml of formulation. It is preferred that the formulation be applied to the plant element at about $10^2$ CFU/seed, between $10^2$ and $10^3$ CFU, at least about $10^3$ CFU, between $10^3$ and $10^4$ CFU, at least about $10^4$ CFU, between $10^4$ and $10^5$ CFU, at least about $10^5$ CFU, between $10^5$ and $10^6$ CFU, at least about $10^6$ CFU, between $10^6$ and $10^7$ CFU, at least about $10^7$ CFU, between $10^7$ and $10^8$ CFU, or even greater than $10^8$ CFU per seed.

In some embodiments, fungal endophytes may be encapsulated in a fungal host, whether its native host or a heterologous host, before incorporation into a formulation.

Populations of Plant Elements (PEs)

In another embodiment, the invention provides for a substantially uniform population of plant elements (PEs) comprising two or more PEs comprising the endophytic population, as described herein above. Substantial uniformity can be determined in many ways. In some cases, at least 10%, between 10% and 20%, for example, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the PEs in the population, contains the endophytic population in an amount effective to colonize the plant disposed on the surface of the PEs. In other cases, at least 10%, between 10% and 20%, for example, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the plant element s in the population, contains at least 1, between 10 and 10, 10, between 10 and 100, or 100 CFU on the plant element surface or per gram of plant element, for example, between 100 and 200 CFU, at least 200 CFU, between 200 and 300 CFU, at least 300 CFU, between 300 and 1,000 CFU, at least 1,000 CFU, between 1,000 and 3,000 CFU, at least 3,000 CFU, between 3,000 and 10,000 CFU, at least 10,000 CFU, between 10,000 and 30,000 CFU, at least 30,000 CFU, between 30,000 and 100,000 CFU, at least 100,000 CFU, between 100,000 and 300,000 CFU, at least 300,000 CFU, between 300,000 and 1,000,000 CFU, or at least 1,000,000 CFU per plant element or more.

In a particular embodiment, the population of plant elements is packaged in a bag or container suitable for commercial sale. Such a bag contains a unit weight or count of the plant elements comprising the endophytic population as described herein, and further comprises a label. In an embodiment, the bag or container contains at least 100 plant elements, between 100 and 1,000 plant elements, 1,000 plant elements, between 1,000 and 5,000 plant elements, for example, at least 5,000 plant elements, between 5,000 and 10,000 plant elements, at least 10,000 plant elements, between 10,000 and 20,000 plant elements, at least 20,000 plant elements, between 20,000 and 30,000 plant elements, at least 30,000 plant elements, between 30,000 and 50,000 plant elements, at least 50,000 plant elements, between 50,000 and 70,000 plant elements, at least 70,000 plant elements, between 70,000 and 80,000 plant elements, at least 80,000 plant elements, between 80,000 and 90,000, at least 90,000 plant elements or more. In another embodiment, the bag or container can comprise a discrete weight of plant elements, for example, at least 1 lb, between 1 and 2 lbs, at least 2 lbs, between 2 and 5 lbs, at least 5 lbs, between 5 and 10 lbs, at least 10 lbs, between 10 and 30 lbs, at least 30 lbs, between 30 and 50 lbs, at least 50 lbs, between 50 and 70 lmbs, at least 70 lbs or more. The bag or container comprises a label describing the plant elements and/or said endophytic population. The label can contain additional information, for example, the information selected from the group consisting of: net weight, lot number, geographic origin of the plant elements, test date, germination rate, inert matter content, and the amount of noxious weeds, if any. Suitable containers or packages include those traditionally used in plant seed commercialization. The invention also contemplates other containers with more sophisticated storage capabilities (e.g., with microbiologically tight wrappings or with gas- or water-proof containments).

In some cases, a sub-population of seeds comprising the endophytic population is further selected on the basis of increased uniformity, for example, on the basis of uniformity of microbial population. For example, individual plant elements of pools collected from individual cobs, individual plants, individual plots (representing plants inoculated on the same day) or individual fields can be tested for uniformity of microbial density, and only those pools meeting specifications (e.g., at least 80% of tested plant elements have minimum density, as determined by quantitative methods described elsewhere) are combined to provide the agricultural seed sub-population.

The methods described herein can also comprise a validating step. The validating step can entail, for example, growing some plant elements collected from the inoculated plants into mature agricultural plants, and testing those individual plants for uniformity. Such validating step can be performed on individual seeds collected from cobs, individual plants, individual plots (representing plants inoculated on the same day) or individual fields, and tested as described above to identify pools meeting the required specifications.

In some embodiments, methods described herein include planting a synthetic composition described herein. Suitable planters include an air seeder and/or fertilizer apparatus used in agricultural operations to apply particulate materials including one or more of the following, seed, fertilizer and/or inoculants, into soil during the planting operation. Seeder/fertilizer devices can include a tool bar having ground-engaging openers thereon, behind which is towed a wheeled cart that includes one or more containment tanks or bins and associated metering means to respectively contain and meter therefrom particulate materials.

In certain embodiments, a composition described herein may be in the form of a liquid, a slurry, a solid, or a powder (wettable powder or dry powder). In another embodiment, a composition may be in the form of a seed coating. Compositions in liquid, slurry, or powder (e.g., wettable powder) form may be suitable for coating plant elements. When used to coat plant elements, the composition may be applied to the plant elements and allowed to dry. In embodiments wherein the composition is a powder (e.g., a wettable powder), a liquid, such as water, may need to be added to the powder before application to a seed.

In still another embodiment, the methods can include introducing into the soil an inoculum of one or more of the endophyte populations described herein. Such methods can include introducing into the soil one or more of the compositions described herein. The inoculum(s) or compositions may be introduced into the soil according to methods known to those skilled in the art. Non-limiting examples include in-furrow introduction, spraying, coating seeds, foliar introduction, etc. In a particular embodiment, the introducing step comprises in-furrow introduction of the inoculum or compositions described herein.

In an embodiment, plant elements may be treated with composition(s) described herein in several ways but preferably via spraying or dripping. Spray and drip treatment may be conducted by formulating compositions described herein and spraying or dripping the composition(s) onto a seed(s) via a continuous treating system (which is calibrated to apply treatment at a predefined rate in proportion to the continuous flow of seed), such as a drum-type of treater. Batch systems, in which a predetermined batch size of seed and composition(s) as described herein are delivered into a mixer, may also be employed.

In another embodiment, the treatment entails coating plant elements. One such process involves coating the inside wall of a round container with the composition(s) described herein, adding plant elements, then rotating the container to cause the plant elements to contact the wall and the composition(s), a process known in the art as "container coating." Plant elements can be coated by combinations of coating methods. Soaking typically entails using liquid forms of the compositions described. For example, plant elements can be soaked for about 1 minute to about 24 hours (e.g., for at least 1 min, between 1 and 5 min, 5 min, between 5 and 10 min, 10 min, between 10 and 20 min, 20 min, between 20 and 40 min, 40 min, between 40 and 80 min, 80 min, between 80 min and 3 hrs, 3 hrs, between 3 hrs and 6 hrs, 6 hr, between 6 hrs and 12 hrs, 12 hr, between 12 hrs and 24 hrs, 24 hrs).

Population of Plants and Agricultural Fields

A major focus of crop improvement efforts has been to select varieties with traits that give, in addition to the highest return, the greatest homogeneity and uniformity. While inbreeding can yield plants with substantial genetic identity, heterogeneity with respect to plant height, flowering time, and time to seed, remain impediments to obtaining a homogeneous field of plants. The inevitable plant-to-plant variability is caused by a multitude of factors, including uneven environmental conditions and management practices. Another possible source of variability can, in some cases, be due to the heterogeneity of the endophyte population inhabiting the plants. By providing endophyte populations onto plant reproductive elements, the resulting plants generated by germinating the plant reproductive elements have a more consistent endophyte composition, and thus are expected to yield a more uniform population of plants.

Therefore, in another embodiment, the invention provides a substantially uniform population of plants. The population can include at least 10 plants, between 10 and 100 plants, for example, at least 100 plants, between 100 and 300 plants, at least 300 plants, between 300 and 1,000 plants, at least 1,000 plants, between 1,000 and 3,000 plants, at least 3,000 plants, between 3,000 and 10,000 plants, at least 10,000 plants, between 10,000 and 30,000 plants, at least 30,000 plants, between 30,000 and 100,000 plants, at least 100,000 plants or more. The plants are derived from plant reproductive elements comprising endophyte populations as described herein. The plants are cultivated in substantially uniform groups, for example in rows, groves, blocks, circles, or other planting layout.

The uniformity of the plants can be measured in a number of different ways. In one embodiment, there is an increased uniformity with respect to endophytes within the plant population. For example, in one embodiment, a substantial portion of the population of plants, for example at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the plant elements or plants in a population, contains a threshold number of an endophyte population. The threshold number can be at least 10 CFU, between 10 and 100 CFU, at least 100 CFU, between 100 and 300 CFU, for example at least 300 CFU, between 300 and 1,000 CFU, at least 1,000 CFU, between 1,000 and 3,000 CFU, at least 3,000 CFU, between 3,000 and 10,000 CFU, at least 10,000 CFU, between 10,000 and 30,000 CFU, at least 30,000 CFU, between 30,000 and 100,000 CFU, at least 100,000 CFU or more, in the plant or a part of the plant. Alternatively, in a substantial portion of the population of plants, for example, in at least 1%, between 1% and 10%, at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the plants in the population, the endophyte population that is provided to the seed or seedling represents at least 0.1%, between 0.1% and 1% at least 1%, between 1% and 5%, at least 5%, between 5% and 10%, at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 80%, at least 80%, between 80% and 90%, at least 90%, between 90% and 95%, at least 95%, between 95% and 99%, at least 99%, between 99% and 100%, or 100% of the total endophyte population in the plant/seed.

In an embodiment, there is increased genetic uniformity of a substantial proportion or all detectable endophytes within the taxa, genus, or species of a component relative to an uninoculated control. This increased uniformity can be a result of the endophyte being of monoclonal origin or otherwise deriving from a population comprising a more uniform genome sequence and plasmid repertoire than would be present in the endophyte population a plant that derives its endophyte community largely via assimilation of diverse soil symbionts.

In another embodiment, there is an increased uniformity with respect to a physiological parameter of the plants within the population. In some cases, there can be an increased uniformity in the height of the plants when compared with a population of reference agricultural plants grown under the same conditions. For example, there can be a reduction in the standard deviation in the height of the plants in the population of at least 5%, between 5% and 10%, for example, at least 10%, between 10% and 15%, at least 15%, between 15% and 20%, at least 20%, between 20% and 30%, at least 30%, between 30% and 40%, at least 40%, between 40% and 50%, at least 50%, between 50% and 60%, at least 60% or more, when compared with a population of reference agricultural plants grown under the same conditions. In other cases, there can be a reduction in the standard deviation in the flowering time of the plants in the population of at least 5%, between 5% and 10%, for example, at least 10%, between 10% and 15%, at least 15%, between 15% and 20%, at least 20%, between 20% and 30%, at least 30%, between 30% and 40%, at least 40%, between 40% and 50%, at least 50%, between 50% and 60%, at least 60% or more, when compared with a population of reference agricultural plants grown under the same conditions.

Commodity Plant Products

The present invention provides a commodity plant product, as well as methods for producing a commodity plant product, that is derived from a plant of the present invention. As used herein, a "commodity plant product" refers to any composition or product that is comprised of material derived from a plant, seed, plant cell, or plant element of the present invention. Commodity plant products may be sold to consumers and can be viable or nonviable. Nonviable commodity products include but are not limited to nonviable plant elements and grains; processed seeds, seed parts, and plant elements; dehydrated plant tissue, frozen plant tissue, and processed plant tissue; seeds and plant elements processed for animal feed for terrestrial and/or aquatic animal consumption, oil, meal, flour, flakes, bran, fiber, paper, tea, coffee, silage, crushed of whole grain, and any other food for human or animal consumption such as the fruit or other edible portion of the plant; and biomasses and fuel products; and raw material in industry.

Industrial uses of oils derived from the agricultural plants described herein include ingredients for paints, plastics, fibers, detergents, cosmetics, lubricants, and biodiesel fuel. Plant oils may be split, inter-esterified, sulfurized, epoxidized, polymerized, ethoxylated, or cleaved. Designing and producing plant oil derivatives with improved functionality and improved oliochemistry is a rapidly growing field. For example, a mixture of triglycerides is usually split and separated into pure fatty acids, which are then combined with petroleum-derived alcohols or acids, nitrogen, sulfonates, chlorine, or with fatty alcohols derived from fats and oils to produce the desired type of oil or fat. Commodity plant products also include industrial compounds, such as a wide variety of resins used in the formulation of adhesives, films, plastics, paints, coatings and foams.

Although the present invention has been described in detail with reference to examples below, it is understood that various modifications can be made without departing from the spirit of the invention. For instance, while the particular examples below may illustrate the methods and embodiments described herein using a specific plant, the principles in these examples may be applied to any agricultural crop. Therefore, it will be appreciated that the scope of this invention is encompassed by the embodiments of the inventions recited herein and the specification rather than the specific examples that are exemplified below. All cited patents and publications referred to in this application are herein incorporated by reference in their entirety.

EXAMPLES

Example 1: Isolation and Identification of Streptomyces Bacterial Endophytes

Isolation and cultivation of endophytic microbes from agricultural plants was performed according to methods well known in the art. Microbial taxa found in agriculturally relevant communities were identified using high-throughput marker gene sequencing across several crops and numerous varieties of seeds.

Classification of bacterial strains using 16S sequences was done by the following methodology.

To accurately characterize isolated bacterial endophytes, colonies were submitted for marker gene sequencing, and the sequences were analyzed to provide taxonomic classifications. Colonies were subjected to 16S rRNA gene PCR amplification using a 27f/1492r primer set (27f-YM primer for 16S sequencing given as SEQ ID NO: 20; 1492R primer for 16S sequencing given as SEQ ID NO: 21), and Sanger sequencing of paired ends was performed at Genewiz (South Plainfield, N.J.). Raw chromatograms were converted to sequences, and corresponding quality scores were assigned using TraceTuner v3.0.6beta (U.S. Pat. No. 6,681,186, incorporated herein by reference). These sequences were quality filtered using PRINSEQ v0.20.3 [Schmieder and Edwards (2011) Bioinformatics. 2011; 27:863-864, incorporated herein by reference] with left and right trim quality score thresholds of 30 and a quality window of 20 bp. Sequences without paired reads were discarded from further processing. Paired end quality filtered sequences were merged using USEARCH v7.0 [Edgar (2010) Nature methods 10:996-8]. Taxonomic classifications were assigned to the sequences using the RDP classifier [Wang et al., (2007) Applied and environmental microbiology 73:5261-7, incorporated herein by reference] trained on the Greengenes database [McDonald et al. (2012), ISME journal 6:610-8, incorporated herein by reference].

Strain A (Streptomyces murinus) is given as SEQ ID NO: 1. Based on performance in experiments demonstrating modulations of plant traits, in the present invention Strain A is described as a reference Streptomyces strain to which Strain B and Strain C are compared.

Strain B (Streptomyces sp.) is given as SEQ ID NO: 2. Based on performance in experiments demonstrating modulations of plant traits, in the present invention Strain B is described as a beneficial Streptomyces strain compared to Strain A, and described as a reference Streptomyces strain to Strain C.

Strain C (Streptomyces SMCD2215) is given as SEQ ID NO: 3. The strain-specific primer pair for Strain C is given as SEQ ID NO: 22 for the forward primer and SEQ ID NO: 23 for the reverse primer. The amplicon resulting from sequencing using those primers is given as SEQ ID NO: 18. Strain C is deposited with the International Depositary Authority of Canada (IDAC, National Microbiology Laboratory, Public Health Agency of Canada, 1015 Arlington Street, Winnipeg, Manitoba, Canada, R3E 3R2) as Deposit ID 081111-06, and with the Saskatchewan Microbial Collection and Database as SMCD2215. Based on performance in experiments demonstrating modulations of plant traits, in the present invention, Strain C is described as a beneficial Streptomyces strain as compared to both Strains B and Strains C.

SEQ ID NO: 4-17 represent additional Streptomyces endophyte strains of the present invention.

Example 2: In Vitro Testing and Characterization of Streptomyces Bacterial Endophytes Strains and Culture Preparations Bacterial endophyte strains Strain C and Strain A, were tested for various metabolic activities as described below.

To prepare the cultures as initial inocula for various assays, bacteria were grown in one liter of Yeast Extract Peptone Dextrose (YEPD) broth in a 2.5-liter Ultra Yield flasks (Thomson Instrument Company). The cultures were grown at 25° C. with continuous shaking at a speed of 130 revolutions per minute (rpm) for five days. The cultures were aliquoted into 50-mL Falcon tubes and were harvested by centrifugation at a speed of 3,500 rpm for 20 minutes. For each sample, one gram (g) of fresh biomass was first rinsed in 5 mL sterile water and resuspended in 15 mL of sterile water. In order to achieve homogeneity, samples were sonicated for 15 seconds continuously with probe intensity set to 3 using the Sonic Dismembrator Model 100 (Thermo Fisher Scientific, Waltham, Mass.). Strain purity was assessed by plating 100 microliter (uL) of bacterial strain resuspension on PDA. After sonication, the cultures were allowed to sit at room temperature for 5-10 minutes before being used in in vitro assays.

The culture of Strain A is shown in FIG. 1. The culture of Strain B is shown in FIG. 2. The culture of Strain C is shown in FIG. 3.

Auxin Biosynthesis by Endophytes

To measure auxin levels, 100 microliters of bacteria culture prepared as described above was inoculated into 1 mL of R2A broth supplemented with L-tryptophan (5 mM) in transparent flat bottom, 12-well tissue culture plates. Each culture was grown in three duplicates. The plates were sealed with a breathable membrane, wrapped in aluminum foil, and incubated at 25° C. on a shaker at a speed of 150 rpm in the dark for 3 days. After 3 days the OD600 nm and OD530 nm were measured on a plate reader to check for bacterial growth. After measuring these ODs, the culture from each well was transferred into a 1.5 mL Eppendorf tube and briefly spun for 1 minute at top speed in a conventional centrifuge. An aliquot of 250 microliters of supernatant was transferred into each well of transparent flat bottom, 48-well tissue culture plates. 50 microliters of yellowish Salkowski reagent (0.01 M FeCl3 in 35% HClO4 (perchloric acid, #311421, Sigma) were added to each well and incubated in the dark for 30 minutes before measuring the OD540 nm in a plate reader to detect pink/red color. Images were also taken for qualitative scoring of the results later.

Auxin is an important plant hormone that can promote cell enlargement and inhibit branch development (meristem activity) in above ground plant tissues, while below ground it has the opposite effect, promoting root branching and growth. Additionally, auxin signaling pathway has been shown to interact with plant defense signaling pathways. Several microbes utilize the auxin-defense crosstalk to down-regulate the defense responses, therefore allowing harmonious co-existence of the microbe and plants.

Strain C was screened for the ability to produce auxin as a possible growth-promoting agent. Strain C yielded a high absorption at OD540 nm, suggesting a high level of auxin (Table 2).

Acetoin and Diacetyl Production

The method was adapted from Phalip et al., (1994) J Basic Microbiol 34: 277-280. (incorporated herein by reference). 100 microliters of bacteria culture prepared as described above was inoculated into 1 mL of R2A broth supplemented with 5% sterile glucose in transparent flat bottom, 12-well tissue culture plates. Each culture was grown in triplicates. The plates were sealed with a breathable membrane, wrapped in aluminum foil, and incubated at 25° C. on a shaker at a speed of 150 rpm in the dark for 3 days. After 3 days the OD600 nm and OD525 nm were measured on a plate reader to check for bacterial growth. After measuring these ODs, the culture from each well was transferred into a 1.5 mL Eppendorf tube and briefly spun for 1 minute at top speed in a conventional centrifuge. An aliquot of 250 microliters of supernatant was transferred into each well of transparent flat bottom, 48-well tissue culture plates. 50 microliters per well was added of freshly blended Barritt's Reagents A and B [5 g/L creatine mixed 3:1 (v/v) with freshly prepared alpha-naphthol (75 g/L in 2.5 M sodium hydroxide)]. After 30 minutes, images were taken to score for red or pink coloration relative to a copper colored negative control and the absorption at 525 nm was measured using a plate reader to quantify the acetoin and diacetyl abundance.

Acetoin is a neutral, four-carbon molecule used as an external energy storage by a number of fermentive microbes. It is produced by the decarboxylation of alpha-acetolactate, a common precursor in the biosynthesis of branched-chain amino acids. Owing to its neutral nature, production and excretion of acetoin during exponential growth prevents overacidification of the cytoplasm and the surrounding medium that would result from accumulation of acidic metabolic products, such as acetic acid and citric acid. Once superior carbon sources are exhausted, and the culture enters stationary phase, acetoin can be used to maintain the culture density.

Qualitatively and quantitatively, Strain C, but not its closely related strain, Strain A, produced a very high level of acetoin and diacetyl compounds (Table 2).

Siderophore Production

To ensure no contaminating iron was carried over from previous experiments, all glassware was deferrated with 6 M HCl and water prior to media preparation [Cox (1994) Methods Enzymol 235: 315-329, incorporated herein by reference]. In this cleaned glassware, 1 mL of R2A broth media, which is iron limited, was aliquotted into each well of transparent flat bottom, 12-well tissue culture plates. 100 microliters of fungal and bacteria culture prepared as described above were inoculated into each well. Each culture was grown in three duplicates. The plates were sealed with a breathable membrane, wrapped in aluminum foil, and incubated at 25° C. on a shaker at a speed of 150 rpm in the dark for 3 days. After 3 days the OD600 nm and OD530 nm were measured on a plate reader to check for bacterial growth. After measuring these ODs, the culture from each well was transferred into a 1.5 mL Eppendorf tube and briefly spun for 1 minute at top speed in a conventional centrifuge. An aliquot of 250 microliters of supernatant was transferred into each well of transparent flat bottom, 48-well tissue culture plates. After incubation, 100 microliters of O-CAS preparation without gelling agent [Perez-Miranda et al. (2007), J Microbiol Methods 70: 127-131, incorporated herein by reference] was added into each well. One liter of O-CAS reagent was prepared using the cleaned glassware by mixing 60.5 mg of chrome azurol S (CAS), 72.9 mg of hexadecyltrimethyl ammonium bromide (HDTMA), 30.24 g of finely crushed Piperazine-1,4-bis-2-ethanesulfonic acid (PIPES) with 10 mL of 1 mM $FeCl_3.6H_2O$ in 10 mM HCl solvent. The PIPES was finely powdered and mixed gently with stirring (not shaking) to avoid producing bubbles, until a deep blue color was achieved. 30 minutes after adding the reagent to each well, images were taken and color change was scored by looking for purple halos (catechol type siderophores) or orange colonies (hydroxamate siderophores) relative to the deep blue of the O-CAS. Absorption at 420 nm was measured using a plate reader to quantify the abundance of siderophore.

Siderophore production by bacteria on a plant surface or inside a plant may both show that a microbe is equipped to grow in a nutrient limited environment, and perhaps protect the plant environment from invasion by other, perhaps undesirable microbes.

Notably, the beneficial *Streptomyces* strain Strain C accumulated hydroxamate siderophore to a high level evidenced by the high absorption at OD420 nm (Table 2) at a higher concentration than the control *Streptomyces* strain Strain A.

Additional In Vitro Testing and Characterization of Bacterial Endophytes

Examples below are adapted from: Johnston-Monje and Raizada (2011), which is incorporated herein by reference in its entirety.

Assay for Growth on Nitrogen Free LGI Media.

All glassware is cleaned with 6 M HCl before media preparation. A new 96 deep-well plate (2 mL well volume) is filled with 1 mL/well of sterile LGI broth [per L, 50 g Sucrose, 0.01 g $FeCl_3-6H_2O$, 0.8 g $K_3PO_4$, 0.2 g $MgSO_4-7H_2O$, 0.002 g $Na_2MoO_4-2H_2O$, pH 7.5]. Bacteria are inoculated with a flame-sterilized 96 pin replicator. The plate is sealed with a breathable membrane, incubated at 25° C. with gentle shaking for 5 days, and $OD_{600}$ readings taken.

ACC Deaminase Activity Assay.

Microbes are assayed for growth with ACC as their sole source of nitrogen. Prior to media preparation all glassware is cleaned with 6 M HCl. A 2 M filter sterilized solution of ACC (#1373A, Research Organics, USA) is prepared in water. 1 µl/mL of this is added to autoclaved LGI broth (see above), and 1 mL aliquots are placed in a new 96 well plate.

The plate is sealed with a breathable membrane, incubated at 25° C. with gentle shaking for 5 days, and $OD_{600}$ readings taken. Only wells that are significantly more turbid than their corresponding nitrogen free LGI wells are considered to display ACC deaminase activity.

Mineral Phosphate Solubilization Assay.

Microbes are plated on tricalcium phosphate media. This is prepared as follows: 10 g/L glucose, 0.373 g/L $NH_4NO_3$, 0.41 g/L $MgSO_4$, 0.295 g/L NaCl, 0.003 FeCl3, 0.7 g/L $Ca_3HPO_4$ and 20 g/L Agar, pH 6, then autoclaved and poured into 150 mm plates. After 3 days of growth at 25° C. in darkness, clear halos are measured around colonies able to solubilize the tricalcium phosphate.

RNAse Activity Assay.

1.5 g of torula yeast RNA (# R6625, Sigma) is dissolved in 1 mL of 0.1 M $Na_2HPO_4$ at pH 8, filter sterilized and added to 250 mL of autoclaved R2A agar media which is poured into 150 mm plates. The bacteria from a glycerol stock plate are inoculated using a flame-sterilized 96 pin replicator, and incubated at 25° C. for 3 days. On day three, plates are flooded with 70% perchloric acid (#311421, Sigma) for 15 minutes and scored for clear halo production around colonies.

Pectinase Activity Assay.

Adapting a previous protocol 0.2% (w/v) of citrus pectin (#76280, Sigma) and 0.1% triton X-100 are added to R2A media, autoclaved and poured into 150 mm plates. Bacteria are inoculated using a 96 pin plate replicator. After 3 days of culturing in the darkness at 25° C., pectinase activity is visualized by flooding the plate with Gram's iodine. Positive colonies are surrounded by clear halos.

Cellulase Activity Assay.

Adapting a previous protocol, 0.2% carboxymethylcellulose (CMC) sodium salt (# C5678, Sigma) and 0.1% triton X-100 are added to R2A media, autoclaved and poured into 150 mm plates. Bacteria are inoculated using a 96 pin plate replicator. After 3 days of culturing in the darkness at 25° C., cellulose activity is visualized by flooding the plate with Gram's iodine. Positive colonies are surrounded by clear halos.

Antibiosis Assay.

Bacteria or fungi are inoculated using a 96 pin plate replicator onto 150 mm Petri dishes containing R2A agar, then grown for 3 days at 25° C. At this time, colonies of either *E. coli* DH5α (gram negative tester), *Bacillus subtillus* ssp. *Subtilis* (gram positive tester), or yeast strain AH109 (fungal tester) are resuspended in 1 mL of 50 mM $Na_2HPO_4$ buffer to an $OD_{600}$ of 0.2, and 30 µl of this is mixed with 30 mL of warm LB agar. This is quickly poured completely over a microbe array plate, allowed to solidify and incubated at 37° C. for 16 hours. Antibiosis is scored by looking for clear halos around microbial colonies.

Biolog Assay

Bacterial strains Strain C and Strain A were maintained on potato dextrose agar (PDA) in dark at 25° C. and subcultured at regular intervals to maintain viability. Bacterial plugs for each strain was used to inoculate 1 liter (L) of Yeast Extract Peptone Dextrose (YEPD) broth and grown at 25° C. for five days at 130 RPM. On day five, 50 milliliters (mL) of the culture was used as inoculum to propagate the bacterial strain in 1 L of YEPD under the same conditions. Thirty mL aliquots of seven-day-old bacterial liquid culture were harvested by centrifuging at 3,500 RPM for 20 minutes to separate the supernatant. One gram (g) of pellet biomass was first rinsed in 5 mL sterile water, resuspended in 15 mL of sterile water and sonicated for 1 minute to obtain a homogenous resuspension. Strain purity was assessed by plating 100 microliters (uL) of bacterial strain resuspension on PDA.

Sole carbon substrate assays were done using Phenotype MicroArray (PM) 1 and 2A MicroPlates (Hayward, Calif.). Bacterial cells grown for 5 days on PDA were inoculated into sterile Inoculation Fluid-0 (IF-0) obtained from BIOLOG. Cells were stirred in order to achieve uniformity and subsequently adjusted with IF-0 to achieve an absorbance value of approximately 0.3. For each PM assay, 2.32 mL of the bacterial suspension was added to 20 mL IF-0 and 0.24 mL 100× Dye Mix D obtained from BIOLOG and brought to a final volume of 24 mL with sterile distilled water. One hundred microliters of the solution was added per well to 96-well PM MicroPlates that contained 95 carbon sources.

MicroPlates were incubated at 25° C. in an enclosed container for 7 days and examined at regular intervals. Carbon utilization by bacterial strains was evidenced by the change from colorless to violet that indicated the reduction of terrazolium violet redox dye (Pohland and Owen, 2009). Visual scorings of dye accumulation were made at hours 12, 24, 48, 72, 96, 120, 144 and 168 hours to determine the rate and pattern of carbon substrate utilization for each strain. Results were recorded upon stable dye pattern development. Very low amounts of violet dye accumulation at day 7 were attributed to slow or stopped cell respiration and those carbon sources were scored as weak substrates. All MicroPlates contained a negative control (water only) well that remained colorless until the end of each experiment.

The ability of a strain to utilize a specific carbon substrate in the BIOLOG PM MicroPlates could be visually observed by the formation of violet dye in that particular well. When microbial strains undergo respiration (NADH production), they reduce a tetrazolium dye that is included in each well with the carbon source. The reduction of the tetrazolium dye results in the formation of a violet dye that is used to obtain metabolic fingerprint of each strain. Using the colorimetric indicator, metabolic fingerprint comparisons were performed for bacterial strains. Time-course visual examination of MicroPlates over duration of 7 days allowed substrate utilization rates to be determined. Cells undergoing respiration actively when grown on a given substrate typically produced a strong violet phenotype either at the onset of the experiment i.e. by hour 12 or steadily over the course of the entire experiment compared to substrates that were not as robustly utilized that resulted in wells that had a weak violet tint suggesting slowed or stopped cell respiration (Table 3).

The following carbon substrates were utilized by Strain C and Strain A: L-Arabinose, N-Acetyl-D-Glucosamine, L-Proline, D-Alanine, D-Trehalose, D-Sorbitol, Glycerol, D-Gluconic acid, D-Xylose, D-Mannitol, L-Glutamic acid, D-Galactonic acid-γ-lactone, D-L-Malic acid, D-Ribose, D-Fructose, α-D-Glucose, Maltose, L-Asparagine, D-Glucosaminic acid, Sucrose, L-glutamine, Adonitol, Maltotriose, Citric acid, m-Inositol, Mucic acid, Glycyl-L-Glutamic acid, L-Serine, L-Malic acid, Glycyl-L-Proline, Tyramine, Pyruvic acid, and L-Galactonic-acid-γ-lactone. The following carbon sources were utilized by Strain C but not Strain A: D-Galactose, β-Methyl-D-glucoside, D-Cellobiose, L-Alanine, L-Alanyl-Glycine, Mono Methyl Succinate, and L-Lyxose.

The following carbon substrates were utilized at a higher rate by the beneficial *Streptomyces* strain Strain C as compared to the control *Streptomyces* strain Strain A: D-galactose, glycerol, beta-methyl-D-glucoside, L-alanine, L-alanyl glycine, monomethyl succinate, glycyl-L-proline, L-lyxose.

Analysis of Gene Frequencies

Identification of Arabinose Transporter Genes

Sequence identity to the arabinose transporter gene as described by SEQ ID NO: 19 was identified in sequences from *Streptomyces* genomes available in public databases, including the National Center for Biotechnology Information (NCBI) Genome and NCBI Assembly, and *Streptomyces* genomes generated by whole genome sequencing and annotation. Sequence similarity was determined using the blastp algorithm (v 2.2.30+) (Altschul, Gish, Miller, Myers, & Lipman, 1990; Camacho et al., 2009) with composition-based score adjustment conditioned on sequence properties (Yu & Altschul, 2005), the BLOSUM62 substitution matrix, and additional parameters set as follows: word size of 3, gap penalties of 11 for existence and 1 for extension, neighboring words threshold of 11, and windows for multiple hits of 40. Query sequences were not filtered with SEG.

*Streptomyces* strains that were predicted to be beneficial were found to comprise at least 3 copies of the arabinose transporter gene in the genome. Of the endophytes disclosed in the present invention, the beneficial endophyte Strain C comprised 3. The endophyte Strain B, which conferred benefit in greenhouse plant phenotypes under water-limited conditions, comprised 4. Additional *Streptomyces* strains that comprise at least 3 are shown in Table 4, and would be expected to confer at least one beneficial trait of agronomic importance to a plant grown associated with, or grown from a seed treated with, said bacterium.

Example 3: Identification of Differentially Regulated Proteins in *Streptomyces* Bacterial Culture (Proteomics)

Methods

Microbial Samples Preparation:

Microbes were cultivated in three biological replicates for each strain. Briefly, each bacterium was initially streaked on Reasoner's 2A (R2A) agar, distinct CFUs selected and cultured in 10 mL R2A broth for 4 days. Fungal strains were streaked on potato dextrose (PD) agar and individual plugs containing spores and mycelial tissues were used to initiate growth in 10 mL PD broth for 6 days. All strains were grown with agitation at room temperature. Microbial culture filtrate was harvested by centrifuging at 4500 RPM for 20 minutes in 15 mL Falcon tubes to allow culture separation and removal of the supernatant. Five mL of culture supernatant were used for secreted proteomics analysis. All steps were performed in sterile conditions. Culture filtrates were kept in dry ice after harvest at all times to preserve protein stability. Media only samples consisting of PDB and R2A were tested independently to ensure the absence of intact proteins that may potentially interfere with the secreted microbial peptides.

Protein Purification and Visualization:

Samples were shipped to the vendor site (MS Bioworks, Ann Arbor, Mich.) for peptide purification and analysis. Each sample was concentrated on a Pall 3 kD MWCO MicroSep Spin Column (VWR Cat #89132-006) and quantified at 1:10 dilution by Qubit fluorometry (Life Technologies). Twelve µg of each sample was separated ~1.5 cm on a 10% Bis-Tris Novex mini-gel (Invitrogen) using the MES buffer system. The gel was stained with Coomassie and each lane was excised into ten equally sized segments. Gel pieces were processed using a robot (ProGest, DigiLab) by washing with 25 mM ammonium bicarbonate followed by acetonitrile. The samples were subsequently reduced with 10 mM dithiothreitol at 60° C. followed by alkylation with 50 mM iodoacetamide at room temperature, digested with trypsin (Promega) at 37° C. for 4 hours and quenched with formic acid. The supernatant was analyzed directly without further processing.

Mass Spectrometry:

The digests were analyzed by nano LC/MS/MS with a Waters NanoAcquity HPLC system interfaced to a Thermo-Fisher Q Exactive. Peptides were loaded on a trapping column and eluted over a 75 µm analytical column at 350 nL/min; both columns were packed with Proteo Jupiter resin (Phenomenex). A 30 min gradient was employed (5 h total). The mass spectrometer was operated in data-dependent mode, with MS and MS/MS performed in the Orbitrap at 70,000 FWHM and 17,500 FWHM resolution, respectively. The fifteen most abundant ions were selected for MS/MS.

Data Acquisition and Processing:

Symbiota provided protein sequence data, KEGG annotations and corresponding protein mass spectrometry spectral count data to ABiL. Data were provided for Strain C and Strain B strains from the bacterial genus *Streptomyces*. All data were converted into file formats and a local database suitable for subsequent processing, analysis and parallelization.

Protein Ortholog Identification:

Pairs/groups of orthologous proteins were identified using a modified version of the OrthoMCL pipeline (Fischer, 2011). Orthologs were identified as reciprocal best BLASTP hits, and then clusters of orthologous proteins were defined using the modified OrthoMCL pipeline. This process was done independently for the within genera and the between genera analyses. BLASTP was run in parallel on the Georgia Tech PACE HPC environment.

Protein Functional Annotation:

KEGG annotations for individual proteins were provided by Symbiota. The program BLAST2GO (Conesa, 2005) was used to annotate proteins with gene ontology (GO) terms based on sequence similarity to previously annotated proteins.

Protein Expression Quantification and Normalization:

Individual protein expression levels were taken as the number of observed spectra (i.e. the spectra count) corresponding to each protein. Protein spectra counts were retrieved across three replicates for each species. Missing counts for any given ortholog or replicate were assigned values of 0. Individual protein expression levels (spectra counts) were then normalized by the total number of observed spectra for each replicate. This process was done independently for the three replicates corresponding to each member of the A-B pair of every species. Fold-change (FC) values for orthologous pairs/groups were computed as log 2 A/B spectra counts for the purpose of functional enrichment analysis (below).

Protein Differential Expression Analysis:

Differential protein expression analysis was done for a) pairs of orthologous proteins from the within genera analysis and b) groups of orthologous proteins from the between genera analysis. Differential expression was quantified by comparing the within group normalized spectra count variation to the between group normalized spectra count variation using the Students t-test. A Benjamini-Hochberg False Discover Rate threshold of 0.2 was used to identify differentially abundant orthologous proteins.

Pathway and Functional Enrichment Analysis:

Enrichment analysis was done in parallel using both KEGG and GO annotations with the hypergeometric test and via Gene Set Enrichment Analysis (GSEA) (Huang, 2009; Subramanian, 2005). For the hypergeometric test, for any given functional annotation category (i.e. KEGG pathway or GO term), the number of proteins up-regulated in the beneficial member of the orthologous pair (species A) was compared to the total number of proteins up-regulated in the complete set of orthologs. For GSEA analysis, orthologous protein pairs/groups were ranked by FC values (as defined in #3 above) and the distribution of FC values was evaluated for a shift using the clusterprofiler R package (Yu, 2012).

Results

The in-culture secretomics analysis of beneficial and control filamentous Gram-positive bacteria *Streptomyces* sp. revealed a total of 505 small secreted proteins including uncharacterized proteins. Out of the 505 total, 460 were categorized in either Gene Ontology (GO) or Kyoto Encyclopedia of Genes and Genomes (KEGG) categories.

Differential protein expression analysis of the orthologous proteins between the Strain C and Strain B revealed a total of 266 total (238 categorized either in GO or KEGG) orthologous proteins that were detected in the beneficial strain only. The proteins ranged between 10.3 to 2.7-fold difference (Differential expression was quantified by comparing the within group normalized spectra count variation to the between group normalized spectra count variation using the Students t test).

Similar differential expression analysis of the small secreted proteins showed that 68 (63 categorized either in GO or KEGG) total orthologous proteins were detected only in the Strain B. The expression levels of proteins in the beneficial strain relative to the control strain were found to range from −11.2 to −2.7 in fold difference.

In addition, 57 (54 categorized either in GO or KEGG) orthologous proteins were found to be present in higher fold changes (7.2 to 0.4) in the beneficial *Streptomyces* strain relative to the control strain, and 114 (105 categorized either in GO or KEGG) orthologous proteins were detected at a lower expression level (−5.6 to −0.7) in the beneficial strain in comparison with the control bacterial strain.

Proteins that were expressed only in the culture of the *Streptomyces* strain Strain C, and not in the culture of the Strain B, are given in Table 5A. Differential protein expression analysis of the orthologous proteins between the Strain C and Strain B strains of *Streptomyces* revealed a total of 266 total (238 categorized either in GO or KEGG) orthologous proteins that were detected in the Strain C only. The proteins ranged between 10.3 to 2.7-fold difference (differential expression was quantified by comparing the within group normalized spectra count variation to the between group normalized spectra count variation using the Students t test).

Proteins that were never expressed in the culture of *Streptomyces* strain Strain C, but that were found in the culture of Strain B, are given in Table 5B. Similar differential expression analysis of the small secreted proteins showed that 68 (63 categorized either in GO or KEGG) total orthologous proteins were detected only in Strain B. The expression levels of proteins in Strain C relative to Strain B were found to range from −11.2 to −2.7 in fold difference (differential expression was quantified by comparing the within group normalized spectra count variation to the between group normalized spectra count variation using the Students t test).

Proteins that were expressed at a higher rate in the culture of *Streptomyces* strain Strain C vs. Strain B are given in Table 5C. In addition, 57 (54 categorized either in GO or KEGG) orthologous proteins were found to be present in higher fold changes (7.2 to 0.4) in the beneficial *Streptomyces* strain relative to the control strain (differential expression was quantified by comparing the within group normalized spectra count variation to the between group normalized spectra count variation using the Students t test).

Proteins that were expressed at a lower rate in the culture *Streptomyces* strain Strain C vs. Strain B are given in Table 5C. 114 (105 categorized either in GO or KEGG) orthologous proteins were detected at a lower expression level (−5.6 to −0.7) in the beneficial strain in comparison with the control bacterial strain (differential expression was quantified by comparing the within group normalized spectra count variation to the between group normalized spectra count variation using the Students t test).

Overall, the small proteins found to be secreted in the bacterial culture could be categorized into various biological categories based on Gene Ontology (GO) clustering. Striking differential expression patterns were observed for proteins within the following gene families:

(1) Mitochondria (i.e. small and large ribosomal subunits): Ribosome; RP-S9; MRPS9; rpsI; Ribosome; RP-S8; rpsH; Ribosome; RP-S7; MRPS7; rpsG; Ribosome; RP-S6; MRPS6; rpsF; Ribosome; RP-S5; MRPS5; rpsE; Ribosome; RP-S4; rpsD; Ribosome; RP-S3; rpsC; Ribosome; RP-S2; MRPS2; rpsB; Ribosome; RP-519; rpsS; Ribosome; RP-518; MRPS18; rpsR; Ribosome; RP-S17; MRPS17; rpsQ; Ribosome; RP-S16; MRPS16; rpsP; Ribosome; RP-S15; MRPS15; rpsO; Ribosome; RP-S13; rpsM; Ribosome; RP-S12; MRPS12; rpsL; Ribosome; RP-S11; MRPS11; rpsK; Ribosome; RP-S10; MRPS10; rpsJ; Ribosome; RP-S1; rpsA; Ribosome; RP-L4; MRPL4; rplD; Ribosome; RP-L22; MRPL22; rplV; Ribosome; RP-L20; MRPL20; rplT; Ribosome; RP-L2; MRPL2; rplB; Ribosome; RP-L16; MRPL16; rplP; Ribosome; RP-L13; MRPL13; rplM; Ribosome; RP-L11; MRPL11; rplK; Ribosome; RP-L10; MRPL10; rplJ; ybeB.

(2) Bacterial stress response: Response to stress; terA; terZ; terD; terD; terD; terD; catalase activity; heme binding; hydrogen peroxide catabolic process; metal ion binding; oxidation-reduction process; response to oxidative stress.

(3) Carbon and amino acid biosynthesis and metabolism: Amino sugar and nucleotide sugar metabolism, beta-Lactam resistance, nagZ; Carbon metabolism, Citrate cycle (TCA cycle), DLD, lpd, pdhD, Glycine, serine and threonine metabolism, Glycolysis/Gluconeogenesis, Pyruvate metabolism, Valine, leucine and isoleucine degradation; Butanoate metabolism, Carbon fixation pathways in prokaryotes, Carbon metabolism, Citrate cycle (TCA cycle), Oxidative phosphorylation, sdhB, frdB; Carbon fixation pathways in prokaryotes, Carbon metabolism, folD, One carbon pool by folate; Biosynthesis of amino acids, Carbon fixation in photosynthetic organisms, Carbon metabolism, FBA, fbaA, Fructose and mannose metabolism, Glycolysis/Gluconeogenesis, Methane metabolism, Pentose phosphate pathway; Biosynthesis of amino acids, Carbon fixation in photosynthetic organisms, Carbon metabolism, FBA, fbaA, Fructose and mannose metabolism, Glycolysis/Gluconeogenesis, Methane metabolism, Pentose phosphate pathway; 2-Oxocarboxylic acid metabolism, Biosynthesis of amino acids, C5-Branched dibasic acid metabolism, leuB, Valine, leucine and isoleucine biosynthesis; Biosynthesis of amino acids, Carbon metabolism, Cyanoamino acid metabolism, glyA, SHMT, Glycine, serine and threonine metabolism, Glyoxylate and dicarboxylate metabolism, Methane metabolism, One carbon pool by folate; ackA, Carbon fixation pathways in prokaryotes, Carbon metabolism, Methane metabolism, Propanoate metabolism, Pyruvate metabolism, Taurine and hypotaurine metabolism; Carbon fixation pathways in prokaryotes, Carbon metabolism, Glyoxylate and dicarboxylate metabolism, MCEE, epi, Propanoate metabolism, Valine, leucine and isoleucine degradation; Biosynthesis of amino acids, Carbon metabolism, E2.2.1.2, talA, talB, Pentose phosphate pathway; Amino sugar and nucleotide sugar metabolism, Carbon metabolism, Glycolysis/Gluconeogenesis, GPI, pgi, Pentose phosphate pathway, Starch and sucrose metabolism; Cyanoamino acid metabolism, ggt, Glutathione metabolism, Taurine and hypotaurine metabolism; Cyanoamino acid metabolism, ggt, Glutathione metabolism, Taurine and hypotaurine metabolism; aroE, Biosynthesis of amino acids, Phenylalanine, tyrosine and tryptophan biosynthesis; ACADM, acd, beta-Alanine metabolism, Carbon metabolism, Fatty acid degradation, Fatty acid metabolism, PPAR signaling pathway, Propanoate metabolism, Valine, leucine and isoleucine degradation; Arginine and proline metabolism, Biosynthesis of amino acids, OTC, argF, argI; Amino sugar and nucleotide sugar metabolism, Carbon metabolism, Glycolysis/Gluconeogenesis, GPI, pgi, Pentose phosphate pathway, Starch and sucrose metabolism; Aminobenzoate degradation, Folate biosynthesis, phoD, Two-component system; Biosynthesis of amino acids, Carbon metabolism, Glycine, serine and threonine metabolism, Methane metabolism, serC, PSAT1, Vitamin B6 metabolism; Benzoate degradation, Butanoate metabolism, Carbon fixation pathways in prokaryotes, Carbon metabolism, E2.3.1.9, atoB, Fatty acid degradation, Fatty acid metabolism, Glyoxylate and dicarboxylate metabolism, Lysine degradation, Propanoate metabolism, Pyruvate metabolism, Synthesis and degradation of ketone bodies, Terpenoid backbone biosynthesis, Tryptophan metabolism, Two-component system, Valine, leucine and isoleucine degradation; Biosynthesis of amino acids, Carbon metabolism, cysK, Cysteine and methionine metabolism, Sulfur metabolism; Carbon metabolism, Citrate cycle (TCA cycle), DLD, lpd, pdhD, Glycine, serine and threonine metabolism, Glycolysis/Gluconeogenesis, Pyruvate metabolism, Valine, leucine and isoleucine degradation; Alzheimer's disease, Biosynthesis of amino acids, Carbon fixation in photosynthetic organisms, Carbon metabolism, GAPDH, gapA, Glycolysis/Gluconeogenesis, HIF-1 signaling pathway; beta-Alanine metabolism, Biosynthesis of unsaturated fatty acids, Butanoate metabolism, Caprolactam degradation, Carbon metabolism, fadJ, Fatty acid degradation, Fatty acid metabolism, Geraniol degradation, Limonene and pinene degradation, Lysine degradation, Propanoate metabolism, Tryptophan metabolism, Valine, leucine and isoleucine degradation; Carbon fixation in photosynthetic organisms, Carbon fixation pathways in prokaryotes, Carbon metabolism, Citrate cycle (TCA cycle), Cysteine and methionine metabolism, Glyoxylate and dicarboxylate metabolism, mdh, Methane metabolism, Pyruvate metabolism; Benzoate degradation, Butanoate metabolism, Carbon fixation pathways in prokaryotes, Carbon metabolism, E2.3.1.9, atoB, Fatty acid degradation, Fatty acid metabolism, Glyoxylate and dicarboxylate metabolism, Lysine degradation, Propanoate metabolism, Pyruvate metabolism, Synthesis and degradation of ketone bodies, Terpenoid backbone biosynthesis, Tryptophan metabolism, Two-component system, Valine, leucine and isoleucine degradation; Carbon fixation pathways in prokaryotes, Carbon metabolism, Citrate cycle (TCA cycle), E4.2.1.2A, fumA, fumB, Pyruvate metabolism; Carbon metabolism, E2.3.3.9, aceB, glcB, Glyoxylate and dicarboxylate metabolism, Pyruvate metabolism; 2-Oxocarboxylic acid metabolism, ACO, acnA, Biosynthesis of amino acids, Carbon fixation pathways in prokaryotes, Carbon metabolism, Citrate cycle (TCA cycle), Glyoxylate and dicarboxylate metabolism; Biosynthesis of amino acids, Carbon fixation in photosynthetic organisms, Carbon metabolism, Fructose and mannose metabolism, Pentose phosphate pathway, rpiB; Carbon metabolism, GLDC, gcvP, Glycine, serine and threonine metabolism; 2-Oxocarboxylic acid metabolism, Biosynthesis of amino acids, E2.6.1.42, ilvE, Pantothenate and CoA biosynthesis, Valine, leucine and isoleucine biosynthesis, Valine, leucine and isoleucine degradation; Glutathione metabolism, pepN; 2-Oxocarboxylic acid metabolism, argC, Arginine and proline metabolism, Biosynthesis of amino acids; Alzheimer's disease, Biosynthesis of amino acids, Carbon fixation in photosynthetic organisms, Carbon metabolism, GAPDH, gapA, Glycolysis/Gluconeogenesis, HIF-1 signaling pathway; Biosynthesis of amino acids, Carbon metabolism, Cyanoamino acid metabolism, glyA, SHMT, Glycine, serine and threonine metabolism, Glyoxylate and dicarboxylate metabolism, Methane metabolism, One carbon pool by folate; Biosynthesis of amino acids, dapA, Lysine biosynthesis; Biosynthesis of amino acids, dapB, Lysine biosynthesis; Biosynthesis of amino acids, Glycine, serine and threonine metabolism, thrC, Vitamin B6 metabolism; Butanoate metabolism, Carbon fixation pathways in prokaryotes, Carbon metabolism, Citrate cycle (TCA cycle), Oxidative phosphorylation, sdhD, frdD; Butanoate metabolism, Carbon metabolism, ccrA; Carbon fixation pathways in prokaryotes, Carbon metabolism, coxS, Methane metabolism, Nitrotoluene degradation; Carbon metabolism, Citrate cycle (TCA cycle), DLD, lpd, pdhD, Glycine, serine and threonine metabolism, Glycolysis/Gluconeogenesis, Pyruvate metabolism, Valine, leucine and isoleucine degradation; Biosynthesis of amino acids, dapB, Lysine biosynthesis; pepP; Carbon metabolism, Glutathione metabolism, Pentose phosphate pathway, PGD, gnd; Biosynthesis of amino acids, Cysteine and methionine metabolism, metE, Selenocompound metabolism; 2-Oxocarboxylic acid metabolism, Biosynthesis of amino acids, Carbon fixation pathways in prokaryotes, Carbon metabolism, Citrate cycle (TCA cycle), Glutathione metabolism, IDH1, IDH2, icd, Peroxisome; 2-Oxocarboxylic acid metabolism, Biosynthesis of amino acids, Carbon metabolism, Citrate cycle (TCA cycle), CS, gltA, Glyoxylate and dicarboxylate metabolism; Biosynthesis of amino acids, Cysteine and methionine metabolism, metB, Selenocompound metabolism, Sulfur metabolism; Amino sugar and nucleotide sugar metabolism, Fructose and mannose metabolism, manB; Aminoacyl-tRNA biosynthesis, lysK; Aminoacyl-tRNA biosynthesis, RARS, argS; 2-Oxocarboxylic acid metabolism, Biosynthesis of amino acids, ilvD, Pantothenate and CoA biosynthesis, Valine, leucine and isoleucine biosynthesis; tilS, mesJ; aceE, Carbon metabolism, Citrate cycle (TCA cycle), Glycolysis/Gluconeogenesis, Pyruvate metabolism;

ACSS, acs, Carbon fixation pathways in prokaryotes, Carbon metabolism, Glycolysis/Gluconeogenesis, Methane metabolism, Propanoate metabolism, Pyruvate metabolism; Aminobenzoate degradation, Bisphenol degradation, E1.14.-.-, E1.14.14.1, Fatty acid degradation, Limonene and pinene degradation, Polycyclic aromatic hydrocarbon degradation, Stilbenoid, diarylheptanoid and gingerol biosynthesis, Tryptophan metabolism; Aminoacyl-tRNA biosynthesis, DARS, aspS; Carbon metabolism, Citrate cycle (TCA cycle), DLAT, aceF, pdhC, Glycolysis/Gluconeogenesis, Pyruvate metabolism; Carbon metabolism, Central carbon metabolism in cancer, Citrate cycle (TCA cycle), Glycolysis/Gluconeogenesis, HIF-1 signaling pathway, PDHB, pdhB, Pyruvate metabolism; Carbon metabolism, Glutathione metabolism, Pentose phosphate pathway, PGD, gnd; Biosynthesis of amino acids, CTH, Cysteine and methionine metabolism, Glycine, serine and threonine metabolism, Selenocompound metabolism; Biosynthesis of amino acids, hisC, Histidine metabolism, Novobiocin biosynthesis, Phenylalanine metabolism, Phenylalanine, tyrosine and tryptophan biosynthesis, Tropane, piperidine and pyridine alkaloid biosynthesis, Tyrosine metabolism; Biosynthesis of amino acids, pheA2, Phenylalanine, tyrosine and tryptophan biosynthesis; Aminoacyl-tRNA biosynthesis, PARS, proS; Aminoacyl-tRNA biosynthesis, EARS, gltX, Porphyrin and chlorophyll metabolism; 2-Oxocarboxylic acid metabolism, Biosynthesis of amino acids, E2.6.1.42, ilvE, Pantothenate and CoA biosynthesis, Valine, leucine and isoleucine biosynthesis, Valine, leucine and isoleucine degradation; Biosynthesis of amino acids, Carbon metabolism, Glycine, serine and threonine metabolism, Methane metabolism, serA, PHGDH; 2-Oxocarboxylic acid metabolism, Biosynthesis of amino acids, Butanoate metabolism, C5-Branched dibasic acid metabolism, E2.2.1.6S, ilvH, ilvN, Pantothenate and CoA biosynthesis, Valine, leucine and isoleucine biosynthesis; Carbon metabolism, gcvT, AMT, Glycine, serine and threonine metabolism, One carbon pool by folate; Biosynthesis of amino acids, Glycine, serine and threonine metabolism, thrC, Vitamin B6 metabolism; Biosynthesis of amino acids, lysA, Lysine biosynthesis; Carbon metabolism, Citrate cycle (TCA cycle), Lysine degradation, OGDH, sucA, Tryptophan metabolism; Amino sugar and nucleotide sugar metabolism, nagB, GNPDA; Amino sugar and nucleotide sugar metabolism, nagB, GNPDA; Biosynthesis of amino acids, dapE, Lysine biosynthesis; Carbon metabolism, ME2, sfcA, maeA, Pyruvate metabolism, Two-component system; Biosynthesis of amino acids, Biosynthesis of ansamycins, Carbon fixation in photosynthetic organisms, Carbon metabolism, E2.2.1.1, tktA, tktB, Pentose phosphate pathway; K07047; AARS, alaS, Aminoacyl-tRNA biosynthesis; Aminoacyl-tRNA biosynthesis, TARS, thrS; Alanine, aspartate and glutamate metabolism, argH, ASL, Arginine and proline metabolism, Biosynthesis of amino acids; Aminoacyl-tRNA biosynthesis, FARSB, pheT; Aminoacyl-tRNA biosynthesis, FARSA, pheS; aroH, Biosynthesis of amino acids, Phenylalanine, tyrosine and tryptophan biosynthesis; Biosynthesis of amino acids, Biosynthesis of ansamycins, Carbon fixation in photosynthetic organisms, Carbon metabolism, E2.2.1.1, tktA, tktB, Pentose phosphate pathway; Biosynthesis of amino acids, Carbon fixation in photosynthetic organisms, Carbon metabolism, Fructose and mannose metabolism, Glycolysis/Gluconeogenesis, Inositol phosphate metabolism, TPI, tpiA; Biosynthesis of amino acids, Carbon fixation in photosynthetic organisms, Carbon metabolism, Glycolysis/Gluconeogenesis, PGK, pgk; Biosynthesis of amino acids, Phenylalanine, tyrosine and tryptophan biosynthesis, trpC; Biosynthesis of amino acids, hisB, Histidine metabolism; Biosynthesis of amino acids, hisD, Histidine metabolism; Aminoacyl-tRNA biosynthesis, IARS, ileS; cynT, can, Nitrogen metabolism; Biosynthesis of amino acids, Carbon metabolism, Central carbon metabolism in cancer, Glycine, serine and threonine metabolism, Glycolysis/Gluconeogenesis, Methane metabolism, PGAM, gpmA; Aminoacyl-tRNA biosynthesis, CARS, cysS; Amino sugar and nucleotide sugar metabolism, murQ; Aminobenzoate degradation, Bisphenol degradation, E1.14.-.-, Limonene and pinene degradation, Polycyclic aromatic hydrocarbon degradation, Stilbenoid, diarylheptanoid and gingerol biosynthesis; 2-Oxocarboxylic acid metabolism, Biosynthesis of amino acids, Carbon metabolism, Citrate cycle (TCA cycle), CS, gltA, Glyoxylate and dicarboxylate metabolism; Carbon fixation in photosynthetic organisms, Carbon fixation pathways in prokaryotes, Carbon metabolism, Methane metabolism, ppc, Pyruvate metabolism; Amino sugar and nucleotide sugar metabolism, glmU; Biosynthesis of amino acids, Carbon metabolism, ENO, eno, Glycolysis/Gluconeogenesis, HIF-1 signaling pathway, Methane metabolism, RNA degradation; Aminoacyl-tRNA biosynthesis, LARS, leuS; Amino sugar and nucleotide sugar metabolism, Fructose and mannose metabolism, manB; Amino sugar and nucleotide sugar metabolism, Fructose and mannose metabolism, manA, MPI; Biosynthesis of amino acids, Carbon metabolism, Glycine, serine and threonine metabolism, Glycolysis/Gluconeogenesis, gpmB, Methane metabolism; Arginine and proline metabolism, Biosynthesis of amino acids, Carbapenem biosynthesis, proA; Aminoacyl-tRNA biosynthesis, VARS, valS; Amino sugar and nucleotide sugar metabolism, Fructose and mannose metabolism, K16881; Biosynthesis of amino acids, Glycine, serine and threonine metabolism, ltaE; Amino sugar and nucleotide sugar metabolism, Butirosin and neomycin biosynthesis, Carbon metabolism, Galactose metabolism, glk, Glycolysis/Gluconeogenesis, Starch and sucrose metabolism, Streptomycin biosynthesis; Carbon metabolism, Citrate cycle (TCA cycle), DLD, lpd, pdhD, Glycine, serine and threonine metabolism, Glycolysis/Gluconeogenesis, Pyruvate metabolism, Valine, leucine and isoleucine degradation;

(4) Energy generation, i.e. ATP binding functions and nucleotide metabolism: 4 iron, 4 sulfur cluster binding, ATP synthesis coupled electron transport, electron carrier activity, membrane, molybdenum ion binding, NADH dehydrogenase (ubiquinone) activity; 5-phosphoribose 1-diphosphate biosynthetic process, ATP binding, cytoplasm, kinase activity, magnesium ion binding, nucleotide biosynthetic process, phosphorylation, ribonucleoside monophosphate biosynthetic process, ribose phosphate diphosphokinase activity; acetate-CoA ligase activity, acetyl-CoA biosynthetic process from acetate, AMP binding, ATP binding, metal ion binding; add, ADA, Primary immunodeficiency, Purine metabolism; alanine-tRNA ligase activity, alanyl-tRNA aminoacylation, ATP binding, cytoplasm, tRNA binding, zinc ion binding; Alanine, aspartate and glutamate metabolism, purA, ADSS, Purine metabolism; alc, ALLC, Purine metabolism; allB, Purine metabolism; aminoacyl-tRNA editing activity, ATP binding, cytoplasm, isoleucine-tRNA ligase activity, isoleucyl-tRNA aminoacylation, regulation of translational fidelity, zinc ion binding; aminoacyl-tRNA editing activity, ATP binding, cytoplasm, leucine-tRNA ligase activity, leucyl-tRNA aminoacylation, regulation of translational fidelity; aminoacyl-tRNA editing activity, ATP binding, cytoplasm, proline-tRNA ligase activity, prolyl-tRNA aminoacylation, regulation of translational fidelity; aminoacyl-tRNA editing activity, ATP binding, cytoplasm, regulation of translational fidelity, valine-tRNA ligase activity, valyl-tRNA aminoacylation; aminoacyl-tRNA ligase activity, aspartate-tRNA ligase activity, ATP binding, cytoplasm, nucleic acid binding, tRNA aminoacylation for protein translation; Arginine and proline metabolism, Atrazine degradation, Epithelial cell signaling in *Helicobacter pylori* infection, Purine metabolism, ureC; Arginine and proline metabolism, Atrazine degradation, Purine metabolism, ureA; Arginine and proline metabolism, Atrazine degradation, Purine metabolism, ureB; Arginine and proline metabolism, codA, Pyrimidine metabolism; arginine-tRNA ligase activity, arginyl-tRNA aminoacylation, ATP binding, cytoplasm; ATP binding; ATP binding; ATP binding, ATP hydrolysis coupled proton transport, plasma membrane, plasma membrane ATP synthesis coupled proton transport, proton-transporting ATP synthase activity, rotational mechanism, proton-transporting ATP synthase complex, catalytic core F(1); ATP binding, ATP hydrolysis coupled proton transport, plasma membrane, plasma membrane ATP synthesis coupled proton transport, proton-transporting ATP synthase activity, rotational mechanism, proton-transporting ATP synthase complex, catalytic core F(1), proton-transporting ATPase activity, rotational mechanism; ATP binding, ATP-binding cassette (ABC) transporter complex, inorganic phosphate transmembrane transporter activity, metabolic process, phosphate ion transmembrane transport, phosphate ion transmembrane-transporting ATPase activity; ATP binding, ATPase activity, cell division, integral component of membrane, metalloendopeptidase activity, plasma membrane, protein catabolic process, proteolysis, zinc ion binding; ATP binding, ATPase activity, metabolic process, peptide transport; ATP binding, ATPase activity, metabolic process, peptide transport; ATP binding, ATPase activity, metabolic process, peptide transport; ATP binding, biotin carboxylase activity, metabolic process, metal ion binding; ATP binding, biotin carboxylase activity, metabolic process, metal ion binding, methylcrotonoyl-CoA carboxylase activity; ATP binding, cell cycle, cell division, cell wall organization, cytoplasm, peptidoglycan biosynthetic process, regulation of cell shape, UDP-N-acetylmuramoyl-tripeptide-D-alanyl-D-alanine ligase activity, UDP-N-acetylmuramoylalanyl-D-glutamyl-2,6-diaminopimelate-D-alanyl-D-alanine ligase activity; ATP binding, chromosome, cytoplasm, DNA binding, DNA topoisomerase type II (ATP-hydrolyzing) activity, DNA topological change, DNA-dependent DNA replication; ATP binding, chromosome, cytoplasm, DNA binding, DNA topoisomerase type II (ATP-hydrolyzing) activity, DNA topological change, DNA-dependent DNA replication, magnesium ion binding; ATP binding, coenzyme A biosynthetic process, cytoplasm, pantetheine-phosphate adenylyltransferase activity; ATP binding, cysteine-glucosaminylinositol ligase activity, mycothiol biosynthetic process, zinc ion binding; ATP binding, cysteine-tRNA ligase activity, cysteinyl-tRNA aminoacylation, cytoplasm, zinc ion binding; ATP binding, cytoplasm, damaged DNA binding, DNA recombination, DNA repair, DNA-dependent ATPase activity, single-stranded DNA binding, SOS response; ATP binding, cytoplasm, damaged DNA binding, DNA recombination, DNA repair, DNA-dependent ATPase activity, single-stranded DNA binding, SOS response; ATP binding, cytoplasm, glutamate-tRNA ligase activity, glutamyl-tRNA aminoacylation, tRNA binding; ATP binding, cytoplasm, glycolytic process, phosphoglycerate kinase activity; ATP binding, cytoplasm, intracellular protein transmembrane transport, plasma membrane, protein import, protein targeting; ATP binding, cytoplasm, ligase activity, forming carbon-nitrogen bonds, tRNA modification; ATP binding, cytoplasm, lysine-tRNA ligase activity, lysyl-tRNA aminoacylation, tRNA binding; ATP binding, cytoplasm, magnesium ion binding, phenylalanine-tRNA ligase activity, phenylalanyl-tRNA aminoacylation, tRNA binding; ATP binding, cytoplasm, magnesium ion binding, phenylalanine-tRNA ligase activity, phenylalanyl-tRNA aminoacylation, tRNA binding, tRNA processing; ATP binding, cytoplasm, metal ion binding, threonine-tRNA ligase activity, threonyl-tRNA aminoacylation; ATP binding, cytoplasm, protein folding; ATP binding, cytoplasm, protein refolding, unfolded protein binding; ATP binding, DNA binding, DNA topoisomerase type II (ATP-hydrolyzing) activity, DNA topological change; ATP binding, GTP binding; ATP binding, peptidase activity, proteolysis; ATP binding, protein folding, unfolded protein binding; ATP diphosphatase activity, hydrolase activity, methylation, methyltransferase activity; Base excision repair, DNA replication, DPO1, polA, Homologous recombination, Nucleotide excision repair, Purine metabolism, Pyrimidine metabolism; beta-Alanine metabolism, DPYS, dht, hydA, Drug metabolism—other enzymes, Pantothenate and CoA biosynthesis, Pyrimidine metabolism; Biosynthesis of amino acids, Carbon metabolism, Central carbon metabolism in cancer, Glycolysis/Gluconeogenesis, PK, pyk, Purine metabolism, Pyruvate metabolism, Type II diabetes mellitus, Viral carcinogenesis; Biosynthesis of amino acids, Carbon metabolism, Pentose phosphate pathway, PRPS, prsA, Purine metabolism; dcd, Pyrimidine metabolism; dgt, Purine metabolism; DHODH, pyrD, Pyrimidine metabolism; DNA replication, DPO3B, dnaN, Homologous recombination, Mismatch repair, Purine metabolism, Pyrimidine metabolism; Drug metabolism—other enzymes, guaB, Purine metabolism; Drug metabolism—other enzymes, guaB, Purine metabolism; Drug metabolism—other enzymes, hprT, hpt, HPRT1, Purine metabolism; E1.17.4.1B, nrdB, nrdF, Purine metabolism, Pyrimidine metabolism; E2.7.1.20, ADK, Purine metabolism; folic acid-containing compound biosynthetic process, histidine biosynthetic process, methenyltetrahydrofolate cyclohydrolase activity, methionine biosynthetic process, methylenetetrahydrofolate dehydrogenase (NADP+) activity, oxidation-reduction process, purine nucleotide biosynthetic process, tetrahydrofolate interconversion; Nicotinate and nicotinamide metabolism, punA, Purine metabolism, Pyrimidine metabolism; nudF, Purine metabolism; One carbon pool by folate, Purine metabolism, purN; plasma membrane, plasma membrane ATP synthesis coupled proton transport, proton-transporting ATP synthase activity, rotational mechanism, proton-transporting ATP synthase complex, catalytic core F(1); pnp, PNPT1, Purine metabolism, Pyrimidine metabolism, RNA degradation; Purine metabolism, purL, PFAS; Purine metabolism, purM; Purine metabolism, Pyrimidine metabolism, RNA polymerase, rpoA; Purine metabolism, Pyrimidine metabolism, RNA polymerase, rpoC; Purine metabolism, rdgB; Purine metabolism, uraH, pucM, hiuH; Purine metabolism, yagR; Purine metabolism, yagS; pyrF, Pyrimidine metabolism; Pyrimidine metabolism, Selenocompound metabolism, trxB; Pyrimidine metabolism, URA4, pyrC.

(5) Respiration: coxA, Oxidative phosphorylation.

(6) DNA binding and regulation of transcription: aminoacyl-tRNA editing activity, ATP binding, cytoplasm, isoleucine-tRNA ligase activity, isoleucyl-tRNA aminoacylation, regulation of translational fidelity, zinc ion binding; aminoacyl-tRNA editing activity, ATP binding, cytoplasm, leucine-tRNA ligase activity, leucyl-tRNA aminoacylation, regulation of translational fidelity; aminoacyl-tRNA editing activity, ATP binding, cytoplasm, proline-tRNA ligase activity, prolyl-tRNA aminoacylation, regulation of translational fidelity; aminoacyl-tRNA editing activity, ATP binding, cytoplasm, regulation of translational fidelity, valine-tRNA ligase activity, valyl-tRNA aminoacylation; anti-sigma factor binding, identical protein binding, regulation of transcription, DNA-templated; ATP binding, cell cycle, cell division, cell wall organization, cytoplasm, peptidoglycan biosynthetic process, regulation of cell shape, UDP-N-acetylmuramoyl-tripeptide-D-alanyl-D-alanine ligase activity, UDP-N-acetylmuramoylalanyl-D-glutamyl-2,6-diaminopimelate-D-alanyl-D-alanine ligase activity; bacterial-type RNA polymerase core enzyme binding, bacterial-type RNA polymerase holo enzyme binding, positive regulation of transcription, DNA-templated, response to antibiotic, zinc ion binding; cell wall organization, cytoplasm, glucosamine-1-phosphate N-acetyltransferase activity, lipid A biosynthetic process, lipopolysaccharide biosynthetic process, magnesium ion binding, peptidoglycan biosynthetic process, regulation of cell shape, UDP-N-acetylglucosamine biosynthetic process, UDP-N-acetylglucosamine diphosphorylase activity; cytoplasm, DNA binding, regulation of transcription, DNA-templated, sigma factor activity, transcription factor activity, sequence-specific DNA binding, transcription initiation from bacterial-type RNA polymerase promoter; cytoplasm, DNA catabolic process, exodeoxyribonuclease VII activity, exodeoxyribonuclease VII complex, nucleic acid binding, nucleic acid phosphodiester bond hydrolysis; cytoplasm, mature ribosome assembly, negative regulation of ribosome biogenesis, negative regulation of translation; DNA binding, DNA-directed RNA polymerase activity, protein dimerization activity, transcription, DNA-templated; DNA binding, DNA-directed RNA polymerase activity, ribonucleoside binding, transcription, DNA-templated; DNA binding, DNA-directed RNA polymerase activity, transcription, DNA-templated; DNA binding, DNA-templated transcription, initiation, intracellular, regulation of transcription, DNA-templated, sigma factor activity, transcription factor activity, sequence-specific DNA binding, transport; DNA binding, DNA-templated transcription, initiation, regulation of transcription, DNA-templated, sigma factor activity, transcription factor activity, sequence-specific DNA binding; DNA binding, DNA-templated transcription, initiation, regulation of transcription, DNA-templated, sigma factor activity, transcription factor activity, sequence-specific DNA binding; DNA binding, intracellular, phosphorelay signal transduction system, regulation of transcription, DNA-templated; DNA binding, intracellular, phosphorelay signal transduction system, regulation of transcription, DNA-templated; DNA binding, intracellular, phosphorelay signal transduction system, regulation of transcription, DNA-templated; DNA binding, intracellular, phosphorelay signal transduction system, regulation of transcription, DNA-templated; DNA binding, intracellular, phosphorelay signal transduction system, regulation of transcription, DNA-templated; DNA binding, regulation of DNA-templated transcription, elongation, RNA polymerase binding, translation elongation factor activity, translational elongation; DNA binding, regulation of transcription, DNA-templated; DNA binding, regulation of transcription, DNA-templated; DNA binding, regulation of transcription, DNA-templated; DNA binding, regulation of transcription, DNA-templated; DNA binding, regulation of transcription, DNA-templated; DNA binding, regulation of transcription, DNA-templated; DNA binding, regulation of transcription, DNA-templated; DNA binding, regulation of transcription, DNA-templated, transcription factor activity, sequence-specific DNA binding; DNA binding, regulation of transcription, DNA-templated, transcription factor activity, sequence-specific DNA binding; isomerase activity, regulation of proteasomal protein catabolic process; lrp, intracellular, regulation of transcription, DNA-templated, sequence-specific DNA binding, transcription factor activity, sequence-specific DNA binding; regulation of transcription, DNA-templated; regulation of transcription, DNA-templated, transcription factor activity, sequence-specific DNA binding.

(7) Hydrolase activity: adenosine deaminase activity, deaminase activity, hydrolase activity, menaquinone biosynthetic process, metabolic process, metal ion binding; ADP-ribose diphosphatase activity, hydrolase activity, metabolic process; alpha-glucan biosynthetic process, cation binding, hydrolase activity, hydrolyzing O-glycosyl compounds, transferase activity, transferring hexosyl groups; aminopeptidase activity, hydrolase activity, acting on carbon-nitrogen (but not peptide) bonds, metabolic process, proteolysis; ATP diphosphatase activity, hydrolase activity, methylation, methyltransferase activity; carbohydrate metabolic process, glucan endo-1,3-beta-D-glucosidase activity, hydrolase activity, hydrolyzing O-glycosyl compounds; carbohydrate metabolic process, glucosamine-6-phosphate deaminase activity, hydrolase activity, N-acetylglucosamine metabolic process; carbohydrate metabolic process, glucosamine-6-phosphate deaminase activity, hydrolase activity, N-acetylglucosamine metabolic process; carbohydrate metabolic process, hydrolase activity, hydrolyzing O-glycosyl compounds; cation binding, glycogen catabolic process, glycogen debranching enzyme activity, hydrolase activity, hydrolyzing O-glycosyl compounds; cellulose catabolic process, hydrolase activity, hydrolyzing O-glycosyl compounds; chloride peroxidase activity, hydrolase activity, oxidation-reduction process, peroxidase activity; cytoplasm, dihydropyrimidinase activity, hydrolase activity, acting on carbon-nitrogen (but not peptide) bonds, metabolic process, metal ion binding; cytoplasm, dimethylallyl diphosphate biosynthetic process, hydrolase activity, isopentenyl-diphosphate delta-isomerase activity, isoprenoid biosynthetic process, metal ion binding; dipeptidase activity, hydrolase activity, metabolic process, proteolysis; DNA binding, DNA biosynthetic process, DNA replication, DNA-directed DNA polymerase activity, hydrolase activity; folic acid-containing compound biosynthetic process, histidine biosynthetic process, methenyltetrahydrofolate cyclohydrolase activity, methionine biosynthetic process, methylenetetrahydrofolate dehydrogenase (NADP+) activity, oxidation-reduction process, purine nucleotide biosynthetic process, tetrahydrofolate interconversion; hydrolase activity, acting on carbon-nitrogen (but not peptide) bonds, in linear amidines, metabolic process, N-carbamoyl-L-amino-acid hydrolase activity, N-formylglutamate deformylase activity; hydrolase activity, acting on carbon-nitrogen (but not peptide) bonds, metabolic process; hydrolase activity, kinase activity, phosphorylation, protein phosphorylation, protein serine/threonine kinase activity; hydrolase activity, metabolic process; hydrolase activity, metabolic process; hydrolase activity, metabolic process; hydrolase activity, metabolic process; hydrolase activity, metabolic process; hydrolase activity, metabolic process; hydrolase activity, metabolic process; hydrolase activity, metabolic process; hydrolase activity, metabolic process; hydrolase activity, metabolic process, triglyceride lipase activity; hydrolase activity, mycothiol metabolic process, mycothiol-dependent detoxification, zinc ion binding; hydroxyisourate hydrolase activity, purine nucleobase metabolic process.

(8) Proteolysis: aminopeptidase activity, cytoplasm, manganese ion binding, metalloexopeptidase activity, proteolysis; aminopeptidase activity, hydrolase activity, acting on carbon-nitrogen (but not peptide) bonds, metabolic process, proteolysis; aminopeptidase activity, manganese ion binding, proteolysis; aminopeptidase activity, manganese ion binding, proteolysis; aminopeptidase activity, metallopeptidase activity, proteolysis, zinc ion binding; aminopeptidase activity, metallopeptidase activity, proteolysis, zinc ion binding; aminopeptidase activity, metallopeptidase activity, proteolysis, zinc ion binding; aminopeptidase activity, metallopeptidase activity, proteolysis, zinc ion binding; aminopeptidase activity, proteolysis; aminopeptidase activity, proteolysis; aminopeptidase activity, proteolysis, serine-type endopeptidase activity; ATP binding, ATPase activity, cell division, integral component of membrane, metalloendopeptidase activity, plasma membrane, protein catabolic process, proteolysis, zinc ion binding; ATP binding, peptidase activity, proteolysis; cell wall, cell wall organization, dipeptidase activity, metallopeptidase activity, proteolysis, zinc ion binding; dipeptidase activity, hydrolase activity, metabolic process, proteolysis; dipeptidase activity, proteolysis; dipeptidyl-peptidase activity, proteolysis; extracellular region, proteolysis, serine-type endopeptidase activity; integral component of membrane, proteolysis, serine-type peptidase activity; metal ion binding, metalloaminopeptidase activity, protein initiator methionine removal, proteolysis; metal ion binding, metalloaminopeptidase activity, protein initiator methionine removal, proteolysis; metalloendopeptidase activity, proteolysis; metallopeptidase activity, proteolysis; metallopeptidase activity, proteolysis; peptidase activity, proteolysis; proteolysis, serine-type D-Ala-D-Ala carboxypeptidase activity.

An important finding from this set of secretomics data is the extremely high levels of expression of the various genes encoding the ribosomal proteins of the small subunit (RPSs) and of the ribosomal protein of the large subunit (RPL) that play integral roles in translation. These proteins are among the highest expressed in the ones detected primarily in the beneficial strain. The ribosomal proteins are known to be conserved and direct the protein synthesis in organisms (Makarova et al. 2001). Interestingly, results indicate that rpsA, rpsB, rpsC, rpsE, rpsF, rpsG, rpsI, rpsJ, rpsK, rpsL, rpsS and rplK are expressed at very high levels (7.5 to 10.3 fold change) in the beneficial strain and little to no expression in the control strain of *Streptomyces*. Other members of the clusters such as rplJ, rpsD, rpsH, rpsM, rpsO, rpsP, rpsQ, and rpsR are expressed 1.4 to 6.7 fold change higher in the beneficial *Streptomyces* sp. compared to its control counterpart. No rps protein seems to be expressed more in the control relative to the beneficial strain. Surprisingly one member of the rpl cluster of ribosomal encoding gene, rplP is detected to have little to no expression in the beneficial strain relative to the beneficial one (−7.9 fold change) and others such as rplB, rplD, rplM, rplV, rplT are expressed lower in the beneficial strain relative to the control (−0.7 to −3.1).

Comparison of the two in-culture small secreted protein data reveals several striking results in those proteins implicated in response to stress. For instance, the data show the presence of *Streptomyces* sp. secreted cluster of ter proteins being expressed differentially in the beneficial and control bacterial strain. Four terD proteins are expressed −3.3 to −1.8 fold coverage lower in the beneficial *Streptomyces* endophyte Strain C compared to Strain B. Another member of the same family of protein, terZ is expressed 2.8 fold higher in Strain C relative to Strain B, while terB is similarly expressed higher in the Strain C (1.2 fold difference). It is noteworthy to state that terA is only expressed in the beneficial *Streptomyces* sp. and is absent or expressed in extremely low levels in the other strain. The bacterial ter cluster of genes and proteins is well studied and has been reported to play roles in natural resistance to tellurite and other toxic materials, pore-forming colicins and other bacteriophages although how they perform those functions is unclear (Anantharaman et al. 2012). The genes encoding the ter proteins are involved in the production of terpenoid antibiotic-terpentecin (Tp) and ter stands for Tp biosynthetic gene (Hamano et al. 2002). Members included terA, terB, terD and terZ described here. Although the specific roles of the 17 terD-domain-encoding genes in the *Streptomyces* sp. are unclear, Sanssouci et al. (2012) reported that they are majorly involved in the proper development of the *Streptomyces* sp. that they worked with.

Small secreted proteins that are involved in carbon and amino acid biosynthesis and metabolism as typified by those involved in the biosynthesis of amino acid such as glycine, serine, lysine and threonine (serA, dapE, thrC), phenylalaline, tyrosine and tryptophan (pheA2), sugar metabolism such as the proteins that play roles in the metabolism of fructose and mannose (manA and manB), pentose, glutathione and glucuronate (xylB, pgd, gnd), starch and sucrose (malZ, glgE, glgX, treX), and other amino acid and sugar metabolism (glmU, nagB, gcvT, eno, murQ) are expressed at very high levels in the beneficial *Streptomyces* strain relative to the control one. In many cases, these proteins were detected at extremely minimal levels, if not none, in the control bacterium (3 to 9.2 fold difference). Proteins involved in metabolism in *Streptomyces* sp. have been correlated with the production of antibiotics (Obanye et al 1996) and extensive research has been devoted to studying the carbon and amino acid metabolism with special focus on secondary metabolites in *Streptomyces* due to their ability to produce the afore-mentioned antibiotics (Tang et al. 1994; Borodina et al. 2005).

Bacterial small secreted proteins found in this study that could be categorized to play important roles in energy generation (i.e. ATP binding functions and nucleotide metabolism) also showed noticeable differences in their expression patterns. For example, the expressions of proteins involved in purine (purL, purM, nudF, allB) and pyrimidine (pyrC) metabolism was markedly higher in the beneficial strain relative to control (3 to 8.1 in fold change difference) and many of the proteins were detected at extremely minimal levels, if at all, in the control bacterium. Interestingly, one protein associated with pyrimidine metabolism, dcd was found to be expressed at a very high level (6.8 fold change) in the beneficial *Streptomyces* sp. and none in the control strain post-normalization of expression spectra counts). This protein is involved in the production of dCTP deaminase that is instrumental for the synthesis of the nucleotide 2'-deoxyuridine 5'-triphosphate (dUTP) (Weiss and Wang, 1994). In the beneficial *Streptomyces* strain, proteins that clustered within the ATP binding GO category had substantially high levels of expression (3.5 to 8.4 fold change relative to the control strain). One protein associated with energy and protein folding in this GO category is groES that is a bacterial heat shock protein (HSP). Curiously, this protein expression is only seen in the control *Streptomyces* strain (−6.8 fold difference relative to the beneficial strain post-normalization of expression spectra counts). The role of groES has been widely investigated in bacteria and initial reports have alluded to its role as a co-chaperonin in *Streptomyces* sp. cellular metabolism (De León et al. 1997)

The small secreted proteins that play a role in bacterial respiration, specifically aerobic respiration such as coxA was interestingly found to be expressed in abundance in the control *Streptomyces* sp. (−7.4 fold difference in the beneficial strain relative to the control). The subunit I of cytochrome aa3-type terminal oxidase is encoded by the gene, coxA and catalyzes the reduction of molecular oxygen to water as the final step in the ATP-generating electron transport pathway. In *Bradyrhizobium japonicum*, the nitrogen fixing bacterial symbiont of soybean, cytochrome aa3 has been reported to be expressed in the free-living aerobic state but not expressed under symbiotic environments (Gabel and Maier, 1990).

Secreted proteins that cluster in the DNA binding and regulation of transcription category was found to be highly expressed in the beneficial strain relative to the control one (3.5 to 7.1 fold change differences). In cases of select proteins namely rsbV, rpoE, regX3, mtrA, hupB and greA, those were found only in the secretome of the beneficial strain. Bacterial transcription elongation factors such as greA play a role in directing the RNAse activity of RNA polymerase and essentially assisting in enzyme read-through (Stepanova et al. 2009). In the model bacterium *E. coli*, protein HU such as hupB is one of the most abundant DNA-binding protein, and is involved in a host of wide ranging activities like initiation of DNA replication, cell division, DNA binding and partitioning, binding of repressors, and transposition of bacteriophage Mu (Dri et al. 1991). In *Mycobacterium smegmatis*, regX3 is involved in the regulation of phosphate import (Glover et al. 2007). Proteins like rsvB are majorly associated with sigma factor σB the key transcription factor that regulates response to dynamic environmental conditions in several Gram-positive bacteria like *Bacillus* sp. (Guldimann et al. 2016).

Several secreted proteins that are encompassed within the hydrolase activity category such as mqnA, mqnD, mqnE and mqnX (4.6, 5.4, 5.7 and 7.3 fold higher, respectively in beneficial relative to control strain) were found to be expressed in relative high levels in the beneficial *Streptomyces* sp. and were extremely low to not expressed at all in the control strain. In *Helicobacter pylori*, the mqn pathway are implicated as being core players in the production of the important prokaryotic respiratory compound menaquinone and are involved in the production of antibiotics (Kim et al. 2014).

Another cluster of proteins that are grouped based on proteolytic activity were observed to be expressed at a high level in both the beneficial 5.1 to 7.4 fold change relative to the control strain) and control *Streptomyces* strains (−5.4 to −9.3 fold change relative to the control strain). The genes for the protein in this category included dacC, dacA and dacA (expressed −2.2 in the beneficial strain relative to the control strain) and have been reported to be encode penicillin-binding proteins (PBPs) with DD-carboxypeptidase activity in *E. coli* (Baquero et al. 1995). In bacteria, PBPs produce and configure peptidoglycan that is an integral structural component of the bacterial cell wall (Denome et al. 1999). In bacteria, members in this group have been reported to play a role in regulated intramembrane proteolysis (Rip) that is implicated in cellular differentiation, lipid metabolism and the cellular response to unfolded proteins by the cleavage of proteins within the membrane (Brown et al. 2000).

In summary, the analysis of the beneficial and control *Streptomyces* sp. secretome have revealed an abundance of differentially expressed small proteins that may play a role in distinguishing the inherent trait of a beneficial bacterial endosymbiont. The presence of molecules outlined above in several biological pathways that are expressed either exclusively or higher in the beneficial strain of *Streptomyces* studied here could provide deeper insights into the adaptation and evolution of the beneficial plant endosymbiont.

Example 4: Coating of Seeds with *Streptomyces* Endophyte Strains

The following protocol was used to coat seeds with bacterial inocula for planting in greenhouse trials. The "sticker" (2% methylcellulose) was autoclaved and aliquoted into 50 mL Falcon tubes. Seeds were pre-weighed and placed into 50 mL Falcon tubes (2 replicate seed aliquots per treatment). *Streptomyces* were prepared by centrifuging cultures (2500×g for 10 minutes), removing supernatant, washing pellets, resuspending in minimal water, diluting to equal $OD_{600}$ of ~1.3. This was diluted by half with the addition of 1 volume equivalent of 2% methylcellulose. 250 uL of the 2% methylcellulose sticker was pre-mixed with the liquid culture suspension, and this liquid was pipetted onto the pre-weighed seeds. The Falcon tube was closed and shaken to distribute the culture:sticker mixed solution evenly. 150 uL of FloRite flowability polymer was added to the Falcon tube with the coated seeds, and shaken. Seeds were transferred to a labeled envelope and kept at room temperature until sowing. For all treatments, 2 replicate seed treatments were performed and on-seed CFUs were assessed on both replicates.

The following protocol was used to coat seeds with bacterial inocula for planting in field trials. First, 3% Sodium alginate (SA) was prepared and autoclaved in the following manner. Erlenmeyer flasks were filled with the appropriate amount of deionized water and warmed to about 50 degrees C. on a heat plate with agitation using a stirring bar. SA powder was poured slowly into the water until it all dissolved. The solution was autoclaved (121° C. A15PSI for 30 minutes). Talcum powder was autoclaved in dry cycle (121° C. @15PSI for 30 minutes) and aliquoted in Ziploc bags or 50 ml falcon tubes at a ratio of 15 g per kg of seed to be treated for formulation controls and 10 g per kg of seed for actual treatments.

The next day, seeds were treated with either powdered or liquid formulations.

For powdered formulations, 10 g per kg of seed is allocated to the seeds to be treated, according to the following procedure. Seeds are placed in large plastic container. 16.6 ml of 2% SA per Kg of seeds to be treated are poured on the seeds. The container is covered and shaken slowly in orbital motion for about 20 seconds to disperse the SA. Endophyte powder is mixed with an equal amount of talcum powder. The mix of endophyte and talc is added on top of the seeds, trying to disperse it evenly. The container is covered and seeds are shaken slowly in orbital motion for about 20 seconds. 13.3 ml of Flo-rite per kg of seed to be treated is poured on the seeds. Seeds are shaken again, slowly and in orbital motion.

For liquid formulations, 8.5 mL per seed was allocated to the seeds to be treated, according to the following procedure. Seeds were placed in large plastic container. 8.3 ml of 2% SA per kg of seed and the same amount of bacterial culture (8.3 ml per kg of seed) were poured on the seeds. The container was covered and shaken slowly in orbital motion for about 20 seconds to disperse the SA. 15 g of talcum powder per kg of seed were added, trying to disperse it evenly. The container was covered and seeds were shaken slowly in orbital motion for about 20 seconds. 13.3 ml of Flo-rite per kg of seed to be treated were poured on the seeds. Seeds were shaken again, slowly and in orbital motion.

Example 5: Seedling Assays

Seeds and Seed Sterilization

Seeds were surface-sterilized with chlorine gas and hydrochloric acid as follows: Seeds were placed in a 250 mL open glass bottle and placed inside a desiccator jar in a fume. The cap of the glass bottle was treated similarly. A beaker containing 100 mL of commercial bleach (8.25% sodium hypochlorite) was placed in the desiccator jar near the bottle containing the seeds. Immediately prior to sealing the jar, 3 mL of concentrated hydrochloric acid (34-37.5%) was carefully added to the bleach and the bottle gently shaken to mix both components. The sterilization was left to proceed for 16 hours. After sterilization, the bottle was closed with its sterilized cap, and reopened in a sterile laminar hood. The opened bottle was left in the sterile hood for a minimum of one hour, with occasional shaking and mixing to air out the seeds and remove chlorine gas leftover. The bottle was then closed and the seeds stored at room temperature in the dark until use.

Seed Coating of Formulation

Coating of seeds with dry or liquid formulation was executed as described in Example 3. All endophytes were grown in UltraYields flasks. Besides non-treated seeds, seeds were also coated with liquid formulation and medium only, to serve as negative controls.

Seed Germination Assay on Water Agar

Sterilized seeds were placed onto water agar plates (1.3% bacto agar) in a biosafety hood using flamed forceps. For each treatment, 4 plates were sowed with 8 seeds each plate. After sowing, plates were sealed with Parafilm, randomized to avoid position effects, and placed in a drawer at room temperature in the dark. Seed germination was monitored every day for 2-4 days. After 3 days, images were taken of each plate and the root length of each seedling is measured using the imaging software ImageJ. The percentage difference between the treated seedlings, the mock-treated seedlings, and non-treated seedlings was then calculated.

Rolling Paper Assay for Evaluating Seed Germination and Seedling Drought Tolerance Sterilized seeds are placed 1-inch apart from each other onto sterilized rolling paper pre-soaked with sterile diH20 in a biosafety hood. The seeds are placed about one inch below the top and about ten inches above the bottom of the rolling paper. After placing the seeds, another layer of pre-soaked rolling paper is covered onto the top and the paper is carefully and slowly rolled up. The paper roll with seeds is placed vertically into autoclaved glass jar and covered with the lid to hold water absorbed in rolling paper. The jars are kept in a growth chamber in the dark, at 22° C., 60% RH for 4 days. At day 4, the lids are open and the jars placed at 22° C., 70% RH, 12 h day light (level 4, ~300-350 microE) for 3 more days before scoring.

Drought Tolerance Assay Using Vermiculite

After scoring the germination rate of seeds on water agar, seedlings of similar physiological status (i.e., similar radical and shoot lengths) are transferred onto autoclaved vermiculite loosely packed in test tubes (3-cm in diameter) in their natural position (i.e., root down and shoot up). Before seedling transfer, 1.5 ml of sterile diH20 are added onto the top of the vermiculite. After transfer, the seedlings are gently covered with surrounding vermiculite. Test tubes are covered with lid to keep moisture for seeding to recover from transplanting and incubated in a growth chamber in the dark with the settings described above. The lid is removed the next day and the growth of seedlings was monitored every day for drought tolerance.

Results

As shown in Table 6, both of the tested *Streptomyces* strains Strain C and Strain A promoted wheat root (radical) growth three days after sowing on water agar.

Example 6: Greenhouse Characterization

Setup and Watering Conditions

A sandy loam growth substrate was mixed in the greenhouse and consisting of 60% loam and 40% mortar sand (Northeast Nursery, Peabody, M A). Prior to mixing, loam was sifted through a ⅜" square steel mesh screen to remove larger particles and debris.

For some greenhouse experiments (denoted in tables), half of the nitrogen fertilizer (urea) and all phosphate (monoammonium phosphate, MAP) and potash to be applied during the season were added to the soil mixture prior to sowing. The remaining urea was provided dissolved in irrigation water at the onset of the reproductive stages of development. For soybean the total applied nutrients were 440 lbs/acre of urea, 38 lbs/MAP, and 105 lbs/acre potash. Substrate surface area per pot was calculated based on pot diameter in order to approximate the "acreage" of individual pots. An equivalent volume of fertilized soil was then gently added to each pot in order to minimize compaction of the soil. The substrate was saturated with water 3-4 hours before sowing.

For other greenhouse experiments (unless otherwise denoted), no fertilizer was applied at the start of the drought, as tests of the loam mix demonstrated a complete nutrient profile already existed in the soil.

Commercially available soybean seeds were coated with microbial treatments using the formulation used for field trials and described herein. Treatments included microbial coatings with each of the *Streptomyces* strains (Strain C, Strain A, and Strain B) and at least one control (non-treated, or formulation only-treated).

Three seeds were sown evenly spaced at the points of a triangle. Soil was then overlaid atop the seeds (estimated average planting depth at 1.0 to 1.5 inches) and an additional 700 mL water was added to moisten the overlaying substrate. Post-planting, the seeds were watered with 125 mL water per day. Pots were thinned down to 1 best seedling at true leaves stage (approximately 2 weeks).

The transplanting protocol for the seeds was as follows: Transplanting occurred at the time of thinning, to replace pots with no emergence or damaged plants with transplanted healthy plants of the same treatment in new pots. Three liters of the identical soil mix was added to the new pot. One plant was carefully removed from a healthy pot of the same treatment and placed in the new pot. The new pot was filled with soil to 4 L, with gentle packing around the roots. The new pot was watered with 700 mL water immediately after adding soil to each transplant. Transplanted seedlings were monitored for wilt and/or stress symptoms and delayed development. The original pots were retained in case the transplant became unhealthy Drought Stress Testing Plants were provided with water to ~50% capacity of the substrate for the first 14 days after sowing at which point water was withheld from water-stress plants until visible signs of wilting in vegetative tissues (i.e. drooping leaves and petioles, leaf rolling, chlorosis). Water-stressed plants were then irrigated to 50% soil water capacity, after which another drought cycle was initiated. Such drought cycles were continued until plants reached maturity. Throughout the experiment, the greenhouse was maintained on a 14 hour photoperiod where they were provided with at least 800 microE m^-2 s^-1, ~21° C. daytime and ~18° C. nighttime temperatures and a relative humidity of ~20-40%.

The watering regime for the drought-exposed seedlings was conducted as follows: approximately half saturation of soil at first day of emergence, third day of emergence, and 1 week later (day of thinning), full saturation at 5 days after thinning to initiate drought, full saturation to end drought when severe drought symptoms are observed, half saturation of soil maintained evenly (not cycling) until harvest.

Scoring

The first day of emergence and final emergence at the true leaf stage were recorded. As follows: by the soy scale every 7 days; wilt score every other day; early pod count at 45 days post planting (average stage of 2-3 pods per plant) with length of each plant's longest pod providing a better predictive measurement than pod length, which was not found to correlate to yield; leaf count at 45 days post planting (found to correlate strongly to yield), yield as measured by final pod count, seed count, and dry seed weight at harvest, nodule count on roots, final dry biomass of plants (separating stems from roots and washing roots), temperature during greenhouse growth periods.

Seedlings were scored as follows:
Final Emergence: seedlings emerged at 12-13 days post planting, out of 3 seeds planted per pot
Pod Count: pods per plant, counted weekly after flowering but before maturity
Seed Pre-Count: seeds per plant, counted inside pods weekly before maturity
Seed Count, Mature: seeds per plant, harvested, mature
Seed Count, Mature+Immature: seeds per plant, harvested, mature and immature
Percent of Seeds That Are Mature: calculated from treatment averages, not per plant
Seed Weight, Mature: dry grams of seed per plant (dried 3 days at 50 degrees C.; mature only)
Wilt Scores: scored visually on a scale from 0=no wilt to 4=unrecoverable;

Midseason Measurements and Harvest

For soybean, emergence percentage was observed. Further, at various times through the growing season, plants were assessed for pod length, pod number, relative chlorophyll content (SPAD), and total yield as mature seeds produced and seed fresh and dry mass. Soy was harvested at the point of agronomical relevance: senescence of pods.

To compare treated plants to controls, a fully Bayesian robust t-test was performed (Gelman, et al. 2013; Kruschke, 2012). Briefly, R (R Core Team, 2015) was used with the BEST package (Kruschke and Meredith, 2014) and JAGS (Plummer, 2003) to perform a Markov Chain Monte Carlo estimation of the posterior distribution the likely differences between the two experimental groups. A 95% highest density interval (HDI) was overlayed onto this distribution to aid in the interpretation of whether the two biological groups truly differ.

Results

All results are shown in Table 7. Photographs of plants are shown in FIG. 4, FIG. 5, and FIG. 6. All plants grown from seeds treated with any *Streptomyces* strain displayed some improved visual phenotypes under water-limited conditions during at least one point in the plant life cycle.

Plants treated with Strain C displayed the best measurable plant characteristics, including better drought tolerance, increased pod counts, and final harvest yield, as compared to the plants treated with the other *Streptomyces* strains.

Under normal watering (well watered) conditions, Strain C imparted a number of improved agronomic characteristics to soybean plants grown from seeds that were inoculated with the Strain C formulation, vs. controls of isoline plants grown from seeds not inoculated with the bacterial endophyte but additionally comprising the formulation components minus Strain C.

Compared to the formulation control, plants grown from seeds inoculated with the Strain C formulation and grown under normal watering (well-watered) conditions, exhibited an increase in dry weight of mature seeds at harvest, an increase of fresh weight of mature seeds at harvest, increase in number of mature seeds at harvest, increase in number of pods at 77 days post planting, and increase in length of pods at 46 days post planting.

Tissue Collection and Processing for Transcriptomics, Hormone, and Metabolomics Analysis In order to assess the effects of *Streptomyces* seed treatment on plant growth at the transcriptomic, phytohormone, and metabolomic levels, soybean plants were harvested. Three pots from each treatment were selected. Once separated, the tissues (roots, stems, and leaves) from the three pots of each treatment were pooled. For collection, first all loosely attached substrate was removed from the roots by gently tapping and shaking the roots. Any adherent substrate was removed by submerging the roots in water and manually dislodging attached soil and debris. The roots were then blotted dry before being cut from the aerial tissue, followed by separating petioles and leaves from the stem. As tissues were removed from the plant they were immediately bagged and frozen in liquid nitrogen. All harvested tissues were kept in liquid nitrogen or stored at −80° C. until further processing.

To prepare for analyses, the tissues were ground with liquid nitrogen using a pre-chilled mortar and pestle. Approximately 100-200 micrograms of each ground sample pool was transferred to a chilled 1.5 mL microtube for RNA extraction and subsequent transcriptome, phytohormone and metabolite analysis. The remaining ground tissue was then transferred to a chilled 50 mL conical tube and stored in liquid nitrogen or at −80° C. until shipment for further analyses.

Transcriptomics analysis was performed as described in Example 8. Hormone analysis was performed as described in Example 9. Metabolomics was performed as described in Example 10. Community sequencing microbiome profiles were analyzed as described in Example 11.

Example 7: Assessment of Plant Colonization

The establishment of plant-microbe interactions is contingent on close proximity. The microbiome of the host plant consists of microorganisms inside tissues as well as those living on the surface and surrounding rhizosphere. The protocols described in this section allow confirmation of successful colonization of plants by endophytic bacteria, for example by direct recovery of viable colonies from various tissues of the inoculated plant.
Recovery of Viable Colonies Seeds are surface-sterilized by exposing them to chlorine gas overnight, using the methods described elsewhere. Sterile seeds are then inoculated with submerged in 0.5 OD overnight cultures (Tryptic Soy Broth) of bacteria and allowed to briefly air dry. The seeds are then placed in tubes filled partially with a sterile sand-vermiculite mixture [(1:1 wt:wt)] and covered with 1 inch of the mixture, watered with sterile water, sealed and incubated in a greenhouse for 7 days. After incubation, various tissues of the plants are harvested and used as donors to isolate bacteria by placing tissue section in a homogenizer (TSB 20%) and mechanical mixing. The slurry is then serially diluted in 10-fold steps to 10-3 and dilutions 1 through 10-3 are plated on TSA 20% plates (1.3% agar). Plates are incubated overnight and pictures are taken of the resulting plates as well as colony counts for CFU. Bacteria are identified visually by colony morphotype and molecular methods described herein. Representative colony morphotypes are also used in colony PCR and sequencing for isolate identification via ribosomal gene sequence analysis as described herein. These trials are repeated twice per experiment, with 5 biological samples per treatment.
Culture-Independent Methods to Confirm Colonization of the Plant or Seeds by Bacteria or Fungi One way to detect the presence of endophytes on or within plants or seeds is to use quantitative PCR (qPCR). Internal colonization by the endophyte can be demonstrated by using surface-sterilized plant tissue (including seed) to extract total DNA, and isolate-specific fluorescent MGB probes and amplification primers are used in a qPCR reaction. An increase in the product targeted by the reporter probe at each PCR cycle therefore causes a proportional increase in fluorescence due to the breakdown of the probe and release of the reporter. Fluorescence is measured by a quantitative PCR instrument and compared to a standard curve to estimate the number of fungal or bacterial cells within the plant.
Experimental Description The design of both species-specific amplification primers, and isolate-specific fluorescent probes are well known in the art. Plant tissues (seeds, stems, leaves, flowers, etc.) are pre-rinsed and surface sterilized using the methods described herein.

Total DNA is extracted using methods known in the art, for example using commercially available Plant-DNA extraction kits, or the following method.

Tissue is placed in a cold-resistant container and 10-50 mL of liquid nitrogen is applied. Tissues are then macerated to a powder.

Genomic DNA is extracted from each tissue preparation, following a chloroform:isoamyl alcohol 24:1 protocol (Sambrook et al., 1989).

Quantitative PCR is performed essentially as described by Gao et al. (2010) with primers and probe(s) specific to the desired isolate using a quantitative PCR instrument, and a standard curve is constructed by using serial dilutions of cloned PCR products corresponding to the specie-specific PCR amplicon produced by the amplification primers. Data are analyzed using instructions from the quantitative PCR instrument's manufacturer software.

As an alternative to qPCR, Terminal Restriction Fragment Length Polymorphism, (TRFLP) can be performed, essentially as described in Johnston-Monje and Raizada (2011). Group specific, fluorescently labelled primers are used to amplify a subset of the microbial population, especially bacteria, especially fungi, especially archaea, especially viruses. This fluorescently labelled PCR product is cut by a restriction enzyme chosen for heterogeneous distribution in the PCR product population. The enzyme cut mixture of fluorescently labelled and unlabeled DNA fragments is then submitted for sequence analysis on a Sanger sequence platform such as the Applied Biosystems 3730 DNA Analyzer.
Immunological Methods to Detect Microbes in Seeds and Vegetative Tissues A polyclonal antibody is raised against specific bacteria X or fungus Y strains via standard methods. A polyclonal antibody is also raised against specific GUS and GFP proteins via standard methods. Enzyme-linked immunosorbent assay (ELISA) and immunogold labeling is also conducted via standard methods, briefly outlined below.

Immunofluorescence microscopy procedures involve the use of semi-thin sections of seed or seedling or adult plant tissues transferred to glass objective slides and incubated with blocking buffer (20 mM Tris (hydroxymethyl)-aminomethane hydrochloride (TBS) plus 2% bovine serum albumin, pH 7.4) for 30 min at room temperature. Sections are first coated for 30 min with a solution of primary antibodies and then with a solution of secondary antibodies (goat anti-rabbit antibodies) coupled with fluorescein isothiocyanate (FITC) for 30 min at room temperature. Samples are then kept in the dark to eliminate breakdown of the light-sensitive FITC. After two 5-min washings with sterile potassium phosphate buffer (PB) (pH 7.0) and one with double-distilled water, sections are sealed with mounting buffer (100 mL 0.1 M sodium phosphate buffer (pH 7.6) plus 50 mL double-distilled glycerine) and observed under a light microscope equipped with ultraviolet light and a FITC Texas-red filter.

Ultrathin (50- to 70-nm) sections for TEM microscopy are collected on pioloform-coated nickel grids and are labeled with 15-nm gold-labeled goat anti-rabbit antibody. After being washed, the slides are incubated for 1 h in a 1:50 dilution of 5-nm gold-labeled goat anti-rabbit antibody in IGL buffer. The gold labeling is then visualized for light microscopy using a BioCell silver enhancement kit. Toluidine blue (0.01%) is used to lightly counterstain the gold-labeled sections. In parallel with the sections used for immunogold silver enhancement, serial sections are collected on uncoated slides and stained with 1% toluidine blue. The sections for light microscopy are viewed under an optical microscope, and the ultrathin sections are viewed by TEM.

Example 8: Identification of Differentially Regulated Genes (Transcriptomics)

Methods

The first transcriptomics (qualitative) analyses were conducted on SYM57-treated plants and formulation control-treated plants, under both normal watering and water-limited conditions. From this, up- and down-regulated transcripts in plants grown from seeds treated with Strain C compared to those of plants grown from seeds treated with only the formulation control were identified.

Whole RNA was extracted from ground soybean plant tissue (from plants as described in Example 6) over dry ice using the QIAgen Plant RNeasy mini kit (cat. no. 74904) per the manufacturer's instructions with minor modification. DNase treatment was performed on the column with the QIAgen RNase-free DNase kit (cat. no. 79254). The RW1 buffer wash was divided into two washes of half the buffer volume suggested by the manufacturer with the DNase treatment applied in between. After elution, RNA samples were kept on dry ice or at −20° C. until shipping. For transcriptome data acquisition, 1.5 micrograms of whole RNA was sent to Cofactor Genomics (St. Louis, Mo.). Sequencing was performed using for cDNA samples using the Kapa PolyA Stranded RNA-Seq kit.

To calculate expression values, transcript cDNA sequences were first aligned to the set of identified genes in the soy genome. Sequence read counts for each sample and gene were next normalized to account for differences in the number of reads per sample and differences in gene lengths. More specifically, raw sequence counts per gene were multiplied by a value representing the mean total number of reads aligned to the gene across all samples divided by the total number of aligned reads for a given sample. This value was then divided by the length of the gene it mapped to in order to eliminate gene length biases. The resulting values were considered to be the expression value.

The resulting expression values and their respective transcripts were filtered to reduce the influence of spurious observations. All observations with expression values lower than 10 were removed from downstream analysis. In addition, transcripts that mapped to genes without function information (i.e. 'uncharacterized protein') were not considered further. Fold changes between control and treated samples were calculated for each transcript by dividing the expression value from the treated sample by the expression value from the control sample. Gene ontology terms (functional categories) were determined for each transcript by referencing the Ensembl database (http://ensembl.gramene.org) using their respective genes.

The second transcriptomics (quantitative) analyses were conducted on plants grown from seeds treated with a variety of *Streptomyces* strains, and formulation control-treated plants. From this, up- and down-regulated transcripts in plants grown from seeds treated with the *Streptomyces* strain Strain C were compared with the transcript profiles of plants grown from seeds treated with Strain B and of the plants grown from seeds treated with only the formulation control.

The specific procedures used for the transcriptomics comparison analyses included the following parameters: FastQC v0.10.1 was run to verify quality of sequences (fastqc-o <Output directory>-t 4<Sequence file>). TrimmomaticSE was run to remove TruSeq adapters (TrimmomaticSE-threads 4<Untrimmed filename> <Trimmed filename> ILLUMINACLIP:TruSeq3-SE.fa:2:30:10 LEADING:3 TRAILING:3 SLIDINGWINDOW:4:15 MINLEN:36). Quantification of reads mapped to each locus of the reference genome. The *Glycine max* Wm82.a2.v1 (Soybean) reference genome was download from Phytozome (phytozome.jgi.doe.gov). Prior to running STAR 2.5.1b_modified, a genome index was generated (STAR--runMode genomeGenerate--runThreadN 8--genomeDir<Output directory>--genomeFastaFiles Gmax_275_v2.0.fa--limitGenomeGenerateRAM 30000000000). Sequences were aligned to the reference genome using STAR 2.5.1b_modified (STAR--genomeDir<Genome index directory>--runThreadN 40--readFilesIn<Trimmed seqs directory>--readFilesCommand zcat--outSAMtype BAM SortedByCoordinate--outFilterIntronMotifs RemoveNoncanonicalUnannotated). The .bam file was indexed using Samtools (samtools index<.bam file>). QC was performed on the .bam file using the RSeQC bam_stat.py utility (bam_stat.py-i<.bam file>> <Output report file>). Reference genome annotation file Gmax_275_Wm82.a2.v1.gene_exons.gff was converted to a .gtf file containing just exon entries with gene_id parameter specifying the locus without specific transcript designation. This results in all reads mapping to the defined range being reported as part of this gene locus. htseq-count 0.6.1p1 was used to quantify the reads (htseq-count-f bam-s reverse<Mapped file from STAR> <.gtf file>> <counts.txt file>). Quantification of reads mapped to alternatively-spliced transcripts from the reference genome. Salmon 0.6.0 was run in quasi-mapping mode to quantify transcript-specific reads (salmon quant-i transcripts_index-1 SR-r< (gunzip-c<Sequence file>)-o<Quant file>). Differential expression analysis of reads mapped to each locus of the reference genome. Gene locus and transcript counts were run separately. Counts/Quant files for each sample were supplied to DESeq2, which generated log 2FoldChange values for each comparison between a rep and its formulation. Results with an absolute value of log 2FoldChange greater than 1.4 and a padj value less than 0.05 were considered high confidence hits.

To compare these results to qualitative results, the reference genome v2.0 gene was cross-referenced (using the Glyma_11_to_Glyma_20_Correspondence_Full.csv file available at Soybase.org) to obtain the reference genome v1.1 gene. If this v1.1 gene was found in the qualitative results output (minus the transcript[.#] specification), the gene was flagged.

Results: Transcriptomics Qualitative Analysis (Soy Normal Watering Conditions)

The transcriptomic analysis of soybean plants inoculated with endophytic bacterial strain Strain C grown under drought watering regimes in the greenhouse revealed several major pathways that are modulated by the endophyte: symbiosis enhancement, resistance against abiotic and biotic stresses and growth promotion. All data are summarized in Table 8A. Plants treated with Strain C exhibited modified (up-regulated and/or down-regulated) gene transcription normal watering (well watered) conditions, as compared to isoline plants not treated with Strain C.

Symbiosis Enhancement

Under normal watering regime, the top induced nitrogen metabolism transcript by Strain C in stems and leaves was asparagine synthetase, an enzyme involved in asparagine metabolism. In most legumes, asparagine is the principal assimilation product of symbiotic nitrogen fixation (Scott et al., 1976). In soybean, high asparagine synthetase transcript level in source leaves is positively correlated with protein concentration of seed (Wan et al., 2006), and in roots, is linked with increased levels of asparagine in xylem sap transported to the shoot (Antunes et al., 2008). The most down-regulated transcripts expressed in roots of soybean plants grown under normal watering regime were: early nodulins (early nodulin-70, -55-1, -93), nodulins (nodulin-16, -24, -26), leghemoglobin C3 and glutamine synthetase. Recent studies revealed that the novel organelle, also termed "symbiosome" (Masalkar et al., 2010) is delimited by the symbiosome membrane (SM)(Day et al., 2001), which controls the transport of all metabolites between the symbiont and the plant host. Biogenesis of the SM is accompanied by the biosynthesis of a variety of nodulin proteins, where they serve transport and regulatory functions in the symbiosis (Fortin et al., 1985). Among these proteins is nod26, a transporter of NH3, which is a major component of the mature symbiosome (Fortin et al., 1987). Nod26 has also been shown to be a site for the interaction of cytosolic nodule glutamine synthetase (GS), which is the critical enzyme for assimilation of environmental ammonia and endogenous ammonia produced metabolically (Masalkar et al., 2010). The binding of GS to nod26 is proposed to promote efficient assimilation of fixed nitrogen and prevent potential ammonia toxicity by localizing the enzyme to the cytosolic side of the symbiosome membrane (Masalkar et al., 2010). Another highly down-regulated transcript in leaves of well-watered plants was malic enzyme, shown to be important for carbon metabolism of bacteroids and free living bacteria by supplying acetyl-CoA for the TCA cycle or providing NADPH and pyruvate for various biosynthetic pathways (Dao et al., 2008a). Soybean plants inoculated with a NAD(+)-dependent malic enzyme mutant formed small root nodules and exhibited significant nitrogen-deficiency symptoms (Dao et al., 2008b).

Resistance Against Abiotic and Biotic Stresses

Plants have evolved multiple strategies to defend themselves against biotic and abiotic stresses.

One of the earliest plant defense responses is the production of reactive oxygen species (ROS) (Bolwell and Daudi, 2009). These oxygen intermediates can serve as signaling molecules that activate plant defense responses (Lamb and Dixon, 1997) or can have direct antimicrobial activity (Peng and Kuc, 1992). However, even though ROS is an important component of signaling during abiotic and biotic stress, the overproduction of ROS leads to oxidative damage to cells and cellular membranes. Plant protection against oxidative damage is regulated through enzymatic and non-enzymatic mechanisms. One of the detoxification enzymes, superoxide dismutase (SOD), catalyses the dismutation of superoxide ($O_2-$) to hydrogen peroxide ($H_2O_2$) that gets reduced to water by peroxidases (POX) (Matamoros et al., 2003).

Transcripts important in protection against oxidative damage that were upregulated in all tissues were: thioredoxin, ferritin and annexin. Thioredoxins are implicated in different aspects of plant life including development and adaptation to environmental changes and stresses. Annexins, a multigene and a multifunctional family of $Ca^{2+}$-dependent membrane-binding proteins, have been shown to regulate the level and the extent of ROS accumulation and lipid peroxidation during stress responses (Jami et al., 2008). Pectinesterase was another transcript induced by Strain C in roots of plants grown under normal condition that has been implicated in drought resistance (An et al., 2008).

Non-specific lipid transfer proteins (ns-LTPs) are ubiquitous small basic secreted proteins, able to bind to several classes of lipids in vitro (Carvalho and Gomes, 2007). They have been implicated in cutin biosynthesis in pollen development (Zhang et al., 2010), responses to stresses and signaling (Ge et al., 2003). Our data shows that both non-specific lipid transfer protein and Phospholipase D were highly upregulated transcripts in root and stem tissues of plants grown under the normal watering regime. Phospholipase D and its product, phosphatidic acid by functioning in signal transduction cascades and influencing the biophysical state of lipid membranes, have been shown to be implicated in multiple plant stress responses (Bargmann and Munnik, 2006).

S-adenosylmethionine synthase, which catalyzes synthesis of s-adenosylmethionine from methionine and ATP, functions as a primary methyl-group donor and as a precursor for metabolites such as ethylene, polyamines, and vitamin B1 (Hesse et al., 2004). Our data shows that S-adenosylmethionine synthase was upregulated in roots and down-regulation in stems of well-watered plants.

Several transcripts that are induced by various biotic stresses and implicated in pathogen defense have been upregulated in plants treated with Strain C: stress-induced protein SAM22, repetitive proline-rich cell wall protein, lipoxygenase, defensing-like protein and phenylalanine ammonia-lyase. Stress-induced protein SAM22 has been shown to be responsive to wounding, salicylic acid, hydrogen peroxide or fungal elicitor (Crowell et al., 1992). Repetitive proline-rich cell wall proteins (PRPs), one of the five families of structural cell wall proteins (Carpita and Gibeaut, 1993) that is associated with early stages of legume root nodule formation (Franssen et al., 1987) and other plant developmental stages, is also contributing to defense reactions against physical damage and pathogen infection (Bradley et al., 1992; Brisson et al., 1994). Lipoxygenases catalyze the dioxygenation of polyunsaturated fatty acids in lipids collectively known as oxylipins. Oxylipins are involved in a number of developmental or stress response processes (Andersson et al., 2006) and they exert protective activities either as signaling molecules in plants during development, wounding, insect and pathogen attack, or direct anti-microbial substances that are toxic to the invader (Yan Y et al., 2013 Plant defensins are small, basic, cysteine rich peptides that inhibit the growth of a broad range of fungi but seem nontoxic to plant cells. Phenylalanine ammonia lyase (PAL) is the first committed enzyme in the phenylpropanoid pathway that leads to biosynthesis of the polyphenol compounds that have multiple functions, such as providing mechanical support (lignins) (Whetten and Sederoff, 1992), protection against abiotic and biotic stress (antioxidants) (Dixon and Paiva, 1995), and signaling with the flavonoid nodulation factors (Weisshaar and Jenkins, 1998).

Together, our data demonstrate that under normal (well watered) growth conditions, Strain C mediates regulation of transcripts involved in protection against abiotic and biotic stress including protection against oxidative stress, defense reactions against physical damage, suppression of inhibition of pollination and fruit setting especially under drought, signaling and induction of local and systemic defense responses against wounding, insect and pathogen attack and production of anti-microbial metabolites.

Growth Promotion

Several groups of transcripts involved in carbon metabolism have been highly upregulated in plants treated with Strain C.

Glucose-1-phosphate adenylyltransferase, a transferase that transfers phosphorous-containing nucleotide groups, is involved in starch and sucrose metabolism (Ghosh and Preiss, 1966). This transcript has been highly upregulated in root tissues grown under normal conditions.

Other transcripts of carbon metabolism induced by Strain C in leaf tissues of plants grown under normal watering condition included genes involved in photosynthesis: Photosystem Q (B) protein, Cytochrome b559 subunit alpha, Cytochrome b6, and ATP synthase subunit b, chloroplastic, and thioredoxins. Major products of photosynthesis, starch and sucrose, provide the carbon sources of all plant compounds and are major plant storage products. Starch metabolism, for example, is important for grain filling. Sucrose plays a pivotal role in plant growth and development. Hydrolysis of sucrose is associated with the respiration required for plant growth and is linked to cell wall synthesis.

The 28 and 31 kDa glycoproteins, also termed pod storage proteins (Zhong et al., 1999), function in nitrogen storage during times of low sink demand for nitrogen because they accumulate in the leaves of soybean plants at anthesis and after depodding, but disappear during pod filling (Wittenbach, 1983). Distribution and accumulation of the 28 and 31 kDa proteins in the stems and leaves of soybean plants are altered when plants are grown from Strain C-treated seeds under well-watered regime.

In summary, the results presented in this section, demonstrate that endophytic bacterium Strain C promotes plant growth and development by enhancing carbon and nitrogen metabolism under normal watering conditions.

Cell Wall Transcripts

The group of cell wall related transcripts upregulated by Strain C in stem and leaf tissues of plants grown under normal watering conditions include: NAC domain protein genes, amine oxidase and auxin-induced protein 15A. NAC domain protein genes are homologous to well-known Arabidopsis transcription factors that regulate the differentiation of xylem vessels and fiber cells (Ooka et al., 2003). Amine oxidase generates hydrogen peroxide that is important for lignification of cortical cell wall and xylem tissue under both stress and normal conditions (Angelini et al., 1993). Another group of developmentally regulated genes induced by Strain C in leaf tissues under the normal watering regime included CASP-like proteins that are expressed in floral and root tissues (Roppolo et al., 2014).

Results: Transcriptomics Qualitative Analysis (Soy Water-Limited Conditions)

The transcriptomic analysis of soybean plants inoculated with endophytic bacterial strain Strain C grown under drought watering regimes in the greenhouse revealed three major pathways that are modulated by the endophyte: symbiosis enhancement, resistance against abiotic and biotic stresses and growth promotion (All data are summarized in Table 8A). Plants treated with Strain C exhibited modified (up-regulated and/or down-regulated) gene transcription under water-limited (drought) conditions, as compared to isoline plants not treated with Strain C.

Symbiosis Enhancement

Under drought conditions, Strain C strongly induced a cascade of plant transcripts involved in nodulation and nitrogen fixation—a process known to occur in legumes and stimulated by symbiotic nitrogen-fixing bacteria of the genus Rhizobium.

Our data demonstrate that Strain C endophytes contribute to enhancement of symbiosis under drought conditions by altering the transcript levels of several important genes in plants treated with Strain C and exposed to water-limited conditions. In the present experiment, auxin-induced protein 15A was highly upregulated by Strain C in leaf tissues. Additionally, genes involved in nodule development, namely nodulin genes (nodulin-16, -20, -22, -24, -26B, -44, -051), early nodulin-70, -55-1, -55-2, and -93, and leghemoglobin biosynthesis genes (leghemoglobin-A, -C1, -C2, -C3) were upregulated in roots. Mutualistic symbiosis between legumes and Rhizobium species plays an important role in the life of the plants by improving mineral nutrition and water consumption, increasing resistance to pathogenic microorganisms and pests, and improving adaptation to various stresses (Stacey et al., 2006). In return, the plant provides products of photosynthesis and the ecological niche to its microsymbionts. The molecular dialog involves plant signaling molecules, flavonoids and isoflavonoids, and bacterial lipochitooligosaccharidic molecules called Nod factors (Stacey et al., 2006). Consequently, the plant forms a highly specific nitrogen-fixing symbiotic organ called a nodule (Crespi and Frugier, 2008). Nodulin-encoding genes are specifically expressed during the development of symbiotic root nodules (Legocki and Verma, 1980). Upon nodule formation, bacteria differentiate into nitrogen-fixing bacteroids that are beneficial to the plants (Kereszt et al., 2011). Symbiosis promotion can be indirect by activating conditions that aid symbiosis by Rhizobium species or direct by producing signals that initiate Nod factor-independent nodulation. Nod factor-independent nodulation is mediated in legumes through control of development of nodule primordium by varying concentrations of plant hormones auxins, cytokinin, and ethylene (Schultze and Kondorosi, 1998).

Several other transcripts related to symbiosis enhancement were upregulated. PUR1 amidophosphoribosyltransferase, chloroplastic, was upregulated in roots. It is the first enzyme in de novo purine biosynthesis (Ito et al., 1994). It is associated with maturation of nodules in soybean and moth-bean (Vigna aconitifolia) (Kim et al., 1995).

Chalcone synthases 3, 5, 7 and chalcone-flavonone 1B-2 isomerase are upregulated in root tissues. Chalcone synthase and chalcone-flavonone isomerase are key enzyme of the flavonoid and isoflavonoids biosynthesis pathway (Tohge et al., 2007). Flavonoids are secondary metabolites that have many functions in higher plants, including UV protection, fertility, antifungal defense and the recruitment of nitrogen-fixing bacteria (Dao et al., 2011).

Thus, compositions such as Strain C that modulate gene expression of a plant experiencing stresses, including drought, improve the stressed plant's ability to form and maintain successful symbiotic relationships with Rhizobium.

Resistance Against Abiotic and Biotic Stresses

Plants have evolved multiple strategies to defend themselves against biotic and abiotic stresses.

Superoxide dismutase (SOD) and superoxide dismutase (Fe), chloroplastic, were found to be upregulated in stem tissues of Strain C-treated plants grown under drought conditions as compared to untreated control plants grown under the same conditions. One of the earliest plant defense responses is the production of reactive oxygen species (ROS) (Bolwell and Daudi, 2009). However, even though ROS are an important component of signaling during abiotic and biotic stress, the overproduction of ROS leads to oxidative damage to cells and cellular membranes. Plant protection against oxidative damage is regulated through enzymatic and non-enzymatic mechanisms. One of the detoxification enzymes, superoxide dismutase (SOD), catalyses the dismutation of superoxide (O2-) to hydrogen peroxide (H2O2) that gets reduced to water by peroxidases (POX) (Matamoros et al., 2003). Thus, plants treated with compositions such as Strain C may have an improved ability to cope with the stresses associated with water-limited conditions, via upregulation of SOD.

Other transcripts important in protection against oxidative damage that were upregulated in stem tissues in Strain C treated plants were thioredoxin and ferritin, particularly: ferritin, chloroplastic ferritin-2, chloroplastic ferritin-4, and chloroplastic ferritin-1. Thioredoxins are implicated in different aspects of plant life including development and adaptation to environmental changes and stresses. They act as antioxidants by facilitating the reduction of other proteins by cysteine thiol-disulfide exchange (Nordberg and Amér, 2001). Recent reverse genetics studies in *Arabidopsis* revealed that besides their iron storage role, ferritins may be involved in mechanisms of action in oxidative stress pathways (Briat et al., 2010). Thus, plants treated with compositions such as Strain C may have an improved ability to cope with stresses associated with water-limited conditions, via the upgregulation of ferritin and thioredoxin.

In the present experiment, soybeans in Strain C-treated plants expressed annexin at a higher level in leaf tissues of Strain C-treated plants exposed to drought. Annexins, a multigene and a multifunctional family of Ca2+-dependent membrane-binding proteins, have been shown to potentially regulate the level and the extent of ROS accumulation and lipid peroxidation during stress responses (Jami et al., 2008). Thus, plants treated with compositions such as Strain C may have an improved ability to cope with the stresses associated with water-limited conditions, via upregulation of annexin.

In the present experiment, glutathione peroxidase transcripts were down-regulated in roots and leaves of Strain C-treated plants exposed to drought. Plant glutathione peroxidases are ubiquitous enzymes (Yang et al., 2005) that detoxify lipid hydroperoxides and other reactive molecules in a species-, organ- and stress-specific manner (Churin et al., 1999; Ramos et al., 2009). Thus, plants treated with compositions such as Strain C may have an improved ability to cope with the stresses associated with water-limited conditions, via down-regulation of glutathione peroxidase.

Plants exposed to water-limited conditions and treated with Strain C had altered expression levels of additional transcripts implicated in abiotic stress. SAM22 was down-regulated in stems and leaves. The heat-shock proteins are molecular chaperones expressed under various stresses to stabilize proteins (De Maio, 1999). HSP22, a chloroplastic small heat-shock protein, was elevated in stems. S-receptor-like serine/threonine-protein kinase is upregulated in roots and leaves. S-receptor-like serine/threonine protein kinase characterized in *Glycine soja*, has been shown to play a key role as a positive regulator of plant tolerance to salt stress (Sun et al., 2013). In plants, alcohol dehydrogenase, a highly conserved enzyme, is induced by stress conditions, particularly during hypoxic response, to anaerobically supply $NAD^+$ for metabolism (Chung and Ferl, 1999). Alcohol dehydrogenase 2 was upregulated in roots. Chloroplast translation initiation factor IF-1 (INFA), a factor necessary for initiation of protein biosynthesis in the chloroplast and known to be inducible by salt stress (Omidbakhshfard et al., 2012), was upregulated in stems.

Expression levels of transcripts implicated in biotic stress were altered in plants exposed to water-limited conditions and treated with Strain C. SAM22 was downregulated in stems and leaves. SAM22 has been shown to be involved in mechanisms of wounding, salicylic acid, hydrogen peroxide or fungal elicitor (Crowell et al., 1992). S-adenosylmethionine caffeic acid 3-O-methyltransferase (COMT) was upregulated in stems. S-adenosylmethionine synthase, which catalyzes synthesis of s-adenosylmethionine from methionine and ATP, functions as a primary methyl-group donor for the COMT reaction and as a precursor for metabolites such as ethylene, polyamines, and vitamin B1 (Hesse et al., 2004).

Repetitive proline-rich cell wall protein 3 was upregulated in roots and repetitive proline-rich cell wall protein was downregulated in leaves. Repetitive proline-rich cell wall proteins (PRPs), one of the five families of structural cell wall proteins (Carpita and Gibeaut, 1993) that is associated with early stages of legume root nodule formation (Franssen et al., 1987) and other plant developmental stages, may also contribute to defense reaction mechanisms against physical damage and pathogen infection (Bradley et al., 1992; Brisson et al., 1994).

Lipoxygenase was upregulated in stems. Additional lipoxygenases were upregulated in roots (LOX9, LOX10), stems (LOX7, VLXB) and leaves (LOX7). Lipoxygenases catalyze the dioxygenation of polyunsaturated fatty acids in lipids collectively known as oxylipins. Oxylipins are involved in a number of developmental or stress response processes (Andersson et al., 2006) and they may exert protective activities either as signaling molecules in plants during development, wounding, insect and pathogen attack, or direct anti-microbial substances that are toxic to the invader (Yan Y et al., 2013).

Defensin-like protein was upregulated in leaves and phenylalanine ammonia-lyase was upregulated in stems. Plant defensins are small, basic, cysteine rich peptides that inhibit the growth of a broad range of fungi but seem nontoxic to plant cells. Their antifungal activity may be regulated through specific binding to membrane targets (Thomma et al., 2002). Phenylalanine ammonia lyase (PAL) is the first committed enzyme in the phenyl-propanoid pathway that leads to biosynthesis of the polyphenol compounds that have multiple functions, such as providing mechanical support (lignins) (Whetten and Sederoff, 1992), protection against abiotic and biotic stress (antioxidants) (Dixon and Paiva, 1995), and signaling with the flavonoid nodulation factors (Weisshaar and Jenkins, 1998).

Our data show that genes involved in phytoalexin synthesis in soybean were downregulated in Strain C-treated plants exposed to drought, namely: cytochrome P450 82A2 (roots), cytochrome P450 82A4 (roots), cytochrome P450 93A1 (roots), NAD(P)H-dependent 6'deoxychalcone synthase (roots) and glucan endo-1,3-beta-glucosidase (stems and leaves). Cytochrome P450 93A3 was upregulated in the roots, cytochrome P450 93E1 was upregulated in the stems, and cytochrome P450 7602 was upregulated in the roots and leaves. The cytochrome P450 93 enzymes are involved in an elicitor-inducible glyceollin biosynthesis in soybean (Schopfer and Ebel, 1998). The CYP76 family is involved in synthesis of indole alkaloids and iridoid monoterpenoids (Höfer et al., 2013), secondary metabolites active in plant-insect interactions (Birkett et al., 2011). Soybean beta-1,3-endoglucanase releases elicitor-active carbohydrates from the cell walls of fungal pathogens initiating phytoalexin accumulation in fungus-infected soybean plants (Takeuchi et al., 1990). Low expression of some of these transcripts in plants that are treated with Strain C may promote the endophyte's systemic colonization of the plant (Reinhold-Hurek and Hurek, 2011). Thus, plants treated with a beneficial *Streptomyces* endophyte composition, for example Strain C, may have an improved ability to cope with the stresses associated with water-limited conditions, via modulation of expression of phytoalexin-associated genes.

Arginine decarboxylase is upregulated in roots and leaves. Arginine decarboxylase is a key enzyme in plant polyamine biosynthesis (Hanfrey et al., 2001). Polyamines have been implicated in a wide range of biological processes including plant growth and development, senescence, environmental stress and they exert an anti-fungal and anti-viral effect (Bais and Ravishankar, 2002).

Thus, plants treated with compositions such as Strain C may have an improved ability to cope with the stresses associated with water-limited conditions, for example via modulation of expression of SAM22, s-adenosylmethionine, defensin-like protein, phenylalanine ammonia-lyase, lipoxygenases, cytochromes, and repetitive proline-rich cell wall protein. Together, our data demonstrate that under drought conditions, Strain C mediates regulation of transcripts involved in protection against abiotic and biotic stresses.

Growth Promotion

Endophytes enable plant growth promotion through different mechanisms that involve nutrient supply to plants or stimulation of plant cell elongation or cell division regulated by phytohormones (Stacey et al., 2006). These mechanisms are modulated through changed rates of carbon metabolism.

Transcripts that were modulated in expression in Strain C-treated plants exposed to water-limiting conditions include: Photosystem Q(B) protein (downregulated in roots) and photosystem I assembly protein Ycf4 (downregulated in roots), cytochrome P450 82A2 (downregulated in roots), cytochrome P450 93A1 (downregulated in roots), cytochrome P450 82A4 (downregulated in roots), cytochrome C oxidase subunit 1 (downregulated in root), ribulose bisphosphate carboxylase small chain (upregulated in stem), fructose-bisphosphate aldolase (upregulated in stem), serine hydroxymethyltransferase (upregulated in leaves) and mitochondrial ATP synthase subunit 9 (downregulated in root). Thus, plants treated with compositions such as Strain C may have an improved ability to cope with the stresses associated with water-limited conditions, via modulation of expression of genes involved in the photosynthetic, carbon fixation and energy transfer pathways.

Sucrose synthase was downregulated in leaf tissues of Strain C treated plants exposed to water-limited conditions. Sucrose is a highly soluble disaccharide that is synthesized in the leaf cytosol from which it diffuses to the rest of the plant (Lunn, 2001). Thus, plants treated with compositions such as Strain C may have an improved ability to cope with the stresses associated with water-limited conditions, via downregulation of expression of sucrose synthase.

Beta-galactosidase, a key enzyme in carbohydrate metabolism was upregulated in roots, stems, and leaves. Beta-amylase (GM-BAMYTKM1), a starch-hydrolyzing enzyme (Ishikawa et al., 2007), was upregulated in the roots.

Chlorophyll a-b binding proteins (CABs), protective components of the photosynthetic light harvesting system, were induced in roots (CAB3), stems (CAB2 and LHCB1-7), and leaves (CAB2 and LHCB1-7). Photosystem I subunit F (PSAF) participates in efficiency of electron transfer from plastocyanin to P700 (Haldrup et al., 2000). Photosystem I subunit F was upregulated in roots.

In summary, the results presented in this section, demonstrate that endophytic bacterium Strain C promotes plant growth and development by enhancing carbon metabolism under drought stress watering regimes.

Cell Wall Transcripts

Amine oxidase is upregulated in root, stem and leaf tissues of Strain C-treated plants exposed to water-limited conditions. Amine oxidase generates hydrogen peroxide that is important for lignification of cortical cell wall and xylem tissue under stress conditions (Angelini et al., 1993). Thus, plants treated with compositions such as Strain C may have an improved ability to cope with the stresses associated with water-limited conditions, via upregulation of expression of amine oxidase.

Our data show high levels of transcript expression of auxin-induced protein 15A in stem and leaf tissues, of Strain C treated plants under water-limited growth conditions. One of the mechanisms by which auxin stimulates cell elongation is by stimulating cell wall-loosening factors (Friml, 2003). In addition, increased seed germination, shoot growth and seed production may be accompanied by increased production of auxin-like compounds (Friml, 2003). Thus, plants treated with compositions such as Strain C may have an improved ability to cope with the stresses associated with water-limited conditions, via upregulation of expression of auxin-induced protein 15A.

Pectinesterase is downregulated in stems of Strain C treated plants that have been subjected to water-limiting conditions. Pectinsterases are thought to be involved in cell-wall remodeling (Imoto et al. (2005) Plant Mol. Biol. 58:177-192). UDP-glucose 6-dehydrogenase, an enzyme that participates in cell wall formation and modification by providing UDP-glucuronate for polysaccharide biosynthesis (Cook et al., 2012), was upregulated in roots, stems, and leaves. Xyloglucan endotransglycosylase (XET1), a key enzyme in cell wall biosynthesis (Bourquin et al., 2002), was upregulated in leaves.

The transcriptomics experiments of the present invention demonstrate upregulation of genes involved in non-specific lipid transfer protein production, in leaf tissues of Strain C-treated plants grown during water-limited conditions. Non-specific lipid transfer proteins (ns-LTPs) are ubiquitous small basic secreted proteins, able to bind to several classes of lipids in vitro (Carvalho and Gomes, 2007). Thus, plants treated with compositions such as Strain C may have an improved ability to cope with the stresses associated with water-limited conditions, via upregulation of expression of non-specific lipid transfer proteins.

Developmental Regulation

Histones are proteins that are primarily involved in DNA packaging into chromatin, and that can affect gene expression. Recent studies show that the developmental transition from a vegetative to a reproductive phase (i.e. flowering) is controlled by chromatin modifications (He, 2009). In addition to histone H2A, which was upregulated in leaves, histone H2B, histone H3, and histone H4 were upregulated in stems and leaves.

A number of other transcripts were altered as a result of treatment with Strain C. Two auxin-induced transcripts, AUX28 (Ainley et al., 1988) and auxin-induced protein 15A were elevated in leaves. Oligopeptide transporter 7 (OPT7) was upregulated in roots. In *Arabidopsis*, oligopeptide transporter 7 is associated with oligopeptide transport in vascular tissue in seedlings and adult plants (Stacey et al., 2006c). Ribonucleoside-diphosphate reductase, responsible for reducing nucleotides to deoxynucleotides prior to DNA synthesis (Guzmán et al., 2002), was upregulated in leaves. The transcription factor PHAN-A, implicated in leaf blade expansion (Eckardt, 2004), was upregulated in leaves. Tubulin beta-1 chain (TUBB1), involved in plant cell growth (Takahashi et al., 1995) and shown to accumulate in roots (Oppenheimer et al., 1988), was upregulated in roots.

Fructose-bisphosphate aldolase is a glycolytic enzyme, induced by the plant hormone gibberellin, that may regulate the vacuolar H-ATPase-mediated control of cell elongation that determines root length (Konishi et al., 2005). Indeed, fructose-bisphosphate aldolase was only induced in roots.

Thus, plants treated with compositions such as Strain C may have an improved ability to cope with the stresses associated with water-limited conditions, for example via upregulation of expression of histones and other genes involved in developmental regulation.

Other

A number of additional transcripts demonstrated modulated expression in Strain C-treated plants grown under water-limited conditions: carbonic anhydrase (downregulated in roots), casparian strip membrane protein 1 (downregulated in roots), isocitrate lyase I (downregulated in roots), 2-hydroxyisoflavanone synthase (downregulated in stems), chloroplastic 50S ribosomal protein L33 (downregulated in leaves), chloroplastic 30S ribosomal protein S18, and serine/threonine protein kinase.

Results: Transcriptomics Quantitative Analysis (Soy Water-Limited Conditions)

Quantitative transcriptomics analyses demonstrated significant conclusions in 6 areas, as described below.

Genes were Quantified as being Significantly Up/Down Regulated in Beneficial Strain C Vs Formulation, that Confirm the Qualitative Analysis (Leaf Root)

All results are summarized in Table 8B. Descriptions of genes are included in the Qualitative Transcriptomics results section.

Plants treated with Strain C may have an improved ability to cope with the stresses associated with water-limited conditions, primarily by increased uptake of nutrients from soil (e.g. ammonium, sulphur) and symbiotic nitrogen and carbon fixation in root nodules and via increased activity of genes involved in protection against abiotic and biotic factors.

Genes that were Quantified as being Significantly Up/Down Regulated in Beneficial Strain C Vs Formulation, in Leaf Root)

All results are summarized in Table 8C.

Top up-regulated leaf genes included: Small and basic intrinsic protein 1A; RAD-like 6, 3; Germin-like protein 1; Ammonium transporter 1,2; Protein of unknown function, DUF547; GDSL-like Lipase/Acylhydrolase superfamily protein; N-terminal nucleophile aminohydrolases (Ntn hydrolases) superfamily protein; nodulin MtN21/EamA-like transporter family protein; proline-rich protein 4; Thioredoxin superfamily protein.

Small and basic intrinsic protein 1A belongs to a family of plant aquaporins (Ishikawa et al., 2005). In plants, aquaporins occur as multiple isoforms localized in the plasma membrane, endoplasmic reticulum, vacuoles, plastids and, in some species, in membrane compartments interacting with symbiotic organisms. In addition to water, plant aquaporins can transport various physiological substrates and dissolved gases such as carbon dioxide and ammonia or metalloids such as boron and silicon. Although they play a central role in water relations of roots, leaves, seeds, and flowers, aquaporins have also been linked to plant mineral nutrition, response to light, temperature and carbon and nitrogen fixation (Maurel et al., 2015).

RAD (RADIALIS) is a target gene in a regulatory network responsible for controlling of floral asymmetry in *Antirrhinum*. In *Arabidopsis*, the expression domains of RAD-like genes are often found in growing tissues, suggesting that RAD-like genes may have developmental roles (Baxter et al., 2007).

Germin-like proteins (GLPs) are present ubiquitously in plants (Dunwell and Cupins, 1998). Multiple studies have revealed diverse functions of GLPs in plant development and abiotic and biotic stresses like resistance to *Sclerotinia* stem rot of soybean (Lu et al., 2010) or *Sclerotinia sclerotiorum* (Rietz et al., 2012).

Ammonium transporter proteins are encoded by multigene families in plants with different physiological roles, one of which is ammonium uptake from the soil (Gazzarrini et al., 1999). Recently, in soybean, a novel symbiotic ammonium transporter 1 was described as a putative ammonium ($NH_4^+$) channel localized to the symbiosome membrane of soybean root nodules playing an important role for soybean *rhizobium* symbiosis because loss of activity results in a reduction of nodule fitness and growth (Chiasson et al., 2014).

The DUF547 domain is associated with class IV glutaredoxins, a family of oxidoreductases related to thioredoxins and deeply involved in regulating activity of metabolic enzymes, transcription factors, and stress-related antioxidant enzymes (Rouhier, 2010).

GDSL esterases/lipases are a newly discovered subclass of lipolytic enzymes with multifunctional properties, such as broad substrate specificity and regiospecificity (Brick et al., 1995). They have been reported to be involved in the regulation of plant development, morphogenesis, synthesis of secondary metabolites, and defense response (Chepyshko et al., 2012).

Most Ntn hydrolases catalyze the hydrolysis of amide bonds. Plant asparaginases belong to the superfamily of N-terminal nucleophile (Ntn) hydrolases.

Nodulin-encoding genes are specifically expressed during the development of symbiotic root nodules (Legocki and Verma, 1980). Upon nodule formation bacteria differentiate into nitrogen-fixing bacteroids that are beneficial to the plants (Kereszt et al., 2011). Nodulin proteins serve transport and regulatory functions in symbiosis (Fortin et al., 1985).

Repetitive proline-rich cell wall proteins (PRPs), one of the five families of structural cell wall proteins (Carpita and Gibeaut, 1993) that are associated with early stages of legume root nodule formation (Franssen et al., 1987) and other plant developmental stages, may also contribute to defense reaction mechanisms against physical damage and pathogen infection (Bradley et al., 1992; Brisson et al., 1994).

Thioredoxins are implicated in different aspects of plant life including development and adaptation to environmental changes and stresses. They act as antioxidants by facilitating the reduction of other proteins by cysteine thiol-disulfide exchange (Nordberg and Arnér, 2001).

Top upregulated genes in root tissue inclue: Subtilase family protein; Serine carboxypeptidase-like 40; Beta-6 tubulin; 4) Cytochrome P450, family 71, subfamily A, polypeptide 19; Sulfate transporter 2,1; Uridine diphosphate glycosyltransferase 74E2; ATPase E1-E2 type family protein/haloacid dehalogenase-like hydrolase family protein; NAD(P)-binding Rossmann-fold superfamily protein.

Subtilases are a family of subtilisin-like serine proteases expanded in plants by functional diversification—for instance they are involved in development of plants and stress response like resistance to pathogens (Chichkova et al., 2004) or establishment of symbiosis (Takeda et al., 2004).

Serine carboxypeptidase-like (SCPL) proteins have emerged as a new group of acyltransferase enzymes that function in a broad range of biochemical pathways, including secondary metabolite biosynthesis, herbicide conjugation, and germination-associated degradation of seed protein reserves (Lehfeldt et al., 2000). They were demonstrated to be involved in normal plant growth and development, synthesis of compounds that protect plants against pathogens, insects and UV light, and for resistance to natural and manmade xenobiotics (Mugford et al., 2009).

Beta-6 tubulin (TUB6) is a structural constituent of cytoskeleton involved in microtubule-based process, response to salt stress, response to cold and it is expressed in multiple plant structures and growth stages (Oppenheimer et al., 1988).

Cytochromes P450 are involved in the biosynthetic pathway of major phytoalexins-chemicals synthesized by plants to deter microbes or insects (Schuler M A1 Berenbaum M R. 2013). In soybean, Cytochrome P450-dependent enzymes are involved in an elicitor-inducible glyceollin biosynthesis (P450s) (Schopfer and Ebel, 1998).

Plant sulfate transporters of the plant roots cells play a major role in sulphur uptake from the environment, and intracellular and long-distance transport within the plant (Buchner et al., 2004). The sulfate transporter in *Lotus japonicus* was found to be crucial for symbiotic nitrogen fixation root nodules (Krusell et al., 2005).

Applied in transgenic crops for pathogen resistance; produces glucosides and detoxifies microbial products. Uridine diphosphate glycosyltransferases (UGT) are a superfamily of regulatory enzymes that modify the activity, solubility, and transport of plant hormones, secondary metabolites, and xenobiotics, thus participating in plant developmental regulation, biotic stress responses, and detoxification of pollutants and herbicides (Ross et al., 2001; Wang 2009).

The haloacid dehalogenase-like hydrolases (HAD) are a large family of enzymes with diverse activities, all involving cleaving bonds between a carbon and a halogen, or a carbon and a phosphorus-containing group (Caparrós-Martin, 2013). In mustard (*Brassica juncea*), a putative haloacid dehalogenase-like hydrolase was upregulated following cadmium exposure, suggesting a role in abiotic stress responses (Minglin et al., 2005).

A large family, diverse functions—could be involved anywhere in development, regulation, responses. Includes short-chain dehydrogenases/reductases (SDR), already described.

Top down-regulated root genes included: PQ-loop repeat family protein/transmembrane family protein; NAD(P)-binding Rossmann-fold superfamily protein; senescence associated gene 18; Cytidine/deoxycytidylate deaminase family protein; Integrase-type DNA-binding superfamily protein; brassinosteroid-6-oxidase 2; branched-chain amino acid transaminase 2; myb domain protein 62.

PQ-loop repeat family protein/transmembrane family protein is also called a MtN3/saliva domain (Yuan and Wang 2013). Theorized involvement in protein transport and as cargo receptors (Saudek 2012). Diverse processes known so far: "reproductive development, senescence, environmental adaptation, and host-pathogen interaction" (Yuan and Wang 2013) and abiotic stress response (Feng et al. 2015).

NAD(P)-binding Rossmann-fold superfamily protein is a large family, diverse functions—could be involved anywhere in development, regulation, responses. Includes short-chain dehydrogenases/reductases (SDR). Sequence searches in databases revealed that SDR6 encoded a NAD(P)-binding Rossmann-fold superfamily protein, which belongs to the short-chain dehydrogenase/reductase (SDR) family of proteins. By virtue of catalyzing >300 different enzymatic reactions [17], the Rossmann fold is one of the most widely occurring protein folds.

Senescence associated gene 18 is involved in leaf senescence in response to biotic/abiotic stress.

BR hormones promote growth in balance/crosstalk with immune response. This is a synthase of brassinosteroids.

Plants synthesize the amino acids valine, leucine, and isoleucine from the products of branched-chain amino acid (BCAA) metabolism, in which BCAA transaminase plays a key role (Binder, 2010). In *Arabidopsis* and other Brassicaceae, BCAA metabolism also leads to production of glucosinolates, defensive secondary metabolites (Binder, 2010).

MYB proteins are transcription factors present across eukaryotes, involved in growth, metabolism, and stress responses in plants (Li et al., 2015).

Top down-regulated genes in roots included: GAST1 protein homolog 3; oxidative stress 3; S-adenosyl-L-methionine-dependent methyltransferases superfamily protein; Late embryogenesis abundant protein, group 1 protein; Peroxidase superfamily protein; Heavy metal transport/detoxification superfamily protein; alcohol dehydrogenase 1; RING/FYVE/PHD zinc finger superfamily protein; 2-oxoglutarate (20 G) and Fe(II)-dependent oxygenase superfamily protein; seed gene 1.

Gibberellic acid-stimulated transcript (GAST) proteins in tomato and their homologs in *Arabidopsis*, rice, and other plant species regulate growth and development in relation to gibberellin signaling, including the development of roots and reproductive structures (Herzog et al., 1995; Ben-Nissan and Weiss, 1996; Furukawa et al., 2006).

The Oxidative Stress 3 (OXS3) protein improves tolerance to heavy metals and oxidative stress, possibly by acting as a chromatin remodeling factor to coordinate stress responses (Blanvillain et al., 2008).

S-adenosylmethionine synthase, which catalyzes synthesis of s-adenosylmethionine from methionine and ATP, functions as a primary methyl-group donor and as a precursor for metabolites such as ethylene, polyamines, and vitamin B1 (Hesse et al., 2004).

Late embryogenesis abundant proteins (LEA) provide desiccation tolerance by changing their folding during drying, possibly creating a water shell under drought and stabilizing cellular components in the absence of water under full desiccation (Shih et al., 2008). The LEA gene HVA1 was successfully transferred from barley into rice to provide water deficit and salt stress tolerance (Xu et al., 1996).

In plants, peroxidases are involved in cell wall lignification, usually associated with pathogen resistance (Bruce and West, 1989), abiotic stress (Huttová et al., 2006; Quiroga et al., 2001), or cell wall modification during growth (Arnaldos et al., 2002; G Martinez Pastur, 2001; Van Hoof and Gaspar, 1976; Kukavica et al., 2012).

In plants, alcohol dehydrogenase, a highly conserved enzyme, is induced by stress conditions, particularly during hypoxic response, to anaerobically supply NAD+ for metabolism (Chung and Ferl, 1999).

Plant homeodomain (PHD) finger domains read chromatin modifications during development and in response to stress, including distinguishing between mono-, di-, and tri-methylated states. This family is present with similar activities across eukaryotes.

Seed gene 1 is involved in lipid storage in seeds. A highly conserved calcium-binding domain located in *Arabidopsis thaliana* Seed Gene 1 (ATSG1) classifies this gene in the caleosin family. Caleosins are oleosin-like proteins, highly expressed in *A. thaliana* mature seeds, where they are largely associated with storage of lipids.

Q3 Up/Down Regulated Genes that are Unique to Strain C Treated Plants (Leaf Root) as Compared to Plants Grown from Seeds Treated with the Formulation Control, that are not Found Significantly Up- or Down-Regulated in Plants Grown from Seeds Treated with Strain A or Strain B All results are summarized in Table 8D.

The top unregulated genes in leaf tissue included: Pathogenesis-related thaumatin superfamily protein; Protein of unknown function, DUF547; PEBP (phosphatidylethanolamine-binding protein) family protein; CLAVATA3/ESR-RELATED 17; cytokinin oxidase/dehydrogenase 6.

The pathogenesis-related thaumatin-like proteins (PR-5) are inducible proteins that regulate plant-microbe interactions (Velazhahan et al., 1999). In soybean, a specific gene encoding a thaumatin-like protein in pathogenesis-related family 5 was discovered to regulate which bacterial species would be accepted in nodule formation (Hayashi et al., 2014).

The DUF547 domain is associated with class IV glutaredoxins, a family of oxidoreductases related to thioredoxins and deeply involved in regulating activity of metabolic enzymes, transcription factors, and stress-related antioxidant enzymes (Rouhier, 2010).

In plants, phosphatidylethanolamine-binding proteins (PEBP) are known to initiate and regulate flowering through interactions with the hormone giberellin and several transcription factors (Harig et al., 2012).

The CLAVATA3/ESR-related genes are essential to regulating growth, development, and meristem maintenance in the shoot and root apical meristems (Miwa et al., 2008).

Cytokinin oxidase/dehydrogenase (CKX) enzymes participate in developmental regulation by inactivating the hormone cytokinin (Schmulling et al., 2003). Cytokinin oxidase has been linked directly to grain yield in rice, as the accumulation of cytokinin leads to the development of increased numbers of fruiting structures (Ashikari et al., 2005).

The top upregulated genes in root included: Subtilase family protein; sulfate transporter 2,1; Uridine diphosphate glycosyltransferase 74E2; ATPase E1-E2 type family protein/haloacid dehalogenase-like hydrolase family protein; early nodulin-like protein 15.

Subtilases are a family of subtilisin-like serine proteases expanded in plants by functional diversification—for instance they are involved in development of plants and stress response like resistance to pathogens (Chichkova et al., 2004) or establishment of symbiosis (Takeda et al., 2004).

Sulfate transporters in the roots are responsible for uptake of the micronutrient sulfate (Takahashi et al., 1997). In legumes, nodule-specific sulfate transporters provide sulfate from the plant host to the *rhizobia*, where sulfate is necessary for synthesis of the nitrogen-fixing enzyme nitrogenase, among other proteins (Krusell et al., 2005).

Uridine diphosphate glycosyltransferases (UGT) are a superfamily of regulatory enzymes that modify the activity, solubility, and transport of plant hormones, secondary metabolites, and xenobiotics, thus participating in plant developmental regulation, biotic stress responses, and detoxification of pollutants and herbicides (Ross et al., 2001; Wang 2009).

The haloacid dehalogenase-like hydrolases (HAD) are a large family of enzymes with diverse activities, all involving cleaving bonds between a carbon and a halogen, or a carbon and a phosphorus-containing group (Caparrós-Martin, 2013). In mustard (*Brassica juncea*), a putative haloacid dehalogenase-like hydrolase was upregulated following cadmium exposure, suggesting a role in abiotic stress responses (Minglin et al., 2005).

Nodulin-encoding genes are specifically expressed during the development of symbiotic root nodules (Legocki and Verma, 1980). Upon nodule formation bacteria differentiate into nitrogen-fixing bacteroids that are beneficial to the plants (Kereszt et al., 2011). Nodulin proteins serve transport and regulatory functions in symbiosis (Fortin et al., 1985).

The following genes were downregulated in leaf: branched-chain amino acid transaminase 2; myb domain protein 62; Protein of unknown function (DUF506); Regulator of chromosome condensation (RCC1) family protein; Dynein light chain type 1 family protein; Acyl-CoA N-acyl-transferases (NAT) superfamily protein.

Plants synthesize the amino acids valine, leucine, and isoleucine from the products of branched-chain amino acid (BCAA) metabolism, in which BCAA transaminase plays a key role (Binder, 2010). In *Arabidopsis* and other Brassicaceae, BCAA metabolism also leads to production of glucosinolates, defensive secondary metabolites (Binder, 2010).

MYB proteins are transcription factors present across eukaryotes, involved in growth, metabolism, and stress responses in plants (Li et al., 2015).

The DUF506 family is believed to belong to the PD-(D/E)XK nuclease superfamily, involved in DNA repair and recombination (Jorgensen and Dorantes-Acosta, 2012), which is essential in preventing genotoxic stress during abiotic stress and pathogen attack (Dona et al., 2013).

The regulator of chromosome condensation (RCC) family are essential regulatory proteins in the cell cycle, responsible for ensuring mitosis does not begin before DNA replication is completed (Dasso, 1993). DNA maintenance is essential in preventing genotoxic stress during abiotic stress and pathogen attack (Dona et al., 2013).

Dynein is an essential molecule for intracellular transport, physically moving proteins, vesicles, and small organelles along a network of microtubules (Lo et al., 2001).

Acyl-CoA acyltransferases are a group of enzymes involved in synthesizing triacylglycerol, which accumulates in the seed, permitting normal seed embryo development (Zhang et al., 2009) and providing the main component of soybean oil (Wang et al., 2006).

The top downregulated genes in root tissue included: GAST1 protein homolog 3; oxidative stress 3; S-adenosyl-L-methionine-dependent methyltransferases superfamily protein; Late embryogenesis abundant protein, group 1 protein; Peroxidase superfamily protein.

Gibberellic acid-stimulated transcript (GAST) proteins in tomato and their homologs in *Arabidopsis*, rice, and other plant species regulate growth and development in relation to gibberellin signaling, including the development of roots and reproductive structures (Herzog et al., 1995; Ben-Nissan and Weiss, 1996; Furukawa et al., 2006).

The Oxidative Stress 3 (OXS3) protein improves tolerance to heavy metals and oxidative stress, possibly by acting as a chromatin remodeling factor to coordinate stress responses (Blanvillain et al., 2008).

S-adenosylmethionine synthase, which catalyzes synthesis of s-adenosylmethionine from methionine and ATP, functions as a primary methyl-group donor and as a precursor for metabolites such as ethylene, polyamines, and vitamin B1 (Hesse et al., 2004).

Late embryogenesis abundant proteins (LEA) provide desiccation tolerance by changing their folding during drying, possibly creating a water shell under drought and stabilizing cellular components in the absence of water under full desiccation (Shih et al., 2008). The LEA gene HVA1 was successfully transferred from barley into rice to provide water deficit and salt stress tolerance (Xu et al., 1996).

In plants, peroxidases are involved in cell wall lignification, usually associated with pathogen resistance (Bruce and West, 1989), abiotic stress (Huttová et al., 2006; Quiroga et al., 2001), or cell wall modification during growth (Arnaldos et al., 2002; G Martinez Pastur, 2001; Van Hoof and Gaspar, 1976; Kukavica et al., 2012).

Up/Down Regulated Genes that are Significantly Represented in Plants Grown from Seeds Treated with Strain C Versus Plants Grown from Seeds Treated with Strain A or Strain B All results are summarized in Table 8E.

In case of *Streptomycetes* Strain C— top upregulated genes or transcripts are expressed at much higher levels than in semi-beneficial strain Strain B compared to control Strain A suggesting presence of genes or transcripts that will lead to drought protection and subsequently yield increase.

The top upregulated genes in leaf included: PQ-loop repeat family protein/transmembrane family protein; NAD(P)-binding Rossmann-fold superfamily protein; Senescence associated gene 18; Integrase-type DNA-binding superfamily protein; Small and basic intrinsic protein 1A.

PQ-loop repeat family proteins are composed of seven predicted transmembrane domains (TMs) and serve functions in amino acid transport (Xuan et al., 2013). In soybean, PQ-loop repeat genes were found to be upregulated in the tolerant genotype 15 days post-infestation by aphids, suggesting their implication in plant tolerance to biotic stress (Prochaska et al., 2015).

NAD(P)-binding Rossmann-fold superfamily protein is involved in oxidoreductase activity, binding, and catalytic activity (Hanukoglu, 2015).

Genes with increased expression during senescence, identified in multiple plant species, are often referred to as SAGs or senescence-upregulated genes (Buchanan-Wollaston, 1997). Senescence associated gene 18 (SAG18) encodes a novel protein (Weaver et al., 1998) and was found to be induced by ozone (Miller et al., 1999). While the initiation of leaf senescence is developmentally regulated, external factors such as nutrient deficiency, pathogenic attack, drought, light limitation, and temperature can induce premature senescence (Smart, 1994).

Integrase-type DNA-binding superfamily protein is a member of the DREB subfamily A-2 of ERF/AP2 transcription factor family that have important functions in the transcriptional regulation of a variety of biological processes related to growth and development, as well as various responses to environmental stimuli like drought (Nakano et al., 2006; Ding et al., 2013).

Small and basic intrinsic protein 1A belongs to a family of plant aquaporins (Ishikawa et al., 2005). In plants, aquaporins occur as multiple isoforms localized in the plasma membrane, endoplasmic reticulum, vacuoles, plastids and, in some species, in membrane compartments interacting with symbiotic organisms. In addition to water, plant aquaporins can transport various physiological substrates and dissolved gases such as carbon dioxide and ammonia or metalloids such as boron and silicon. Although they play a central role in water relations of roots, leaves, seeds, and flowers, aquaporins have also been linked to plant mineral nutrition, response to light, temperature and carbon and nitrogen fixation (Maurel et al., 2015).

Top upregulated genes in root included: Subtilase family protein; Beta-6 tubulin; Cytochrome P450, family 71, subfamily A, polypeptide 19; Serine carboxypeptidase-like 40; Nuclear factor Y, subunit C4.

Subtilases are a family of subtilisin-like serine proteases expanded in plants by functional diversification—for instance they are involved in development of plants and stress response like resistance to pathogens (Chichkova et al., 2004) or establishment of symbiosis (Takeda et al., 2004).

Beta-6 tubulin (TUB6) is a structural constituent of cytoskeleton involved in microtubule-based process, response to salt stress, response to cold and it is expressed in multiple plant structures and growth stages (Oppenheimer et al., 1988).

Cytochromes P450 are involved in the biosynthetic pathway of major phytoalexins-chemicals synthesized by plants to deter microbes or insects (Schuler M A1, Berenbaum M R. 2013). In soybean, Cytochrome P450-dependent enzymes are involved in an elicitor-inducible glyceollin biosynthesis (P450s) (Schopfer and Ebel, 1998).

Serine carboxypeptidase-like (SCPL) proteins have emerged as a new group of acyltransferase enzymes that function in a broad range of biochemical pathways, including secondary metabolite biosynthesis, herbicide conjugation, and germination-associated degradation of seed protein reserves (Lehfeldt et al., 2000). They were demonstrated to be involved in normal plant growth and development, synthesis of compounds that protect plants against pathogens, insects and UV light, and for resistance to natural and manmade xenobiotics (Mugford et al., 2009).

Nuclear factor Ys (NF-Ys) are heterotrimeric transcription factors evolutionary conserved in yeast, mammals and plants composed of three subunits: NF-YA, NF-YB, and NF-YC, which bind with high affinity and specificity to the CCAAT box, cis elements present in many eukaryotic promoters, activating or repressing transcription of the downstream genes (Ceribelli et al., 2008). More recently, plant NF-Y genes have gained major interest due to their roles in many biological processes in plant development or adaptation to environmental conditions, particularly in the root nodule symbiosis established between legume plants and nitrogen fixing bacteria (Ripodas et al., 2015).

The top down-regulated genes in leaf included: Pathogenesis-related thaumatin superfamily protein; Vacuolar iron transporter (VIT) family protein; PLAT/LH2 domain-containing lipoxygenase family protein; Disease resistance protein (TIR-NBS-LRR class), putative; Protein of unknown function, DUF547.

The pathogenesis-related thaumatin-like proteins (PR-5) are inducible proteins that regulate plant-microbe interactions (Velazhahan et al., 1999). In soybean, a specific gene encoding a thaumatin-like protein in pathogenesis-related family 5 was discovered to regulate which bacterial species would be accepted in nodule formation (Hayashi et al., 2014).

The majority of disease resistance genes (R genes) in plants encode nucleotide-binding site leucine-rich repeat (NBS-LRR) proteins. This large family is encoded by hundreds of diverse genes per genome and can be subdivided into the functionally distinct TIR-domain-containing (TNL) and CC-domain-containing (CNL) subfamilies. Genetically, the LRRs of plant R proteins are determinants of response specificity, and their action can lead to plant cell death in the form of the familiar hypersensitive response (HR).

The DUF547 domain is associated with class IV glutaredoxins, a family of oxidoreductases related to thioredoxins and deeply involved in regulating activity of metabolic enzymes, transcription factors, and stress-related antioxidant enzymes (Rouhier, 2010).

The top down-regulated genes in root included: Cytochrome P450, family 71, subfamily B, polypeptide 35; Major facilitator superfamily protein; Ammonium transporter; Protein kinase superfamily protein; ABC-2 type transporter family protein.

Cytochromes P450 are involved in the biosynthetic pathway of major phytoalexins-chemicals synthesized by plants to deter microbes or insects (Schuler M A1 Berenbaum M R. 2013). In soybean, Cytochrome P450-dependent enzymes are involved in an elicitor-inducible glyceollin biosynthesis (P450s) (Schopfer and Ebel, 1998).

The major facilitator superfamily (MFS) is a class of membrane transport proteins that facilitate import/export of small solutes (drugs, metabolites, oligosaccharides, amino acids and oxyanions) across cell membranes in response to chemiosmotic gradients (Marger and Saier, 1993). In plants, MFS transporters play critical roles in withstanding harmful stresses, for example, which are involved in the transport of sugar, phosphates and nitrate, but also in plant defense against various toxin stresses by exporting toxin outside the cell (Peng et al., 2011).

Ammonium transporter proteins are encoded by multigene families in plants with different physiological roles, one of which is ammonium uptake from the soil (Gazzarrini et al., 1999). Recently, in soybean, a novel symbiotic ammonium transporter 1 was described as a putative ammonium (NH4+) channel localized to the symbiosome membrane of soybean root nodules playing an important role for soybean rhizobium symbiosis because loss of activity results in a reduction of nodule fitness and growth (Chiasson et al., 2014).

Eukaryotic protein kinase superfamily constitutes enzymes that catalyze the reversible transfer of the gamma-phosphate from ATP to amino acid side chains of proteins. In plants, protein phosphorylation has been implicated in responses to many signals, including light, pathogen invasion, hormones, temperature stress, and nutrient deprivation (Laurie and Halford, 2001).

ABC transporters, driven by ATP hydrolysis, constitute one of the largest protein families found in all living organisms (Jones and George, 2004). ABC transporters were originally identified as transporters involved in detoxification processes, that have been later shown to be required for organ growth, plant nutrition, plant development, response to abiotic stresses, pathogen resistance and the interaction of the plant with its environment (Kang et al., 2011).

Up/Down Regulated Transcripts that are Significantly Represented in Strain C Treated Plants Vs. The Streptomyces Strains Strain B and Strain A All results are summarized in Table 8F.

Compared to plants grown from seeds treated with Strain B or Strain A, there were significantly increased (>=5×) or decreased (<=5×) transcripts in plants grown from seeds treated with the beneficial endophyte Streptomyces Strain C. Plants grown from seeds treated with Strain C displayed the best phenotypes under drought conditions, and best final harvest yield and plant scores.

Expression Patterns in Putative Sugar Transporter Genes in Streptomyces

A total of 16 genes annotated with sugar transporter domains (PF00083, PF04142, PF07690) were upregulated in roots or leaves of soybeans treated with Streptomyces Strain B and Strain C relative to roots of untreated controls, and downregulated in roots and leaves of soybeans treated with Streptomyces Strain A. These genes are annotated as components of membranes having transmembrane transporter activity. The soybean gene Glyma.06G313500 was found to be down regulated in both leaf and root tissue in Strain A treated soybean and upregulated in both leaf and root tissue in Strain B and Strain C. Glyma.06G313500 is a homolog of the Arabidopsis thaliana gene zinc induced facilitator-like 1 (ZIFL1) which is involved in the directional transport of the plant hormone auxin between cells (Remy, Baster, Friml, & Duque, 2013). Results are shown in Table 9.

The inventors particularly point out the correlation between the upregulation of transcription of sugar transporter genes in plant tissues of plants grown from seeds treated with a beneficial Streptomyces strain Strain B or Strain C as compared to Strain A, and the increased numbers of arabinose transporter genes of beneficial Streptomyces strains Strain B or Strain C as compared to the genome of Strain A (as described in Example 2). Increases in sugar transport for both the microbe and the plant were an important feature of a beneficial Streptomyces endophyte-plant relationship.

Example 9: Identification of Differentially Regulated Hormones

Methods

For hormone analysis, 100±10 mg tissue was measured into microtubes (chilled with liquid nitrogen), and sent on dry ice to the lab of Dr. Michael Kolomiets in the Department of Plant Pathology and Microbiology at Texas A&M University. Plant hormone analysis was performed per Christiansen et al. (2014) with slight modification. Briefly, hormones were extracted from 100±10 mg of frozen tissue and tissue weights were recorded for quantification. A mixture containing 10 microliters of 2.5 microMolar internal standards and 500 microliters of extraction buffer [1-propanol/$H_2O$/concentrated HCl (2:1:0.002, vol/vol/vol) was added to each sample and vortexed until thawed. Samples were agitated for 30 min at 4° C., then 500 microliters of dichloromethane (CH2Cl2) were added. Samples were agitated again for 30 min at 4° C., and then centrifuged at 13,000×g for 5 min. in darkness. The lower organic layer was removed into a glass vial and the solvent was evaporated by drying samples for 30-40 min under a N2 stream. Samples were re-solubilized in 150 microliters of MeOH, shaken for 1 min and centrifuged at 14,000×g for 2 min. A supernatant of 90 microliters was transferred into the autosampler vial and hormones were analyzed by ultraperformance liquid chromatography, coupled to mass spectrometry (UPLC-MS/MS). Ascentis Express C-18 Column (3 cm×2.1 mm, 2.7 cm) connected to an API 3200 using electrospray ionization-tandem mass spectrometry (MS/MS) with scheduled multiple reaction monitoring (SMRM). The injection volume was 5 microliters and had a 300 microliters/min mobile phase consisting of Solution A (0.05% acetic acid in water) and Solution B (0.05% acetic acid in acetonitrile) with a gradient consisting of (time—%

B): 0.3—1%, 2—45%, 5—100%, 8—100%, 9—1%, 11—stop. Quantitation was carried out with Analyst software (AB Sciex), using the internal standards as a reference for extraction recovery. Leaf and root tissue was saved in −62° C. and saved for subsequent gene expression analysis.

Mass spectra of 8 plant hormones were obtained: jasmonic acid (JA), jasmonic acid-isoleucine (JA-Ile), salicylic acid (SA), abscisic acid (ABA), 12-oxo-phytodienoic acid (OPDA), 10-oxo-11 phytoenoic acid (OPEA), traumatic acid (TA) and cinnaminic acid (CA). Fold changes between control and treated samples were calculated by dividing the mass spectrum value from the treated sample by the value from the control sample.

Results

Normal Watering Conditions

All results are summarized in Table 10A.

The plant hormone analysis of soybean plants inoculated with endophytic bacterial strain Strain C grown under a normal (well watered) watering regime in the greenhouse revealed that Strain C augmented and modified hormone levels in different tissue types in planta.

Plant phytohormone ABA is involved in regulation of developmental processes such as seed maturation and dormancy (Baker et al., 1988), responses to environmental stresses (Shinozaki and Yamaguchi-Shinozaki, 2000) including stomatal closure (McAinsh, 1990) and expression of stress-related genes (Urao et al., 1993). Data show that ABA levels were highly upregulated in roots of Strain C-treated plants grown under normal watering condition.

Salicylic acid (SA) is considered one of the key endogenous component involved in local and systemic defense responses in plants (Shah and Klessig, 1999). SA is synthesized through phenylpropanoid pathway from cinnamic acid (CA) via two possible pathways (Klambt, 1962; el-Basyouni et al., 1964). Cinnamic acid is a precursor for biosynthesis of the polyphenol compounds (Lee et al., 1995) that have multiple functions, such as providing mechanical support (lignins) (Whetten and Sederoff, 1992), protection against abiotic and biotic stress (antioxidants) (Dixon and Paiva, 1995), and signaling with the flavonoid nodulation factors (Weisshaar and Jenkins, 1998). Our data show that pattern of expression of SA and CA is very similar to ABA.

Lipoxygenases catalyze the dioxygenation of polyunsaturated fatty acids in lipids collectively known as oxylipins. Oxylipins are involved in a number of developmental or stress response processes (Andersson et al., 2006) and they exert protective activities either as signaling molecules in plants during development, wounding, insect and pathogen attack, or direct anti-microbial substances that are toxic to the invader (Yan Y et al., 2013). Particularly well studied examples of the plant oxylipins are jasmonates (JAs) that are formed by the enzymatic action of 13-LOX on linolenic acid that enables production of 12-oxo-phytodienoic acid (OPDA) and its downstream products such as free JA, MeJA, cis-jasmone and JA-Ile (Göbel and Feussner, 2009). Down-regulation is observed in root tissues of well-watered plants. Our results are in line with evidence showing that depending on particular stress, JA can act both synergistically and antagonistically with salicylic acid (Beckers and Spoel, 2006) and abscisic acid (ABA) (Anderson et al., 2004) in plant-pathogen or -insect interactions. In addition, our data demonstrates that the levels of JA and JA-Ile were upregulated in leaves of well-watered plants.

Depending on the source of the enzyme, lipoxygenase activity on linolenic acid will yield either 9- or 13-hydroperoxides which are further metabolized into diverse oxylipins (Andersson et al., 2006; Göbel and Feussner, 2009). Hydroperoxide lyase can then catalyze the breakdown of 13-hydroperoxylinolenic acid to C12 and C6 moieties that are further metabolized to traumatic acid (TA) and the various C6 aldehydes and alcohols (Croft et al., 1993). Traumatic acid, which is produced from both linoleic acid and linolenic acids, is a plant wound hormone associated with cell proliferation in plants (Vick and Zimmerman, 1987) and causes abscission in cotton buds (Strong and Kruitwagen, 1967). Data show that TA is upregulated in all tissues of metabolically active well-watered plants.

A parallel pathway involving 9-LOX activity on linoleic acid leads to the production of 10-oxo-11-phytoenoic acid (OPEA). Despite structural similarity to jasmonates, physiological roles for OPEA is not well understood. This hormone is highly induced at the site of pathogen infection and it can suppress the growth of mycotoxigenic fungi suggesting more specialized roles in local defense reactions (Christensen et al., 2015). Even though OPDA and OPEA may have slightly different biological functions, they belong to the same pathway and show similar pattern of expression in our experiments: down-regulated under normal condition (except OPDA, stem tissue).

Water-Limited (Drought) Conditions

All results are summarized in Table 10B.

The plant hormone analysis of soybean plants inoculated with endophytic bacterial strain Strain C grown under drought watering regime in the greenhouse revealed that Strain C augmented and modified hormone levels in different tissue types and growth conditions in planta (Table 7).

Our data shows that the levels of the plant hormone abscisic acid (ABA) levels were decreased in Strain C-treated plants in all three tissue types in plants exposed to drought, compared to plants grown from seed treated with formulation only and exposed to drought. ABA is involved in regulation of developmental processes such as seed maturation and dormancy (Baker et al., 1988), responses to environmental stresses (Shinozaki and Yamaguchi-Shinozaki, 2000) including stomatal closure (McAinsh, 1990) and expression of stress-related genes (Urao et al., 1993). ABA negatively affects root nodule formation (Phillips, 1971; Bano and Harper, 2002). Thus, plants treated with compositions such as Strain C may have an improved ability to cope with the stresses associated with water-limited conditions, via decreased expression of ABA.

Our data shows that the pattern of expression of salicylic acid (SA) and cinnamic acid (CA) is very similar to ABA, with slightly upregulated levels of SA and CA in leaf tissues. SA is an endogenous component involved in local and systemic defense responses in plants (Shah and Klessig, 1999). At the infection site, the plant triggers localized programmed cell death, a phenomenon known as the hypersensitive response (Caplan et al., 2008), followed by accumulation of SA, and an induction of pathogenesis-related proteins in distal tissues to protect plants from secondary infections. This type of protection is called systemic acquired resistance (SAR) and it provides broad-spectrum resistance against pathogenic fungi, oomycetes, bacteria and viruses (Shah and Klessig, 1999). The protective effect of SAR can last for months, and possibly even throughout the whole growing season (Kuc, 1987). SA is synthesized through phenylpropanoid pathway from cinnamic acid (CA) via two possible pathways (Klambt, 1962; el-Basyouni et al., 1964). Cinnamic acid is a precursor for biosynthesis of the polyphenol compounds (Lee et al., 1995) that have multiple functions, such as providing mechanical support (lignins) (Whetten and Sederoff, 1992), protection against abiotic and biotic stress (antioxidants) (Dixon and Paiva, 1995), and signaling with the flavonoid nodulation factors (Weisshaar and Jenkins, 1998). Thus, plants treated with compositions such as Strain C may have an improved ability to cope with the stresses associated with water-limited conditions, via modulation of expression of SA and/or CA.

Jasmonic acid (JA) and its derivative jasmonic acid isoleucine (JA-Ile) are down-regulated in Strain C-treated plants grown under water-limited conditions, in all tissues. Jasmonates (JAs) are formed by the enzymatic action of 13-LOX on linolenic acid that enables production of 12-oxo-phytodienoic acid (OPDA) and its downstream products such as free JA, MeJA, cis-jasmone and JA-Ile (Göbel and Feussner, 2009). JAs are a type of oxylipins, which are involved in a number of developmental or stress response processes (Andersson et al., 2006) and they exert protective activities either as signaling molecules in plants during development, wounding, insect and pathogen attack, or direct anti-microbial substances that are toxic to the invader (Yan Y et al., 2013). Oxylipins are formed by the dioxygenation of polyunsaturated fatty acids in lipids, a reaction catalyzed by lipoxygenases. Thus, plants treated with compositions such as Strain C may have an improved ability to cope with the stresses associated with water-limited conditions, via decreased expression of JA and/or JA-Ile.

Levels of traumatic acid (TA) are down-regulated in all tissues of Strain C-treated plants grown under water-limited conditions. TA, which is produced from both linoleic acid and linolenic acid, is a plant wound hormone associated with cell proliferation in plants (Vick and Zimmerman, 1987) and causes abscission in cotton buds (Strong and Kruitwagen, 1967). Thus, plants treated with compositions such as Strain C may have an improved ability to cope with the stresses associated with water-limited conditions, via decreased expression of TA.

In Strain C-treated plants grown under water-limited conditions, OPDA levels were slightly but not significantly decreased in root tissues, and significantly increased in both stem and leaf tissues. OPEA levels were increased in all tissues of Strain C-treated plants grown under water-limited conditions. Despite structural similarity to jasmonates, physiological roles for OPEA is not well understood. This hormone is highly induced at the site of pathogen infection and it can suppress the growth of mycotoxigenic fungi suggesting more specialized roles in local defense reactions (Christensen et al., 2015). Thus, plants treated with compositions such as Strain C may have an improved ability to cope with the stresses associated with water-limited conditions, via modulation of expression of OPEA and/or OPDA.

Example 10: Identification of Differentially Regulated Metabolites (Metabolomics)

Methods

For metabolite analysis, 150±10 mg of each sample was transferred into 1.5 mL microtubes (chilled in liquid nitrogen) and sent on dry ice to the Proteomics and Metabolomics Facility at Colorado State University. Metabolomics data acquisition was performed per the following methods provided by Dr. Corey Broeckling at CSU. To prepare the samples for analysis, phytohormones were extracted from ground plant material using a biphasic protocol. One mL of a methyl tert-butyl ether (MTBE):methanol:water mixture (6:3:1) was added to each sample then shaken for 1 hour. Next, 250 microliters cold water and a mix of internal standards was added to each sample to promote phase separation. Samples were shaken again for 5 minutes. Samples were then centrifuged at 2,095×g at 4° C. for 15 minutes. The organic top phase was removed for hormone analysis, dried under an inert nitrogen environment, then re-suspended in 400 microliters of 50% acetonitrile. Extracts were then directly analyzed by LC-MS.

For GC-MS, the polar (lower phase) extract was dried using a speedvac, resuspended in 50 microliters of pyridine containing 50 mg/mL of methoxyamine hydrochloride, incubated at 60° C. for 45 min, sonicated for 10 min, and incubated for an additional 45 min at 60° C. Next, 25 microliters of N-methyl-N-trimethylsilyltrifluoroacetamide with 1% trimethylchlorosilane (MSTFA+1% TMCS, Thermo Scientific) was added and samples were incubated at 60° C. for 30 min, centrifuged at 3000×g for 5 min, cooled to room temperature, and 80 microliters of the supernatant was transferred to a 150 microliters glass insert in a GC-MS autosampler vial. Metabolites were detected using a Trace GC Ultra coupled to a Thermo ISQ mass spectrometer (Thermo Scientific). Samples were injected in a 1:10 split ratio twice in discrete randomized blocks. Separation occurred using a 30 m TG-5MS column (Thermo Scientific, 0.25 mm i.d., 0.25 micrometer film thickness) with a 1.2 mL/min helium gas flow rate, and the program consisted of 80° C. for 30 sec, a ramp of 15° C. per min to 330° C., and an 8 min hold. Masses between 50-650 m/z were scanned at 5 scans/sec after electron impact ionization. The ionization source was cleaned and retuned and the injection liner replaced between injection replicates. Analysis for plant hormones was performed by UPLC-MS/MS as follows.

Over 1250 metabolites were detected and mass spectra annotated by comparing to libraries of known spectra including an in-house database of 1200 compounds at CSU (LC-MS only), the National Institute of Standards and Technology databases, Massbank MS database, and the Golm Metabolite Database. Initial annotation was automated, followed by manual validation of annotations. Following annotation, approximately 160 compounds were identified. After removal of technical artifacts (e.g. siloxane), and ambiguous or vague annotations (e.g. carbohydrate or saccharide), 145 identified compounds remained for analysis. These compounds were assessed for fold change over control plants. Metabolites were grouped by pathways (e.g. carbohydrate metabolism or alkaloid biosynthesis) and the KEGG database and literature were manually referenced to identify pertinent shifts in metabolic patterns in plants treated with microbes. Any compound without an appreciable shift compared to that observed in control plants was removed from further analysis.

Results

Normal Watering Conditions

All results are summarized in Table 11A.

An important metabolic system in plants involves the production of phenylpropanoid compounds. SYM treatments show modulation of phenylpropanoid production under well-watered conditions, often in a tissue-specific manner, as well as causing alterations in the levels of aromatic amino acid precursors (phenylalanine, tyrosine, tryptophan) that feed into these pathways. Lignin, for example, is an important structural component in plants, second in abundance only to cellulose. Strain C-treatment under well-watered conditions stimulates relative increases in a variety of lignin precursors in stem tissue (caffeic acid) and leaf tissue (sinapic acid, ferulic acid).

Another diverse group of plant metabolites, the alkaloids, may be constitutively synthesized in the plant or may be produced de novo. Although alkaloids can be synthesized in response to stresses such as wounding, they are also transiently produced in early stages of plant development (Cheong et al., 2002). Strain C treatments elicit a variety of alterations in alkaloid biosynthetic pathways under well-watered conditions. An increase in pipecolic acid is observed in root tissues of Strain C-treated plants under normal watering regimes. Strain C also appears to have a positive effect on the transportation of tryptophan, an important alkaloid precursor, as evinced by its accumulation in stem tissues of plants under normal watering regime.

Flavonoid and isoflavonoids compounds are exuded by plant roots into the rhizosphere in response to nutrient stress in order to recruit compatible nitrogen-fixing bacteria. These signals are perceived by N-fixing *rhizobia*, which then begin production of nodulation factors that stimulate the development of nodules in the roots of the host plant (Gibson et al., 2008).

A variety of other metabolites appear to be modulated by Strain C treatments. For instance, a direct precursor to brassinosteroid production, campesterol, is increased relative to control in well-watered leaf tissue treated with Strain C. Lumichrome has the ability to affect plant root respiration, transpiration rates, as well as stomatal conductance in a variety agrinomically relevant plants (Phillips et al., 1999, Matiru and Dakora, 2005). In addition to production by members of the *Rhizobia*, it has been shown that soil microbes such as *Pseudomonas* can degrade riboflavin to lumichrome in rhizosphere systems (Yanagita and Foster, 1956). Well-watered plants present with decreased amounts of lumichrome in plants grown from Strain C treated seeds.

In addition to the specific compounds and pathways above, SYM treatments cause significant modulation in the levels of free amino acids and nitrogenous compounds. Allantoin, a product of urea metabolism, can constitute a large percentage of the soluble nitrogen in plant sap and may be integral in nitrogen transport in nodulated soybean plants (Reinbothe and Mothes, 1962; McClure and Israel, 1979 Strain C-treatment modulates allantoin accumulation in various tissues. Well-watered plants accumulate allantoin in both stem and leaf tissue, perhaps denoting an increase in nitrogen transport and metabolism, or an increase in N-assimilation. Strain C treatment causes an increase in the levels of several amino acids in stem tissue of well-watered plants.

The metabolism of carbohydrates and lipids also shift under SYM treatment. Carbohydrates and lipids are utilized in a wide range of functions, whether for energy storage, as signaling molecules, or the composition of structural material. Treatment by Strain C modulates the levels of a variety of carbohydrate and lipid metabolites including galactose, which is increased in stem and leaf tissue of well-watered plant). Fatty acids may serve as precursors to lipid-based hormones such as the jasmonates. Strain C appears to affect lipid metabolism as shown by the modulation in levels of a variety of fatty acids (hexadecanoic acid) as well as other precursors to lipid biosynthesis (ethanolamine, sphingosine).

Water-Limited (Drought) Conditions

All results are summarized in Table 11B.

An important metabolic system in plants involves the production of phenylpropanoid compounds. The production of a wide variety of phenylpropanoids may be influenced by stress conditions and important plant signaling molecules. The shikimic acid pathway sits atop many of these mechanisms as it produces the cyclic amino acids that constitute the raw materials for many defense compounds. Strain C treatments show modulation of phenylpropanoid production under drought conditions, often in a tissue-specific manner, as well as causing alterations in the levels of aromatic amino acid precursors (phenylalanine, tyrosine, tryptophan) that feed into these pathways. All tested phenylpropanoid compounds (phenylalanine, shikimic acid, tyrosine, quinic acid, sinapic acid, ferulic acid, caffeic acid) displayed reduced production under water-limited conditions in leaf tissues; all but phenylalanine and shikimic acid displayed reduced production in root tissues; ferulic acid alone demonstrated increased production in stem tissues. Thus, plants treated with compositions such as Strain C may have an improved ability to cope with the stresses associated with water-limited conditions, via modulation of production of phenylpropanoids.

Another diverse group of plant metabolites, the alkaloids, may be constitutively synthesized in the plant or may be produced de novo. Although alkaloids can be synthesized in response to stresses such as wounding, they are also transiently produced in early stages of plant development (Cheong et al., 2002). Strain C treatments elicited a variety of alterations in alkaloid biosynthetic pathways under drought conditions. For instance, 2-piperidinecarboxylic acid (pipecolic acid), which accumulates in plants in response to pathogen attack and has been shown to accumulate in halotolerant species (Navarova et al., 2012, Moulin et al., 2006). Pipecolic acid, a non-protein amino acid and degradation product of the amino acid lysine, is an intermediary of tropane alkaloid biosynthesis. A relative increase in pipecolic acid was observed in root tissues of Strain C-treated plants. Strain C also appears to have a positive effect on the transportation of tryptophan, an important alkaloid precursor, as evidenced by its accumulation in stem tissues of plants. In addition to these, the following compounds involved in alkaloid biosynthetic pathways were altered in Strain C-treated plants grown under water-limited conditions: phenylalanine (decreased production in leaf), tyrosine (decreased production in leaf and root), tryptamine (decreased production in leaf), benzoic acid (decreased production in root and leaf), nicotinic acid (decreased production in root and leaf). Thus, plants treated with compositions such as Strain C may have an improved ability to cope with the stresses associated with water-limited conditions, via modulation of production of alkaloids.

Flavonoid and isoflavonoids compounds are exuded by plant roots into the rhizosphere in response to nutrient stress in order to recruit compatible nitrogen-fixing bacteria. These signals are perceived by N-fixing *rhizobia*, which then begin production of nodulation factors that stimulate the development of nodules in the roots of the host plant (Gibson et al., 2008). Indeed, one study showed that *Rhizobium leguminosarum* cells pretreated with plant-produced hesperetin stimulate increased nodulation in the host compared to bacteria that are not pretreated (Begum et al., 2001). Hesperetin levels showed a relative increase in stem tissue of drought plants treated with Strain C and a decrease in leaf tissue. In addition to playing a role in symbiosis development, these compounds may also function in pathogen response. Daidzein, which was decreased in roots and leaves of Strain C-treated plants, accumulates in soybean plants in response to invasion by pathogenic *Pseudomonas* (Osman and Fett, 1982). In altering the accumulation of two distinct (iso)-flavonoid compounds Strain C may be influencing both stress response and the recruitment and colonization of beneficial N-fixing symbionts. In addition to hesperetin and diadzein, the following compounds were evaluated in Strain C-treated plants grown under water-limited conditions: quinic acid (decreased production in root and leaf tissues) and shikimic acid (decreased in leaf tissues). Thus, plants treated with compositions such as Strain C may have an improved ability to cope with the stresses associated with water-limited conditions, via modulation of production of flavonoids and/or isoflavonoids.

A variety of other compounds, such as those involved in lipid and/or fatty alcohol metabolism, appear to be modulated by Strain C treatments. The following compounds were evaluated in Strain C-treated plants grown under water-limited conditions: ethanoliamine (increased in stem tissues and decreased in leaf tissues), ethanolaminephosphate (decreased in leaf tissues), sphingosine (decreased in both stem and leaf tissues), glycerol (increased in stem tissues), hexadecanoic acid (increased in both root and stem tissues), octadecadienoic acid (decreased in leaf tissues), octadecanoic acid (increased in both root and stem tissues and decreased in leaves), dodecanol (decreased in both root and leaf tissues), and campesterol (decreased in leaf tissues). Thus, plants treated with compositions such as Strain C may have an improved ability to cope with the stresses associated with water-limited conditions, via modulation of production of compounds involved in lipid and/or fatty alcohol metabolism.

In addition to the specific compounds and pathways above, SYM treatments cause significant modulation in the levels of free amino acids and nitrogenous compounds. Allantoin, a product of urea metabolism, can constitute a large percentage of the soluble nitrogen in plant sap and may be integral in nitrogen transport in nodulated soybean plants (Reinbothe and Mothes, 1962; McClure and Israel, 1979). Interestingly, Strain C-treatment modulates allantoin accumulation in various tissues. Strain C appears to cause a general depression in free-amino acids in leaf and root tissues under drought stress, with decreases in both leaf and root tissues observed for the following compounds: alanine, allantoin, glutamic acid, glutamine, histidine, leucine, methionine, proline, threonine, tryptophan, tyrosine, and valine. Additionally, decreases in root tissue alone were seen for: asparagine and aspartic acid. Decreases in leaf tissue alone were seen for: beta-alanine, isoleucine, phenylalanine, and serine. For stem tissues, any modulation of concentration was always an increase, and seen for the following compounds: glutamine, histidine, leucine, tryptophan, and valine. Thus, plants treated with compositions such as Strain C may have an improved ability to cope with the stresses associated with water-limited conditions, via modulation of production of free amino acids and/or nitrogen metabolism.

The metabolism of carbohydrates and lipids also shift under Strain C treatment. Carbohydrates and lipids are utilized in a wide range of functions, whether for energy storage, as signaling molecules, or the composition of structural material. Treatment by Strain C modulates the levels of a variety of compounds, including increases in stem tissues and decreases in root tissues seen for D-glucopyranose, and decreases in leaf tissues for each of the following: galactose, lyxose, threose, and trehalose. Thus, plants treated with compositions such as Strain C may have an improved ability to cope with the stresses associated with water-limited conditions, via modulation of production of carbohydrates.

Finally, other compounds were found to have modulated levels of production in Strain C-treated plants grown under water-limited conditions. For example, leaf tissue of plants treated with Strain C accumulates higher levels of lumichrome than control plants under water-limiting conditions. Lumichrome has the ability to affect plant root respiration, transpiration rates, as well as stomatal conductance in a variety agrinomically relevant plants (Phillips et al., 1999; Matiru and Dakora, 2005). In addition to production by members of the Rhizobia, it has been shown that soil microbes such as *Pseudomonas* can degrade riboflavin to lumichrome in rhizosphere systems (Yanagita and Foster, 1956). Further, lumichrome can promote plant growth, perhaps through its ability to stimulate increases in photosynthetic rates (Matiru and Dakora, 2005; Khan et al., 2008). Other compounds whose levels are altered as a result of treatment with Strain C included: salicylic acid (decreased in root and leaf tissues, increased in stem tissues), pyrogallol (decreased in root tissues), vanillic acid (increased in stem tissues and decreased in leaf tissues), gallic acid (decreased in leaf tissues), beta-tocopherol (decreased in root tissues), and galacturonic acid (decreased in root tissues). Thus, plants treated with compositions such as Strain C may have an improved ability to cope with the stresses associated with water-limited conditions, via modulation of production of any of the preceeding compounds.

Example 11: Microbial Community Sequencing of Plants

Methods

Cultivation-independent analysis of microbial taxa based on marker gene high-throughput sequencing was performed as follows.

Leaf and root tissue was obtained from soybean plants grown from seeds treated with active and mock microbial compositions grown under water-stressed conditions (seed treatment and growth conditions described above). Whole leaves and roots were collected from 4 biological replicates per treatment. For each treatment and tissue, the biological replicates were processed independently. The roots were cleaned in successive water baths, with manual disaggregation and removal of larger pieces of material. Tissues were flash frozen in liquid nitrogen, then ground using a mortar and pestle treated with 95% ethanol and RNAse Away (Life Technologies, Inc., Grand Island, N.Y.) to remove contaminant RNA and DNA. DNA was extracted from the ground tissues using the DNeasy DNA extraction kit (Qiagen, Hilden, Germany) according to the manufacturer's instructions.

Marker genes were amplified and sequenced from the extracted DNA. For the bacterial and archaeal analyses, the V4 hypervariable region of the 16S rRNA gene was targeted (primers 515f, 806r), and for fungi, the second internal transcribed spacer (ITS2) region of the rRNA operon (primers fITS7, ITS4) was targeted. The two marker genes were PCR amplified separately using 35 cycles, and staggered 9-bp barcoded primers specific to each sample were used to facilitate combining of samples. To reduce the amplification of chloroplast and mitochondrial DNA, PNA clamps specific to the rRNA genes in these organelles were used. PCR reactions to amplify 16S rRNA and ITS regions followed the protocol of Kozich et al. (2013) (Kozich, Westcott, Baxter, Highlander, & Schloss, 2013). PCR products were cleaned with Agencourt AMPure XP beads at a 0.7:1 bead-to-library ratio (Beckman Coulter), quantified using the PicoGreen assay (Life Technologies, Inc., Grand Island, N.Y.) and pooled in equimolar concentrations. The final library was quantified by qPCR using the KAPA Library quantification kit (KAPA Biosystems) and diluted to 4 nM. In preparation for cluster generation and sequencing, pooled libraries were denatured with NaOH, diluted with hybridization buffer, and then heat denatured before MiSeq sequencing (Illumina). Each run included a minimum of 2.5% PhiX to serve as an internal control.

OTU Assignment

For both 16S rRNA and ITS2 sequences, the raw sequence data were reassigned to distinct samples based on barcode sequences introduced during library prep, and quality filtering and OTU (i.e. operational taxonomic unit) clustering was conducted using the UPARSE pipeline (Edgar 2013). Each endophyte was assigned to an Operational Taxonomic Unit (OTU). OTU clustering (Rideout et al, 2014) was performed using a cascading approach, comparing the sequences against the Greengenes (McDonald et al., 2012) and SILVA (Quast et al., 2013) and UNITE (Abarenkov et al., 2010) reference databases, which are provided with full-length clustering at various widths. Bacterial sequences were compared to the combined Greengenes 99% OTU representative sequences and SILVA non-redundant sequences. Sequences without a 99% match to the combined reference 99% OTUs but having a 97% match were assigned to 97% OTUs with the best match representative sequence from the 99% reference sequences. Fungal sequences were compared to the UNITE Dynamic OTU representative sequences, where dynamic represents values between 97% and 99% depending on the OTU. Sequences that did not match the UNITE Dynamic OTUs at the appropriate clustering level, but did have a 97% match were assigned to 97% OTUs with best match representative sequence from the Dynamic OTUs. The remaining sequences that did not match any of the three reference databases, Greengenes. SILVA, or UNITE, but were present at a level of at least 10 reads across the samples, were de novo clustered using UPARSE (independently for the bacterial and fungal sequences). Sequences that did not match a reference sequence were mapped to the de novo OTUs at 97%. Remaining sequences that did not match either a reference or de novo OTU were removed from this analysis.

Identification of Differences Between Treatments

Only samples having at least 1000 reads after quality filtering were retained, and only OTUs with a mean relative abundance of 0.1% within a tissue/treatment were included in this analysis. Community differences at the genus and family level were computed by summing the relative abundance of OTUs by their taxonomic assignments at the genus and family levels across all biological replicates of the tissue/treatment using the phyloseq package in R (McMurdie and Holmes (2013)) (Figures CSGen1-4 and Figures CSFam1-4). For each tissue, we identified OTUs found in all biological replicates of beneficial microbial treatment and not in microbial treatments with negative or neutral affects or in untreated controls (Tables CSUOTU1-3). OTUs with significant differences in abundance between treatments/tissues were identified using the R package DESeq2 (Love et al. 2014). Raw read counts per OTU for biological replicates of different microbial treatments and untreated controls were used as inputs to DESeq2, the log 2 fold change and adjusted p-value of each contrast are included in Tables CSDE1-2 as are the average, normalized abundance of each OTU (as counts per million) in each treatment.

Results

All results are summarized in FIGS. 7-10, Table 12, and Table 13.

In all treatments, Enterobacteriaceae was the most abundant family of bacteria in soybean leaves and *Escherichia-Shigella* the most abundant bacterial genera. Seeds treated with *Streptomyces* sp. reduced the average abundance of members of the Enterobacteriaceae family and the *Escherichia-Shigella* genera. The biggest decreases were seen in plants treated with Strain C whose mean abundance decreased 37% relative to untreated controls.

Treatment with Strain C increased the abundance of the arbuscular mycorrhizal (AM) fungi in roots of treated plants. Fungal communities of Strain C treated soybean roots are enriched in Glomeraceae, showing an increase in average abundance of 140% relative to untreated controls and 92% relative to Strain B. Glomeraceae contains several genera of AM fungi including *Rhizophagus* and *Glomus*. The *Glomus* genus of arbuscular mycorrhizal are more abundant in Strain C treated samples relative to controls, and the *Glomus* OTU F1.0|SYM97_ITS2|1707 and F1.0|SYM97_ITS2|1548 are found in all replicates of the Strain C treatment and not in Strain B or untreated samples. Additionally, the *Glomus* OTU F1.0|SYM97_ITS2||1594 is significantly differentially abundant in Strain C treated samples relative to untreated samples.

The communities of both Strain C treated samples are enriched in OTU belonging to the genus *Rhizophagus*, compared to co-generic treatments or untreated controls. Fungal communities of Strain C treated soybean roots are enriched in *Rhizophagus*, showing an increase in average abundance of 88% relative to untreated controls and 106% relative to Strain B. The *Rhizophagus* OTUs F1.0|SYM97_ITS2|1548 and F1.0|SYM97_ITS2|1707 are found in all biological replicates of Strain C treated soybean roots but not in Strain B or untreated controls.

Example 12: Field Trials

Seeds from soybean were treated with Strain C as well as the formulation control as described in Example 4. Seeds were sown in at least two different growing regions for efficacy testing. Trials consisted of ten replicate plots for each treatment and control respectively arranged in a spatially balanced randomized complete block design (Van Es et al. 2007). The plot area was well-maintained and kept weed-, insect- and disease-free In addition to measuring total yield, metrics such as seedling emergence, normalized difference vegetation index (NDVI) and time to flowering were assessed. Trials were conducted during non-irrigated conditions.

All results are shown in Table 14.

Soybean trials under were conducted at three different locations using two soybean varieties in the Midwest region of the United States during 2015. Field conditions during the trial were particularly wet: field conditions did not constitute drought or water-limited conditions even though they were non-irrigated. No negative impacts on any measured variable was seen for plants grown from seeds treated with Strain C as compared to plants grown from seeds treated with the formulation control only. Parity was achieved for yield (bushels per acre), percent moisture (% per plot), and seed weight (pounds per bushel).

Maize trials were conducted at three different locations using four soybean varieties in the Midwest region of the United States during 2015. Field conditions during the trial were particularly wet: field conditions did not constitute drought or water-limited conditions even though they were non-irrigated. No negative impacts on any measured variable was seen for plants grown from seeds treated with Strain C as compared to plants grown from seeds treated with the formulation control only. Parity was achieved for yield (bushels per acre), percent moisture (% per plot), and seed weight (pounds per bushel). Two varieties of maize demonstrated improvements in yield for plants grown from seeds treated with Strain C as compared to plants grown from seeds treated with the formulation control only.

Example 13: Gene Enrichment Analysis

Gene set enrichment analysis (GSEA) was used to identify molecular functions, biological processes and cellular components that are enriched in the set of genes which are differentially expressed between water stressed soybean plants treated with beneficial *Streptomyces* and untreated water stressed soybean plants. Soybean genes whose expression had absolute value of log 2 fold change differences greater than two between plants treatment with a beneficial *Streptomyces* and untreated plants, the "query", were submitted to GSEA tool AgriGO (http://bioinfo.cau.edu.cn/agriGO/). Singular enrichment analysis was run using Fishers exact test and multi-test adjustment using the method of Benjamini & Yekutieli (Benjamini, Y. & Yekutieli, D. (2001) The Annals of Statistics, 29(4): 1165-1188).

Results are given in Table 15.

Having illustrated and described the principles of the present invention, it should be apparent to persons skilled in the art that the invention can be modified in arrangement and detail without departing from such principles. We claim all modifications that are within the spirit and scope of the appended claims. All publications and published patent documents cited in this specification are incorporated herein by reference to the same extent as if each individual publication or patent application is specifically and individually indicated to be incorporated herein by reference. It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

TABLE 1

Selected sequences of the present invention

| SEQ ID NO | Kingdom | Phylum | Class | Order | Family | Genus | Species | Sequence |
|---|---|---|---|---|---|---|---|---|
| 1 | Bacteria | Actinobacteria | Actinobacteria | Streptomycetales | Streptomycetaceae | *Streptomyces* | murinus | GCCCTTCGGGGTGGATTAGTGGCGAACGGG TGAGTAACACGTGGGCAATCTGCCCTGCAC TCTGGGACAAGCCCTGGAAACGGGGTCTAA TACCGGATATGACCATCTTGGGCATCCTTG ATGGTGTAAAGCTCCGGCGGTGCAGGATGA GCCCGCGGCCTATCAGCTTGTTGGTGAGGT AATGGCTCACCAAGGCGACGACGGGTAGCC GGCCTGAGAGGGCGACCGGCCACACTGGGA CTGAGACACGGCCCAGACTCCTACGGGAGG CAGCAGTGGGGAATATTGCACAATGGGCGA AAGCCTGATGCAGCGACGCCGCGTGAGGGA TGACGGCCTTCGGGTTGTAAACCTCTTTCA GCAGGGAAGAAGCGAAAGTGACGGTACCTG CAGAAGAAGCGCCGGCTAACTACGTGCCAG CAGCCGCGGTAATACGTAGGGCGCAAGCGT TGTCCGGAATTATTGGGCGTAAAGAGCTCG TAGGCGGCTTGTCACGTCGATTGTGAAAGC TCGGGGCTTAACCCCGAGTCTGCAGTCGAT ACGGGCTAGCTAGAGTGTGGTAGGGGAGAT CGGAATTCCTGGTGTAGCGGTGAAATGCGC AGATATCA |
| 2 | Bacteria | Actinobacteria | Actinobacteria | Streptomycetales | Streptomycetaceae | *Streptomyces* | incertae sedis | GCCCTTCGGGGTGGATTAGTGGCGAACGGG TGAGTAACACGTGGGCAATCTGCCCTTCAC TCTGGGACAAGCCCTGGAAACGGGGTCTAA TACCGGATAACACTCTGTCCCGCATGGGAC GGGGTTAAAAGCTCCGGCGGTGAAGGATGA GCCCGCGGCCTATCAGCTTGTTGGTGGGGT GATGGCCTACCAAGGCGACGACGGGTAGCC GGCCTGAGAGGGCGACCGGCCACACTGGGA CTGAGACACGGCCCAGACTCCTACGGGAGG CAGCAGTGGGGAATATTGCACAATGGGCGA AAGCCTGATGCAGCGACGCCGCGTGAGGGA TGACGGCCTTCGGGTTGTAAACCTCTTTCA GCAGGGAAGAAGCGAAAGTGACGGTACCTG CAGAAGAAGCGCCGGCTAACTACGTGCCAG CAGCCGCGGTAATACGTAGGGCGCAAGCGT TGTCCGGAATTATTGGGCGTAAAGAGCTCG TAGGCGGCTTGTCACGTCGGATGTGAAAGC CCGGGGCTTAACCCCGGGTCTGCATTCGAT ACGGGCTAGCTAGAGTGTGGTAGGGGAGAT CGGA |
| 3 | Bacteria | Actinobacteria | Actinobacteria | Streptomycetales | Streptomycetaceae | *Streptomyces* | SMCD2215 | TGATATCTGCGCATTTCACCGCTACACCAG GAATTCCGATCTCCCCTACCACACTCTAGC CTGCCCGTATCGACTGCAGACCCGAGGTTA AGCCTCGGGCTTTCACAATCGACGTGACAA GCCGCCTACGAGCTCTTTACGCCCAATAAT |

TABLE 1-continued

Selected sequences of the present invention

| SEQ ID NO | Kingdom | Phylum | Class | Order | Family | Genus | Species | Sequence |
|---|---|---|---|---|---|---|---|---|
| | | | | | | | | TCCGGACAACGCTTGCGCCCTACGTATTAC CGCGGCTGCTGGCACGTAGTTAGCCGGCGC TTCTTCTGCAGGTACCGTCACTTGCGCTTC TTCCCTGCTGAAAGAGGTTTACAACCCGAA GGCCGTCATCCCTCACGCGGCGTCGCTGCA TCAGGCTTGCGCCCATTGTGCAATATTCCC CACTGCTGCCTCCCGTAGGAGTCTGGGCCG TGTCTCAGTCCCAGTGTGGCCGGTCGCCCT CTCAGGCCGGCTACCCGTCGTCGCCTTGGT GAGCCATTACCTCACCAACAAGCTGATAGG CCGCGGGCTCATCCTTCACCGCCGGAGCTT TCCACGCACATCGGATGCCCGAGCGCGTCG TATCCGGTATTAGACCCCGTTTCCAGGGCT TGTCCCAGAGTGAAGGGCAGATTGCCCACG TGTTACTCACCCGTTCGCCACTAATCCACC CCGAAGGGCTTCATCGTTCGAC |
| 4 | Bacteria | Actinobacteria | Actinobacteria | Streptomycetales | Streptomycetaceae | *Streptomyces* | SMCD2215 | GGGTTGGGCCACCGGCTTCGGGTGTTACCG ACTTTCGTGACGTGACGGGCGGTGTGTACA AGGCCCGGGAACGTATTCACCGCAGCACTG CTGATCTGCGATTACTAGCGACTCCGACTT CATGGGGTCGAGTTGCAGACCCCAATCCGA ACTGAGACCGGCTTTTTGAGATTCGCTCCA CCTCACGGTATCGCAGCTCATTGTACCGGC CATTGTAGCACGTGTGCAGCCCAAGACATA AGGGGCATGATGACTTGACGTCGTCCCCAC CTTCCTCCGAGTTGACCCCGGCGGTCTCCT GTGAGTCCCCATCACCCCGAAGGGCATGCT GGCAACACAGAACAAGGGTTGCGCTCGTTG CGGGACTTAACCCAACATCTCACGACACGA GCTGACGACAGCCATGCACCACCTGTACAC CGACCACAAGGGGGCACCCATCTCTGGATG TTTCCGGTGTATGTCAAGCCTTGGTAAGGT TCTTCGCGTTGCGTCGAATTAAGCCACATG CTCCGCCGCTTGTGCGGGCCCCCGTCAATT CCTTTGAGTTTTAGCCTTGCGGCCGTACTC CCCAGGCGGGGAACTTAATGCGTTAGCTGC GGCACCGACGACGTGGAATGTCGCCAACAC CTAGTTCCCACCGTTTACGGCGTGGACTAC CAGGGTATCTAATCCTGTTCGCTCCCCACG CTTTCGCTCCTCAGCGTCAGTAATGGCCCA GAGATCCGCCTTCGCCACCGGTGTTCCTCC TGATATCTGCGCATTTCACCGCTACACCAG GAATTCCGATCTCCCCTACCACACTCTAGC CTGCCCGTATCGACTGCAGACCCGAGGTTA AGCCTCGGGCTTTCACAATCGACGTGACAA GCCGCCTACGAGCTCTTTACGCCCAATAAT TCCGGACAACGCTTGCGCCCTACGTATTAC CGCGGCTGCTGGCACGTAGTTAGCCGGCGC TTCTTCTGCAGGTACCGTCACTTGCGCTTC TTCCCTGCTGAAAGAGGTTTACAACCCGAA GGCCGTCATCCCTCACGCGGCGTCGCTGCA TCAGGCTTGCGCCCATTGTGCAATATTCCC CACTGCTGCCTCCCGTAGGAGTCTGGGCCG TGTTCAGTCCCAGTGTGGCCGGTCGCCCTC TCAGGCCGGCTACCCGTCGTCGCCTTGGTG AGCCATTACCTCACCAACAAGCTGATAGGC CGCGGGCTCATCCTTCACCGCCGGAGCTTT CCACGCACATCGGATGCCCGAGCGCGTCGT ATCCGGTATTAGACCCCGTTTCCAGGGCTT GTCCCAGAGTGAAGGGCAGATTGCCCACGT GTTACTCACCCGTTCGCCACTAATCCACCC CGAAGGGCTTCATCGTTCGACTGCA |
| 5 | Bacteria | Actinobacteria | Actinobacteria | Streptomycetales | Streptomycetaceae | *Streptomyces* | incertae sedis | CGCTGGACCAACTCCTTCGGGAGGCAGCAG TGGGGAATATTGCACAATGGGCGCAAGCCT GATGCAGCGACGCCGCGTGAGGGATGACGG CCTTCGGGTTGTAAACCTCTTTCAGCAGGG AAGAAGCGCAAGTGACGGTACCTGCAGAAG AAGCGCCGGCTAACTACGTGCCAGCAGCCG CGGTAATACGTAGGGCGCAAGCGTTGTCCG GAATTATTGGGCGTAAAGAGCTCGTAGGCG GCTTGTCACGTCGATTGTGAAAGCCCGAGG CTTAACCTCGGGTCTGCAGTCGATACGGGC |

TABLE 1-continued

Selected sequences of the present invention

| SEQ ID NO | Kingdom | Phylum | Class | Order | Family | Genus | Species | Sequence |
|---|---|---|---|---|---|---|---|---|
| | | | | | | | | AGGCTAGAGTGTGGTAGGGGAGATCGGAAT TCCTGGTGTAGCGGTGAAATGCGCAGATAT CAGGAGGAACACCGGTGGCGAAGGCGGATC TCTGGGCCATTACTGACGCTGAGGAGCGAA AGCGTGGGGAGCGAACAGGATTAGATACCC TGGTAGTCCACGCCGTAAACGGTGGGAACT AGGTGTTGGCGACATTCCACGTCGTCGGTG CCGCAGCTAACGCATTAAGTTCCCCGCCTG GGGAGTACGGCCGCAAGGCTAAAACTCAAA GGAATTGACGGGGGCCCGCACAAGCGGCGG AGCATGTGGCTTAATTCGACGCAACGCGAA GAACCTTACCAAGGCTTGACATACACCGGA AACATCCAGAGATGGGTGCCCCCTTGTGGT CGGCGTACAGGTCGTGCATGGCTGTCGTCA GCTCGTGTCGTGAGATGTTGGGTAAGTCCC GCAACGAGCGCAACCTTGTTCTGGTGCTGC CAGCATGCCCTTCGGGTGATGGGACTTCAC CACGGAGACCGCGGCTCCACTCCGACGAGG TGGGGACGACGTCAGTCATCATGCCCTAA TGTCTGGCTG |
| 6 | Bacteria | Actino-bacteria | Actino-bacteria | Strepto-mycetales | Strepto-mycetaceae | Strepto-myces | ginseng-isoli | CCGGGGGCACTCCACTGCGTATGTGTGACG AGTAGACCGCTGCGCTTAGCTGAGGTCTGA TGAAATGTAGAACACTTAACAAAAATATGC CCGGATGGATATACTTTTCAACGACAGGGC TGCGATTGGATGATCTCCTTTGAAACACAG AACTAGTCACGGCGACGAATACTCAACTTC GACCCCCCCCCTTTCTGGAGGCGCGTCTTA GTCCCTCCTTGATGGAGCTGCCCCGTGCT CGGCGGCCGGAGTCGGCGGTGTTTTCCGCT GTACCTGAGACGCTGGACCAACTCCTTCGG GAGGCAGCAGTGGGGAATATTGCACAATGG GCGCAAGCCTGATGCAGCGACGCCGCGTGA GGGATGACGGCCTTCGGGTTGTAAACCTCT TTCAGCAGGGAAGAAGCGCAAGTGACGGTA CCTGCAGAAGAAGCGCCGGCTAACTACGTG CCAGCAGCCGCGGTAATACGTAGGGCGCAA GCGTTGTCCGGAATTATTGGGCGTAAAGAG CTCGTAGGCGGCTTGTCACGTCGATTGTGA AAGCCCGAGGCTTAACCTCGGGTCTGCAGT CGATACGGGCAGGCTAGAGTGTGGTAGGGG AGATCGGAATTCCTGGTGTAGCGGTGAAAT GCGCAGATATCAGGAGGAACACCGGTGGCG AAGGCGGATCTCTGGGCCATTACTGACGCT GAGGAGCGAAAGCGTGGGGAGCGAACAGGA TTAGATACCCTGGTAGTCCACGCCGTAAAC GGTGGGAACTAGGTGTTGGCGACATTCCAC GTCGTCGGTGCCGCAGCTAACGCATTAAGT TCCCCGCCTGGGGAGTACGGCCGCAAGGCT AAAACTCAAAGGAATTGACGGGGGCCCGCA CAAGCGGCGGAGCATGTGGCTTAATTCGAC GCAACGCGAAGAACCTTACCAAGGCTTGAC ATACACCGGAAACATCCAGAGATGGGTGCC CCCTTGTGGTCGGCGTACAGGTCGTGCATG GCTGTCGTCAGCTCGTGTCGTGAGATGTTG GGTAAGTCCCGCAACGAGCGCAACCTTGTT CTGGTGCTGCCAGCATGCCCTTCGGGTGAT GGGACTTCACCACGGAGACCGCGGCTCCAC TCCGACGAGGTGGGGACGACGTCAGTCAT CATGCCCTAATGTCTGGCTG |
| 7 | Bacteria | Actino-bacteria | Actino-bacteria | Strepto-mycetales | Strepto-mycetaceae | Strepto-myces | SMCD2215 | Ccagactcctacgggaggcagcagtgggga atattgcacaatgggcgcaagcctgatgca gcgacgccgcgtgagggatgacggccttcg ggttgtaaacctctttcagcagggaagaag cgcaagtgacggtacctgcagaagaagcgc cggctaactacgtgccagcagccgcggtaa tacgtagggcgcaagcgttgtccggaatta ttgggcgtaaagagctcgtaggcggcttgt cacgtcgattgtgaaagcccgaggcttaac ctcgggtctgcagtcgatacgggcaggcta gagtgtggtaggggagatcggaattcctgg tgtagcggtgaaatgcgcagatatcaggag gaacaccggtggcgaaggcggatctctggg |

TABLE 1-continued

Selected sequences of the present invention

| SEQ ID NO | Kingdom | Phylum | Class | Order | Family | Genus | Species | Sequence |
|---|---|---|---|---|---|---|---|---|
| | | | | | | | | ccattactgacgctgaggagcgaaagcgtg gggagcgaacaggattagataccctggtag tccacgccgtaaacggtgggaactaggtgt tggcgacattccacgtcgtcggtgccgcag ctaacgcattaagttccccgcctggggagt acggccgcaaggctaaaactcaaaggaatt gacggggccccgcacaagcggcggagcatg tggcttaattcgacgcaacgcgaagaacct taccaaggcttgacatacaccggaaacatc cagagatgggtgccccttgtggtcggtgt acaggtggtgcatggctgtcgtcagctcgt gtcgtgagatgttgggttaagtcccgcaac gagcgcaaccccttgttctgtgttgccagca tgcccttcggggtgatggggactcacagga gaccgccggggtcaactcggaggaaggtgg ggacgacgtcaagtcatcatgcccttatg tct |
| 8 | Bacteria | Actinobacteria | Actinobacteria | Streptomycetales | Streptomycetaceae | *Streptomyces* | SMCD2215 | CGCTGGACCAACTCCTTCGGGAGGCAGCAG TGGGGAATATTGCACAATGGGCGCAAGCCT GATGCAGCGACGCCGCGTGAGGGATGACGG CCTTCGGGTTGTAAACCTCTTTCAGCAGGG AAGAAGCGCAAGTGACGGTACCTGCAGAAG AAGCGCCGGCTAACTACGTGCCAGCAGCCG CGGTAATACGTAGGGCGCAAGCGTTGTCCG GAATTATTGGGCGTAAAGAGCTCGTAGGCG GCTTGTCACGTCGATTGTGAAAGCCCGAGG CTTAACCTCGGGTCTGCAGTCGATACGGGC AGGCTAGAGTGTGGTAGGGGAGATCGGAAT TCCTGGTGTAGCGGTGAAATGCGCAGATAT CAGGAGGAACACCGGTGGCGAAGGCGGATC TCTGGGCCATTACTGACGCTGAGGAGCGAA AGCGTGGGGAGCGAACAGGATTAGATACCC TGGTAGTCCACGCCGTAAACGGTGGGAACT AGGTGTTGGCGACATTCCACGTCGTCGGTG CCGCAGCTAACGCATTAAGTTCCCCGCCTG GGGAGTACGGCCGCAAGGCTAAAACTCAAA GGAATTGACGGGGCCCGCACAAGCGGCGG AGCATGTGGCTTAATTCGACGCAACGCGAA GAACCTTACCAAGGCTTGACATACACCGGA AACATCCAGAGATGGGTGCCCCTTGTGGT CGGCGTACAGGTCGTGCATGGCTGTCGTCA GCTCGTGTCGTGAGATGTTGGGTAAGTCCC GCAACGAGCGCAACCTTGTTCTGGTGCTGC CAGCATGCCCTTCGGGTGATGGGACTTCAC CACGGAGACCGCGGCTCCACTCCGACGAGG TGGGGGACGACGTCAGTCATCATGCCCTAA TGTCTGGCTG |
| 9 | Bacteria | Actinobacteria | Actinobacteria | Streptomycetales | Streptomycetaceae | *Streptomyces* | griseus | CACATGCAGTCGAACGATGAAGCCTTTCGG GGTGGATTAGTGGCGAACGGGTGAGTAACA CGTGGGCAATCTGCCCTTCACTCTGGGACA AGCCCTGGAAACGGGGTCTAATACCGGATA ATACTTCTGCCTGCATGGGTGGGGGTTGAA AGCTCCGGCGGTGAAGGATGAGCCCGCGGC CTATCAGCTTGTTGGTGGGGTAATGGCCTA CCAAGGCGACGACGGGTAGCCGGCCTGAGA GGGCGACCGGCCACACTGGGACTGAGACAC GGCCCAGACTCCTACGGGAGGCAGCAGTGG GGAATATTGCACAATGGGCGAAAGCCTGAT GCAGCGACGCCGCGTGAGGGATGACGGCCT TCGGGTTGTAAACCTCTTTCAGCAGGGAAG AAGCGCAAGTGACGGTACCTGCAGAAGAAG CGCCGGCTAACTACGTGCCAGCAGCCGCGG TAATACGTAGGGCGCAAGCGTTGTCCGAA TTATTGGGCGTAAAGAGCTCGTAGGCGGCT TGTCACGTCGGATGTGAAAGCCCGGGGCTT AACCCCGGGTCTGCATTCGATACGGGCTAG CTAGAGTGTGGTAGGGGAGATCGGAATTCC TGGTGTAGCGGTGAAATGCGCAGATATCAG GAGGAACACCGGTGGCGAAGGCGGATCTCT GGGCCATTACTGACGCTGAGGAGCGAAAGC GTGGGGAGCGAACAGGATTAGATACCCTGG TAGTCCACGCCGTAAACGTTGGGAACTAGG |

TABLE 1-continued

Selected sequences of the present invention

| SEQ ID NO | Kingdom | Phylum | Class | Order | Family | Genus | Species | Sequence |
|---|---|---|---|---|---|---|---|---|
| | | | | | | | | TGTTGGCGACATTCCACGTCGTCGGTGCCG CAGCTAACGCATTAAGTTCCCCGCCTGGGG AGTACGGCCGCAAGGCTAAAACTCAAAGGA ATTGACGGGGGCCCGCACAAGCAGCGGAGC ATGTGGCTTAAATTCGACGCAACGCGAAGA ACCTTACCAAGGCTTGACATATACCGGAAA GCATCAGAGATGGTGCCCCCCTTGTGGTCG GTATACAGGTGGTGCATGGCTGTCGTCAGC TCGTGTCGTGAGATGTTGGGTTAAGTCCCG CAACGAGCGCAACCCTTGTTCTGTGTTGCC AGCATGCCTTTCGGGGTGATGGGGACTCAC AGGAGACTGCCGGGGTCAACTCGGAGGAAG GTGGGGACGACGTCAAGTCATCATGCCCCT TATGTCTTGGGCTGCACACGTGCTACAATG GCCGGTACAATGAGCTGCGATGCCGTGAGG CGGAGCGAATCTCAAAAAGCCGGTCTCAGT TCGGATTGGGGTCTGCAACTCGACCCCATG AAGTCGGAGTTGCTAGTAATCGCAGATCAG CATTGCTGCGGTGAATACGTTCCCGGGCCT TGTACACACCGCCCGTCACGTCACGAAAGT CGGTAACACCCGAAGCCGGTGGCCCAACCC CT |
| 10 | Bacteria | Actinobacteria | Actinobacteria | Streptomycetales | Streptomycetaceae | *Streptomyces* | ginsengisoli | CCGGGGGCACTCCACTGCGTATGTGTGACG AGTAGACCGCTGCGCTTAGCTGAGGTCTGA TGAAATGTAGAACACTTAACAAAAATATGC CCGGATGGATATACTTTTCAACGACAGGGC TGCGATTGGATGATCTCCTTTGAAACACAG AACTAGTCACGGCGACGAATACTCAACTTC GACCCCCCCCTTTCTGGAGGCGCGTCTTA GTCCCCTCCTTGATGGAGCTGCCCCGTGCT CGGCGGCCGGAGTCGGCGGTGTTTTCCGCT GTACCTGAGACGCTGGACCAACTCCTTCGG GAGGCAGCAGTGGGGAATATTGCACAATGG GCGCAAGCCTGATGCAGCGACGCCGCGTGA GGGATGACGGCCTTCGGGTTGTAAACCTCT TTCAGCAGGGAAGAAGCGCAAGTGACGGTA CCTGCAGAAGAAGCGCCGGCTAACTACGTG CCAGCAGCCGCGGTAATACGTAGGGCGCAA GCGTTGTCCGGAATTATTGGGCGTAAAGAG CTCGTAGGCGGCTTGTCACGTCGATTGTGA AAGCCCGAGGCTTAACCTCGGGTCTGCAGT CGATACGGGCAGGCTAGAGTGTGGTAGGGG AGATCGGAATTCCTGGTGTAGCGGTGAAAT GCGCAGATATCAGGAGGAACACCGGTGGCG AAGGCGGATCTCTGGGCCATTACTGACGCT GAGGAGCGAAAGCGTGGGGAGCGAACAGGA TTAGATACCCTGGTAGTCCACGCCGTAAAC GGTGGGAACTAGGTGTTGGCGACATTCCAC GTCGTCGGTGCCGCAGCTAACGCATTAAGT TCCCCGCCTGGGGAGTACGGCCGCAAGGCT AAAACTCAAAGGAATTGACGGGGGCCCGCA CAAGCGGCGGAGCATGTGGCTTAATTCGAC GCAACGCGAAGAACCTTACCAAGGCTTGAC ATACACCGGAAACATCCAGAGATGGGTGCC CCCTTGTGGTCGGCGTACAGGTCGTGCATG GCTGTCGTCAGCTCGTGTCGTGAGATGTTG GGTAAGTCCCGCAACGAGCGCAACCTTGTT CTGGTGCTGCCAGCATGCCCTTCGGGTGAT GGGACTTCACCACGGAGACCGCGGCTCCAC TCCGACGAGGTGGGGACGACGTCAGTCAT CATGCCCTAATGTCTGGCTG |
| 11 | Bacteria | Actinobacteria | Actinobacteria | Streptomycetales | Streptomycetaceae | *Streptomyces* | praecox | TACCATGCAGTCGAACGATGAAGCCCTTCG GGGTGGATTAGTGGCGAACGGGTGAGTAAC ACGTGGGCAATCTGCCCTTCACTCTGGGAC AAGCCCTGGAAACGGGGTCTAATACCGGAT AACACTCTGTCCCGCATGGGACGGGGTTAA AAGCTCCGGCGGTGAAGGATGAGCCGCGG CCTATCAGCTTGTTGGTGGGGTGATGGCCT ACCAAGGCGACGACGGGTAGCCGGCCTGAG AGGGCGACCGGCCACACTGGGACTGAGACA CGGCCCAGACTCCTACGGGAGGCAGCAGTG GGGAATATTGCACAATGGGCGAAAGCCTGA |

TABLE 1-continued

Selected sequences of the present invention

| SEQ ID NO | Kingdom | Phylum | Class | Order | Family | Genus | Species | Sequence |
|---|---|---|---|---|---|---|---|---|
| | | | | | | | | TGCAGCGACGCCGCGTGAGGGATGACGGCC TTCGGGTTGTAAACCTCTTTCAGCAGGGAA GAAGCGAAAGTGACGGTACCTGCAGAAGAA GCGCCGGCTAACTACGTGCCAGCAGCCGCG GTAATACGTAGGGCGCAAGCGTTGTCCGGA AATTATTGGGCGTAAAGAGCTCGTAGGCGG CTTGTCACGTCGGATGTGAAAGCCCGGGGC TTAACCCCGGGTCTGCATTCGATACGGGCT AGCTAGAGTGTGGTAGGGGAGATCGGAATT CCTGGTGTAGCGGTGAAATGCGCAGATATC AGGAGGAACACCGGTGGCGAAGGCGGATCT CTGGGCCATTACTGACGCTGAGGAGCGAAA GCGTGGGGAGCGAACAGGATTAGATACCCT GGTAGTCCACGCCGTAAACGTTGGGAACTA GGTGTTGGCGACATTCCACGTCGTCGGTGC CGCAGCTAACGCATTAAGTTCCCCGCCTGG GGAGTACGGCCGCAAGGCTAAAACTCAAAG GAATTGACGGGGCCCGCACAAGCAGCGGA GCATGTGGCTTAATTCGACGCAACGCGAAG AACCTTACCAAGGCTTGACATATACCGGAA AGCATCAGAGATGGTGCCCCCCTTGTGGTC GGTATACAGGTGGTGCATGGCTGTCGTCAG CTCGTGTCGTGAGATGTTGGGGTTAAGTCC CGCAACGAGCGCAACCCTTGTTCTGTGTTG CCAGCATGCCCTTCGGGGTGATGGGGACTC ACAGGAGACTGCCGGGGTCAACTCGGAGGA AGGTGGGGACGACGTCAAGTCATCATGCCC CTTATGTCTTGGGCTGCACACGTGCTACAA TGGCCGGTACAATGAGCTGCGATGCCGCGA GGCGGAGCGAATCTCAAAAAGCCGGTCTCA GTTCGGATTGGGGTCTGCAACTCGACCCCA TGAAGTCGGAGTTGCTAGTAATCGCAGATC AGCATTGCTGCGGTGAATACGTTCCCGGGC CTTGTACACACCGCCCGTCACGTCACGAAA GTCGGTAACACCCGAAGCCGGTGGCCCAAC CCCTTGTGGGAGGGAGCTGTCGA |
| 12 | Bacteria | Actinobacteria | Actinobacteria | Streptomycetales | Streptomycetaceae | *Streptomyces* | *neyagawaensis* | CATTCACGGAGAGTTTGATCCTGGCTCAGG ACGAACGCTGGCGGCGTGCTTAACACATGC AAGTCGAACGATGAAGCCCTTCGGGGTGGA TTAGTGGCGAACGGGTGAGTAACACGTGGG CAATCTGCCCTTCACTCTGGGACAAGCCCT GGAAACGGGGTCTAATACCGGATACGACGC GCTCGGGCATCCGATGTGCGTGGAAAGCTC CGGCGGTGAAGGATGAGCCCGCGGCCTATC AGCTTGTTGGTGAGGTAACGGCTCACCAAG GCGACGACGGGTAGCCGGCCTGAGAGGGCG ACCGGCCACACTGGGACTGAGACACGGCCC AGACTCCTACGGGAGGCAGCAGTGGGGAAT ATTGCACAATGGGCGAAAGCCTGATGCAGC GACGCCGCGTGAGGGATGACGGCCTTCGGG TTGTAAACCTCTTTCAGCAGGGAAGAAGCG AAAGTGACGGTACCTGCAGAAGAAGCGCCG GCTAACTACGTGCCAGCAGCCGCGGTAATA CGTAGGGCGCGAGCGTTGTCCGGAATTATT GGGCGTAAAGAGCTCGTAGGCGGTCTGTCG CGTCGGATGTGAAAGCCCGGGGCTTAACCC CGGGTCTGCATTCGATACGGGCAGACTAGA GTGTGGTAGGGGAGATCGGAATTCCTGGTG TAGCGGTGAAATGCGCAGATATCAGGAGGA ACACCGGTGGCGAAGGCGGATCTCTGGGCC ATTACTGACGCTGAGGAGCGAAAGCGTGGG GAGCGAACAGGATTAGATACCCTGGTAGTC CACGCCGTAAACGGTGGGAACTAGGTGTTG GCGACATTCCACGTCGTCGGTGCCGCAGCT AACGCATTAAGTTCCCCGCCTGGGGAGTAC GGCCGCAAGGCTAAAACTCAAAGGAATTGA CGGGGGCCCGCACAAGCAGCGGAGCATGTG GCTTAATTCGACGCAACGCGAAGAACCTTA CCAAGGCTTGACATACGCGGAAACACCCA GAGATGGGTGCCCCCTTGTGGTCGGTGTAC AGGTGGTGCATGGCTGTCGTCAGCTCGTGT CGTGAGATGTTGGGTTAAGTCCCGCAACGA GCGCAACCCTTGTTCTGTGTTGCCAGCATG |

TABLE 1-continued

Selected sequences of the present invention

| SEQ ID NO | Kingdom | Phylum | Class | Order | Family | Genus | Species | Sequence |
|---|---|---|---|---|---|---|---|---|
| | | | | | | | | CCCTTCGGGGTGATGGGGACTCACAGGAGA CTGCCGGGGTCAACTCGGAGGAAGGTGGGG ACGACGTCAAGTCATCATGCCCCTTATGTC TTGGGCTGCACACGTGCTACAATGGCAGGT ACAATGAGCTGCGAAGCCGTGAGGCGGAGC GAATCTCAAAAAGCCTGTCTCAGTTCGGAT TGGGGTCTGCAACTCGACCCCATGAAGTCG GAGTTGCTAGTAATCGCAGATCAGCAGTGC TGCGGTGAATACGTTCCCGGGCCTTGTACA CACCGCCCGTCACGTCACGAAAGTCGGTAA CACCCGAAGCCGGTGGCCCAACCCCTTGTG GGAGGGAGCTGTCGAAGGTGGGACTGGCGA TTGGGACGAAGTCGTAACAAGGTAGCCGTA CCGGAAGGTGCGGCTGGATCACCTCCTTTC TAAGGAGCACTTCTAGCCGGGCTTCGGCCT GGTTCAGAGGCCAGAACATCAGCGAATGTC TGATGCTGGTAGCTCATGGGTGGAACGTTG ATTATTCGGCACGGTCGGTATGGGTGAGAG CGCTAGTACTGCTTCGGCGTGGAACGCGAA GCTCATCAACTGACCGGGTCGGGCACGCTG TTGGGTGTCTGAGGGTGCGAGCGTTGCTCG CCCTTCACGATGCCGACCCCGGTGAAGATC CGCGTTGAGCGGGTTGTGACGGGTGGTTGG TCGTTGTTTGAGAACTGCACAGTGGACGCG AGCATCTGTGGCCAAGTTTTTAAGGGCGC |
| 13 | Bacteria | Actinobacteria | Actinobacteria | Streptomycetales | Streptomycetaceae | *Streptomyces* | *albidoflavus* | ACGAACGCTGGCGGCGTGCTTAACACATGC AAGTCGAACGATGAACCGCTTTCGGGCGGG GATTAGTGGCGAACGGGTGAGTAACACGTG GGCAATCTGCCCTGCACTCTGGGACAAGCC CTGGAAACGGGGTCTAATACCGGATATGAC TGTCCATCGCATGGTGGATGGTGTAAAGCT CCGGCGGTGCAGGATGAGCCCGCGGCCTAT CAGCTTGTTGGTGAGGTAGTGGCTCACCAA GGCGACGACGGGTAGCCGGCCTGAGAGGGC GACCGGCCACACTGGGACTGAGACACGGCC CAGACTCCTACGGGAGGCAGCAGTGGGGAA TATTGCACAATGGGCGAAAGCCTGATGCAG CGACGCCGCGTGAGGGATGACGGCCTTCGG GTTGTAAACCTCTTTCAGCAGGGAAGAAGC GAAAGTGACGGTACCTGCAGAAGAAGCGCC GGCTAACTACGTGCCAGCAGCCGCGGTAAT ACGTAGGGCGCAAGCGTTGTCCGGAATTAT TGGGCGTAAAGAGCTCGTAGGCGGCTTGTC ACGTCGGTTGTGAAAGCCCGGGGCTTAACC CCGGGTCTGCAGTCGATACGGGCAGGCTAG AGTTCGGTAGGGGAGATCGGAATTCCTGGT GTAGCGGTGAAATGCGCAGATATCAGGAGG AACACCGGTGGCGAAGGCGGATCTCTGGGC CGATACTGACGCTGAGGAGCGAAAGCGTGG GGAGCGAACAGGATTAGATACCCTGGTAGT CCACGCCGTAAACGGTGGGCACTAGGTGTG GGCAACATTCCACGTTGTCCGTGCCGCAGC TAACGCATTAAGTGCCCCGCCTGGGGAGTA CGGCCGCAAGGCTAAAACTCAAAGGAATTG ACGGGGGCCCGCACAAGCGGCGGAGCATGT GGCTTAATTCGACGCAACGCGAAGAACCTT ACCAAGGCTTGACATACACCGGAAACGTCT GGAGACAGGCGCCCCCTTGTGGTCGGTGTA CAGGTGGTGCATGGCTGTCGTCAGCTCGTG TCGTGAGATGTTGGGTTAAGTCCCGCAACG AGCGCAACCCTTGTCCCGTGTTGCCAGCAG GCCCTTGTGGTGCTGGGGACTCACGGGAGA CCGCCGGGGTCAACTCGGAGGAAGGTGGGG ACGACGTCAAGTCATCATGCCCCTTATGTC TTGGGCTGCACACGTGCTACAATGGCCGGT ACAATGAGCTGCGATACCGNGAGGTGGAGC GAATCTCAAAAAGCCGGTCTCAGTTCGGAT TGGGGTCTGCAACTCGACCCCATGAAGTCG GAGTCGCTAGTAATCGCAGATCAGCATTGC TGCGGTGAATACGTTCCCGGGCCTTGTACA CACCGCCCGTCACGTCACGAAAGTCGGTAA CACCCGAAGCCGGTGGCCCAACCCCTTGTG GGAGGGAGCTGTCGAAGGTGGGACTGGCGA |

TABLE 1-continued

Selected sequences of the present invention

| SEQ ID NO | Kingdom | Phylum | Class | Order | Family | Genus | Species | Sequence |
|---|---|---|---|---|---|---|---|---|
| | | | | | | | | TTGGGACGAAGTCGTAACAAGGTAGCCGTA CCGGAAGG |
| 14 | Bacteria | Actinobacteria | Actinobacteria | Streptomycetales | Streptomycetaceae | *Streptomyces* | albus | AGAGTTTGATCCTGGCTCAGGACGAACGCT GGCGGCGTGCTTAACACATGCAAGTCGAAC GATGAACCGCTTTCGGGCGGGGATTAGTGG CGAACGGGTGAGTAACACGTGGGCAATCTG CCCTGCACTCTGGGACAAGCCCTGGAAACG GGGTCTAATACCGGATATGACTGTCCATCG CATGGTGGATGGTGTAAAGCTCCGGCGGTG CAGGATGAGCCCGCGGCCTATCAGCTTGTT GGTGAGGTAGTGGCTCACCAAGGCGACGAC GGGTAGCCGGCCTGAGAGGGCGACCGGCCA CACTGGGACTGAGACACGGCCCAGACTCCT ACGGGAGGCAGCAGTGGGGAATATTGCACA ATGGGCGAAAGCCTGATGCAGCGACGCCGC GTGAGGGATGACGGCCTTCGGGTTGTAAAC CTCTTTCAGCAGGGAAGAAGCGAAAGTGAC GGTACCTGCAGAAGAAGCGCCGGCTAACTA CGTGCCAGCAGCCGCGGTAATACGTAGGGC GCAAGCGTTGTCCGGAATTATTGGGCGTAA AGAGCTCGTAGGCGGCTTGTCACGTCGGTT GTGAAAGCCCGGGGCTTAACCCCGGGTCTG CAGTCGATACGGGCAGGCTAGAGTTCGGTA GGGGAGATCGGAATTCCTGGTGTAGCGGTG AAATGCGCAGATATCAGGAGGAACACCGGT GGCGAAGGCGGATCTCTGGGCCGATACTGA CGCTGAGGAGCGAAAGCGTGGGGAGCGAAC AGGATTAGATACCCTGGTAGTCCACGCCGT AAACGGTGGGCACTAGGTGTGGGCAACATT CCACGTTGTCCGTGCCGCAGCTAACGCATT AAGTGCCCCGCCTGGGGAGTACGGCCGCAA GGCTAAAACTCAAAGGAATTGACGGGGGCC CGCACAAGCGGCGGAGCATGTGGCTTAATT CGACGCAACGCGAAGAACCTTACCAAGGCT TGACATACACCGGAAACGTCTGGAGACAGG CGCCCCCTTGTGGTCGGTGTACAGGTGGTG CATGGCTGTCGTCAGCTCGTGTCGTGAGAT GTTGGGTTAAGTCCCGCAACGAGCGCAACC CTTGTCCCGTGTTGCCAGCAGGCCTTTGTG GTGCTGGGGACTCACGGGAGACCGCCGGGG TCAACTCGGAGGAAGGTGGGGACGACGTCA AGTCATCATGCCCCTTATGTCTTGGGCTGC ACACGTGCTACAATGGCCGGTACAATGAGC TGCGATACCGCGAGGTGGAGCGAATCTCAA AAAGCCGGTCTCAGTTCGGATTGGGGTCTG CAACTCGACCCCATGAAGTCGGAGTCGCTA GTAATCGCAGATCAGCATTGCTGCGGTGAA TACGTTCCCGGGCCTTGTACACACCGCCCG TCACGTCACGAAAGTCGGTAACACCCGAAG CCGGTGGCCCAACCCCTTGTGGGAGGGAGC TGTCGAAGGTGGGACTGGCGATTGGGACGA AGTCGTAACAAGGTAGCCGTACCGGAAGGT GCGGCTGGATCACCT |
| 15 | Bacteria | Actinobacteria | Actinobacteria | Streptomycetales | Streptomycetaceae | *Streptomyces* | aureofaciens | GAGTTTGATCCTGGCTCAGGACGAACGCTG GCGGCGTGCTTAACACATGCAAGTCGAACG ATGAACCTCCTTCGGGAGGGGATTAGTGGC GAACGGGTGAGTAACACGTGGGCAATCTGC CCTGCACTCTGGGACAAGCCCTGGAAACGG GGTCTAATACCGGATACTGACCCGCTTGGG CATCCAAGCGGTTCGAAAGCTCCGGCGGTG CAGGATGAGCCCGCGGCCTATCAGCTTGTT GGTGAGGTAATGGCTCACCAAGGCGACGAC GGGTAGCCGGCCTGAGAGGGCGACGGCCAC ACTGGGACTGAGACACGGCCCAGACTCCTA CGGGAGGCAGCAGTGGGGAATATTGCACAA TGGGCGAAAGCCTGATGCAGCGACGCCGCG TGAGGGATGACGGCCTTCGGGTTGTAAACC TCTTTCAGCAGGGAAGAAGCGAAAGTGACG GTACCTGCAGAAGAAGCGCCGGCTAACTAC GTGCCAGCAGCCGCGGTAATACGTAGGGCG CGAGCGTTGTCCGGAATTATTGGGCGTAAA GAGCTCGTAGGCGGCTTGTCACGTCGGTTG |

TABLE 1-continued

Selected sequences of the present invention

| SEQ ID NO | Kingdom | Phylum | Class | Order | Family | Genus | Species | Sequence |
|---|---|---|---|---|---|---|---|---|
| | | | | | | | | TGAAAGCCCGGGGCTTAACCCCGGGTCTGC AGTCGATACGGGCAGGCTAGAGTTCGGTAG GGGAGATCGGAATTCCTGGTGTAGCGGTGA AATGCGCAGATATCAGGAAGAACACCGGTG GCGAAGGCGGATCTCTGGGCCGATACTGAC GCTGAGGAGCGAAAGCGTGGGGAGCGAACA GGATTAGATACCCTGGTAGTCCACGCCGTA AACGGTGGGCACTAGGTGTGGGCGACATTC CACGTCGTCGGTGCCGCAGCTAACGCATTA AGTGCCCCGCCTGGGGAGTACGGCCGCAAG GCTAAAACTCAAAGGAATTGACGGGGGCCC GCACAAGCGGCGGAGCATGTGGCTTAATTC GACGCAACGCGAAGAACCTTACCAAGGCTT GACATACACCGGAAAGCATCAGAGATGGTG CCCCCCTTGTGGTCGGTGTACAGGTGGTGC ATGGCTGTCGTCAGCTCGTGTCGTGAGATG TTGGGTTAAGTCCCGCAACGAGCGCAACCC TTGTCCCGTGTTGCCAGCAGGCCCTTGTGG TGCTGGGGACTCACGGGAGACCGCCGGGGT CAACTCGGAGGAAGGTGGGGACGACGTCAA GTCATCATGCCCCTTATGTCTTGGGCTGCA CACGTGCTACAATGGCCGGTACAATGAGCT GCGATACCGCGAGGTGGAGCGAATCTCAAA AAGCCGGTCTCAGTTCGGATTGGGGTCTGC AACTCCACCCCATGAAGTCGGAGTCGCTAG TAATCGCAGATCAGCATTGCTGCGGTGAAT ACGTTCCCGGGCCTTGTACACACCGCCCGT CACGTCACGAAAGTCGGTAACACCCGAAGC CGGTGGCCCAACCCCTTGTGGGAGGGAGCT GTCGAAGGTGGGACTGGCGATTGGGACGAA GTCGTAACAAGGTAGCCGTACCGGAAGGTG CGGCTGGAT |
| 16 | Bacteria | Actinobacteria | Actinobacteria | Streptomycetales | Streptomycetaceae | *Streptomyces* | *mutabilis* | CGCTGGCGGCGTGCTTAACACATGCAAGTC GAACGATGAACCACCTTCGGGTGGGGATTA GTGGCGAACGGGTGAGTAACACGTGGGCAA TCTGCCCTGCACTCTGGGACAAGCCCTGGA AACGGGGTCTAATACCGGATACTGACCCTC GCAGGCATCTGCGAGGTTCGAAAGCTCCGG CGGTGCAGGATGAGCCCGCGGCCTATCAGC TAGTTGGTGAGGTAATGGCTCACCAAGGCG ACGACGGGTAGCCGGCCTGAGAGGGCGACC GGCCACACTGGGACTGAGACACGGCCCAGA CTCCTACGGGAGGCAGCAGTGGGGAATATT GCACAATGGGCGAAAGCCTGATGCAGCGAC GCCGCGTGAGGGATGACGGCCTTCGGGTTG TAAACCTCTTTCAGCAGGGAAGAAGCGAAA GTGACGGTACCTGCAGAAGAAGCGCCGGCT AACTACGTGCCAGCAGCCGCGGTAATACGT AGGGCGCAAGCGTTGTCCGGAATTATTGGG CGTAAAGAGCTCGTAGGCGGCTTGTCACGT CGGTTGTGAAAGCCCGGGGCTTAACCCCGG GTCTGCAGTCGATACGGGCAGGCTAGAGTT CGGTAGGGGAGATCGGAATTCCTGGTGTAG CGGTGAAATGCGCAGATATCAGGAGGAACA CCGGTGGCGAAGGCGGATCTCTGGGCCGAT ACTGACGCTGAGGAGCGAAAGCGTGGGGAG CGAACAGGATTAGATACCCTGGTAGTCCAC GCCGTAAACGGTGGGCACTAGGTGTGGGCA ACATTCCACGTTGTCCGTGCCGCAGCTAAC GCATTAAGTGCCCCGCCTGGGGAGTACGGC CGCAAGGCTAAAACTCAAAGGAATTGACGG GGGCCCGCACAAGCGGCGGAGCATGTGGCT TAATTCGACGCAACGCGAAGAACCTTACCA AGGCTTGACATACACCGGAAAACCCTGGAG ACAGGGTCCCCCTTGTGGTCGGTGTACAGG TGGTGCATGGCTGTCGTCAGCTCGTGTCGT GAGATGTTGGGTTAAGTCCCGCAACGAGCG CAACCCTTGTCCCGTGTTGCCAGCAGGCCC TTGTGGTGCTGGGGACTCACGGGAGACCGC CGGGGTCAACTCGGAGGAAGGTGGGGACGA CGTCAAGTCATCATGCCCCTTATGTCTTGG GCTGCACACGTGCTACAATGGCCGGTACAA TGAGCTGCGATACCGCGAGGTGGAGCGAAT |

TABLE 1-continued

Selected sequences of the present invention

| SEQ ID NO | Kingdom | Phylum | Class | Order | Family | Genus | Species | Sequence |
|---|---|---|---|---|---|---|---|---|
| | | | | | | | | CTCAAAAAGCCGGTCTCAGTTCGGATTGGG GTCTGCAACTCGACCCCATGAAGTCGGAGT CGCTAGTAATCGCAGATCAGCATTGCTGCG GTGAATACGTTCCCGGGCCTTGTACACACC GCCCGTCACGTCACGAAAGTCGGTAACACC CGAAGCCGGTGGCCCAACCCCTTGTGGGAG GGAGCTGTCGAAGGTGGGACTGGCGATTGG GACGAAGTCGTAACAAGGTAGCCGTACCGG AA |
| 17 | Bacteria | Actinobacteria | Actinobacteria | Streptomycetales | Streptomycetaceae | *Streptomyces* | lydicus | GTCGAACGATGAACCTCCTTCGGGAGGGGA TTAGTGGCGAACGGGTGAGTAACACGTGGG CAATCTGCCCTTCACTCTGGGACAAGCCCT GGAAACGGGCTCTAATACCGGATACGACAC GGGGTCGCATGACCTCCGTGTGGAAAGCTC CGGCGGTGAAGGATGAGCCCGCGGCCTATC AGCTTGTTGGTGGGGTGATGGCCTACCAAG GCGACGACGGGTAGCCGGCCTGAGAGGGCG ACCGGCCACACTGGGACTGAGACACGGCCC AGACTCCTACGGGAGGCAGCAGTGGGGAAT ATTGCACAATGGGCGAAAGCCTGATGCAGC GACGCCGCGTGAGGGATGACGGCCTTCGGG TTGTAAACCTCTTTCAGCAGGGAAGAAGCG AGAGTGACGGTACCTGCAGAAGAAGCGCCG GCTAACTACGTGCCAGCAGCCGCGGTAATA CGTAGGGCGCAAGCGTTGTCCGGAATTATT GGGCGTAAAGAGCTCGTAGGCGGCTTGTCA CGTCGGATGTGAAAGCCCGGGGCTTAACCC CGGGTCTGCATTCGATACGGGCAGGCTAGA GTTCGGTAGGGGAGATCGGAATTCCTGGTG TAGCGGTGAAATGCGCAGATATCAGGAGGA ACACCGGTGGCGAAGGCGGATCTCTGGGCC GATACTGACGCTGAGGAGCGAAAGCGTGGG GAGCGAACAGGATTAGATACCCTGGTAGTC CACGCCGTAAACGTTGGGAACTAGGTGTGG GCGACATTCCACGTCGTCGTGCCGCAGCT AACGCATTAAGTTCCCCGCCTGGGGAGTAC GGCCGCAAGGCTAAAACTCAAAGGAATTGA CGGGGGCCCGCACAAGCAGCGGAGCATGTG GCTTAATTCGACGCAACGCGAAGAACCTTA CCAAGGCTTGACATACACCGGAAAACCCTG GAGACAGGGTCCCCCTTGTGGTCGGTGTAC AGGTGGTGCATGGCTGTCGTCAGCTCGTGT CGTGAGATGTTGGGTTAAGTCCCGCAACGA GCGCAACCCTTGTTCTGTGTTGCCAGCATG CCCTTCGGGGTGATGGGGACTCACAGGAGA CTGCCGGGGTCAACTCGGAGGAAGGTGGGG ACGACGTCAAGTCATCATGCCCCTTATGTC TTGGGCTGCACACGTGCTACAATGGCCGGT ACAATGAGCTGCGATACCGCGAGGTGGAGC GAATCTCAAAAGCCGGTCTCAGTTCGGAT TGGGGTCTGCAACTCGACCCCATGAAGTCG GAGTTGCTAGTAATCGCAGATCAGCATTGC TGCGGTGAATACGTTCCCGGGCCTTGTACA CACCGCCCGTCACGTCACGAAAGTCGGTAA CACCCGAAGCC |
| 19 | Bacteria | Proteobacteria | Gammaproteobacteria | Enterobacteriales | Enterobacteriaceae | *Escherichia* | coli str. K-12 substr. MG1655 | MVTINTESALTPRSLRDTRRMNMFVSVAAA VAGLLFGLDIGVIAGALPFITDHFVLTSRL QEWVVSSMMLGAAIGALFNGWLSFRLGRKY SLMAGAILFVLGSIGSAFATSVEMLIAARV VLGIAVGIASYTAPLYLSEMASENVRGKMI SMYQLMVTLGIVLAFLSDTAFSYSGNWRAM LGVLALPAVLLIILVVFLPNSPRWLAEKGR HIEAEEVLRMLRDTSEKAREELNEIRESLK LKQGGWALFKINRNVRRAVFLGMLLQAMQQ FTGMNIIMYYAPRIFKMAGFTTTEQQMIAT LVVGLTFMFATFIAVFTVDKAGRKPALKIG FSVMALGTLVLGYCLMQFDNGTASSGLSWL SVGMTMMCIAGYAMSAAPVVWILCSEIQPL KCRDFGITCSTTTNWVSNMIIGATFLTLLD SIGAAGTFWLYTALNIAFVGITFWLIPETK NVTLEHIERKLMAGEKLRNIGV |

TABLE 1-continued

Selected sequences of the present invention

| SEQ ID NO | Kingdom | Phylum | Class | Order | Family | Genus | Species | Sequence |
|---|---|---|---|---|---|---|---|---|
| 20 | | | | | | | | AGAGTTTGATYMTGGCTCAG |
| 21 | | | | | | | | GGTTACCTTGTTACGACTT |
| 22 | | | | | | | | CCCTCTGGAATAGTGCGTCT |
| 23 | | | | | | | | GGCTGCAACCGTAGTAGGA |
| 18 | Bacteria | Actinobacteria | Actinobacteria | Streptomycetales | Streptomycetaceae | *Streptomyces* | SMCD2215 | TCCCTCTGGAATAGTGCGTCTTTGACGTCCTGGTGAGACCAGACCTGAGCGGGGACAGAGGGGCGCGCTGGATGGGGTTCTGTCCTACTACGGTTGCAGC |

TABLE 2

Auxin, acetoin, and siderophore production by the beneficial *Streptomyces* endophyte Strain C and the control *Streptomyces* endophyte Strain A

| | auxin | | acetoin | | siderophore | |
|---|---|---|---|---|---|---|
| | Average | SE | Average | SE | Average | SE |
| (+) Control | 0.0825 | 0.0022 | 3.8513 | 0.0848 | 0.2450 | 0.0956 |
| Strain C | 0.0535 | 0.0013 | 0.3140 | 0.0288 | 0.2643 | 0.1359 |
| Strain A | Not determined | | 0.0513 | 0.0165 | 0.1730 | 0.0717 |

TABLE 3

Biolog Assay Data
Rate of utilization of 190 sole carbon sources by the beneficial *Streptomyces* endophyte strain Strain C and the control *Streptomyces* strain Strain A, using BIOLOG Phenotype MicroArray 1 and 2A as monitored over 7 days. ++++ rapid dye formation by hour 12; +++ strong dye accumulation after hour 48; ++ noticeable dye accumulation at hour 168; − weak substrate; nm not metabolized

| Carbon substrate | Strain C | Strain A |
|---|---|---|
| L-Arabinose | ++++ | ++++ |
| N-Acetyl-D-Glucosamine | +++ | +++ |
| D-Saccharic acid | − | − |
| Succinic acid | − | − |
| D-Galactose | ++ | − |
| L-Aspartic acid | − | − |
| L-Proline | +++ | +++ |
| D-Alanine | ++ | ++ |
| D-Trehalose | +++ | +++ |
| D-Mannose | − | − |
| Dulcitol | nm | nm |
| D-Serine | nm | nm |
| D-Sorbitol | ++ | ++ |
| Glycerol | ++ | + |
| L-Fucose | nm | − |
| D-Glucuronic acid | − | − |
| D-Gluconic acid | ++ | ++ |
| D-L-α-Glycerol phosphate | − | − |
| D-Xylose | ++++ | ++++ |
| L-Lactic acid | − | − |
| Formic acid | − | − |
| D-Mannitol | +++ | +++ |
| L-Glutamic acid | ++ | ++ |
| D-Glucose-6-Phosphate | nm | nm |
| D-Galactonic acid-γ-lactone | ++ | ++ |
| D-L-Malic acid | ++ | ++ |
| D-Ribose | ++++ | ++++ |
| Tween 20 | − | − |
| L-Rhamnose | − | − |
| D-Fructose | ++ | ++ |
| Acetic acid | − | − |
| α-D-Glucose | +++ | ++ |
| Maltose | +++ | +++ |
| D-Melibiose | − | nm |
| Thymidine | nm | nm |
| L-Asparagine | ++ | ++ |
| D-Aspartic acid | nm | nm |
| D-Glucosaminic acid | +++ | +++ |
| 1,2-Propanediol | − | − |
| Tween 40 | − | − |
| α-Keto-Glutaric acid | − | − |
| α-Keto-Butyric acid | − | − |
| α-Methyl-D-Galactoside | − | − |
| α-D-Lactose | − | − |
| Lactulose | − | − |
| Sucrose | +++ | ++ |
| Uridine | − | − |
| L-glutamine | ++ | ++ |
| m-Tartaric acid | nm | nm |
| D-Glucose-1-Phosphate | − | − |
| D-Fructose-6-Phosphate | − | − |
| Tween 80 | | |
| α-Hydroxy Glutaric acid-γ-lactone | − | − |
| α-Hydroxy Butyric acid | − | − |
| β-Methyl-D-glucoside | ++ | − |
| Adonitol | ++ | ++ |
| Maltotriose | +++ | +++ |
| 2-Deoxy adenosine | nm | nm |
| Adenosine | − | nm |
| Glycyl-L-Aspartic acid | − | − |
| Citric acid | ++ | ++ |
| m-Inositol | +++ | +++ |
| D-Threonine | − | − |
| Fumaric acid | − | − |
| Bromo succinic acid | − | − |
| Propionic acid | − | − |
| Mucic acid | ++ | ++ |
| Glycolic acid | − | − |

TABLE 3-continued

Biolog Assay Data
Rate of utilization of 190 sole carbon sources
by the beneficial *Streptomyces* endophyte strain
Strain C and the control *Streptomyces* strain
Strain A, using BIOLOG Phenotype MicroArray
1 and 2A as monitored over 7 days. ++++ rapid
dye formation by hour 12; +++ strong dye
accumulation after hour 48; ++ noticeable dye
accumulation at hour 168; − weak substrate;
nm not metabolized

| Carbon substrate | Strain C | Strain A |
|---|---|---|
| Glyoxylic acid | nm | nm |
| D-Cellobiose | ++ | − |
| Inosine | − | nm |
| Glycyl-L-Glutamic acid | ++ | ++ |
| Tricarballylic acid | nm | − |
| L-Serine | ++ | ++ |
| L-Threonine | − | − |
| L-Alanine | ++ | − |
| L-Alanyl-Glycine | ++ | − |
| Acetoacetic acid | − | − |
| N-acetyl-β-D-Mannosamine | nm | nm |
| Mono Methyl Succinate | ++ | nm |
| Methyl Pyruvate | − | nm |
| D-Malic acid | − | nm |
| L-Malic acid | ++++ | ++++ |
| Glycyl-L-Proline | +++ | ++ |
| p-Hydroxy Phenyl acetic acid | − | − |
| m-Hydroxy Phenyl Acetic acid | nm | − |
| Tyramine | ++ | ++ |
| D-Psicose | − | − |
| L-Lyxose | ++++ | − |
| Glucuronamide | nm | − |
| Pyruvic acid | ++++ | ++++ |
| L-Galactonic-acid-γ-lactone | ++ | ++ |
| D-Galacturonic acid | − | − |
| Phenylethhyl-amine | nm | nm |
| 2-Aminoethanol | − | − |

TABLE 4

Whole genome sequencing analysis
of arabinose transporter genes
Frequency analysis of the number
of occurrences of arabinose transporter
genes from whole genome sequencing.
A beneficial *Streptomyces* strain
comprised at least 3 arabinose
transporter genes in its genome.

| Strain | 16S SEQID NO | # arabinose transporter genes |
|---|---|---|
| Strain C | 3 | 3 |
| Strain B | 2 | 4 |
| *Streptomyces albidoflavus* | 13 | 4 |
| *Streptomyces albus* | 14 | 4 |
| *Streptomyces aureofaciens* | 15 | 3 |
| *Streptomyces mutabilis* | 16 | 3 |
| Streptomyces *lydicus* | 17 | 4 |

Table 5: Proteomics Analysis of *Streptomyces* Culture Secretome

TABLE 5A

Proteins expressed in the culture of the *Streptomyces* strain Strain C but not in that of the
*Streptomyces* strain Strain B. Results are shown by KEGG pathway, by Gene Ontology (GO)
description, means of levels for each strain (normalized spectra counts), and the fold-change
computed as $\log_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 86 | Ribosome, RP-S19, rpsS | rRNA binding, small ribosomal subunit, structural constituent of ribosome, translation | 1.258 | 0.000 | 10.3 |
| 91 | Ribosome, RP-S7, MRPS7, rpsG | rRNA binding, small ribosomal subunit, structural constituent of ribosome, translation, tRNA binding | 1.091 | 0.000 | 10.1 |
| 181 | Ribosome, RP-S2, MRPS2, rpsB | small ribosomal subunit, structural constituent of ribosome, translation | 0.947 | 0.000 | 9.9 |
| 80 | Ribosome, RP-S5, MRPS5, rpsE | rRNA binding, small ribosomal subunit, structural constituent of ribosome, translation | 0.858 | 0.000 | 9.7 |
| 89 | Ribosome, RP-S10, MRPS10, rpsJ | small ribosomal subunit, structural constituent of ribosome, translation, tRNA binding | 0.750 | 0.000 | 9.6 |
| 84 | Ribosome, RP-S3, rpsC | mRNA binding, rRNA binding, small ribosomal subunit, structural constituent of ribosome, translation | 0.709 | 0.000 | 9.5 |
| 41 | 2-Oxocarboxylic acid metabolism, Biosynthesis of amino acids, Carbon metabolism, Citrate cycle (TCA cycle), CS, gltA, Glyoxylate and dicarboxylate metabolism | citrate (Si)-synthase activity, cytoplasm, tricarboxylic acid cycle | 0.583 | 0.000 | 9.2 |

TABLE 5A-continued

Proteins expressed in the culture of the *Streptomyces* strain Strain C but not in that of the *Streptomyces* strain Strain B. Results are shown by KEGG pathway, by Gene Ontology (GO) description, means of levels for each strain (normalized spectra counts), and the fold-change computed as log$_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 92 | Ribosome, RP-S12, MRPS12, rpsL | response to antibiotic, rRNA binding, small ribosomal subunit, structural constituent of ribosome, translation, tRNA binding | 0.560 | 0.000 | 9.1 |
| 73 | Ribosome, RP-S9, MRPS9, rpsI | ribosome, structural constituent of ribosome, translation | 0.480 | 0.000 | 8.9 |
| 153 | Ribosome, RP-S6, MRPS6, rpsF | ribosome, rRNA binding, structural constituent of ribosome, translation | 0.433 | 0.000 | 8.8 |
| 29 | 2-Oxocarboxylic acid metabolism, Biosynthesis of amino acids, Carbon fixation pathways in prokaryotes, Carbon metabolism, Citrate cycle (TCA cycle), Glutathione metabolism, IDH1, IDH2, icd, Peroxisome | isocitrate dehydrogenase (NADP+) activity, metal ion binding, tricarboxylic acid cycle | 0.429 | 0.000 | 8.7 |
| 179 | frr, MRRF, RRF | cytoplasm, translational termination | 0.353 | 0.000 | 8.5 |
| 346 | Biosynthesis of amino acids, Carbon fixation in photosynthetic organisms, Carbon metabolism, Glycolysis/Gluconeogenesis, PGK, pgk | ATP binding, cytoplasm, glycolytic process, phosphoglycerate kinase activity | 0.335 | 0.000 | 8.4 |
| 173 | Aminoacyl-tRNA biosynthesis, PARS, proS | aminoacyl-tRNA editing activity, ATP binding, cytoplasm, proline-tRNA ligase activity, prolyl-tRNA aminoacylation, regulation of translational fidelity | 0.321 | 0.000 | 8.3 |
| 345 | Biosynthesis of amino acids, Carbon fixation in photosynthetic organisms, Carbon metabolism, Fructose and mannose metabolism, Glycolysis/Gluconeogenesis, Inositol phosphate metabolism, TPI, tpiA | cytoplasm, gluconeogenesis, glycolytic process, pentose-phosphate shunt, triose-phosphate isomerase activity | 0.312 | 0.000 | 8.3 |
| 343 | Biosynthesis of amino acids, Biosynthesis of ansamycins, Carbon fixation in photosynthetic organisms, Carbon metabolism, E2.2.1.1, tktA, tktB, Pentose phosphate pathway | metabolic process, metal ion binding, transketolase activity | 0.306 | 0.000 | 8.3 |
| 180 | tsf, TSFM | cytoplasm, translation elongation factor activity, translational elongation | 0.296 | 0.000 | 8.2 |
| 377 | Biosynthesis of amino acids, Carbon metabolism, Central carbon metabolism in cancer, Glycine, serine and threonine metabolism, Glycolysis/Gluconeogenesis, Methane metabolism, PGAM, gpmA | 2,3-bisphosphoglycerate-dependent phosphoglycerate mutase activity, gluconeogenesis, glycolytic process | 0.274 | 0.000 | 8.1 |
| 70 | Drug metabolism-other enzymes, guaB, Purine metabolism | IMP dehydrogenase activity, oxidation-reduction process, purine nucleotide biosynthetic process | 0.273 | 0.000 | 8.1 |
| 351 | Ribosome, RP-S1, rpsA | ribosome, RNA binding, structural constituent of ribosome, translation | 0.272 | 0.000 | 8.1 |
| 402 | Biosynthesis of amino acids, Carbon metabolism, ENO, eno, Glycolysis/Gluconeogenesis, HIF-1 signaling pathway, Methane metabolism, RNA degradation | cell surface, extracellular region, glycolytic process, magnesium ion binding, phosphopyruvate hydratase activity, phosphopyruvate hydratase complex | 0.238 | 0.000 | 7.9 |
| 292 | E5.2.1.8 | peptidyl-prolyl cis-trans isomerase activity, protein folding, protein peptidyl-prolyl isomerization | 0.239 | 0.000 | 7.9 |
| 238 | HPD, hppD, Phenylalanine metabolism, Tyrosine metabolism, Ubiqui and other terpenoid-qui biosynthesis | 4-hydroxyphenylpyruvate dioxygenase activity, aromatic amino acid family metabolic process, metal ion binding, oxidation-reduction process | 0.191 | 0.000 | 7.6 |
| 409 | Aminoacyl-tRNA biosynthesis, LARS, leuS | aminoacyl-tRNA editing activity, ATP binding, cytoplasm, leucine-tRNA ligase activity, leucyl-tRNA aminoacylation, regulation of translational fidelity | 0.197 | 0.000 | 7.6 |
| 285 | Aminoacyl-tRNA biosynthesis, FARSB, pheT | ATP binding, cytoplasm, magnesium ion binding, phenylalanine-tRNA ligase activity, phenylalanyl-tRNA aminoacylation, tRNA binding, tRNA processing | 0.197 | 0.000 | 7.6 |
| 32 | Glycine, serine and threonine metabolism, kbl, GCAT | biosynthetic process, glycine C-acetyltransferase activity, L-threonine catabolic process to | 0.198 | 0.000 | 7.6 |

TABLE 5A-continued

Proteins expressed in the culture of the *Streptomyces* strain Strain C but not in that of the *Streptomyces* strain Strain B. Results are shown by KEGG pathway, by Gene Ontology (GO) description, means of levels for each strain (normalized spectra counts), and the fold-change computed as log$_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 122 | Drug metabolism-other enzymes, hprT, hpt, HPRT1, Purine metabolism | glycine, ligase activity, pyridoxal phosphate binding cytoplasm, guanine phosphoribosyltransferase activity, hypoxanthine phosphoribosyltransferase activity, purine ribonucleoside salvage | 0.188 | 0.000 | 7.6 |
| 77 | Ribosome, RP-S11, MRPS11, rpsK | ribosome, rRNA binding, structural constituent of ribosome, translation | 0.198 | 0.000 | 7.6 |
| 107 | Aminoacyl-tRNA biosynthesis, lysK | ATP binding, cytoplasm, lysine-tRNA ligase activity, lysyl-tRNA aminoacylation, tRNA binding | 0.179 | 0.000 | 7.5 |
| 219 | E1.17.4.1B, nrdB, nrdF, Purine metabolism, Pyrimidine metabolism | deoxyribonucleoside diphosphate metabolic process, DNA replication, integral component of membrane, metal ion binding, oxidation-reduction process, ribonucleoside-diphosphate reductase activity, thioredoxin disulfide as acceptor | 0.174 | 0.000 | 7.5 |
| 96 | Ribosome, RP-L11, MRPL11, rplK | large ribosomal subunit rRNA binding, ribosome, structural constituent of ribosome, translation | 0.176 | 0.000 | 7.5 |
| 437 | Glutathione metabolism, pepN | aminopeptidase activity, metallopeptidase activity, proteolysis, zinc ion binding | 0.174 | 0.000 | 7.4 |
| 398 | Carbon fixation in photosynthetic organisms, Carbon fixation pathways in prokaryotes, Carbon metabolism, Methane metabolism, ppc, Pyruvate metabolism | carbon fixation, magnesium ion binding, oxaloacetate metabolic process, phosphoenolpyruvate carboxylase activity, tricarboxylic acid cycle | 0.173 | 0.000 | 7.4 |
| 208 | | regulation of transcription, DNA-templated, transcription factor activity, sequence-specific DNA binding | 0.170 | 0.000 | 7.4 |
| 176 | mqnX, Ubiqui and other terpenoid-qui biosynthesis | adenosine deaminase activity, deaminase activity, hydrolase activity, menaqui biosynthetic process, metabolic process, metal ion binding | 0.158 | 0.000 | 7.3 |
| 198 | Biosynthesis of amino acids, Carbon metabolism, Glycine, serine and threonine metabolism, Methane metabolism, serA, PHGDH | amino acid binding, L-serine biosynthetic process, NAD binding, oxidation-reduction process, phosphoglycerate dehydrogenase activity | 0.159 | 0.000 | 7.3 |
| 425 | Aminoacyl-tRNA biosynthesis, VARS, valS | aminoacyl-tRNA editing activity, ATP binding, cytoplasm, regulation of translational fidelity, valine-tRNA ligase activity, valyl-tRNA aminoacylation | 0.142 | 0.000 | 7.2 |
| 139 | Aminoacyl-tRNA biosynthesis, DARS, aspS | aminoacyl-tRNA ligase activity, aspartate-tRNA ligase activity, ATP binding, cytoplasm, nucleic acid binding, tRNA aminoacylation for protein translation | 0.146 | 0.000 | 7.2 |
| 194 | 2-Oxocarboxylic acid metabolism, Biosynthesis of amino acids, E2.6.1.42, ilvE, Pantothenate and CoA biosynthesis, Valine, leucine and isoleucine biosynthesis, Valine, leucine and isoleucine degradation | isoleucine biosynthetic process, L-isoleucine transaminase activity, L-leucine transaminase activity, L-valine transaminase activity, leucine biosynthetic process, valine biosynthetic process | 0.146 | 0.000 | 7.2 |
| 376 | | transport | 0.148 | 0.000 | 7.2 |
| 28 | Biosynthesis of amino acids, Cysteine and methionine metabolism, metE, Selenocompound metabolism | 5-methyltetrahydropteroyltriglutamate-homocysteine S-methyltransferase activity, methionine biosynthetic process, methylation, zinc ion binding | 0.134 | 0.000 | 7.1 |
| 202 | Carbon metabolism, gcvT, AMT, Glycine, serine and threonine metabolism, One carbon pool by folate | aminomethyltransferase activity, glycine decarboxylation via glycine cleavage system, methylation, transaminase activity | 0.138 | 0.000 | 7.1 |
| 127 | rsbV | antisigma factor binding, identical protein binding, regulation of transcription, DNA-templated | 0.135 | 0.000 | 7.1 |
| 97 | | biosynthetic process, L-aspartate: 2-oxoglutarate aminotransferase activity, L-phenylalanine: 2-oxoglutarate aminotransferase activity, pyridoxal phosphate binding, transaminase activity | 0.135 | 0.000 | 7.1 |
| 204 | | catalytic activity, enoyl-CoA hydratase activity, isomerase activity, metabolic process | 0.141 | 0.000 | 7.1 |
| 49 | | oxidation-reduction process, oxidoreductase activity | 0.138 | 0.000 | 7.1 |

TABLE 5A-continued

Proteins expressed in the culture of the *Streptomyces* strain Strain C but not in that of the
*Streptomyces* strain Strain B. Results are shown by KEGG pathway, by Gene Ontology (GO)
description, means of levels for each strain (normalized spectra counts), and the fold-change
computed as $\log_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 146 | PPIA | peptidyl-prolyl cis-trans isomerase activity, protein folding, protein peptidyl-prolyl isomerization | 0.135 | 0.000 | 7.1 |
| 324 | Homologous recombination, recA | ATP binding, cytoplasm, damaged DNA binding, DNA recombination, DNA repair, DNA-dependent ATPase activity, single-stranded DNA binding, SOS response | 0.123 | 0.000 | 7.0 |
| 324 | Homologous recombination, recA | ATP binding, cytoplasm, damaged DNA binding, DNA recombination, DNA repair, DNA-dependent ATPase activity, single-stranded DNA binding, SOS response | 0.123 | 0.000 | 7.0 |
| 71 | groEL, HSPD1, Legionellosis, RNA degradation, Tuberculosis, Type I diabetes mellitus | ATP binding, cytoplasm, protein refolding, unfolded protein binding | 0.127 | 0.000 | 7.0 |
| 412 | prfB | cytoplasm, translation release factor activity, codon specific, translational termination | 0.127 | 0.000 | 7.0 |
| 443 | | iron-sulfur cluster assembly, iron-sulfur cluster binding, structural molecule activity | 0.131 | 0.000 | 7.0 |
| 229 | Biosynthesis of amino acids, dapE, Lysine biosynthesis | lysine biosynthetic process via diaminopimelate, succinyl-diaminopimelate desuccinylase activity | 0.131 | 0.000 | 7.0 |
| 217 | Carbon metabolism, Citrate cycle (TCA cycle), Lysine degradation, OGDH, sucA, Tryptophan metabolism | oxoglutarate dehydrogenase (succinyl-transferring) activity, thiamine pyrophosphate binding, transferase activity, transferring acyl groups, tricarboxylic acid cycle | 0.125 | 0.000 | 7.0 |
| 416 | ybeB | cytoplasm, mature ribosome assembly, negative regulation of ribosome biogenesis, negative regulation of translation | 0.120 | 0.000 | 6.9 |
| 358 | Biosynthesis of amino acids, hisD, Histidine metabolism | histidine biosynthetic process, histidinol dehydrogenase activity, NAD binding, oxidation-reduction process, zinc ion binding | 0.119 | 0.000 | 6.9 |
| 469 | | hydrolase activity, metabolic process | 0.122 | 0.000 | 6.9 |
| 330 | K06910 | | 0.116 | 0.000 | 6.9 |
| 125 | aceE, Carbon metabolism, Citrate cycle (TCA cycle), Glycolysis/Gluconeogenesis, Pyruvate metabolism | oxidation-reduction process, pyruvate dehydrogenase (acetyl-transferring) activity | 0.122 | 0.000 | 6.9 |
| 447 | | zinc ion binding | 0.122 | 0.000 | 6.9 |
| 131 | Alanine, aspartate and glutamate metabolism, purA, ADSS, Purine metabolism | 'de novo' AMP biosynthetic process, adenylosuccinate synthase activity, cytoplasm, GTP binding, IMP metabolic process, magnesium ion binding | 0.113 | 0.000 | 6.8 |
| 366 | cynT, can, Nitrogen metabolism | carbonate dehydratase activity, metabolic process, zinc ion binding | 0.110 | 0.000 | 6.8 |
| 136 | dcd, Pyrimidine metabolism | dCTP deaminase activity, dUMP biosynthetic process, dUTP biosynthetic process, pyrimidine ribonucleotide biosynthetic process | 0.108 | 0.000 | 6.8 |
| 220 | PDF, def | iron ion binding, peptide deformylase activity, translation | 0.109 | 0.000 | 6.8 |
| 64 | K07164 | | 0.114 | 0.000 | 6.8 |
| 199 | 2-Oxocarboxylic acid metabolism, Biosynthesis of amino acids, Butanoate metabolism, C5-Branched dibasic acid metabolism, E2.2.1.6S, ilvH, ilvN, Pantothenate and CoA biosynthesis, Valine, leucine and isoleucine biosynthesis | acetolactate synthase activity, amino acid binding, branched-chain amino acid biosynthetic process | 0.106 | 0.000 | 6.7 |
| 108 | Aminoacyl-tRNA biosynthesis, RARS, argS | arginine-tRNA ligase activity, arginyl-tRNA aminoacylation, ATP binding, cytoplasm | 0.100 | 0.000 | 6.7 |
| 190 | Aminoacyl-tRNA biosynthesis, EARS, gltX, Porphyrin and chlorophyll metabolism | ATP binding, cytoplasm, glutamate-tRNA ligase activity, glutamyl-tRNA aminoacylation, tRNA binding | 0.101 | 0.000 | 6.7 |
| 59 | Amino sugar and nucleotide sugar metabolism, Fructose and mannose metabolism, manB | carbohydrate metabolic process, intramolecular transferase activity, phosphotransferases, magnesium ion binding | 0.102 | 0.000 | 6.7 |
| 33 | lipB, Lipoic acid metabolism | cellular protein modification process, cytoplasm, ligase activity, lipoate biosynthetic process, lipoyl(octanoyl) transferase activity, octanoyltransferase activity | 0.104 | 0.000 | 6.7 |
| 116 | 2-Oxocarboxylic acid metabolism, Biosynthesis of amino acids, ilvD, Pantothenate and CoA biosynthesis, | 4 iron, 4 sulfur cluster binding, dihydroxy-acid dehydratase activity, isoleucine biosynthetic process, metal ion binding, valine biosynthetic | 0.095 | 0.000 | 6.6 |

TABLE 5A-continued

Proteins expressed in the culture of the *Streptomyces* strain Strain C but not in that of the *Streptomyces* strain Strain B. Results are shown by KEGG pathway, by Gene Ontology (GO) description, means of levels for each strain (normalized spectra counts), and the fold-change computed as log$_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| | Valine, leucine and isoleucine biosynthesis | process | | | |
| 128 | ACSS, acs, Carbon fixation pathways in prokaryotes, Carbon metabolism, Glycolysis/Gluconeogenesis, Methane metabolism, Propanoate metabolism, Pyruvate metabolism | acetate-CoA ligase activity, acetyl-CoA biosynthetic process from acetate, AMP binding, ATP binding, metal ion binding | 0.097 | 0.000 | 6.6 |
| 39 | Biosynthesis of unsaturated fatty acids, DESA1, Fatty acid biosynthesis, Fatty acid metabolism | acyl-[acyl-carrier-protein] desaturase activity, fatty acid metabolic process, oxidation-reduction process | 0.093 | 0.000 | 6.6 |
| 272 | AARS, alaS, Aminoacyl-tRNA biosynthesis | alanine-tRNA ligase activity, alanyl-tRNA aminoacylation, ATP binding, cytoplasm, tRNA binding, zinc ion binding | 0.096 | 0.000 | 6.6 |
| 162 | Biosynthesis of amino acids, pheA2, Phenylalanine, tyrosine and tryptophan biosynthesis | amino acid binding, chorismate mutase activity, cytoplasm, L-phenylalanine biosynthetic process, prephenate dehydratase activity | 0.096 | 0.000 | 6.6 |
| 286 | Aminoacyl-tRNA biosynthesis, FARSA, pheS | ATP binding, cytoplasm, magnesium ion binding, phenylalanine-tRNA ligase activity, phenylalanyl-tRNA aminoacylation, tRNA binding | 0.095 | 0.000 | 6.6 |
| 325 | SIG1, rpoD | cytoplasm, DNA binding, regulation of transcription, DNA-templated, sigma factor activity, transcription factor activity, sequence-specific DNA binding, transcription initiation from bacterial-type RNA polymerase promoter | 0.097 | 0.000 | 6.6 |
| 24 | | DNA binding, metabolic process, RNA-3'-phosphate cyclase activity | 0.097 | 0.000 | 6.6 |
| 216 | | ligase activity, oxidation-reduction process, oxidoreductase activity | 0.095 | 0.000 | 6.6 |
| 166 | Purine metabolism, purM | 'de novo' IMP biosynthetic process, ATP binding, cytoplasm, phosphoribosylformylglycinamidine cyclo-ligase activity | 0.086 | 0.000 | 6.5 |
| 270 | Pyrimidine metabolism, URA4, pyrC | 'de novo' UMP biosynthetic process, dihydroorotase activity, zinc ion binding | 0.087 | 0.000 | 6.5 |
| 467 | Biosynthesis of amino acids, Glycine, serine and threonine metabolism, ItaE | cellular amino acid metabolic process, lyase activity, threonine aldolase activity | 0.090 | 0.000 | 6.5 |
| 378 | regX3, Two-component system | DNA binding, intracellular, phosphorelay signal transduction system, regulation of transcription, DNA-templated | 0.087 | 0.000 | 6.5 |
| 50 | mca | hydrolase activity, mycothiol metabolic process, mycothiol-dependent detoxification, zinc ion binding | 0.092 | 0.000 | 6.5 |
| 329 | spo0M | | 0.091 | 0.000 | 6.5 |
| 352 | Base excision repair, DNA replication, DPO1, polA, Homologous recombination, Nucleotide excision repair, Purine metabolism, Pyrimidine metabolism | 3'-5' exonuclease activity, DNA binding, DNA biosynthetic process, DNA repair, DNA-dependent DNA replication, DNA-directed DNA polymerase activity, nucleic acid phosphodiester bond hydrolysis | 0.082 | 0.000 | 6.4 |
| 239 | Carbon metabolism, ME2, sfcA, maeA, Pyruvate metabolism, Two-component system | amino acid binding, malate dehydrogenase (decarboxylating) (NAD+) activity, malate dehydrogenase (decarboxylating) (NADP+) activity, malate metabolic process, metal ion binding, NAD binding, oxaloacetate decarboxylase activity, oxidation-reduction process | 0.081 | 0.000 | 6.4 |
| 379 | Aminoacyl-tRNA biosynthesis, CARS, cysS | ATP binding, cysteine-tRNA ligase activity, cysteinyl-tRNA aminoacylation, cytoplasm, zinc ion binding | 0.086 | 0.000 | 6.4 |
| 420 | Arginine and proline metabolism, Biosynthesis of amino acids, Carbapenem biosynthesis, proA | cytoplasm, glutamate-5-semialdehyde dehydrogenase activity, L-proline biosynthetic process, NADP binding, oxidation-reduction process | 0.085 | 0.000 | 6.4 |
| 304 | nudF, Purine metabolism | ADP-ribose diphosphatase activity, hydrolase activity, metabolic process | 0.079 | 0.000 | 6.3 |
| 123 | tilS, mesJ | ATP binding, cytoplasm, ligase activity, forming carbon-nitrogen bonds, tRNA modification | 0.076 | 0.000 | 6.3 |
| 117 | clpC | ATP binding, peptidase activity, proteolysis | 0.079 | 0.000 | 6.3 |
| 52 | Biosynthesis of amino acids, Cysteine and methionine metabolism, metB, Selenocompound metabolism, Sulfur metabolism | cystathionine gamma-lyase activity, cystathionine gamma-synthase activity, L-cysteine desulfhydrase activity, L-cystine L-cysteine-lyase (deaminating), metabolic process, pyridoxal phosphate binding | 0.079 | 0.000 | 6.3 |
| 90 | fusA, GFM, EFG | cytoplasm, GTP binding, GTPase activity, translation elongation factor activity, translational elongation | 0.077 | 0.000 | 6.3 |

TABLE 5A-continued

Proteins expressed in the culture of the *Streptomyces* strain Strain C but not in that of the *Streptomyces* strain Strain B. Results are shown by KEGG pathway, by Gene Ontology (GO) description, means of levels for each strain (normalized spectra counts), and the fold-change computed as $\log_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 142 | Carbon metabolism, Citrate cycle (TCA cycle), DLAT, aceF, pdhC, Glycolysis/ Gluconeogenesis, Pyruvate metabolism | dihydrolipoyllysine-residue (2-methylpropanoyl)transferase activity, metabolic process, transferase activity, transferring acyl groups | 0.080 | 0.000 | 6.3 |
| 193 | K07131 | | 0.078 | 0.000 | 6.3 |
| 193 | K07131 | | 0.078 | 0.000 | 6.3 |
| 213 | ATPF1D, atpH, Oxidative , phosphorylation Photosynthesis | plasma membrane, plasma membrane ATP synthesis coupled proton transport, proton-transporting ATP synthase activity, rotational mechanism, proton-transporting ATP synthase complex, catalytic core F(1) | 0.076 | 0.000 | 6.3 |
| 281 | Alanine, aspartate and glutamate metabolism, argH, ASL, Arginine and proline metabolism, Biosynthesis of amino acids | arginine biosynthetic process via ornithine, argininosuccinate lyase activity, cytoplasm | 0.074 | 0.000 | 6.2 |
| 332 | | enoyl-CoA hydratase activity, isomerase activity, metabolic process | 0.073 | 0.000 | 6.2 |
| 245 | | gas vesicle shell, structural molecule activity, vesicle membrane | 0.072 | 0.000 | 6.2 |
| 192 | K07131 | | 0.071 | 0.000 | 6.2 |
| 177 | betB, gbsA, Glycine, serine and threonine metabolism | oxidation-reduction process, oxidoreductase activity, acting on the aldehyde or oxo group of donors, NAD or NADP as acceptor | 0.074 | 0.000 | 6.2 |
| 161 | | oxidation-reduction process, oxidoreductase activity, acting on paired donors, with incorporation or reduction of molecular oxygen | 0.067 | 0.000 | 6.1 |
| 150 | DNA replication, DPO3B, dnaN, Homologous recombination, Mismatch repair, Purine metabolism, Pyrimidine metabolism | 3'-5' exonuclease activity, cytoplasm, DNA binding, DNA biosynthetic process, DNA polymerase III complex, DNA replication, DNA-directed DNA polymerase activity, nucleic acid phosphodiester bond hydrolysis | 0.063 | 0.000 | 6.0 |
| 265 | ribH, RIB4, Riboflavin metabolism | 6,7-dimethyl-8-ribityllumazine synthase activity, riboflavin biosynthetic process, riboflavin synthase complex, transferase activity | 0.065 | 0.000 | 6.0 |
| 357 | Biosynthesis of amino acids, hisB, Histidine metabolism | cytoplasm, histidine biosynthetic process, imidazoleglycerol-phosphate dehydratase activity | 0.064 | 0.000 | 6.0 |
| 408 | E3.4.13.19, DPEP1 | dipeptidase activity, proteolysis | 0.065 | 0.000 | 6.0 |
| 415 | mtrA, Two-component system | DNA binding, intracellular, phosphorelay signal transduction system, regulation of transcription, DNA-templated | 0.064 | 0.000 | 6.0 |
| 130 | | DNA binding, regulation of transcription, DNA-templated | 0.061 | 0.000 | 6.0 |
| 104 | mqnA, Ubiqui and other terpenoid-qui biosynthesis | hydro-lyase activity, menaqui biosynthetic process | 0.064 | 0.000 | 6.0 |
| 182 | | lyase activity, metabolic process | 0.065 | 0.000 | 6.0 |
| 79 | map | metal ion binding, metalloaminopeptidase activity, protein initiator methionine removal, proteolysis | 0.065 | 0.000 | 6.0 |
| 60 | add, ADA, Primary immunodeficiency, Purine metabolism | adenosine deaminase activity, nucleotide metabolic process, purine ribonucleoside monophosphate biosynthetic process, zinc ion binding | 0.059 | 0.000 | 5.9 |
| 277 | Galactose metabolism, malZ, Starch and sucrose metabolism | alpha-1,4-glucosidase activity, carbohydrate metabolic process, catalytic activity, cation binding, maltose alpha-glucosidase activity, maltose metabolic process | 0.057 | 0.000 | 5.9 |
| 294 | | DNA binding, intracellular, phosphorelay signal transduction system, regulation of transcription, DNA-templated | 0.057 | 0.000 | 5.9 |
| 206 | Biosynthesis of amino acids, Carbon metabolism, Central carbon metabolism in cancer, Glycolysis/Gluconeogenesis, PK, pyk, Purine metabolism, Pyruvate metabolism, Type II diabetes mellitus, Viral carcinogenesis | glycolytic process, kinase activity, magnesium ion binding, potassium ion binding, pyruvate kinase activity | 0.059 | 0.000 | 5.9 |
| 27 | Carbon metabolism, Glutathione metabolism, Pentose phosphate pathway, PGD, gnd | NADP binding, oxidation-reduction process, pentose-phosphate shunt, phosphogluconate dehydrogenase (decarboxylating) activity | 0.058 | 0.000 | 5.9 |
| 55 | | catalytic activity, metabolic process, methylglutaconyl-CoA hydratase activity | 0.055 | 0.000 | 5.8 |

TABLE 5A-continued

Proteins expressed in the culture of the *Streptomyces* strain Strain C but not in that of the *Streptomyces* strain Strain B. Results are shown by KEGG pathway, by Gene Ontology (GO) description, means of levels for each strain (normalized spectra counts), and the fold-change computed as $\log_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 465 | Fructose and mannose metabolism, Pentose and glucuronate interconversions, xyIA | cytoplasm, D-xylose metabolic process, magnesium ion binding, pentose-phosphate shunt, xylose isomerase activity | 0.054 | 0.000 | 5.8 |
| 159 | | hydrolase activity, kinase activity, phosphorylation, protein phosphorylation, protein serine/threonine kinase activity | 0.053 | 0.000 | 5.8 |
| 58 | Nicotinate and nicotinamide metabolism, punA, Purine metabolism, Pyrimidine metabolism | nucleoside metabolic process, purine-nucleoside phosphorylase activity | 0.055 | 0.000 | 5.8 |
| 214 | Biosynthesis of amino acids, Glycine, serine and threonine metabolism, thrC, Vitamin B6 metabolism | pyridoxal phosphate binding, threonine biosynthetic process, threonine synthase activity | 0.054 | 0.000 | 5.8 |
| 363 | Aminoacyl-tRNA biosynthesis, IARS, ileS | aminoacyl-tRNA editing activity, ATP binding, cytoplasm, isoleucine-tRNA ligase activity, isoleucyl-tRNA aminoacylation, regulation of translational fidelity, zinc ion binding | 0.050 | 0.000 | 5.7 |
| 278 | Aminoacyl-tRNA biosynthesis, TARS, thrS | ATP binding, cytoplasm, metal ion binding, threonine-tRNA ligase activity, threonyl-tRNA aminoacylation | 0.051 | 0.000 | 5.7 |
| 289 | | cell, cell redox homeostasis, flavin adenine dinucleotide binding, oxidation-reduction process, oxidoreductase activity | 0.050 | 0.000 | 5.7 |
| 302 | aroH, Biosynthesis of amino acids, Phenylalanine, tyrosine and tryptophan biosynthesis | chorismate mutase activity, metabolic process | 0.052 | 0.000 | 5.7 |
| 451 | K06929 | cofactor binding | 0.050 | 0.000 | 5.7 |
| 69 | | DNA binding, intracellular, phosphorelay signal transduction system, regulation of transcription, DNA-templated | 0.052 | 0.000 | 5.7 |
| 263 | K07047 | hydrolase activity, acting on carbon-nitrogen (but not peptide) bonds, metabolic process | 0.049 | 0.000 | 5.7 |
| 197 | Arginine and proline metabolism, PRODH | oxidation-reduction process, proline catabolic process to glutamate, proline dehydrogenase activity | 0.051 | 0.000 | 5.7 |
| 227 | paaG, Phenylalanine metabolism | catalytic activity, isomerase activity, metabolic process | 0.047 | 0.000 | 5.6 |
| 413 | Biosynthesis of amino acids, Carbon metabolism, Glycine, serine and threonine metabolism, Glycolysis/Gluconeogenesis, gpmB, Methane metabolism | catalytic activity, metabolic process | 0.046 | 0.000 | 5.6 |
| 143 | Carbon metabolism, Central carbon metabolism in cancer, Citrate cycle (TCA cycle), Glycolysis/Gluconeogenesis, HIF-1 signaling pathway, PDHB, pdhB, Pyruvate metabolism | catalytic activity, metabolic process, oxidation-reduction process, pyruvate dehydrogenase (acetyl-transferring) activity | 0.049 | 0.000 | 5.6 |
| 172 | nusA | cytoplasm, RNA binding, transcription antitermination, transcription factor activity, sequence-specific DNA binding, translation elongation factor activity, translational elongation | 0.047 | 0.000 | 5.6 |
| 407 | | DNA binding, intracellular, phosphorelay signal transduction system, regulation of transcription, DNA-templated | 0.047 | 0.000 | 5.6 |
| 301 | K07586 | | 0.047 | 0.000 | 5.6 |
| 354 | Glutathione metabolism, pepN | aminopeptidase activity, metallopeptidase activity, proteolysis, zinc ion binding | 0.044 | 0.000 | 5.5 |
| 411 | Amino sugar and nucleotide sugar metabolism, Fructose and mannose metabolism, manA, MPI | carbohydrate metabolic process, GDP-mannose biosynthetic process, mannose-6-phosphate isomerase activity, zinc ion binding | 0.044 | 0.000 | 5.5 |
| 218 | Amino sugar and nucleotide sugar metabolism, nagB, GNPDA | carbohydrate metabolic process, glucosamine-6-phosphate deaminase activity, hydrolase activity, N-acetylglucosamine metabolic process | 0.045 | 0.000 | 5.5 |
| 218 | Amino sugar and nucleotide sugar metabolism, nagB, GNPDA | carbohydrate metabolic process, glucosamine-6-phosphate deaminase activity, hydrolase activity, N-acetylglucosamine metabolic process | 0.045 | 0.000 | 5.5 |
| 400 | Amino sugar and nucleotide sugar metabolism, glmU | cell wall organization, cytoplasm, glucosamine-1-phosphate N-acetyltransferase activity, lipid A biosynthetic process, lipopolysaccharide biosynthetic process, magnesium ion binding, peptidoglycan biosynthetic process, regulation of cell shape, UDP-N-acetylglucosamine biosynthetic | 0.045 | 0.000 | 5.5 |

TABLE 5A-continued

Proteins expressed in the culture of the *Streptomyces* strain Strain C but not in that of the *Streptomyces* strain Strain B. Results are shown by KEGG pathway, by Gene Ontology (GO) description, means of levels for each strain (normalized spectra counts), and the fold-change computed as $\log_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 215 | Biosynthesis of amino acids, lysA, Lysine biosynthesis | process, UDP-N-acetylglucosamine diphosphorylase activity<br>diaminopimelate decarboxylase activity, lysine biosynthetic process via diaminopimelate, pyridoxal phosphate binding | 0.043 | 0.000 | 5.5 |
| 367 | | DNA binding, regulation of transcription, DNA-templated | 0.044 | 0.000 | 5.5 |
| 145 | | DNA binding, regulation of transcription, DNA-templated | 0.045 | 0.000 | 5.5 |
| 235 | | integral component of membrane | 0.044 | 0.000 | 5.5 |
| 144 | | isomerase activity, regulation of proteasomal protein catabolic process | 0.045 | 0.000 | 5.5 |
| 375 | mshD | mycothiol biosynthetic process, mycothiol synthase activity, N-acetyltransferase activity | 0.045 | 0.000 | 5.5 |
| 102 | FAH, fahA, Styrene degradation, Tyrosine metabolism | aromatic amino acid family metabolic process, fumarylacetoacetase activity | 0.041 | 0.000 | 5.4 |
| 228 | Base excision repair, tag | base-excision repair, DNA-3-methyladenine glycosylase activity | 0.040 | 0.000 | 5.4 |
| 384 | mqnD, Ubiqui and other terpenoid-qui biosynthesis | carbon-carbon lyase activity, menaqui biosynthetic process | 0.042 | 0.000 | 5.4 |
| 120 | Folate biosynthesis, folB | dihydroneopterin aldolase activity, folic acid biosynthetic process, tetrahydrofolate biosynthetic process | 0.041 | 0.000 | 5.4 |
| 51 | greA | DNA binding, regulation of DNA-templated transcription, elongation, RNA polymerase binding, translation elongation factor activity, translational elongation | 0.042 | 0.000 | 5.4 |
| 297 | | DNA binding, regulation of transcription, DNA-templated, transcription factor activity, sequence-specific DNA binding | 0.042 | 0.000 | 5.4 |
| 307 | CYP134A1, cypX | heme binding, iron ion binding, monooxygenase activity, oxidation-reduction process, oxidoreductase activity, acting on paired donors, with incorporation or reduction of molecular oxygen | 0.041 | 0.000 | 5.4 |
| 266 | Drug metabolism-other enzymes, guaB, Purine metabolism | IMP dehydrogenase activity, oxidation-reduction process, purine nucleotide biosynthetic process | 0.041 | 0.000 | 5.4 |
| 187 | K07040 | | 0.042 | 0.000 | 5.4 |
| 223 | | response to stress | 0.040 | 0.000 | 5.4 |
| 148 | gyrB | ATP binding, chromosome, cytoplasm, DNA binding, DNA topoisomerase type II (ATP-hydrolyzing) activity, DNA topological change, DNA-dependent DNA replication, magnesium ion binding | 0.039 | 0.000 | 5.3 |
| 410 | Amino sugar and nucleotide sugar metabolism, Fructose and mannose metabolism, manB | carbohydrate metabolic process, intramolecular transferase activity, phosphotransferases | 0.040 | 0.000 | 5.3 |
| 410 | Amino sugar and nucleotide sugar metabolism, Fructose and mannose metabolism, manB | carbohydrate metabolic process, intramolecular transferase activity, phosphotransferases, phosphomannomutase activity | 0.040 | 0.000 | 5.3 |
| 387 | 2-Oxocarboxylic acid metabolism, Biosynthesis of amino acids, Carbon metabolism, Citrate cycle (TCA cycle), CS, gltA, Glyoxylate and dicarboxylate metabolism | citrate (Si)-synthase activity, transferase activity, transferring acyl groups, acyl groups converted into alkyl on transfer, tricarboxylic acid cycle | 0.040 | 0.000 | 5.3 |
| 46 | Butanoate metabolism, E4.1.3.4, HMGCL, hmgL, Geraniol degradation, Peroxisome, Synthesis and degradation of ketone bodies, Valine, leucine and isoleucine degradation | hydroxymethylglutaryl-CoA lyase activity, lyase activity, metabolic process, transferase activity | 0.039 | 0.000 | 5.3 |
| 315 | ABC transporters, ABC.NGC.S | transport, transporter activity | 0.037 | 0.000 | 5.3 |
| 295 | mshC | ATP binding, cysteine-glucosaminylinositol ligase activity, mycothiol biosynthetic process, zinc ion binding | 0.035 | 0.000 | 5.2 |
| 426 | | bacterial-type RNA polymerase core enzyme binding, bacterial-type RNA polymerase holo enzyme binding, positive regulation of transcription, DNA-templated, response to antibiotic, zinc ion binding | 0.037 | 0.000 | 5.2 |
| 35 | idi, IDI, Terpenoid backbone biosynthesis | cytoplasm, dimethylallyl diphosphate biosynthetic process, hydrolase activity, isopentenyl-di phosphate delta-isomerase activity, isoprenoid biosynthetic process, metal ion binding | 0.035 | 0.000 | 5.2 |

TABLE 5A-continued

Proteins expressed in the culture of the *Streptomyces* strain Strain C but not in that of the *Streptomyces* strain Strain B. Results are shown by KEGG pathway, by Gene Ontology (GO) description, means of levels for each strain (normalized spectra counts), and the fold-change computed as $\log_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 37 | K06959 | DNA binding, DNA repair | 0.035 | 0.000 | 5.2 |
| 328 | | integral component of membrane | 0.035 | 0.000 | 5.2 |
| 333 | chlD, bchD, Porphyrin and chlorophyll metabolism | magnesium chelatase activity, metabolic process | 0.035 | 0.000 | 5.2 |
| 236 | Purine metabolism, rdgB | metal ion binding, nucleoside triphosphate catabolic process, nucleoside-triphosphatase activity, nucleoside-triphosphate diphosphatase activity, nucleotide binding, purine nucleotide metabolic process | 0.037 | 0.000 | 5.2 |
| 56 | bccA, Fatty acid biosynthesis, Fatty acid metabolism, Propanoate metabolism, Pyruvate metabolism, Tetracycline biosynthesis, Valine, leucine and isoleucine degradation | ATP binding, biotin carboxylase activity, metabolic process, metal ion binding | 0.032 | 0.000 | 5.1 |
| 56 | bccA, Fatty acid biosynthesis, Fatty acid metabolism, Propanoate metabolism, Pyruvate metabolism, Tetracycline biosynthesis, Valine, leucine and isoleucine degradation | ATP binding, biotin carboxylase activity, metabolic process, metal ion binding | 0.032 | 0.000 | 5.1 |
| 452 | Cysteine and methionine metabolism, E4.4.1.11, Selenocompound metabolism | catalytic activity, metabolic process, pyridoxal phosphate binding | 0.034 | 0.000 | 5.1 |
| 189 | hupB | chromosome condensation, DNA binding | 0.033 | 0.000 | 5.1 |
| 319 | E3.4.13.- | dipeptidase activity, hydrolase activity, metabolic process, proteolysis | 0.033 | 0.000 | 5.1 |
| 276 | Glycerophospholipid metabolism, pgsA, PGS1 | integral component of membrane, membrane, phospholipid biosynthetic process, phosphotransferase activity, for other substituted phosphate groups | 0.033 | 0.000 | 5.1 |
| 240 | Biosynthesis of amino acids, Biosynthesis of ansamycins, Carbon fixation in photosynthetic organisms, Carbon metabolism, E2.2.1.1, tktA, tktB, Pentose phosphate pathway | metabolic process, metal ion binding, transketolaseactivity | 0.033 | 0.000 | 5.1 |
| 471 | map | metal ion binding, metalloaminopeptidase activity, protein initiator methionine removal, proteolysis | 0.034 | 0.000 | 5.1 |
| 185 | Bacterial secretion system, Protein export, SRP54, ffh | 7S RNA binding, GTP binding, GTPase activity, metabolic process, signal recognition particle, SRP-dependent cotranslational protein targeting to membrane | 0.032 | 0.000 | 5.0 |
| 342 | ncd2, npd, Nitrogen metabolism | dioxygenase activity, nitronate monooxygenase activity, oxidation-reduction process | 0.031 | 0.000 | 5.0 |
| 389 | | catalytic activity, haloalkane dehalogenase activity, metabolic process | 0.029 | 0.000 | 4.9 |
| 320 | Starch and sucrose metabolism, treX, glgX | cation binding, glycogen catabolic process, glycogen debranching enzyme activity, hydrolase activity, hydrolyzing O-glycosyl compounds | 0.028 | 0.000 | 4.9 |
| 36 | | hydrolase activity, metabolic process | 0.029 | 0.000 | 4.9 |
| 110 | | hydrolase activity, metabolic process | 0.029 | 0.000 | 4.9 |
| 468 | Amino sugar and nucleotide sugar metabolism, Butirosin and neomycin biosynthesis, Carbon metabolism, Galactose metabolism, glk, Glycolysis/Gluconeogenesis, Starch and sucrose metabolism, *Streptomycin* biosynthesis | kinase activity, phosphorylation | 0.029 | 0.000 | 4.9 |
| 336 | E2.6.1.-B | metabolic process, transaminase activity | 0.029 | 0.000 | 4.9 |
| 449 | Biosynthesis of unsaturated fatty acids, Biotin metabolism, fabG, Fatty acid biosynthesis, Fatty acid metabolism | 3-oxoacyl-[acyl-carrier-protein] reductase (NADPH) activity, oxidation-reduction process, oxidoreductase activity | 0.027 | 0.000 | 4.8 |
| 156 | Biosynthesis of amino acids, CTH, Cysteine and methionine metabolism, Glycine, serine and threonine metabolism, Selenocompound metabolism | catalytic activity, metabolic process, pyridoxal phosphate binding | 0.028 | 0.000 | 4.8 |
| 474 | Carbon metabolism, Citrate cycle (TCA cycle), DLD, lpd, pdhD, Glycine, serine and threonine metabolism, Glycolysis/Gluconeogenesis, Pyruvate metabolism, Valine, leucine and isoleucine degradation | cell, cell redox homeostasis, flavin adenine dinucleotide binding, oxidation-reduction process, oxidoreductase activity | 0.027 | 0.000 | 4.8 |
| 175 | | DNA binding, regulation of transcription, DNA-templated | 0.027 | 0.000 | 4.8 |

TABLE 5A-continued

Proteins expressed in the culture of the *Streptomyces* strain Strain C but not in that of the *Streptomyces* strain Strain B. Results are shown by KEGG pathway, by Gene Ontology (GO) description, means of levels for each strain (normalized spectra counts), and the fold-change computed as $\log_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 356 | Biosynthesis of amino acids, Phenylalanine, tyrosine and tryptophan biosynthesis, trpC | indole-3-glycerol-phosphate synthase activity, tryptophan biosynthetic process | 0.027 | 0.000 | 4.8 |
| 45 | bccA, Fatty acid biosynthesis, Fatty acid metabolism, Propanoate metabolism, Pyruvate metabolism, Tetracycline biosynthesis, Valine, leucine and isoleucine degradation | ATP binding, biotin carboxylase activity, metabolic process, metal ion binding, methylcrotonoyl-CoA carboxylase activity | 0.025 | 0.000 | 4.7 |
| 42 | ABC transporters, rbsD | cytoplasm, D-ribose catabolic process, intramolecular lyase activity, monosaccharide binding | 0.026 | 0.000 | 4.7 |
| 428 | Phosphotransferase system (PTS), PTS-EI.PTSI ptsI | cytoplasm, kinase activity, metal ion binding, phosphoenolpyruvate-dependent sugar phosphotransferase system, phosphoenolpyruvate-protein phosphotransferase activity, phosphorylation | 0.024 | 0.000 | 4.7 |
| 473 | K06911 | dioxygenase activity, oxidation-reduction process | 0.025 | 0.000 | 4.7 |
| 53 | | integral component of membrane | 0.024 | 0.000 | 4.7 |
| 105 | mqnE, Ubiqui and other terpenoid-qui biosynthesis | 4 iron, 4 sulfur cluster binding, iron ion binding, menaqui biosynthetic process, transferase activity, transferring alkyl or aryl (other than methyl) groups | 0.023 | 0.000 | 4.6 |
| 463 | glbN | heme binding, oxygen binding | 0.023 | 0.000 | 4.6 |
| 461 | | hydrolase activity, metabolic process | 0.022 | 0.000 | 4.6 |
| 373 | | integral component of membrane | 0.023 | 0.000 | 4.6 |
| 155 | | beta-lactamase activity, metabolic process | 0.022 | 0.000 | 4.5 |
| 306 | | DNA binding, regulation of transcription, DNA-templated | 0.022 | 0.000 | 4.5 |
| 369 | Base excision repair, nfo | deoxyribonuclease IV (phage-T4-induced) activity, DNA binding, DNA repair, nucleic acid phosphodiester bond hydrolysis, zinc ion binding | 0.021 | 0.000 | 4.4 |
| 149 | Carbon metabolism, Glutathione metabolism, Pentose phosphate pathway, PGD, gnd | NADP binding, oxidation-reduction process, pentose-phosphate shunt, phosphogluconate dehydrogenase (decarboxylating) activity | 0.020 | 0.000 | 4.4 |
| 25 | egtD, Histidine metabolism | | 0.020 | 0.000 | 4.4 |
| 397 | tam | cytoplasm, methylation, trans-aconitate 2-methyltransferase activity | 0.019 | 0.000 | 4.3 |
| 132 | Aminobenzoate degradation, Bisphenol degradation, E1.14.-.-, E1.14.14.1, Fatty acid degradation, Limonene and pinene degradation, Polycyclic aromatic hydrocarbon degradation, Stilbenoid, diarylheptanoid and gingerol biosynthesis, Tryptophan metabolism | heme binding, iron ion binding, monooxygenase activity, oxidation-reduction process, oxidoreductase activity, acting on paired donors, with incorporation or reduction of molecular oxygen | 0.019 | 0.000 | 4.3 |
| 386 | Aminobenzoate degradation, Bisphenol degradation, E1.14.-.-, Limonene and pinene degradation, Polycyclic aromatic hydrocarbon degradation, Stilbenoid, diarylheptanoid and gingerol biosynthesis | heme binding, iron ion binding, monooxygenase activity, oxidation-reduction process, oxidoreductase activity, acting on paired donors, with incorporation or reduction of molecular oxygen | 0.017 | 0.000 | 4.2 |
| 312 | paaX | transcription, DNA-templated | 0.017 | 0.000 | 4.2 |
| 226 | mrp, NUBPL | ATP binding | 0.016 | 0.000 | 4.1 |
| 390 | | DNA binding, regulation of transcription, DNA-templated | 0.016 | 0.000 | 4.1 |
| 253 | | DNA binding, regulation of transcription, DNA-templated, transcription factor activity, sequence-specific DNA binding | 0.016 | 0.000 | 4.1 |
| 348 | yhbJ | ATP binding, GTP binding | 0.015 | 0.000 | 4.0 |
| 137 | Biotin metabolism, fabF, Fatty acid biosynthesis, Fatty acid metabolism | beta-ketoacyl-acyl-carrier-protein synthase II activity, fatty acid biosynthetic process | 0.015 | 0.000 | 4.0 |
| 414 | Bacterial secretion system, Protein export, secA | ATP binding, cytoplasm, intracellular protein transmembrane transport, plasma membrane, protein import, protein targeting | 0.014 | 0.000 | 3.9 |
| 221 | SIG3.2, rpoE | DNA binding, DNA-templated transcription, initiation, regulation of transcription, DNA-templated, sigma factor activity, transcription factor activity, sequence-specific DNA binding | 0.014 | 0.000 | 3.9 |
| 362 | | zinc ion binding | 0.014 | 0.000 | 3.9 |
| 383 | Amino sugar and nucleotide sugar metabolism, murQ | carbohydrate binding, carbohydrate metabolic process, carbon-oxygen lyase activity, kinase activity, N-acetylmuramic acid catabolic process, phosphorylation | 0.013 | 0.000 | 3.8 |
| 454 | SIG3.2, rpoE | DNA binding, DNA-templated transcription, initiation, regulation of transcription, DNA- | 0.013 | 0.000 | 3.8 |

TABLE 5A-continued

Proteins expressed in the culture of the *Streptomyces* strain Strain C but not in that of the *Streptomyces* strain Strain B. Results are shown by KEGG pathway, by Gene Ontology (GO) description, means of levels for each strain (normalized spectra counts), and the fold-change computed as log$_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| | | templated, sigma factor activity, transcription factor activity, sequence-specific DNA binding | | | |
| 401 | Purine metabolism, rdgB | ATP diphosphatase activity, hydrolase activity, methylation, methyltransferase activity | 0.012 | 0.000 | 3.7 |
| 364 | yfiH | | 0.012 | 0.000 | 3.7 |
| 255 | allB, Purine metabolism | allantoin catabolic process, allantoinase activity, cobalt ion binding, purine nucleobase metabolic process, zinc ion binding | 0.011 | 0.000 | 3.6 |
| 435 | glgE, Starch and sucrose metabolism | alpha-glucan biosynthetic process, cation binding, hydrolase activity, hydrolyzing O-glycosyl compounds, transferase activity, transferring hexosyl groups | 0.011 | 0.000 | 3.6 |
| 290 | | DNA binding, DNA biosynthetic process, DNA repair, DNA-directed DNA polymerase activity, exonuclease activity, nucleic acid phosphodiester bond hydrolysis | 0.011 | 0.000 | 3.6 |
| 327 | Cysteine and methionine metabolism, Sulfur metabolism, Sulfur relay system, TST, MPST, sseA | metabolic process, thiosulfate sulfurtransferase activity | 0.011 | 0.000 | 3.6 |
| 442 | nadA, Nicotinate and nicotinamide metabolism | 4 iron, 4 sulfur cluster binding, cytoplasm, metal ion binding, NAD biosynthetic process, quinolinate biosynthetic process, quinolinate synthetase A activity, transferase activity, transferring alkyl or aryl (other than methyl) groups | 0.010 | 0.000 | 3.5 |
| 365 | Lysine biosynthesis, murF, Peptidoglycan biosynthesis, Vancomycin resistance | ATP binding, cell cycle, cell division, cell wall organization, cytoplasm, peptidoglycan biosynthetic process, regulation of cell shape, UDP-N-acetylmuramoyl-tripeptide-D-alanyl-D-alanine ligase activity, UDP-N-acetylmuramoylalanyl-D-glutamyl-2,6-diaminopimelate-D-alanyl-D-alanine ligase activity | 0.011 | 0.000 | 3.5 |
| 48 | E3.2.1.4, Starch and sucrose metabolism | cellulose catabolic process, hydrolase activity, hydrolyzing O-glycosyl compounds | 0.011 | 0.000 | 3.5 |
| 61 | SIG3.2, rpoE | DNA binding, DNA-templated transcription, initiation, intracellular, regulation of transcription, DNA-templated, sigma factor activity, transcription factor activity, sequence-specific DNA binding, transport | 0.010 | 0.000 | 3.5 |
| 475 | | hydrolase activity, metabolic process | 0.010 | 0.000 | 3.5 |
| 418 | terA | response to stress | 0.011 | 0.000 | 3.5 |
| 446 | Amino sugar and nucleotide sugar metabolism, Fructose and mannose metabolism, K16881 | biosynthetic process, carbohydrate metabolic process, intramolecular transferase activity, phosphotransferases, mannose-1-phosphate guanylyltransferase activity, nucleotidyltransferase activity | 0.010 | 0.000 | 3.4 |
| 160 | Biosynthesis of amino acids, hisC, Histidine metabolism, Novobiocin biosynthesis, Phenylalanine metabolism, Phenylalanine, tyrosine and tryptophan biosynthesis, Tropane, piperidine and pyridine alkaloid biosynthesis, Tyrosine metabolism | histidine biosynthetic process, histidinol-phosphate transaminase activity, pyridoxal phosphate binding | 0.008 | 0.000 | 3.2 |
| 165 | Purine metabolism, purL, PFAS | 'de novo' IMP biosynthetic process, ATP binding, cytoplasm, magnesium ion binding, phosphoribosylformylglycinamidine synthase activity | 0.007 | 0.000 | 3.0 |
| 109 | cobA-hemD, Porphyrin and chlorophyll metabolism | methylation, methyltransferase activity, oxidation-reduction process, porphyrin-containing compound biosynthetic process, precorrin-2 dehydrogenase activity, uroporphyrin-III C-methyltransferase activity, uroporphyrinogen-III synthase activity | 0.006 | 0.000 | 2.9 |
| 282 | Pentose and glucuronate interconversions, xylB, XYLB | carbohydrate metabolic process, carbohydrate phosphorylation, kinase activity, phosphorylation, phosphotransferase activity, alcohol group as acceptor, xylulokinase activity | 0.006 | 0.000 | 2.7 |
| 388 | | regulation of transcription, DNA-templated | 0.006 | 0.000 | 2.7 |

TABLE 5B

Proteins not expressed in the culture of the *Streptomyces* strain Strain C but were expressed in that of the *Streptomyces* strain Strain B. Results are shown by KEGG pathway, by Gene Ontology (GO) description, means of levels for each strain (normalized spectra counts), and the fold-change computed as $\log_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 439 | Carbon metabolism, Citrate cycle (TCA cycle), DLD, lpd, pdhD, Glycine, serine and threonine metabolism, Glycolysis/Gluconeogenesis, Pyruvate metabolism, Valine, leucine and isoleucine degradation | cell, cell redox homeostasis, dihydrolipoyl dehydrogenase activity, flavin adenine dinucleotide binding, glycolytic process, oxidation-reduction process | 0.000 | 2.305 | −11.2 |
| 308 | pepP | aminopeptidase activity, manganese ion binding, proteolysis | 0.000 | 0.647 | −9.3 |
| 224 | | ATP binding | 0.000 | 0.462 | −8.9 |
| 334 | | integral component of membrane | 0.000 | 0.310 | −8.3 |
| 374 | ABC transporters, pstB | ATP binding, ATP-binding cassette (ABC) transporter complex, inorganic phosphate transmembrane transporter activity, metabolic process, phosphate ion transmembrane transport, phosphate ion transmembrane-transporting ATPase activity | 0.000 | 0.303 | −8.2 |
| 151 | Pyrimidine metabolism, Selenocompound metabolism, trxB | cytoplasm, oxidation-reduction process, removal of superoxide radicals, thioredoxin-disulfide reductase activity | 0.000 | 0.243 | −7.9 |
| 83 | Ribosome, RP-L16, MRPL16, rplP | ribosome, rRNA binding, structural constituent of ribosome, translation, tRNA binding | 0.000 | 0.245 | −7.9 |
| 244 | | isomerase activity, metabolic process | 0.000 | 0.221 | −7.8 |
| 247 | Butanoate metabolism, Carbon metabolism, ccrA | crotonyl-CoA reductase activity, oxidation-reduction process, zinc ion binding | 0.000 | 0.210 | −7.7 |
| 76 | Purine metabolism, Pyrimidine RNA polymerase, rpoA | metabolism, DNA binding, DNA-directed RNA polymerase activity, protein dimerization activity, transcription, DNA-templated | 0.000 | 0.204 | −7.7 |
| 462 | Biosynthesis of amino acids, Carbon metabolism, Cyanoamino acid metabolism, glyA, SHMT, Glycine, serine and threonine metabolism, Glyoxylate and dicarboxylate metabolism, Methane metabolism, One carbon pool by folate | cytoplasm, glycine biosynthetic process from serine, glycine hydroxymethyltransferase activity, methylation, pyridoxal phosphate binding, methyltransferase activity, tetrahydrofolate interconversion | 0.000 | 0.192 | −7.6 |
| 246 | | dipeptidyl-peptidase activity, proteolysis | 0.000 | 0.196 | −7.6 |
| 305 | coxA, Oxidative phosphorylation | aerobic respiration, copper ion binding, cytochrome-c oxidase activity, electron transport chain, heme binding, hydrogen ion transmembrane transport, integral component of membrane, iron ion binding, plasma membrane, respiratory chain | 0.000 | 0.165 | −7.4 |
| 429 | coxA, Oxidative phosphorylation | aerobic respiration, copper ion binding, cytochrome-c oxidase activity, electron transport chain, heme binding, hydrogen ion transmembrane transport, integral component of membrane, iron ion binding, plasma membrane, respiratory chain | 0.000 | 0.165 | −7.4 |
| 438 | coxA, Oxidative phosphorylation | aerobic respiration, copper ion binding, cytochrome-c oxidase activity, electron transport chain, heme binding, hydrogen ion transmembrane transport, integral component of membrane, iron ion binding, plasma membrane, respiratory chain | 0.000 | 0.165 | −7.4 |
| 250 | beta-Alanine metabolism, DPYS, dht, hydA, Drug metabolism-other enzymes, Pantothenate and CoA biosynthesis, Pyrimidine metabolism | cytoplasm, dihydropyrimidinase activity, hydrolase activity, acting on carbon-nitrogen (but not peptide) bonds, metabolic process, metal ion binding | 0.000 | 0.164 | −7.4 |
| 44 | Arginine and proline metabolism, E3.5.3.11, speB | agmatinase activity, guanidinobutyrase activity, metabolic process, metal ion binding | 0.000 | 0.153 | −7.3 |
| 288 | | oxidation-reduction process, oxidoreductase activity | 0.000 | 0.159 | −7.3 |
| 111 | | oxidation-reduction process, peroxidase activity, peroxiredoxin activity | 0.000 | 0.142 | −7.2 |

TABLE 5B-continued

Proteins not expressed in the culture of the *Streptomyces* strain Strain C but were expressed in that of the *Streptomyces* strain Strain B. Results are shown by KEGG pathway, by Gene Ontology (GO) description, means of levels for each strain (normalized spectra counts), and the fold-change computed as $\log_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 258 | Purine metabolism, uraH, pucM, hiuH | hydroxyisourate hydrolase activity, purine nucleobase metabolic process | 0.000 | 0.133 | −7.1 |
| 460 | Alanine, aspartate and glutamate metabolism, Butanoate metabolism, gabD, Lysine degradation, Tyrosine metabolism | oxidation-reduction process, oxidoreductase activity, acting on the aldehyde or oxo group of donors, NAD or NADP as acceptor, succinate-semialdehyde dehydrogenase (NAD+) activity | 0.000 | 0.133 | −7.1 |
| 477 | | oxidation-reduction process, peroxidase activity, peroxiredoxin activity | 0.000 | 0.133 | −7.1 |
| 457 | Arginine and proline metabolism, Atrazine degradation, Epithelial cell signaling in *Helicobacter pylori* infection, Purine metabolism, ureC | cytoplasm, nickel cation binding, urea catabolic process, urease activity | 0.000 | 0.125 | −7.0 |
| 300 | | hydrolase activity, metabolic process, triglyceride lipase activity | 0.000 | 0.131 | −7.0 |
| 72 | groES, HSPE1 | ATP binding, cytoplasm, protein folding | 0.000 | 0.112 | −6.8 |
| 169 | Biosynthesis of amino acids, dapB, Lysine biosynthesis | 4-hydroxy-tetrahydrodipicolinate reductase, cytoplasm, diaminopimelate biosynthetic process, lysine biosynthetic process via diaminopimelate, NAD binding, NADP binding, oxidation-reduction process, oxidoreductase activity, acting on CH or CH2 groups, NAD or NADP as acceptor | 0.000 | 0.105 | −6.7 |
| 231 | ABC transporters, beta-Lactam resistance, oppD | ATP binding, ATPase activity, metabolic process, peptide transport | 0.000 | 0.098 | −6.6 |
| 338 | RNA transport, rnz | 3'-tRNA processing endoribonuclease activity, tRNA 3-trailer cleavage, endonucleolytic, zinc ion binding | 0.000 | 0.082 | −6.4 |
| 455 | Arginine and proline metabolism, Atrazine degradation, Purine metabolism, ureA | cytoplasm, nickel cation binding, urea catabolic process, urease activity | 0.000 | 0.084 | −6.4 |
| 456 | Arginine and proline metabolism, Atrazine degradation, Purine metabolism, ureB | cytoplasm, urea catabolic process, urease activity | 0.000 | 0.085 | −6.4 |
| 112 | Purine metabolism, yagS | flavin adenine dinucleotide binding, oxidation-reduction process, oxidoreductase activity, acting on CH—OH group of donors | 0.000 | 0.085 | −6.4 |
| 103 | nuoG, Oxidative phosphorylation | 4 iron, 4 sulfur cluster binding, ATP synthesis coupled electron transport, electron carrier activity, membrane, molybdenum ion binding, NADH dehydrogenase (ubiqui) activity | 0.000 | 0.080 | −6.3 |
| 283 | 2-Oxocarboxylic acid metabolism, argC, Arginine and proline metabolism, Biosynthesis of amino acids | arginine biosynthetic process, cytoplasm, N-acetyl-gamma-glutamyl-phosphater eductase activity, NAD binding, oxidation-reduction process, protein dimerization activity | 0.000 | 0.078 | −6.3 |
| 98 | Arginine and proline metabolism, codA, Pyrimidine metabolism | cytosine deaminase activity, metabolic process | 0.000 | 0.080 | −6.3 |
| 234 | | integral component of membrane | 0.000 | 0.079 | −6.3 |
| 403 | | integral component of membrane | 0.000 | 0.073 | −6.2 |
| 68 | One carbon pool by folate, Purine metabolism, purN | 'de novo' IMP biosynthetic process, methylation, methyltransferase activity, phosphoribosylglycinamide formyltransferase activity | 0.000 | 0.066 | −6.1 |
| 322 | aidB | acyl-CoA dehydrogenase activity, flavin adenine dinucleotide binding, oxidation-reduction process | 0.000 | 0.070 | −6.1 |
| 138 | cpo | chloride peroxidase activity, hydrolase activity, oxidation-reduction process, peroxidase activity | 0.000 | 0.066 | −6.1 |
| 355 | Oxidative phosphorylation, qcrB | electron carrier activity, hydrogen ion transmembrane transport, integral component of membrane, oxidoreductase activity, respiratory electron transport chain, ubiquinol-cytochrome-c reductase activity | 0.000 | 0.069 | −6.1 |
| 261 | | flavin adenine dinucleotide binding, oxidation-reduction process, oxidoreductase activity, acting on CH—OH group of donors, xanthine dehydrogenase activity | 0.000 | 0.066 | −6.1 |

TABLE 5B-continued

Proteins not expressed in the culture of the *Streptomyces* strain Strain C but were expressed in that of the *Streptomyces* strain Strain B. Results are shown by KEGG pathway, by Gene Ontology (GO) description, means of levels for each strain (normalized spectra counts), and the fold-change computed as $\log_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 248 | | integral component of membrane, oxidation-reduction process, oxidoreductase activity | 0.000 | 0.065 | −6.1 |
| 251 | Alanine, aspartate and glutamate metabolism, beta-Alanine metabolism, Butanoate metabolism, Propanoate metabolism, puuE | metabolic process, pyridoxal phosphate binding, transaminase activity | 0.000 | 0.070 | −6.1 |
| 260 | Carbon fixation pathways in prokaryotes, Carbon metabolism, coxS, Methane metabolism, Nitrotoluene degradation | 2 iron, 2 sulfur cluster binding, electron carrier activity, metal ion binding, oxidation-reduction process, oxidoreductase activity, xanthine dehydrogenase activity | 0.000 | 0.062 | −6.0 |
| 347 | Alzheimer's disease, Biosynthesis of amino acids, Carbon fixation in photosynthetic organisms, Carbon metabolism, GAPDH, gapA, Glycolysis/Gluconeogenesis, HIF-1 signaling pathway | glucose metabolic process, glyceraldehyde-3-phosphate dehydrogenase (NAD+) (phosphorylating) activity, NAD binding, NADP binding, oxidation-reduction process | 0.000 | 0.058 | −5.9 |
| 157 | dgoD, Galactose metabolism | catalytic activity, metabolic process, metal ion binding | 0.000 | 0.056 | −5.8 |
| 470 | | extracellular region, proteolysis, serine-type endopeptidase activity | 0.000 | 0.051 | −5.7 |
| 65 | | oxidation-reduction process, peroxidase activity, peroxiredoxin activity | 0.000 | 0.052 | −5.7 |
| 368 | Thiamine metabolism, thiE | magnesium ion binding, thiamine biosynthetic process, thiamine diphosphate biosynthetic process, thiamine-phosphate diphosphorylase activity | 0.000 | 0.044 | −5.5 |
| 268 | pyrF, Pyrimidine metabolism | 'de novo' pyrimidine nucleobase biosynthetic process, 'de novo' UMP biosynthetic process, orotidine-5'-phosphate decarboxylase activity | 0.000 | 0.042 | −5.4 |
| 323 | | metallopeptidase activity, proteolysis | 0.000 | 0.040 | −5.4 |
| 62 | Butanoate metabolism, Carbon fixation pathways in prokaryotes, Carbon metabolism, Citrate cycle (TCA cycle), Oxidative phosphorylation, sdhD, frdD | integral component of membrane, oxidation-reduction process, oxidoreductase activity, acting on the CH—CH group of donors | 0.000 | 0.037 | −5.3 |
| 191 | | 5-carboxymethyl-2-hydroxymuconate delta-isomerase activity, isomerase activity, metabolic process, ureidoglycolate lyase activity | 0.000 | 0.030 | −5.0 |
| 174 | | cellulase activity, polysaccharide catabolic process | 0.000 | 0.030 | −4.9 |
| 340 | Biosynthesis of amino acids, dapA, Lysine biosynthesis | 4-hydroxy-tetrahydrodipicolinate synthase, lyase activity, metabolic process | 0.000 | 0.027 | −4.8 |
| 391 | pat, Phosphonate and phosphinate metabolism | metabolic process, N-acetyltransferase activity | 0.000 | 0.023 | −4.6 |
| 164 | K07045 | hydrolase activity, metabolic process | 0.000 | 0.020 | −4.4 |
| 331 | actP | integral component of membrane, plasma membrane, transmembrane transport, transporter activity | 0.000 | 0.019 | −4.3 |
| 100 | nuoH, Oxidative phosphorylation | integral component of membrane, oxidation-reduction process, oxidoreductase activity, acting on NAD(P)H, qui or similar compound as acceptor, plasma membrane, qui binding | 0.000 | 0.017 | −4.1 |
| 232 | Mismatch repair, xseA | cytoplasm, DNA catabolic process, exodeoxyribonuclease VII activity, exodeoxyribonuclease VII complex, nucleic acid binding, nucleic acid phosphodiester bond hydrolysis | 0.000 | 0.014 | −3.9 |
| 382 | Biosynthesis of amino acids, Glycine, serine and threonine metabolism, thrC, Vitamin B6 metabolism | metabolic process, threonine synthase activity | 0.000 | 0.010 | −3.5 |
| 129 | | integral component of membrane, plasma membrane, transmembrane transport | 0.000 | 0.009 | −3.4 |

TABLE 5B-continued

Proteins not expressed in the culture of the *Streptomyces* strain Strain C but were expressed in that of the *Streptomyces* strain Strain B. Results are shown by KEGG pathway, by Gene Ontology (GO) description, means of levels for each strain (normalized spectra counts), and the fold-change computed as $\log_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 353 | | 4 iron, 4 sulfur cluster binding, formate dehydrogenase (NAD+) activity, molybdenum ion binding, nitrate reductase activity, oxidation-reduction process | 0.000 | 0.006 | −2.7 |

TABLE 5C

Proteins expressed in the culture of the *Streptomyces* strain Strain C at a higher level than were expressed in the culture of the *Streptomyces* strain Strain B. Results are shown by KEGG pathway, by Gene Ontology (GO) description, means of levels for each strain (normalized spectra counts), and the fold-change computed as $\log_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 303 | Alanine, aspartate and glutamate metabolism, ald, Taurine and hypotaurine metabolism | alanine dehydrogenase activity, L-alanine catabolic process, oxidation-reduction process | 0.690 | 0.004 | 7.2 |
| 445 | Glutathione metabolism, pepN | aminopeptidase activity, metallopeptidase activity, proteolysis, zinc ion binding | 0.222 | 0.001 | 6.8 |
| 135 | dnaK, RNA degradation, Tuberculosis | ATP binding, protein folding, unfolded protein binding | 0.260 | 0.001 | 6.7 |
| 78 | Ribosome, RP-S13, rpsM | ribosome, rRNA binding, structural constituent of ribosome, translation, tRNA binding | 0.865 | 0.007 | 6.7 |
| 233 | Carbon fixation pathways in prokaryotes, Carbon metabolism, Citrate cycle (TCA cycle), E4.2.1.2A, fumA, fumB, Pyruvate metabolism | fumarate hydratase activity, generation of precursor metabolites and energy | 0.145 | 0.002 | 5.8 |
| 196 | Alanine, aspartate and glutamate metabolism, Arginine and proline metabolism, E1.2.1.88 | 1-pyrroline-5-carboxylate dehydrogenase activity, glutamate biosynthetic process, oxidation-reduction process, oxidoreductase activity, acting on the aldehyde or oxo group of donors, NAD or NADP as acceptor, proline biosynthetic process | 0.643 | 0.023 | 4.7 |
| 95 | Ribosome, RP-L10, MRPL10, rplJ | large ribosomal subunit rRNA binding, ribosome, ribosome biogenesis, structural constituent of ribosome, translation | 0.249 | 0.012 | 4.3 |
| 293 | TRM61, GCD14 | tRNA (adenine-N1-)-methyltransferase activity, tRNA (m1A) methyltransferase complex, tRNA methylation | 0.076 | 0.003 | 4.3 |
| 267 | Aminoacyl-tRNA biosynthesis, MTFMT, fmt, One carbon pool by folate | conversion of methionyl-tRNA to N-formyl-methionyl-tRNA, methionyl-tRNA formyltransferase activity, translational initiation | 0.069 | 0.003 | 4.2 |
| 167 | RNA degradation, rnj | 5'-3 exoribonuclease activity, endoribonuclease activity, RNA binding, RNA phosphodiester bond hydrolysis, endonucleolytic, RNA phosphodiester bond hydrolysis, exonucleolytic, RNA processing, zinc ion binding | 0.233 | 0.013 | 4.1 |
| 421 | E3.1.1.41, Penicillin and cephalosporin biosynthesis | cephalosporin-C deacetylase activity, metabolic process | 0.105 | 0.006 | 3.9 |
| 256 | Carbon metabolism, E2.3.3.9, aceB, glcB, Glyoxylate and dicarboxylate metabolism, Pyruvate metabolism | glyoxylate cycle, malate synthase activity, tricarboxylic acid cycle | 0.173 | 0.011 | 3.9 |
| 38 | beta-Alanine metabolism, Biosynthesis of unsaturated fatty acids, Butanoate metabolism, Caprolactam degradation, Carbon metabolism, fadJ, Fatty acid degradation, Fatty acid metabolism, Geraniol degradation, Limonene and pinene degradation, Lysine degradation, Propanoate metabolism, Tryptophan metabolism, Valine, leucine and isoleucine degradation | 3-hydroxyacyl–CoA dehydrogenase activity, fatty acid beta-oxidation | 0.029 | 0.001 | 3.7 |

TABLE 5C-continued

Proteins expressed in the culture of the *Streptomyces* strain Strain C at a higher level than were expressed in the culture of the *Streptomyces* strain Strain B. Results are shown by KEGG pathway, by Gene Ontology (GO) description, means of levels for each strain (normalized spectra counts), and the fold-change computed as log$_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 154 | Ribosome, RP-S18, MRPS18, rpsR | ribosome, rRNA binding, structural constituent of ribosome, translation | 0.657 | 0.049 | 3.7 |
| 291 | dgt, Purine metabolism | dGTPase activity, GTP metabolic process, magnesium ion binding | 0.053 | 0.004 | 3.4 |
| 168 | E2.1.1.148, thyX, thy1, One carbon pool by folate, Pyrimidine metabolism | dTMP biosynthetic process, flavin adenine dinucleotide binding, methylation, thymidylate synthase (FAD) activity | 0.257 | 0.023 | 3.4 |
| 264 | Carbohydrate digestion and absorption, E3.2.1.1, amyA, malS, Starch and sucrose metabolism | alpha-amylase activity, carbohydrate metabolic process, cation binding, starch binding | 0.044 | 0.004 | 3.2 |
| 207 | ybbN | cell, cell redox homeostasis, glycerol ether metabolic process, oxidation-reduction process, protein disulfide oxidoreductase activity | 0.109 | 0.012 | 3 |
| 225 | K07053 | DNA binding, DNA biosynthetic process, DNA replication, DNA-directed DNA polymerase activity, hydrolase activity | 0.069 | 0.008 | 2.9 |
| 448 | Carbon metabolism, GLDC, gcvP, Glycine, serine and threonine metabolism | glycine decarboxylation via glycine cleavage system, glycine dehydrogenase (decarboxylating) activity, oxidation-reduction process | 0.442 | 0.057 | 2.9 |
| 184 | Ribosome, RP-S16, MRPS16, rpsP | ribosome, structural constituent of ribosome, translation | 0.567 | 0.080 | 2.8 |
| 262 | None | 1,4-alpha-glucan branching enzyme activity, carbohydrate binding, carbohydrate metabolic process, cation binding, neopullulanase activity, pullulanase activity | 0.233 | 0.036 | 2.7 |
| 313 | 2-Oxocarboxylic acid metabolism, ACO, acnA, Biosynthesis of amino acids, Carbon fixation pathways in prokaryotes, Carbon metabolism, Citrate cycle (TCA cycle), Glyoxylate and dicarboxylate metabolism | 4 iron, 4 sulfur cluster binding, aconitate hydratase activity, metabolic process | 0.497 | 0.074 | 2.7 |
| 279 | 2-Oxocarboxylic acid metabolism, Biosynthesis of amino acids, E2.6.1.42, ilvE, Pantothenate and CoA biosynthesis, Valine, leucine and isoleucine biosynthesis, Valine, leucine and isoleucine degradation | 4-amino-4-deoxychorismate lyase activity, metabolic process, transaminase activity | 0.057 | 0.008 | 2.7 |
| 459 | Arginine and proline metabolism, E2.6.1.13, rocD | metabolic process, ornithine-oxo-acid transaminase activity, pyridoxal phosphate binding, transaminase activity | 0.068 | 0.010 | 2.6 |
| 350 | terZ | response to stress | 0.125 | 0.021 | 2.6 |
| 147 | gyrA | ATP binding, chromosome, cytoplasm, DNA binding, DNA topoisomerase type II (ATP-hydrolyzing) activity, DNA topological change, DNA-dependent DNA replication | 0.168 | 0.028 | 2.5 |
| 326 | gyrB | ATP binding, DNA binding, DNA topoisomerase type II (ATP-hydrolyzing) activity, DNA topological change | 0.038 | 0.006 | 2.5 |
| 126 | topA | DNA binding, DNA topoisomerase type I activity, DNA topological change, magnesium ion binding | 0.218 | 0.038 | 2.5 |
| 82 | Ribosome, RP-S17, MRPS17, rpsQ | ribosome, rRNA binding, structural constituent of ribosome, translation | 1.308 | 0.232 | 2.5 |
| 433 | None | carbohydrate metabolic process, glucan endo-1,3-beta-D-glucosidase activity, hydrolase activity, hydrolyzing O-glycosyl compounds | 0.039 | 0.007 | 2.3 |
| 444 | E2.7.1.20, ADK, Purine metabolism | adenosine kinase activity, AMP biosynthetic process, carbohydrate phosphorylation, | 0.191 | 0.041 | 2.2 |

TABLE 5C-continued

Proteins expressed in the culture of the *Streptomyces* strain Strain C at a higher level than were expressed in the culture of the *Streptomyces* strain Strain B. Results are shown by KEGG pathway, by Gene Ontology (GO) description, means of levels for each strain (normalized spectra counts), and the fold-change computed as $\log_2$ StrainC/StrainB spectra count (normalized spectra counts of StrainC/StrainB).

| SEQ ID | KEGG | GO | Strain C mean | Strain B mean | Fold-change |
|---|---|---|---|---|---|
| 341 | Selenocompound metabolism, sufS | D-ribose metabolic process, phosphorylation, ribokinase activity cysteine desulfurase activity, cysteine metabolic process, pyridoxal phosphate binding | 0.080 | 0.017 | 2.2 |
| 361 | rluD | lyase activity, pseudouridine synthase activity, pseudouridine synthesis, RNA binding | 0.023 | 0.004 | 2.2 |
| 393 | Cysteine and methionine metabolism, E2.4.2.28, mtaP | nucleoside metabolic process, S-methyl-5-thioadenosine phosphorylase activity | 0.061 | 0.012 | 2.2 |
| 237 | rph | RNA phosphodiester bond hydrolysis, tRNA binding, tRNA nucleotidyltransferase activity, tRNA processing, tRNA-specific ribonuclease activity | 0.150 | 0.032 | 2.2 |
| 66 | Carbon fixation in photosynthetic organisms, Carbon fixation pathways in prokaryotes, Carbon metabolism, Citrate cycle (TCA cycle), Cysteine and methionine metabolism, Glyoxylate and dicarboxylate metabolism, mdh, Methane metabolism, Pyruvate metabolism | carbohydrate metabolic process, L-malate dehydrogenase activity, malate metabolic process, tricarboxylic acid cycle | 0.577 | 0.135 | 2.1 |
| 349 | None | hydrolase activity, metabolic process | 0.058 | 0.013 | 2.1 |
| 200 | ABC.PE.A1 | ATP binding, ATPase activity, metabolic process, peptide transport | 0.051 | 0.012 | 2 |
| 201 | ABC.PE.A | ATP binding, ATPase activity, metabolic process, peptide transport | 0.067 | 0.016 | 2 |
| 274 | Bacterial secretion system, Protein export, secF | integral component of membrane, intracellular, intracellular protein transmembrane transport, P-P-bond-hydrolysis-driven protein transmembrane transporter activity, plasma membrane, protein targeting, protein transport by the Sec complex | 0.019 | 0.004 | 2 |
| 273 | Ribosome, RP-S4, rpsD | rRNA binding, small ribosomal subunit, structural constituent of ribosome, translation | 1.030 | 0.277 | 1.9 |
| 209 | Benzoate degradation, Butanoate metabolism, Carbon fixation pathways in prokaryotes, Carbon metabolism, E2.3.1.9, atoB, Fatty acid degradation, Fatty acid metabolism, Glyoxylate and dicarboxylate metabolism, Lysine degradation, Propanoate metabolism, Pyruvate metabolism, Synthesis and degradation of ketone bodies, Terpenoid backbone biosynthesis, Tryptophan metabolism, Two-component system, Valine, leucine and isoleucine degradation | acetyl-CoA C-acetyltransferase activity, metabolic process | 0.215 | 0.063 | 1.8 |
| 309 | None | monooxygenase activity, oxidation-reduction process, oxidoreductase activity, acting on paired donors, with incorporation or reduction of molecular oxygen | 0.119 | 0.034 | 1.8 |
| 430 | Biosynthesis of amino acids, Carbon fixation in photosynthetic organisms, Carbon metabolism, Fructose and mannos metabolism, Pentose phosphate pathway, rpiB | carbohydrate metabolic process, ribose-5-phosphate isomerase activity | 0.193 | 0.064 | 1.6 |
| 360 | None | hydrolase activity, metabolic process | 0.030 | 0.009 | 1.6 |
| 171 | Ribosome, RP-S15, MRPS15, rpsO | ribosome, rRNA binding, structural constituent of ribosome, translation | 0.900 | 0.298 | 1.6 |

TABLE 5C-continued

Proteins expressed in the culture of the *Streptomyces* strain Strain C at a higher level than were expressed in the culture of the *Streptomyces* strain Strain B. Results are shown by KEGG pathway, by Gene Ontology (GO) description, means of levels for each strain (normalized spectra counts), and the fold-change computed as log₂ StrainC/StrainB spectra count (normalized spectra counts of StrainC/StrainB).

| SEQ ID | KEGG | GO | Strain C mean | Strain B mean | Fold-change |
|---|---|---|---|---|---|
| 93 | Purine metabolism, Pyrimidine metabolism, RNA polymerase, rpoC | DNA binding, DNA-directed RNA polymerase activity, transcription, DNA-templated | 0.535 | 0.207 | 1.4 |
| 337 | K09702 | None | 0.063 | 0.024 | 1.4 |
| 81 | Ribosome, RP-S8, rpsH | ribosome, rRNA binding, structural constituent of ribosome, translation | 0.781 | 0.289 | 1.4 |
| 94 | Purine metabolism, Pyrimidine metabolism, RNA polymerase, rpoB | DNA binding, DNA-directed RNA polymerase activity, ribonucleoside binding, transcription, DNA-templated | 0.345 | 0.140 | 1.3 |
| 243 | terB | None | 0.127 | 0.054 | 1.2 |
| 170 | pnp, PNPT1, Purine metabolism, Pyrimidine metabolism, RNA degradation | 3'-5'-exoribonuclease activity, cytoplasm, magnesium ion binding, mRNA catabolic process, polyribonucleotide nucleotidyltransferase activity, RNA binding, RNA phosphodiester bond hydrolysis, exonucleolytic, RNA processing | 0.419 | 0.245 | 0.8 |
| 318 | cld | None | 0.361 | 0.267 | 0.4 |

TABLE 5D

Proteins expressed in the culture of the *Streptomyces* strain Strain C at a lower level than were expressed in the culture of the *Streptomyces* strain Strain B.

| SEQ ID | KEGG | GO | Strain C mean | Strain B mean | Fold-change |
|---|---|---|---|---|---|
| 134 | Biosynthesis of amino acids, Carbon fixation in photosynthetic organisms, Carbon metabolism, FBA, fbaA, Fructose and mannose metabolism, Glycolysis/Gluconeogenesis, Methane metabolism, Pentose phosphate pathway | fructose-bisphosphate aldolase activity, glycolytic process, zinc ion binding | 0.003 | 0.202 | −5.6 |
| 298 | ACADM, acd, beta-Alanine metabolism, Carbon metabolism, Fatty acid degradation, Fatty acid metabolism, PPAR signaling pathway, Propanoate metabolism, Valine, leucine and isoleucine degradation | acyl-CoA dehydrogenase activity, butyryl-CoA dehydrogenase activity, flavin adenine dinucleotide binding, oxidation-reduction process | 0.003 | 0.154 | −5.4 |
| 427 | Two-component system, Vancomycin resistance, vanX | cell wall, cell wall organization, dipeptidase activity, metallopeptidase activity, proteolysis, zinc ion binding | 0.002 | 0.121 | −5.1 |
| 99 | None | integral component of membrane | 0.006 | 0.176 | −4.8 |
| 113 | Purine metabolism, yagR | oxidation-reduction process, oxidoreductase activity | 0.003 | 0.114 | −4.7 |
| 321 | ABC.SN.S | membrane, sulfur compound metabolic process, transport | 0.011 | 0.226 | −4.2 |
| 476 | Alzheimer's disease, Biosynthesis of amino acids, Carbon fixation in photosynthetic organisms, Carbon metabolism, GAPDH, gapA, Glycolysis/Gluconeogenesis, HIF-1 signaling pathway | glucose metabolic process, NAD binding, NADP binding, oxidation-reduction process, oxidoreductase activity, acting on the aldehyde or oxo group of donors, NAD or NADP as acceptor | 0.006 | 0.108 | −4.1 |
| 370 | bfr, Porphyrin and chlorophyll metabolism | cell, cellular iron ion homeostasis, ferric iron binding, ferroxidase activity, iron ion transport, oxidation-reduction process | 0.012 | 0.208 | −4.0 |
| 47 | None | integral component of membrane | 0.017 | 0.284 | −4.0 |
| 259 | None | oxidation-reduction process, oxidoreductase activity | 0.011 | 0.177 | −3.9 |
| 133 | KYNU, kynU, Tryptophan metabolism | 'de novo' NAD biosynthetic process from tryptophan, anthranilate metabolic process, cytoplasm, kynureninase activity, L-kynurenine catabolic process, pyridoxal phosphate binding, quinolinate biosynthetic process, tryptophan catabolic process | 0.007 | 0.110 | −3.8 |
| 34 | Sesquiterpenoid and triterpenoid biosynthesis, shc | hopanoid biosynthetic process, intramolecular transferase activity | 0.006 | 0.095 | −3.8 |
| 249 | Cyanoamino acid metabolism, ggt, Glutathione metabolism, Taurine and hypotaurine metabolism | gamma-glutamyltransferase activity, glutathione metabolic process | 0.004 | 0.054 | −3.6 |

TABLE 5D-continued

Proteins expressed in the culture of the *Streptomyces* strain Strain C at a lower level than were expressed in the culture of the *Streptomyces* strain Strain B.

| SEQ ID | KEGG | GO | Strain C mean | Strain B mean | Fold-change |
|---|---|---|---|---|---|
| 40 | None | carbohydrate metabolic process, hydrolase activity, hydrolyzing O-glycosyl compounds | 0.005 | 0.066 | −3.5 |
| 394 | Folate biosynthesis, moaC, Sulfur relay system | Mo-molybdopterin cofactor biosynthetic process | 0.015 | 0.163 | −3.4 |
| 372 | coxA, Oxidative phosphorylation | aerobic respiration, copper ion binding, cytochrome-c oxidase activity, electron transport chain, heme binding, hydrogen ion transmembrane transport, integral component of membrane, iron ion binding, plasma membrane, respiratory chain | 0.016 | 0.165 | −3.3 |
| 299 | HGD, hmgA, Styrene degradation, Tyrosine metabolism | homogentisate 1,2-dioxygenase activity, iron ion binding, L-phenylalanine catabolic process, oxidation-reduction process, tyrosine catabolic process | 0.046 | 0.455 | −3.3 |
| 257 | yfbK | integral component of membrane | 0.005 | 0.060 | −3.3 |
| 316 | ABC transporters, xylH | integral component of membrane, plasma membrane, transport, transporter activity | 0.004 | 0.050 | −3.3 |
| 31 | terD | response to stress | 0.124 | 1.193 | −3.3 |
| 310 | Arginine and proline metabolism, E3.5.3.6, arcA | arginine catabolic process to ornithine, arginine deiminase activity, cytoplasm, protein citrullination | 0.023 | 0.202 | −3.1 |
| 43 | Amino sugar and nucleotide sugar metabolism, beta-Lactam resistance, nagZ | beta-N-acetylhexosaminidase activity, carbohydrate metabolic process | 0.024 | 0.218 | −3.1 |
| 85 | Ribosome, RP-L22, MRPL22, rplV | large ribosomal subunit, rRNA binding, structural constituent of ribosome, translation | 0.059 | 0.516 | −3.1 |
| 417 | Biosynthesis of amino acids, Carbon metabolism, cysK, Cysteine and methionine metabolism, Sulfur metabolism | cysteine biosynthetic process, cysteine synthase activity, transferase activity | 0.012 | 0.100 | −3.0 |
| 67 | Carbon fixation pathways in prokaryotes, Carbon metabolism, folD, One carbon pool by folate | folic acid-containing compound biosynthetic process, histidine biosynthetic process, methenyltetrahydrofolate cyclohydrolase activity, methionine biosynthetic process, methylenetetrahydrofolate dehydrogenase (NADP+) activity, oxidation-reduction process, purine nucleotide biosynthetic process, tetrahydrofolate interconversion | 0.053 | 0.422 | −3.0 |
| 450 | mscS | integral component of membrane, transmembrane transport | 0.005 | 0.048 | −3.0 |
| 359 | Aminobenzoate degradation, Folate biosynthesis, phoD, Two-component system | None | 0.022 | 0.179 | −3.0 |
| 431 | ECM4 | glutathione transferase activity, metabolic process | 0.006 | 0.052 | −2.9 |
| 464 | None | N-acetylmuramoyl-L-alanine amidase activity, peptidoglycan catabolic process | 0.021 | 0.161 | −2.9 |
| 158 | Thiamine metabolism, thiC | 4 iron, 4 sulfur cluster binding, lyase activity, thiamine biosynthetic process, thiamine diphosphate biosynthetic process, zinc ion binding | 0.034 | 0.245 | −2.8 |
| 284 | None | hydrolase activity, metabolic process | 0.029 | 0.216 | −2.8 |
| 203 | Biosynthesis of amino acids, Carbon metabolism, Cyanoamino acid metabolism, glyA, SHMT, Glycine, serine and threonine metabolism, Glyoxylate and dicarboxylate metabolism, Methane metabolism, One carbon pool by folate | cytoplasm, glycine biosynthetic process from serine, glycine hydroxymethyltransferase activity, methylation, methyltransferase activity, pyridoxal phosphate binding, tetrahydrofolate interconversion | 0.028 | 0.192 | −2.7 |
| 423 | None | peptidase activity, proteolysis | 0.034 | 0.223 | −2.7 |
| 335 | None | aminopeptidase activity, hydrolase activity, acting on carbon-nitrogen (but not peptide) bonds, metabolic process, proteolysis | 0.016 | 0.100 | −2.6 |
| 101 | None | aminopeptidase activity, proteolysis, serine-type endopeptidase activity | 0.059 | 0.344 | −2.5 |
| 114 | Amyotrophic lateral sclerosis (ALS), FoxO signaling pathway, Glyoxylate and dicarboxylate metabolism, katE, CAT, catB, srpA, Peroxisome, Tryptophan metabolism | catalase activity, heme binding, hydrogen peroxide catabolic process, metal ion binding, oxidation-reduction process, response to oxidative stress | 0.045 | 0.251 | −2.5 |
| 434 | None | oxidation-reduction process, protein disulfide oxidoreductase activity | 0.046 | 0.270 | −2.5 |
| 119 | terD | response to stress | 0.191 | 1.086 | −2.5 |
| 230 | None | biosynthetic process, pyridoxal phosphate binding, succinyldiaminopimelate transaminase activity | 0.051 | 0.277 | −2.4 |
| 453 | K06988 | coenzyme F420 binding, NADP binding, NADPH regeneration, oxidoreductase activity, acting on NAD(P)H | 0.012 | 0.066 | −2.4 |
| 466 | None | dioxygenase activity, lyase activity, oxidation-reduction process | 0.006 | 0.038 | −2.4 |

TABLE 5D-continued

Proteins expressed in the culture of the *Streptomyces* strain Strain C at a lower level than were expressed in the culture of the *Streptomyces* strain Strain B.

| SEQ ID | KEGG | GO | Strain C mean | Strain B mean | Fold-change |
|---|---|---|---|---|---|
| 118 | terD | response to stress | 0.103 | 0.546 | −2.4 |
| 441 | CARP, pepA, Glutathione metabolism | aminopeptidase activity, cytoplasm, manganese ion binding, metalloexopeptidase activity, proteolysis | 0.102 | 0.504 | −2.3 |
| 30 | Inositol phosphate metabolism, iolB | glucuronate isomerase activity, inositol catabolic process | 0.005 | 0.029 | −2.3 |
| 183 | lepB, Protein export | integral component of membrane, proteolysis, serine-type peptidase activity | 0.027 | 0.130 | −2.3 |
| 296 | None | metallopeptidase activity, proteolysis | 0.069 | 0.354 | −2.3 |
| 271 | aroE, Biosynthesis of amino acids, Phenylalanine, tyrosine and tryptophan biosynthesis | oxidation-reduction process, shikimate 3-dehydrogenase (NADP+) activity | 0.011 | 0.057 | −2.3 |
| 57 | Carbon metabolism, Citrate cycle (TCA cycle), DLD, lpd, pdhD, Glycine, serine and threonine metabolism, Glycolysis/Gluconeogenesis, Pyruvate metabolism, Valine, leucine and isoleucine degradation | cell, cell redox homeostasis, dihydrolipoyl dehydrogenase activity, flavin adenine dinucleotide binding, oxidation-reduction process, oxidoreductase activity | 0.074 | 0.335 | −2.2 |
| 424 | None | dioxygenase activity, oxidation-reduction process | 0.030 | 0.145 | −2.2 |
| 371 | Oxidative phosphorylation, qcrB | electron carrier activity, hydrogen ion transmembrane transport, integral component of membrane, oxidoreductase activity, respiratory electron transport chain, ubiquinol-cytochrome-c reductase activity | 0.014 | 0.069 | −2.2 |
| 141 | dacC, dacA, dacD, Peptidoglycan biosynthesis | proteolysis, serine-type D-Ala-D-Ala carboxypeptidase activity | 0.097 | 0.443 | −2.2 |
| 269 | DHODH, pyrD, Pyrimidine metabolism | 'de novo' pyrimidine nucleobase biosynthetic process, 'de novo' UMP biosynthetic process, cytoplasm, dihydroorotate dehydrogenase activity, oxidation-reduction process, plasma membrane | 0.004 | 0.022 | −2.1 |
| 311 | Arginine and proline metabolism, Biosynthesis of amino acids, OTC, argF, argI | amino acid binding, arginine catabolic process to ornithine, arginine deiminase pathway, cytoplasm, ornithine carbamoyltransferase activity, ornithine metabolic process | 0.049 | 0.207 | −2.1 |
| 314 | None | carbohydrate binding, carbohydrate metabolic process, catalytic activity | 0.082 | 0.351 | −2.1 |
| 222 | K09118 | integral component of membrane, plasma membrane | 0.053 | 0.237 | −2.1 |
| 399 | Biosynthesis of amino acids, Carbon metabolism, Pentose phosphate pathway, PRPS, prsA, Purine metabolism | 5-phosphoribose 1-diphosphate biosynthetic process, ATP binding, cytoplasm, kinase activity, magnesium ion binding, nucleotide biosynthetic process, phosphorylation, ribonucleoside monophosphate biosynthetic process, ribose phosphate diphosphokinase activity | 0.078 | 0.326 | −2.0 |
| 458 | None | aminopeptidase activity, proteolysis | 0.203 | 0.836 | −2.0 |
| 178 | E2.6.1.- | beta-alanine-pyruvate transaminase activity, metabolic process, pyridoxal phosphate binding, transaminase activity | 0.060 | 0.240 | −2.0 |
| 115 | None | carbohydrate metabolic process, extracellular region, mannosyl-glycoprotein endo-beta-N-acetylglucosaminidase activity | 0.014 | 0.059 | −2.0 |
| 472 | None | aminopeptidase activity, proteolysis | 0.052 | 0.191 | −1.9 |
| 242 | Amino sugar and nucleotide sugar metabolism, Carbon metabolism, Glycolysis/Gluconeogenesis, GPI, pgi, Pentose phosphate pathway, Starch and sucrose metabolism | cytoplasm, gluconeogenesis, glucose-6-phosphate isomerase activity, glycolytic process | 0.210 | 0.779 | −1.9 |
| 63 | Butanoate metabolism, Carbon fixation pathways in prokaryotes, Carbon metabolism, Citrate cycle (TCA cycle), Oxidative phosphorylation, sdhB, frdB | 2 iron, 2 sulfur cluster binding, 3 iron, 4 sulfur cluster binding, 4 iron, 4 sulfur cluster binding, electron carrier activity, metal ion binding, succinate dehydrogenase (ubiquinone) activity, tricarboxylic acid cycle | 0.095 | 0.334 | −1.8 |
| 205 | ackA, Carbon fixation pathways in prokaryotes, Carbon metabolism, Methane metabolism, Propanoate metabolism, Pyruvate metabolism, Taurine and hypotaurine metabolism | acetate kinase activity, acetyl-CoA biosynthetic process, ATP binding, cytoplasm, magnesium ion binding, organic acid metabolic process, phosphorylation | 0.039 | 0.134 | −1.8 |
| 344 | Amino sugar and nucleotide sugar metabolism, Carbon metabolism, Glycolysis/Gluconeogenesis, GPI, pgi, Pentose phosphate pathway, Starch and sucrose metabolism | cytoplasm, gluconeogenesis, glucose-6-phosphate isomerase activity, glycolytic process | 0.220 | 0.779 | −1.8 |
| 280 | E3.1.4.46, glpQ, ugpQ, Glycerophospholipid metabolism | glycerophosphodiester phosphodiesterase activity, lipid metabolic process | 0.056 | 0.197 | −1.8 |
| 432 | FoxO signaling pathway, Huntington's disease, Peroxisome, SOD2 | metal ion binding, oxidation-reduction process, removal of superoxide radicals, superoxide dismutase activity | 0.299 | 1.077 | −1.8 |

TABLE 5D-continued

Proteins expressed in the culture of the *Streptomyces* strain Strain C at a lower level than were expressed in the culture of the *Streptomyces* strain Strain B.

| SEQ ID | KEGG | GO | Strain C mean | Strain B mean | Fold-change |
|---|---|---|---|---|---|
| 419 | None | metalloendopeptidase activity, proteolysis | 0.105 | 0.379 | −1.8 |
| 380 | terD | response to stress | 0.384 | 1.386 | −1.8 |
| 254 | alc, ALLC, Purine metabolism | allantoicase activity, allantoin catabolic process, purine nucleobase metabolic process | 0.090 | 0.300 | −1.7 |
| 381 | otsA, Starch and sucrose metabolism | alpha, alpha-trehalose-phosphate synthase (UDP-forming) activity, catalytic activity, trehalose biosynthetic process | 0.076 | 0.247 | −1.7 |
| 121 | ftsH, hflB | ATP binding, ATPase activity, cell division, integral component of membrane, metalloendopeptidase activity, plasma membrane, protein catabolic process, proteolysis, zinc ion binding | 0.032 | 0.107 | −1.7 |
| 395 | None | Mo-molybdopterin cofactor biosynthetic process | 0.023 | 0.075 | −1.7 |
| 186 | HXT, Meiosis - yeast | carbohydrate transport, integral component of membrane, substrate-specific transmembrane transporter activity, transmembrane transport | 0.035 | 0.104 | −1.6 |
| 317 | hemE, UROD, Porphyrin and chlorophyll metabolism | cytoplasm, protoporphyrinogen IX biosynthetic process, uroporphyrinogen decarboxylase activity | 0.019 | 0.059 | −1.6 |
| 195 | 2-Oxocarboxylic acid metabolism, Biosynthesis of amino acids, C5-Branched dibasic acid metabolism, leuB, Valine, leucine and isoleucine biosynthesis | 3-isopropylmalate dehydrogenase activity, cytoplasm, leucine biosynthetic process, magnesium ion binding, NAD binding, oxidation-reduction process | 0.043 | 0.124 | −1.5 |
| 241 | Biosynthesis of amino acids, Carbon metabolism, E2.2.1.2, talA, talB, Pentose phosphate pathway | carbohydrate metabolic process, cytoplasm, pentose-phosphate shunt, sedoheptulose-7-phosphate: D-glyceraldehyde-3-phosphate glyceronetransferase activity | 0.087 | 0.250 | −1.5 |
| 252 | Cyanoamino acid metabolism, ggt, Glutathione metabolism, Taurine and hypotaurine metabolism | gamma-glutamyltransferase activity, glutathione metabolic process | 0.117 | 0.339 | −1.5 |
| 406 | E3.5.1.87 | hydrolase activity, acting on carbon-nitrogen (but not peptide) bonds, in linear amidines, metabolic process, N-carbamoyl-L-amino-acid hydrolase activity, N-formylglutamate deformylase activity | 0.059 | 0.170 | −1.5 |
| 210 | Carbon fixation pathways in prokaryotes, Carbon metabolism, Glyoxylate and dicarboxylate metabolism, MCEE, epi, Propanoate metabolism, Valine, leucine and isoleucine degradation | None | 0.078 | 0.217 | −1.5 |
| 140 | E3.4.11.21, DNPEP | aminopeptidase activity, metallopeptidase activity, proteolysis, zinc ion binding | 0.072 | 0.196 | −1.4 |
| 392 | Fructose and mannose metabolism, Phosphotransferase system (PTS), PTS-Fru-EIIA, fruB, PTS-Fru-EIIB, fruA | carbohydrate transmembrane transport, fructose transport, integral component of membrane, metabolic process, phosphoenolpyruvate-dependent sugar phosphotransferase system, plasma membrane, protein-N(PI)-phosphohistidine-fructose phosphotransferase system transporter activity, proton transport, sugar: proton symporter activity | 0.025 | 0.069 | −1.4 |
| 436 | Carbon metabolism, Citrate cycle (TCA cycle), DLD, lpd, pdhD, Glycine, serine and threonine metabolism, Glycolysis/Gluconeogenesis, Pyruvate metabolism, Valine, leucine and isoleucine degradation | cell, cell redox homeostasis, dihydrolipoyl dehydrogenase activity, flavin adenine dinucleotide binding, glycolytic process, oxidation-reduction process | 0.850 | 2.305 | −1.4 |
| 106 | lrp | intracellular, regulation of transcription, DNA-templated, sequence-specific DNA binding, transcription factor activity, sequence-specific DNA binding | 0.063 | 0.170 | −1.4 |
| 275 | pdxS, pdx1, Vitamin B6 metabolism | pyridoxal 5'-phosphate synthase (glutamine hydrolysing) activity, pyridoxal phosphate biosynthetic process, vitamin B6 biosynthetic process | 0.154 | 0.418 | −1.4 |
| 440 | Carbon metabolism, Citrate cycle (TCA cycle), DLD, lpd, pdhD, Glycine, serine and threonine metabolism, Glycolysis/Gluconeogenesis, Pyruvate metabolism, Valine, leucine and isoleucine degradation | cell, cell redox homeostasis, dihydrolipoyl dehydrogenase activity, flavin adenine dinucleotide binding, glycolytic process, oxidation-reduction process | 0.932 | 2.305 | −1.3 |
| 465 | Fructose and mannose metabolism, Pentose and glucuronate interconversions, xylA | cytoplasm, D-xylose metabolic process, magnesium ion binding, pentose-phosphate shunt, xylose isomerase activity | 0.054 | 0.138 | −1.3 |
| 87 | Ribosome, RP-L2, MRPL2, rplB | large ribosomal subunit, rRNA binding, structural constituent of ribosome, transferase activity, translation | 0.433 | 1.030 | −1.3 |

TABLE 5D-continued

Proteins expressed in the culture of the *Streptomyces* strain Strain C at a lower
level than were expressed in the culture of the *Streptomyces* strain Strain B.

| SEQ ID | KEGG | GO | Strain C mean | Strain B mean | Fold-change |
|---|---|---|---|---|---|
| 404 | Benzoate degradation, Butanoate metabolism, Carbon fixation pathways in prokaryotes, Carbon metabolism, E2.3.1.9, atoB, Fatty acid degradation, Fatty acid metabolism, Glyoxylate and dicarboxylate metabolism, Lysine degradation, Propanoate metabolism, Pyruvate metabolism, Synthesis and degradation of ketone bodies, Terpenoid backbone biosynthesis, Tryptophan metabolism, Two-component system, Valine, leucine and isoleucine degradation | acetyl-CoA C-acyltransferase activity, metabolic process, transferase activity, transferring acyl groups other than amino-acyl groups | 0.081 | 0.191 | −1.2 |
| 188 | E2.7.7.3A, coaD, kdtB, Pantothenate and CoA biosynthesis | ATP binding, coenzyme A biosynthetic process, cytoplasm, pantetheine-phosphate adenylyltransferase activity | 0.042 | 0.098 | −1.2 |
| 422 | dhaK, Glycerolipid metabolism | glycerol metabolic process, glycerone kinase activity, phosphorylation | 0.042 | 0.101 | −1.2 |
| 211 | ATPF1B, atpD, Oxidative phosphorylation, Photosynthesis | ATP binding, ATP hydrolysis coupled proton transport, plasma membrane, plasma membrane ATP synthesis coupled proton transport, proton-transporting ATP synthase activity, rotational mechanism, proton-transporting ATP synthase complex, catalytic core F(1) | 0.275 | 0.594 | −1.1 |
| 385 | Biosynthesis of amino acids, Carbon metabolism, Glycine, serine and threonine metabolism, Methane metabolism, serC, PSAT1, Vitamin B6 metabolism | cytoplasm, L-serine biosynthetic process, O-phospho-L-serine: 2-oxoglutarate aminotransferase activity, pyridoxal phosphate binding, pyridoxine biosynthetic process | 0.089 | 0.195 | −1.1 |
| 396 | tatD | DNA metabolic process, endodeoxyribonuclease activity, producing 5'-phosphomonoesters | 0.080 | 0.179 | −1.1 |
| 124 | Arginine and proline metabolism, Ascorbate and aldarate metabolism, beta-Alanine metabolism, Chloroalkane and chloroalkene degradation, E1.2.1.3, Fatty acid degradation, Glycerolipid metabolism, Glycolysis/Gluconeogenesis, Histidine metabolism, Limonene and pinene degradation, Lysine degradation, Pentose and glucuronate interconversions, Pyruvate metabolism, Tryptophan metabolism, Valine, leucine and isoleucine degradation | aldehyde dehydrogenase (NAD) activity, oxidation-reduction process, oxidoreductase activity, acting on the aldehyde or oxo group of donors, NAD or NADP as acceptor | 0.165 | 0.341 | −1.0 |
| 26 | E3.2.1.24, Other glycan degradation | alpha-mannosidase activity, carbohydrate binding, mannose metabolic process, zinc ion binding | 0.036 | 0.071 | −1.0 |
| 163 | pepP | aminopeptidase activity, manganese ion binding, proteolysis | 0.327 | 0.647 | −1.0 |
| 212 | ATPF1A, atpA, Oxidative phosphorylation, Photosynthesis | ATP binding, ATP hydrolysis coupled proton transport, plasma membrane, plasma membrane ATP synthesis coupled proton transport, proton-transporting ATP synthase activity, rotational mechanism, proton-transporting ATP synthase complex, catalytic core F(1), proton-transporting ATPase activity, rotational mechanism | 0.373 | 0.758 | −1.0 |
| 54 | Histidine metabolism, hutH, HAL | cytoplasm, histidine ammonia-lyase activity, histidine catabolic process to glutamate and formamide, histidine catabolic process to glutamate and formate | 0.128 | 0.254 | −1.0 |
| 152 | E5.5.1.4, INO1, Inositol phosphate metabolism, Streptomycin biosynthesis | inositol biosynthetic process, inositol-3-phosphate synthase activity, phospholipid biosynthetic process | 0.131 | 0.251 | −0.9 |
| 75 | truA, PUS1 | lyase activity, pseudouridine synthase activity, RNA binding, tRNA pseudouridine synthesis | 0.059 | 0.113 | −0.9 |
| 287 | Ribosome, RP-L20, MRPL20, rplT | ribosomal large subunit assembly, ribosome, rRNA binding, structural constituent of ribosome, translation | 0.458 | 0.874 | −0.9 |
| 339 | HINT1, hinT, hit | bis(5'-nucleosyl)-tetraphosphatase (asymmetrical) activity, catalytic activity, metabolic process | 0.087 | 0.155 | −0.8 |

TABLE 5D-continued

Proteins expressed in the culture of the *Streptomyces* strain Strain C at a lower level than were expressed in the culture of the *Streptomyces* strain Strain B.

| SEQ ID | KEGG | GO | Strain C mean | Strain B mean | Fold-change |
|---|---|---|---|---|---|
| 405 | Histidine metabolism, hutU, UROC1 | cytoplasm, histidine catabolic process to glutamate and formamide, histidine catabolic process to glutamate and formate, urocanate hydratase activity | 0.071 | 0.118 | −0.7 |
| 88 | Ribosome, RP-L4, MRPL4, rplD | ribosome, rRNA binding, structural constituent of ribosome, translation | 0.325 | 0.522 | −0.7 |
| 74 | Ribosome, RP-L13, MRPL13, rplM | ribosome, structural constituent of ribosome, translation | 0.493 | 0.813 | −0.7 |

Results are shown by KEGG pathway, by Gene Ontology (GO) description, means of levels for each strain (normalized spectra counts), and the fold-change computed as $\log_2$ StrainC/StrainB spectra count (normalized spectra counts of StrainC/StrainB).

TABLE 6

| Wheat radical length under normal conditions | | |
|---|---|---|
| | radical length | |
| | Average (cm) | SE |
| Formulation Control | 2.5897 | 0.3267 |
| Strain C | 2.7124 | 0.1958 |
| Strain A | 2.8529 | 0.1752 |

Table 7: Greenhouse Soybean Plant Yield Characteristics

TABLE 7A

Greenhouse soybean plant yield characteristics under normal (non-water limited) watering conditions

| Traits (per plant), at days post planting (dpp) | Percent improvement (%): Strain C over formulation control |
|---|---|
| Dry weight of mature seeds (0% moisture), harvest | 0.38 |
| Fresh weight of mature seeds, harvest | 1.37 |
| Number of mature seeds, harvest | 3.20 |
| SPAD measurement of chlorophyll, 87 dpp | −5.09 |
| Number of pods, 77 dpp | 9.50 |
| Lengths of pods, 46 dpp | 10.76 |

Soybean plants grown from seeds treated with Strain C show improved phenotypes under normal watering conditions.

TABLE 7B

Greenhouse plant yield characteristics under water-limited conditions

| Traits (per plant), at days post planting (dpp) | Percent improvement (%): Strain C over control | Probability of beneficial effect |
|---|---|---|
| Dry weight of mature seeds (0% moisture), harvest | 52 | 0.99● |
| Fresh weight of mature seeds, harvest | 50 | 0.99● |
| Number of mature seeds, harvest | 50 | 0.98● |
| SPAD measurement of chlorophyll, 89 dpp | 10 | |
| Number of pods, 77 dpp | 30 | |
| Lengths of pods, 62 dpp | 9 | |

Circle (●) indicates Bayesian significance at posterior probability = 95%, as calculated using Bayesian high-density interval (R package "BEST)". Bayesian posterior probability of a beneficial effect quantifies the posterior belief placed on the percent improvement being beneficial, i.e. the treatment mean being different than the control mean in the direction reported.

TABLE 7C

Greenhouse plant wilt characteristics under water-limited conditions

| Traits (per plant), at days post planting (dpp) | Percent improvement (%): Strain C over control | P values |
|---|---|---|
| Percent of leaves scored 3 = severe wilting, 32 dpp | −55 | 1.94E−14* |
| Percent of leaves scored 0 = no wilting, 32 dpp | 87 | 0.0004* |

Asterisk (*) indicates significance at alpha level = 0.05. P values were calculated using a Fisher exact test (R package "stats"), one-tailed for the beneficial effect of treatment.

TABLE 7D

Beneficial *Streptomyces* endophyte Strain C imparts improved plant characteristics under water-limited conditions in the greenhouse vs. other *Streptomyces* strains

| Parameter (dpp = days post planting) | non-treated | formulation control | Strain A | Strain C | Strain B | unit |
|---|---|---|---|---|---|---|
| Final Emergence (13 dpp) | 2.67 | 2.44 | 2.50 | 2.94 * | 2.39 * | seedlings, out of 3 seeds planted per pot |
| Pod Count (49 dpp) | 7.17 * | 8.50 | 8.80 | 8.93 * | 8.71 | pods per plant |
| Seed Pre-Count (55 dpp) | 18.56 | 20.83 | 21.80 | 20.93 | 21.57 | seeds per plant, counted inside pods |
| Seed Count, Mature (96 dpp) | 20.89 | 20.42 | 18.10 | 21.43 | 20.29 | seeds per plant, harvested, mature |
| Seed Count, Mature + Immature (97 dpp) | 34.44 | 33.25 | 31.40 | 34.79 | 33.86 | seeds per plant, harvested, mature + immature |
| Percent of Seeds That Are Mature (96 dpp) | 60.65% | 61.40% | 57.64% | 61.60% | 59.92% | percent of seeds matured |
| Seed Weight, Mature (96 dpp) | 3.55 | 3.54 | 3.28 | 3.63 | 3.35 | dry grams of mature seed per plant |
| Wilt Score (38 dpp) | 1.83 | 1.44 | 1.57 | 1.17 | 1.33 | score (0 = no wilt, 4 = max wilt) |
| Wilt Score (39 dpp) | 2.56 | 2.31 | 2.50 | 2.28 | 2.24 | score (0 = no wilt, 4 = max wilt) |

* indicates statistically significant values vs. all other treatments/control groups
Bold number values indicates instances where Strain C treated plants performed better than any other *Streptomyces* strain or control Table 8: Transcriptomics Results

TABLE 8A

Quantitative transcript analysis of upregulated and downregulated genes of Strain C-treated plants under normal (well watered) and water-limited (drought) growth conditions.

| | Condition: | | | | | |
|---|---|---|---|---|---|---|
| | well-watered | | | Water-limited | | |
| Transcript: | root | stem | leaf | root | stem | leaf |
| Symbiosis Enhancement | | | | | | |
| Nodulin-24 | − | | | | + | |
| Nodulin-26 | − | | | | | |
| Early nodulin-70 | − | | | | | |
| Early nodulin-55-1 | − | | | | | |
| Early nodulin-93 | − | | | | | |
| Nodulin-16 | − | | | | | |
| Auxin (auxin-induced protein 15A) | | + | | | + | + |
| Resistance to Biotic & Abiotic Stresses | | | | | | |
| annexin | | | | | | + |
| SAM22 | | + | + | | − | − |
| s-adenosylmethionine: caffeic acid 3-0-methyltransferase | | | | | + | |
| s-adenosylmethionine decarboxylase proenzyme | + | | | | | |
| s-adenosylmethionine synthase | | − | | | | |

TABLE 8A-continued

Quantitative transcript analysis of upregulated and downregulated genes of Strain C-treated plants under normal (well watered) and water-limited (drought) growth conditions.

| | Condition: | | | | | |
|---|---|---|---|---|---|---|
| | well-watered | | | Water-limited | | |
| Transcript: | root | stem | leaf | root | stem | leaf |
| Repetitive proline-rich cell wall protein | + | | | | | − |
| Lipoxygenase | + | − | | | | |
| Growth Promotion | | | | | | |
| Glucose-1-phosphate adenylyl transferase | + | | | | | |
| Photosystem Q(B) protein | | | + | − | | |
| Photosystem I assembly protein Ycf4 | | | | − | | |
| Cytochrome b559 subunit alpha | | | + | | | |
| Cytochrome b6 | + | | + | | | |
| ATP synthase subunit b, chloroplastic | | | + | | | |
| Cytochrome P450 82A4 | | | | − | | |
| Cytochrome P450 82A2 | | | | − | | |
| Cytochrome P450 93A1 | | | | − | | |
| Cytochrome C oxidase subunit 1 | | | | − | | |
| ATP synthase gamma chain | | + | | | | |
| ATP synthase subunit 9, mitochondrial | | | | − | | |
| Superoxide dismutase | | | | | + | |
| Superoxide dismutase (Fe), chloroplastic | | | | | + | |
| Ferritin | | | | | + | |
| Ferritin-2, Chloroplastic | + | | | | + | |
| Ferritin-1, chloroplastic | | | | | + | |
| Ferroredoxin-thioredoxin reductase catalytic ch . . . | + | | | | | |
| Serine hydroxymethyltransferase | | | − | | | + |
| Putative uncharacterized protein | + | | | | | |
| Leghemoglobin C3 | − | | | | | |
| RuBisCO-associated protein | | | − | | | |
| NAD(P)H-dependent 6'deoxychalcone synthase | | | | − | | |
| Sucrose synthase | | | | | | − |
| Cell Wall Transcripts | | | | | | |
| NAC domain protein NAC5 | | + | + | | | |
| Amine oxidase | | + | + | | | + |
| Auxin-induced protein 15A | | + | | | + | + |
| Non-specific lipid transfer protein | | | | | | + |
| Phospholipase D | + | | − | | | |
| Developmental Regulation | | | | | | |
| CASP-like proteins | | | + | | | |
| Histone H2A | | | + | | | + |
| Histone H3 | | | | | | + |
| Histone H2B | | | | | | + |
| Nitrogen Metabolism | | | | | | |
| Asparagine synthase | | + | + | | | |
| Other | | | | | | |
| Glutamine synthetase | − | − | | | | |
| Kunitz-type trypsin inhibitor KTI1 | − | | | | | |
| Stem 28 kDa glycoprotein | | − | | | | |
| Stem 31 kDa glycoprotein | | − | | | | |
| Small heat shock protein | | − | | | | |
| Malic enzyme | | | − | | | |
| Pectinesterase | | | − | | | − |
| Auxin-induced protein 6B | | | − | | | |
| Auxin-induced protein AUX22 | | | − | | | |
| Auxin-induced protein AUX28 | | | − | | | |
| Carbonic anhydrase | | | | − | | |
| Casparian strip membrane protein 1 | | | | − | | |
| Glutathione peroxidase | | | | − | | − |
| Isocitrate lyase i | | | | − | | |
| 2-hydroxyisoflavanone synthase | | | | | − | |
| Glucan endo-1,3-beta glucosidase | | | | | − | − |
| 50S ribosomal protein L33, chloroplastic | | | | | | − |
| 30S ribosomal protein S18, chloroplastic | | | | | | − |
| Serine/threonine protein kinase | | | | | | − |

"+" and "−" denote a relative increase or decrease, respectively, when compared to control plants grown in similar conditions (formulation control).

TABLE 8B

Quantification of up- and down- regulated genes identified in qualitative transcriptomics studies, in plants grown from seeds treated with Strain C, as compared to plants grown from seeds treated with the formulation control.

| | | | Qualitative Plant Transcriptomics | | Quantitative Plant Transcriptomics | | |
|---|---|---|---|---|---|---|---|
| Tissue | Plant GeneName | SEQ ID | Gene Description | Up/Down Regulated | Gene Description | Up/Down Regulated | Fold Change |
| Leaf | Glyma.16G165200 | 2950 | Putative uncharacterized protein | + | light-harvesting chlorophyll-protein complex II subunit B1 | + | 15.30 |
| Leaf | Glyma.02G215700 | 719 | Metalloendoproteinase 1 | + | matrix metalloproteinase | + | 15.12 |
| Leaf | Glyma.16G165800 | 2954 | Chlorophyll a-b binding protein 2, chloroplastic | + | light-harvesting chlorophyll-protein complex II subunit B1 | + | 14.12 |
| Root | Glyma.17G073400 | 3046 | Early nodulin-55-2 | + | early nodulin-like protein 15 | + | 14.07 |
| Leaf | Glyma.04G083200 | 973 | Putative uncharacterized protein | + | tonoplast intrinsic protein 4; 1 | + | 13.43 |
| Leaf | Glyma.05G007100 | 1065 | Carbonic anhydrase | + | carbonic anhydrase 1 | + | 12.02 |
| Leaf | Glyma.08G015300 | 1538 | Putative uncharacterized protein | + | plasma membrane intrinsic protein 1; 4 | + | 11.26 |
| Root | Glyma.02G245600 | 741 | Putative uncharacterized protein | + | Gibberellin-regulated family protein | + | 10.39 |
| Leaf | Glyma.15G213600 | 2830 | Serine/threonine-protein kinase | + | S-locus lectin protein kinase family protein | + | 10.11 |
| Root | Glyma.18G018900 | 3164 | Early nodulin-70 | + | slufate transporter 2; 1 | + | 8.49 |
| Leaf | Glyma.19G007700 | 3297 | Carbonic anhydrase | + | carbonic anhydrase 1 | + | 8.12 |
| Leaf | Glyma.14G010900 | 2609 | Fructose-bisphosphate aldolase | + | Aldolase superfamily protein | + | 7.64 |
| Leaf | Glyma.02G303000 | 772 | Fructose-bisphosphate aldolase | + | Aldolase superfamily protein | + | 7.42 |
| Leaf | Glyma.16G165500 | 2952 | Chlorophyll a-b binding protein 2, chloroplastic | + | light-harvesting chlorophyll-protein complex II subunit B1 | + | 7.33 |
| Root | Glyma.19G196900 | 3395 | Putative uncharacterized protein | + | NAD(P)-binding Rossmann-fold superfamily protein | + | 7.12 |
| Leaf | Glyma.08G008800 | 1533 | Acyl carrier protein | + | acyl carrier protein 4 | + | 7.07 |
| Root | Glyma.13G364400 | 2595 | Nodulin-44 | + | | + | 6.84 |
| Root | Glyma.05G023700 | 1077 | Putative uncharacterized protein | + | Flavin-binding monooxygenase family protein | + | 6.73 |
| Root | Glyma.06G182700 | 1331 | Carbonic anhydrase | + | carbonic anhydrase 2 | + | 6.50 |
| Leaf | Glyma.03G028000 | 789 | Arginase | + | Arginase/deacetylase superfamily protein | + | 6.43 |
| Root | Glyma.02G204500 | 711 | Early nodulin-55-1 | + | early nodulin-like protein 10 | + | 5.99 |
| Leaf | Glyma.01G142400 | 538 | RuBisCO-associated protein | + | | + | 5.41 |
| Root | Glyma.09G229200 | 1901 | Purple acid phosphatase | + | purple acid phosphatase 10 | + | 5.34 |
| Leaf | Glyma.19G046800 | 3329 | Ribulose bisphosphate carboxylase small chain 4, chloroplastic | + | Ribulose bisphosphate carboxylase (small chain) family protein | + | 5.10 |
| Leaf | Glyma.02G218300 | 725 | Glutamyl-tRNA reductase | + | Glutamyl-tRNA reductase family protein | + | 5.07 |
| Root | Glyma.14G052400 | 2633 | Nodulin-24 | + | | + | 5.00 |
| Leaf | Glyma.17G012000 | 3003 | Aminomethyltransferase | + | Glycine cleavage T-protein family | + | 4.92 |
| Leaf | Glyma.08G181000 | 1670 | Soyasaponin III rhamnosyltransferase | + | UDP-Glycosyltransferase superfamily protein | + | 4.86 |
| Leaf | Glyma.07G142700 | 1470 | Fructose-1,6-bisphosphatase, chloroplastic | + | high cyclic electron flow 1 | + | 4.79 |
| Leaf | Glyma.19G046600 | 3327 | Ribulose bisphosphate carboxylase small chain 4, chloroplastic | + | Ribulose bisphosphate carboxylase (small chain) family protein | + | 4.79 |
| Leaf | Glyma.09G210900 | 1889 | Phosphoribulokinase | + | phosphoribulokinase | + | 4.71 |
| Leaf | Glyma.16G205200 | 2987 | Putative uncharacterized protein | + | light harvesting complex of photosystem II 5 | + | 4.68 |
| Leaf | Glyma.13G046200 | 2379 | Ribulose bisphosphate carboxylase small chain 1, chloroplastic | + | Ribulose bisphosphate carboxylase (small chain) family protein | + | 4.47 |
| Root | Glyma.02G265200 | 750 | Nodulin-16 | + | | + | 4.39 |
| Leaf | Glyma.17G140600 | 3092 | L-lactate dehydrogenase | + | Lactate/malate dehydrogenase family protein | + | 4.31 |
| Leaf | Glyma.12G101800 | 2302 | Putative uncharacterized protein | + | xyloglucan endotransglucosylase/hydrolase 9 | + | 4.29 |
| Root | Glyma.15G045000 | 2730 | Nodulin-22 | + | | + | 4.26 |
| Leaf | Glyma.13G204800 | 2471 | ATP synthase gamma chain | + | ATPase, F1 complex, gamma subunit protein | + | 4.22 |
| Root | Glyma.10G198800 | 2026 | Leghemoglobin C3 | + | haemoglobin 2 | + | 4.15 |
| Leaf | Glyma.12G178800 | 2321 | Superoxide dismutase | + | copper/zinc superoxide dismutase 2 | + | 4.12 |
| Root | Glyma.08G002500 | 1530 | Beta-galactosidase | + | Glycosyl hydrolase family 35 protein | + | 4.11 |

TABLE 8B-continued

Quantification of up- and down- regulated genes identified in qualitative transcriptomics studies, in plants grown from seeds treated with Strain C, as compared to plants grown from seeds treated with the formulation control.

| Tissue | Plant GeneName | SEQ ID | Qualitative Plant Transcriptomics | | Quantitative Plant Transcriptomics | | |
| --- | --- | --- | --- | --- | --- | --- | --- |
| | | | Gene Description | Up/Down Regulated | Gene Description | Up/Down Regulated | Fold Change |
| Leaf | Glyma.20G026700 | 3462 | Phosphorylase | + | Glycosyl transferase, family 35 | + | 4.06 |
| Leaf | Glyma.14G185700 | 2678 | Glutamyl-tRNA reductase | + | Glutamyl-tRNA reductase family protein | + | 3.98 |
| Root | Glyma.08G181000 | 1670 | Soyasaponin III rhamnosyltransferase | + | UDP-Glycosyltransferase superfamily protein | + | 3.98 |
| Root | Glyma.07G048800 | 1428 | Putative uncharacterized protein | + | O-methyltransferase 1 | + | 3.90 |
| Leaf | Glyma.14G177600 | 2675 | Putative uncharacterized protein | + | Cupredoxin superfamily protein | + | 3.85 |
| Leaf | Glyma.19G021400 | 3308 | Putative uncharacterized protein | + | basic helix-loop-helix (bHLH) DNA-binding family protein | + | 3.83 |
| Root | Glyma.19G074000 | 3337 | Nodulin-26B | + | | + | 3.81 |
| Root | Glyma.10G292200 | 2079 | Chalcone--flavonone isomerase 1B-2 | + | Chalcone-flavanone isomerase family protein | + | 3.81 |
| Root | Glyma.13G307000 | 2557 | Putative uncharacterized protein | + | Peroxidase superfamily protein | + | 3.74 |
| Leaf | Glyma.19G212600 | 3408 | Pectinesterase | + | Plant invertase/pectin methylesterase inhibitor superfamily | + | 3.55 |
| Root | Glyma.10G066700 | 1959 | Fructose-bisphosphate aldolase | + | Aldolase superfamily protein | + | 3.40 |
| Root | Glyma.13G328800 | 2570 | Nodulin-20 | + | | + | 3.39 |
| Root | Glyma.04G140900 | 995 | Annexin | + | annexin 8 | + | 3.32 |
| Root | Glyma.10G199000 | 2027 | Leghemoglobin C1 | + | haemoglobin 2 | + | 3.26 |
| Root | Glyma.20G024200 | 3461 | Nodulin-C51 | + | | + | 3.24 |
| Root | Glyma.08G196900 | 1686 | Putative uncharacterized protein | + | peptidase M20/M25/M40 family protein | + | 3.10 |
| Root | Glyma.20G145200 | 3517 | Amine oxidase | + | Copper amine oxidase family protein | + | 3.09 |
| Root | Glyma.11G035300 | 2109 | Putative uncharacterized protein | + | 2-oxoglutarate (2OG) and Fe(II)-dependent oxygenase superfamily protein | + | 3.06 |
| Root | Glyma.13G306900 | 2556 | Putative uncharacterized protein | + | Peroxidase superfamily protein | + | 3.05 |
| Root | Glyma.02G051700 | 627 | Beta-galactosidase | + | beta-galactosidase 3 | + | 3.00 |
| Root | Glyma.04G165000 | 1005 | Putative uncharacterized protein | + | Flavin-binding monooxygenase family protein | + | 2.91 |
| Root | Glyma.08G350800 | 1763 | Beta-amyrin 24-hydroxylase | + | cytochrome P450, family 93, subfamily D, polypeptide 1 | + | 2.89 |
| Root | Glyma.08G243600 | 1717 | Putative uncharacterized protein | + | cytochrome P450, family 716, subfamily A, polypeptide 1 | + | 2.79 |
| Root | Glyma.07G001300 | 1400 | Beta-amyrin synthase | + | Terpenoid cyclases family protein | + | 2.77 |
| Root | Glyma.06G109200 | 1282 | Inducible nitrate reductase | + | nitrate reductase 1 | + | 2.75 |
| Root | Glyma.20G145100 | 3516 | Amine oxidase | + | Copper amine oxidase family protein | + | 2.72 |
| Root | Glyma.08G295600 | 1735 | Thioredoxin | − | thioredoxin 2 | − | −1.72 |
| Root | Glyma.14G022500 | 2614 | Putative uncharacterized protein | − | GDSL-like Lipase/Acylhydrolase superfamily protein | − | −1.72 |
| Root | Glyma.17G137800 | 3087 | Vacuolar-processing enzyme | − | beta vacuolar processing enzyme | − | −1.73 |
| Root | Glyma.15G104900 | 2773 | Putative uncharacterized protein | − | Eukaryotic aspartyl protease family protein | − | −1.75 |
| Root | Glyma.02G262500 | 749 | Ferritin | − | ferritin 4 | − | −1.79 |
| Root | Glyma.13G222300 | 2489 | Serine hydroxymethyltransferase | − | serine hydroxymethyltransferase 3 | − | −1.80 |
| Root | Glyma.01G077100 | 516 | CASP-like protein 4 | − | Uncharacterised protein family (UPF0497) | − | −1.81 |
| Root | Glyma.17G072400 | 3045 | Heat shock 70 kDa protein | − | heat shock protein 70B | − | −1.81 |
| Root | Glyma.09G042400 | 1793 | Putative uncharacterized protein | − | TOXICOS EN LEVADURA 2 | − | −1.82 |
| Root | Glyma.13G208200 | 2474 | Putative uncharacterized protein | − | Eukaryotic aspartyl protease family protein | − | −1.85 |
| Root | Glyma.17G039000 | 3022 | S-adenosylmethionine synthase | − | S-adenosylmethionine synthetase family protein | − | −1.87 |
| Root | Glyma.07G229100 | 1507 | Transcriptional factor NAC51 | − | NAC-like, activated by AP3/PI | − | −1.94 |
| Root | Glyma.07G139700 | 1467 | Probable glutathione S-transferase | − | glutathione S-transferase TAU 8 | − | −1.96 |
| Root | Glyma.01G006500 | 481 | DNA-directed RNA polymerase | − | nuclear RNA polymerase C2 | − | −2.02 |
| Root | Glyma.02G288500 | 763 | Citrate synthase | − | citrate synthase 3 | − | −2.08 |

TABLE 8B-continued

Quantification of up- and down- regulated genes identified in qualitative transcriptomics studies, in plants grown from seeds treated with Strain C, as compared to plants grown from seeds treated with the formulation control.

| | | | | Qualitative Plant Transcriptomics | | Quantitative Plant Transcriptomics | | |
|---|---|---|---|---|---|---|---|---|
| Tissue | Plant GeneName | SEQ ID | Gene Description | Up/Down Regulated | | Gene Description | Up/Down Regulated | Fold Change |
| Root | Glyma.02G145300 | 691 | Methylcrotonoyl-CoA carboxylase subunit alpha, mitochondrial | − | | methylcrotonyl-CoA carboxylase alpha chain, mitochondrial/ 3-methylcrotonyl-CoA carboxylase 1 (MCCA) | − | −2.13 |
| Root | Glyma.11G047900 | 2118 | Adenylyl-sulfate kinase | − | | APS kinase | − | −2.16 |
| Root | Glyma.01G129400 | 533 | Peroxisomal aminotransferase | − | | alanine: glyoxylate aminotransferase 3 | − | −2.18 |
| Root | Glyma.02G213700 | 718 | Carbonic anhydrase | − | | beta carbonic anhydrase 5 | − | −2.42 |
| Root | Glyma.06G050100 | 1250 | Branched-chain-amino-acid aminotransferase | − | | branched-chain amino acid transaminase 2 | − | −2.48 |
| Root | Glyma.17G032700 | 3015 | Seed maturation protein PM36 | − | | Haem oxygenase-like, multi-helical | − | −2.52 |
| Leaf | Glyma.19G212800 | 3409 | Sucrose synthase | − | | ATSUS3, SUS3 | − | −2.56 |
| Leaf | Glyma.15G112900 | 2781 | Alternative oxidase | − | | IM, IM1 | − | −2.57 |
| Leaf | Glyma.09G173200 | 1867 | Glutamine synthetase | − | | ATGLN1; 1, ATGSR1, GLN1; 1, GSR 1 | − | −2.69 |
| Leaf | Glyma.13G354900 | 2588 | Malic enzyme | − | | ATNADP-ME4, NADP-ME4 | − | −2.73 |
| Leaf | Glyma.17G039000 | 3022 | S-adenosylmethionine synthase | − | | MAT4, MTO3, SAMS3 | − | −2.87 |
| Leaf | Glyma.17G032700 | 3015 | Seed maturation protein PM36 | − | | | − | −2.88 |
| Leaf | Glyma.07G104500 | 1453 | Glutamine synthetase | − | | ATGLN1; 1, ATGSR1, GLN1; 1, GSR 1 | − | −2.92 |
| Leaf | Glyma.17G192000 | 3114 | Putative uncharacterized protein | − | | AAP6 | − | −2.92 |
| Root | Glyma.11G024100 | 2098 | Glutathione peroxidase | − | | glutathione peroxidase 6 | − | −2.95 |
| Leaf | Glyma.11G024100 | 2098 | Glutathione peroxidase | − | | ATGPX6, GPX6, LSC803, PHGPX | − | −2.96 |
| Leaf | Glyma.08G118900 | 1619 | Putative uncharacterized protein | − | | ATGSTU7, GST25, GSTU7 | − | −3.01 |
| Leaf | Glyma.04G050400 | 953 | Ferrochelatase | − | | ATFC-I, FC-I, FC1 | − | −3.08 |
| Leaf | Glyma.12G140200 | 2311 | Serine/threonine-protein kinase | − | | ARK3, RK3 | − | −3.14 |
| Leaf | Glyma.08G119300 | 1621 | ER lumen protein retaining receptor | − | | AERD2, ATERD2, ERD2 | − | −3.20 |
| Leaf | Glyma.19G094100 | 3344 | Putative uncharacterized protein | − | | ATWRKY75, WRKY75 | − | −3.35 |
| Leaf | Glyma.07G243500 | 1513 | Stress-induced protein SAM22 | − | | MLP423 | − | −3.55 |
| Leaf | Glyma.02G244000 | 740 | Glutamine synthetase | − | | ATGLN1; 1, ATGSR1, GLN1; 1, GSR 1 | − | −3.81 |
| Leaf | Glyma.06G082400 | 1269 | Aspartate aminotransferase | − | | ASP3, YLS4 | − | −4.09 |
| Leaf | Glyma.19G245400 | 3434 | Wound-induced protein | − | | HEL, PR-4, PR4 | − | −4.24 |
| Leaf | Glyma.17G023000 | 3007 | CASP-like protein 8 | − | | | − | −4.39 |
| Leaf | Glyma.04G123800 | 987 | Ubiquinol oxidase 1, mitochondrial | − | | AOX1A, ATAOX1A | − | −4.41 |
| Leaf | Glyma.02G128000 | 680 | S-adenosylmethionine decarboxylase proenzyme | − | | | − | −4.42 |
| Leaf | Glyma.05G161600 | 1158 | Glutathione S-transferase GST 14 | − | | ATGSTU7, GST25, GSTU7 | − | −4.63 |
| Leaf | Glyma.02G145300 | 691 | Methylcrotonoyl-CoA carboxylase subunit alpha, mitochondrial | − | | MCCA | − | −5.58 |

TABLE 8C

Additional top up- and down- regulated genes in plants grown from seeds treated with Strain C, as compared to plants grown from seeds treated with the formulation control, that were not identified in the qualitative transcriptomics studies.

| | | | | Quantitative Plant Transcriptomics | |
|---|---|---|---|---|---|
| Tissue | Plant GeneName | SEQ ID | Gene Description | Up/Down Regulated | Fold Change |
| Root | Glyma.05G051400 | 1102 | Subtilase family protein | + | 24.26 |
| Root | Glyma.20G056200 | 3471 | serine carboxypeptidase-like 40 | + | 20.53 |
| Root | Glyma.05G246100 | 1213 | beta-6 tubulin | + | 20.44 |
| Leaf | Glyma.13G183200 | 2456 | | + | 20.36 |

TABLE 8C-continued

Additional top up- and down- regulated genes in plants grown from seeds treated with Strain C, as compared to plants grown from seeds treated with the formulation control, that were not identified in the qualitative transcriptomics studies.

| | | | | Quantitative Plant Transcriptomics | | |
|---|---|---|---|---|---|---|
| Tissue | Plant GeneName | SEQ ID | Gene Description | | Up/Down Regulated | Fold Change |
| Root | Glyma.02G235300 | 736 | cytochrome P450, family 71, subfamily A, polypeptide 19 | | + | 18.70 |
| Leaf | Glyma.06G307000 | 1383 | small and basic intrinsic protein 1A | | + | 17.58 |
| Root | Glyma.11G238500 | 2242 | slufate transporter 2; 1 | | + | 17.30 |
| Root | Glyma.19G251500 | 3438 | Subtilase family protein | | + | 17.09 |
| Root | Glyma.09G245900 | 1909 | Uridine diphosphate glycosyltransferase 74E2 | | + | 17.05 |
| Leaf | Glyma.15G057600 | 2736 | | | + | 16.92 |
| Leaf | Glyma.02G055900 | 628 | RAD-like 6 | | + | 16.39 |
| Leaf | Glyma.07G038500 | 1423 | germin-like protein 1 | | + | 16.23 |
| Leaf | Glyma.10G168200 | 1996 | ammonium transporter 1; 2 | | + | 15.62 |
| Root | Glyma.12G217200 | 2344 | nuclear factor Y, subunit C4 | | + | 15.60 |
| Leaf | Glyma.01G184600 | 563 | Protein of unknown function, DUF547 | | + | 14.78 |
| Root | Glyma.11G101900 | 2155 | ATPase E1-E2 type family protein/haloacid dehalogenase-like hydrolase family protein | | + | 14.56 |
| Leaf | Glyma.03G252700 | 904 | GDSL-like Lipase/Acylhydrolase superfamily protein | | + | 14.25 |
| Root | Glyma.09G280500 | 1920 | UDP-glucosyl transferase 73B5 | | + | 14.10 |
| Leaf | Glyma.06G043000 | 1247 | N-terminal nucleophile aminohydrolases (Ntn hydrolases) superfamily protein | | + | 13.72 |
| Leaf | Glyma.06G123200 | 1293 | nodulin MtN21/EamA-like transporter family protein | | + | 13.30 |
| Root | Glyma.09G135900 | 1848 | NAD(P)-binding Rossmann-fold superfamily protein | | + | 13.20 |
| Root | Glyma.20G129000 | 3499 | SPX domain gene 2 | | + | 13.12 |
| Leaf | Glyma.11G098500 | 2151 | proline-rich protein 4 | | + | 13.08 |
| Root | Glyma.08G166600 | 1660 | Eukaryotic aspartyl protease family protein | | + | 12.61 |
| Root | Glyma.10G183400 | 2012 | PLAC8 family protein | | + | 12.60 |
| Root | Glyma.19G167000 | 3382 | peptide transporter 3 | | + | 12.49 |
| Root | Glyma.09G129900 | 1840 | CBS domain-containing protein with a domain of unknown function (DUF21) | | + | 12.47 |
| Root | Glyma.19G157000 | 3375 | Terpenoid cyclases/Protein prenyltransferases superfamily protein | | + | 12.42 |
| Leaf | Glyma.06G218000 | 1347 | Thioredoxin superfamily protein | | + | 12.40 |
| Root | Glyma.08G054000 | 1564 | beta-6 tubulin | | + | 12.36 |
| Root | Glyma.18G147800 | 3225 | U-box domain-containing protein kinase family protein | | + | 12.31 |
| Root | Glyma.11G223400 | 2232 | Cupredoxin superfamily protein | | + | 12.26 |
| Root | Glyma.08G055500 | 1568 | ABC-2 type transporter family protein | | + | 12.24 |
| Root | Glyma.03G187400 | 866 | don-glucosyltransferase 1 | | + | 12.21 |
| Leaf | Glyma.18G228700 | 3252 | Major Facilitator Superfamily with SPX (SYG1/Pho81/XPR1) domain-containing protein | | + | 12.10 |
| Leaf | Glyma.07G023000 | 1416 | NDH-dependent cyclic electron flow 1 | | + | 12.04 |
| Leaf | Glyma.20G065300 | 3475 | Exostosin family protein | | + | 12.03 |
| Root | Glyma.16G180400 | 2970 | Calcium-dependent lipid-binding (CaLB domain) family protein | | + | 11.99 |
| Leaf | Glyma.05G160900 | 1155 | | | + | 11.97 |
| Root | Glyma.15G105900 | 2774 | glucose-6-phosphate/phosphate translocator 2 | | + | 11.94 |
| Root | Glyma.08G327300 | 1751 | cytochrome P450, family 71, subfamily B, polypeptide 35 | | + | 11.93 |
| Leaf | Glyma.02G130500 | 685 | | | + | 11.90 |
| Root | Glyma.02G102700 | 672 | PLC-like phosphodiesterases superfamily protein | | + | 11.85 |
| Leaf | Glyma.04G065600 | 962 | Bifunctional inhibitor/lipid-transfer protein/seed storage 2S albumin superfamily protein | | + | 11.82 |
| Root | Glyma.18G000600 | 3150 | PHYTOENE SYNTHASE | | + | 11.78 |
| Root | Glyma.06G055300 | 1255 | ACT-like protein tyrosine kinase family protein | | + | 11.77 |
| Root | Glyma.20G000800 | 3450 | DNAse I-like superfamily protein | | + | 11.26 |
| Root | Glyma.08G120500 | 1624 | Major facilitator superfamily protein | | + | 11.20 |
| Root | Glyma.10G177100 | 2005 | FAD-binding Berberine family protein | | + | 11.12 |
| Root | Glyma.19G237800 | 3427 | glutathione synthetase 2 | | + | 11.01 |
| Root | Glyma.02G083200 | 648 | cytochrome P450, family 707, subfamily A, polypeptide 3 | | + | 10.89 |
| Leaf | Glyma.07G138900 | 1464 | RHO guanyl-nucleotide exchange factor 11 | | + | 10.75 |
| Root | Glyma.05G108500 | 1126 | NAD(P)-binding Rossmann-fold superfamily protein | | + | 10.70 |
| Root | Glyma.04G036100 | 937 | Major facilitator superfamily protein | | + | 10.59 |
| Root | Glyma.06G139500 | 1303 | ATP binding cassette subfamily B19 | | + | 10.57 |
| Leaf | Glyma.02G063300 | 634 | methyl esterase 1 | | + | 10.23 |
| Leaf | Glyma.14G031200 | 2622 | PHYTOENE SYNTHASE | | + | 10.14 |
| Root | Glyma.02G043300 | 624 | GDSL-like Lipase/Acylhydrolase superfamily protein | | + | 10.05 |
| Leaf | Glyma.15G118500 | 2785 | Heavy metal transport/detoxification superfamily protein | | + | 10.02 |
| Leaf | Glyma.14G005500 | 2605 | | | + | 10.01 |
| Root | Glyma.03G263900 | 918 | GDSL-motif lipase 5 | | + | 10.01 |
| Leaf | Glyma.06G132600 | 1300 | Rhodanese/Cell cycle control phosphatase superfamily protein | | + | 9.98 |
| Leaf | Glyma.16G068700 | 2898 | GDSL-like Lipase/Acylhydrolase superfamily protein | | + | 9.97 |
| Root | Glyma.10G056200 | 1952 | SAUR-like auxin-responsive protein family | | + | 9.91 |
| Root | Glyma.19G244400 | 3431 | ammonium transporter 2 | | + | 9.89 |
| Leaf | Glyma.13G048000 | 2380 | kinase interacting (KIP1-like) family protein | | + | 9.80 |
| Leaf | Glyma.13G274900 | 2526 | squamosa promoter-binding protein-like 12 | | + | 9.75 |
| Leaf | Glyma.10G015500 | 1928 | | | + | 9.69 |
| Leaf | Glyma.08G138200 | 1637 | myo-inositol-1-phosphate synthase 3 | | + | 9.47 |
| Leaf | Glyma.10G168100 | 1994 | ammonium transporter 1; 2 | | + | 9.39 |
| Leaf | Glyma.17G259500 | 3147 | GDSL-like Lipase/Acylhydrolase superfamily protein | | + | 9.39 |
| Leaf | Glyma.19G198500 | 3398 | Eukaryotic aspartyl protease family protein | | + | 9.35 |
| Leaf | Glyma.11G098400 | 2149 | | | + | 9.30 |
| Leaf | Glyma.18G011800 | 3157 | photosystem II BY | | + | 9.25 |
| Leaf | Glyma.09G258400 | 1913 | | | + | 9.19 |
| Leaf | Glyma.03G125000 | 827 | RAD-like 1 | | + | 8.87 |

TABLE 8C-continued

Additional top up- and down- regulated genes in plants grown from seeds treated with Strain C, as compared to plants grown from seeds treated with the formulation control, that were not identified in the qualitative transcriptomics studies.

| | | | | Quantitative Plant Transcriptomics | | |
|---|---|---|---|---|---|---|
| Tissue | Plant GeneName | SEQ ID | Gene Description | | Up/Down Regulated | Fold Change |
| Leaf | Glyma.16G007700 | 2860 | germin-like protein 1 | | + | 8.84 |
| Leaf | Glyma.14G115500 | 2654 | Bifunctional inhibitor/lipid-transfer protein/seed storage 2S albumin superfamily protein | | + | 8.79 |
| Leaf | Glyma.05G036800 | 1090 | basic helix-loop-helix (bHLH) DNA-binding superfamily protein | | + | 8.51 |
| Leaf | Glyma.13G270600 | 2522 | general regulatory factor 9 | | + | 8.50 |
| Root | Glyma.17G055600 | 3036 | | | − | −3.44 |
| Root | Glyma.06G090900 | 1275 | transcription factor-related | | − | −3.44 |
| Root | Glyma.16G175800 | 2965 | Glycosyl hydrolases family 32 protein | | − | −3.44 |
| Root | Glyma.01G225100 | 596 | highly ABA-induced PP2C gene 3 | | − | −3.53 |
| Root | Glyma.18G260000 | 3269 | nitrate transporter 1.5 | | − | −3.54 |
| Root | Glyma.U020300 | 3566 | RmlC-like cupins superfamily protein | | − | −3.55 |
| Root | Glyma.13G216200 | 2483 | Glutaredoxin family protein | | − | −3.58 |
| Root | Glyma.15G096600 | 2765 | Thioredoxin superfamily protein | | − | −3.62 |
| Root | Glyma.03G015900 | 787 | BON association protein 2 | | − | −3.64 |
| Root | Glyma.13G181000 | 2453 | Aluminium induced protein with YGL and LRDR motifs | | − | −3.64 |
| Root | Glyma.13G171400 | 2443 | | | − | −3.68 |
| Root | Glyma.15G001300 | 2701 | autoinhibited Ca(2+)-ATPase 9 | | − | −3.70 |
| Root | Glyma.11G059100 | 2130 | Reticulan like protein B13 | | − | −3.74 |
| Root | Glyma.10G134400 | 1976 | CCT motif family protein | | − | −3.78 |
| Root | Glyma.06G154200 | 1315 | cation/hydrogen exchanger 15 | | − | −3.78 |
| Root | Glyma.04G061300 | 960 | WRKY DNA-binding protein 40 | | − | −3.81 |
| Root | Glyma.03G197900 | 874 | NAC domain containing protein 90 | | − | −3.84 |
| Root | Glyma.09G091800 | 1824 | | | − | −3.85 |
| Root | Glyma.10G072400 | 1962 | | | − | −3.86 |
| Root | Glyma.08G181100 | 1671 | xylem NAC domain 1 | | − | −3.87 |
| Root | Glyma.13G230300 | 2495 | Pollen Ole e 1 allergen and extensin family protein | | − | −3.88 |
| Root | Glyma.17G092800 | 3054 | Gibberellin-regulated family protein | | − | −4.02 |
| Root | Glyma.02G110600 | 676 | EXS (ERD1/XPR1/SYG1) family protein | | − | −4.06 |
| Root | Glyma.13G150100 | 2433 | SAUR-like auxin-responsive protein family | | − | −4.07 |
| Root | Glyma.08G079700 | 1590 | | | − | −4.10 |
| Root | Glyma.07G052600 | 1431 | | | − | −4.14 |
| Root | Glyma.01G139900 | 537 | glycoprotease 1 | | − | −4.17 |
| Root | Glyma.16G207500 | 2988 | Peroxidase superfamily protein | | − | −4.38 |
| Root | Glyma.02G208600 | 712 | Protein of unknown function (DUF1637) | | − | −4.74 |
| Root | Glyma.20G200900 | 3540 | seed gene 1 | | − | −4.77 |
| Root | Glyma.06G072400 | 1268 | 2-oxoglutarate (2OG) and Fe(II)-dependent oxygenase superfamily protein | | − | −4.83 |
| Root | Glyma.18G242400 | 3257 | RING/FYVE/PHD zinc finger superfamily protein | | − | −4.97 |
| Root | Glyma.06G062000 | 1263 | | | − | −4.97 |
| Root | Glyma.13G035200 | 2374 | alcohol dehydrogenase 1 | | − | −5.11 |
| Root | Glyma.16G150100 | 2937 | Heavy metal transport/detoxification superfamily protein | | − | −5.14 |
| Root | Glyma.20G191800 | 3538 | Peroxidase superfamily protein | | − | −5.16 |
| Root | Glyma.05G112000 | 1128 | Late embryogenesis abundant protein, group 1 protein | | − | −5.41 |
| Root | Glyma.05G223400 | 1199 | S-adenosyl-L-methionine-dependent methyltransferases superfamily protein | | − | −5.56 |
| Root | Glyma.14G209000 | 2693 | oxidative stress 3 | | − | −5.89 |
| Root | Glyma.20G175800 | 3533 | GAST1 protein homolog 3 | | − | −6.12 |
| Leaf | Glyma.07G220000 | 1505 | Glycosyl hydrolase superfamily protein | | − | −8.62 |
| Leaf | Glyma.13G222700 | 2491 | Pentatricopeptide repeat (PPR) superfamily protein | | − | −8.75 |
| Leaf | Glyma.06G319700 | 1391 | Leucine-rich repeat (LRR) family protein | | − | −8.79 |
| Leaf | Glyma.05G082400 | 1111 | Disease resistance protein (CC-NBS-LRR class) family | | − | −8.82 |
| Leaf | Glyma.20G210100 | 3544 | Eukaryotic aspartyl protease family protein | | − | −8.95 |
| Leaf | Glyma.15G206800 | 2826 | Glycosyl hydrolase family protein with chitinase insertion domain | | − | −9.05 |
| Leaf | Glyma.13G115500 | 2419 | lysine-ketoglutarate reductase/saccharopine dehydrogenase bifunctional enzyme | | − | −9.09 |
| Leaf | Glyma.09G139600 | 1853 | CAP160 protein | | − | −9.12 |
| Leaf | Glyma.02G281400 | 755 | Bifunctional inhibitor/lipid-transfer protein/seed storage 2S albumin superfamily protein | | − | −9.15 |
| Leaf | Glyma.18G121000 | 3213 | | | − | −9.19 |
| Leaf | Glyma.04G070000 | 965 | | | − | −9.23 |
| Leaf | Glyma.19G214300 | 3410 | | | − | −9.34 |
| Leaf | Glyma.02G148200 | 693 | Eukaryotic aspartyl protease family protein | | − | −9.37 |
| Leaf | Glyma.18G231500 | 3253 | | | − | −9.41 |
| Leaf | Glyma.U020300 | 3566 | RmlC-like cupins superfamily protein | | − | −9.48 |
| Leaf | Glyma.10G046000 | 1949 | exocyst subunit exo70 family protein H4 | | − | −9.54 |
| Leaf | Glyma.05G208300 | 1192 | basic helix-loop-helix (bHLH) DNA-binding superfamily protein | | − | −9.57 |
| Leaf | Glyma.10G207100 | 2037 | Papain family cysteine protease | | − | −9.76 |
| Leaf | Glyma.17G033300 | 3016 | Acyl-CoA N-acyltransferases (NAT) superfamily protein | | − | −9.85 |
| Leaf | Glyma.12G150400 | 2313 | protochlorophyllide oxidoreductase A | | − | −9.96 |
| Leaf | Glyma.12G088300 | 2293 | NAD+ ADP-ribosyltransferases; NAD+ ADP-ribosyltransferases | | − | −9.97 |
| Leaf | Glyma.12G223500 | 2352 | Dynein light chain type 1 family protein | | − | −9.99 |
| Leaf | Glyma.14G145800 | 2662 | Regulator of chromosome condensation (RCC1) family protein | | − | −10.02 |
| Leaf | Glyma.17G135100 | 3083 | Protein of unknown function (DUF1442) | | − | −10.16 |
| Leaf | Glyma.17G044300 | 3028 | lysine-ketoglutarate reductase/saccharopine dehydrogenase bifunctional enzyme | | − | −10.19 |
| Leaf | Glyma.20G144800 | 3514 | Haloacid dehalogenase-like hydrolase (HAD) superfamily protein | | − | −10.40 |
| Leaf | Glyma.13G179200 | 2451 | Protein of unknown function (DUF506) | | − | −10.66 |
| Leaf | Glyma.06G062000 | 1263 | | | − | −10.69 |

TABLE 8C-continued

Additional top up- and down- regulated genes in plants grown from seeds treated with Strain C, as compared to plants grown from seeds treated with the formulation control, that were not identified in the qualitative transcriptomics studies.

| | | | Quantitative Plant Transcriptomics | | |
|---|---|---|---|---|---|
| Tissue | Plant GeneName | SEQ ID | Gene Description | Up/Down Regulated | Fold Change |
| Leaf | Glyma.08G330000 | 1755 | | − | −11.05 |
| Leaf | Glyma.16G164800 | 2948 | Integrase-type DNA-binding superfamily protein | − | −11.16 |
| Leaf | Glyma.08G042100 | 1560 | myb domain protein 62 | − | −11.30 |
| Leaf | Glyma.03G234500 | 894 | alpha/beta-Hydrolases superfamily protein | − | −14.71 |
| Leaf | Glyma.06G050100 | 1250 | branched-chain amino acid transaminase 2 | − | −15.00 |
| Leaf | Glyma.17G115900 | 3073 | Lactoylglutathione lyase/glyoxalase I family protein | − | −15.85 |
| Leaf | Glyma.19G033900 | 3323 | brassinosteroid-6-oxidase 2 | − | −16.76 |
| Leaf | Glyma.06G028300 | 1234 | Integrase-type DNA-binding superfamily protein | − | −17.41 |
| Leaf | Glyma.15G186100 | 2817 | Cytidine/deoxycytidylate deaminase family protein | − | −17.53 |
| Leaf | Glyma.08G131300 | 1630 | senescence associated gene 18 | − | −27.11 |
| Leaf | Glyma.03G113200 | 818 | NAD(P)-binding Rossmann-fold superfamily protein | − | −32.60 |
| Leaf | Glyma.01G178800 | 552 | PQ-loop repeat family protein/transmembrane family protein | − | −46.06 |

TABLE 8D

Genes that are significantly up- or down- regulated in soybean plants grown from seeds treated with Strain C but that are not found to be significantly up- or down- regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.05G051400 | 1102 | Subtilase family protein | 24.26 |
| root | Glyma.11G238500 | 2242 | slufate transporter 2; 1 | 17.30 |
| root | Glyma.19G251500 | 3438 | Subtilase family protein | 17.09 |
| root | Glyma.09G245900 | 1909 | Uridine diphosphate glycosyltransferase 74E2 | 17.05 |
| root | Glyma.11G101900 | 2155 | ATPase E1-E2 type family protein/haloacid dehalogenase-like hydrolase family protein | 14.56 |
| root | Glyma.17G073400 | 3046 | early nodulin-like protein 15 | 14.07 |
| root | Glyma.08G166600 | 1660 | Eukaryotic aspartyl protease family protein | 12.61 |
| root | Glyma.16G180400 | 2970 | Calcium-dependent lipid-binding (CaLB domain) family protein | 11.99 |
| root | Glyma.02G102700 | 672 | PLC-like phosphodiesterases superfamily protein | 11.85 |
| root | Glyma.19G237800 | 3427 | glutathione synthetase 2 | 11.01 |
| root | Glyma.02G245600 | 741 | Gibberellin-regulated family protein | 10.39 |
| root | Glyma.10G056200 | 1952 | SAUR-like auxin-responsive protein family | 9.91 |
| root | Glyma.18G012300 | 3159 | Pectate lyase family protein | 9.85 |
| leaf | Glyma.10G015500 | 1928 | | 9.69 |
| root | Glyma.02G092600 | 657 | Uncharacterised protein family (UPF0497) | 9.68 |
| root | Glyma.08G190700 | 1678 | multidrug resistance-associated protein 6 | 9.67 |
| root | Glyma.16G053000 | 2889 | GRAS family transcription factor | 9.60 |
| root | Glyma.18G289800 | 3286 | Uncharacterised protein family (UPF0497) | 9.55 |
| root | Glyma.15G260600 | 2849 | Eukaryotic aspartyl protease family protein | 9.44 |
| root | Glyma.13G177100 | 2449 | | 9.04 |
| root | Glyma.08G245600 | 1720 | glycosyl hydrolase family 81 protein | 9.00 |
| root | Glyma.09G188700 | 1872 | sulfate transporter 3; 1 | 8.82 |
| root | Glyma.12G190900 | 2328 | | 8.79 |
| root | Glyma.02G044300 | 626 | NEP-interacting protein 2 | 8.72 |
| root | Glyma.20G063100 | 3473 | zinc transporter 1 precursor | 8.70 |
| root | Glyma.12G161500 | 2317 | Tyrosine transaminase family protein | 8.70 |
| root | Glyma.16G048800 | 2886 | beta-galactosidase 7 | 8.60 |
| root | Glyma.18G018900 | 3164 | slufate transporter 2; 1 | 8.49 |
| root | Glyma.14G064400 | 2639 | Subtilase family protein | 8.31 |
| root | Glyma.08G166200 | 1658 | Eukaryotic aspartyl protease family protein | 8.28 |
| root | Glyma.10G206800 | 2035 | | 7.89 |
| root | Glyma.16G121900 | 2920 | NEP-interacting protein 2 | 7.89 |
| root | Glyma.17G202900 | 3118 | O-Glycosyl hydrolases family 17 protein | 7.60 |
| root | Glyma.08G102100 | 1608 | NAD(P)-binding Rossmann-fold superfamily protein | 7.51 |
| root | Glyma.13G191600 | 2465 | sulfotransferase 2A | 7.49 |
| root | Glyma.15G176200 | 2810 | | 7.48 |
| root | Glyma.05G175500 | 1165 | GTP cyclohydrolase II | 7.43 |
| leaf | Glyma.06G023900 | 1230 | Pathogenesis-related thaumatin superfamily protein | 7.39 |
| leaf | Glyma.11G057600 | 2129 | Protein of unknown function, DUF547 | 7.27 |
| root | Glyma.08G215300 | 1699 | basic helix-loop-helix (bHLH) DNA-binding superfamily protein | 7.27 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.07G005800 | 1406 | | 7.14 |
| root | Glyma.13G182800 | 2454 | Protein of unknown function (DUF1218) | 7.05 |
| root | Glyma.05G126200 | 1136 | RmlC-like cupins superfamily protein | 7.01 |
| root | Glyma.19G105500 | 3354 | GRF zinc finger/Zinc knuckle protein | 7.01 |
| root | Glyma.09G260500 | 1915 | | 7.00 |
| root | Glyma.08G079800 | 1591 | Ankyrin repeat family protein | 6.91 |
| root | Glyma.13G364400 | 2595 | | 6.84 |
| root | Glyma.09G228000 | 1900 | Protein of unknown function, DUF642 | 6.76 |
| root | Glyma.15G048400 | 3845 | XS domain-containing protein/XS zinc finger domain-containing protein-related | 6.76 |
| root | Glyma.14G032000 | 2624 | | 6.74 |
| root | Glyma.02G244000 | 740 | glutamine synthase clone R1 | 6.73 |
| root | Glyma.05G017000 | 4147 | glutamine dumper 2 | 6.56 |
| leaf | Glyma.16G151000 | 2939 | PEBP (phosphatidylethanolamine-binding protein) family protein | 6.50 |
| root | Glyma.06G182700 | 1331 | carbonic anhydrase 2 | 6.50 |
| root | Glyma.10G078500 | 1965 | Putative lysine decarboxylase family protein | 6.49 |
| root | Glyma.15G025300 | 2720 | calmodulin-binding family protein | 6.48 |
| leaf | Glyma.03G028000 | 789 | Arginase/deacetylase superfamily protein | 6.43 |
| leaf | Glyma.07G219600 | 1503 | CLAVATA3/ESR-RELATED 17 | 6.43 |
| leaf | Glyma.11G149100 | 2181 | cytokinin oxidase/dehydrogenase 6 | 6.37 |
| root | Glyma.08G065500 | 1579 | Concanavalin A-like lectin protein kinase family protein | 6.36 |
| root | Glyma.05G204500 | 4183 | CBS/octicosapeptide/Phox/Bemp1 (PB1) domains-containing protein | 6.18 |
| root | Glyma.07G214000 | 3780 | Nucleic acid-binding, OB-fold-like protein | 6.18 |
| leaf | Glyma.02G080800 | 644 | light-harvesting chlorophyll-protein complex II subunit B1 | 6.13 |
| leaf | Glyma.08G205800 | 1695 | Mitochondrial substrate carrier family protein | 6.13 |
| leaf | Glyma.19G024200 | 3310 | expansin A15 | 6.11 |
| root | Glyma.08G162400 | 1655 | Eukaryotic aspartyl protease family protein | 6.11 |
| root | Glyma.12G090800 | 2295 | germin-like protein 10 | 6.05 |
| leaf | Glyma.13G172100 | 2444 | glutamate receptor 2.7 | 6.02 |
| root | Glyma.13G183500 | 2458 | | 6.00 |
| root | Glyma.06G192300 | 4494 | BANQUO 3 | 5.99 |
| root | Glyma.02G204500 | 711 | early nodulin-like protein 10 | 5.99 |
| root | Glyma.06G123300 | 1295 | nodulin MtN21/EamA-like transporter family protein | 5.97 |
| root | Glyma.10G252600 | 2066 | | 5.97 |
| root | Glyma.06G194700 | 1337 | | 5.83 |
| root | Glyma.11G035500 | 2110 | 2-oxoglutarate (2OG) and Fe(II)-dependent oxygenase superfamily protein | 5.80 |
| root | Glyma.05G181500 | 1170 | Heavy metal transport/detoxification superfamily protein | 5.78 |
| root | Glyma.11G097800 | 2147 | plasma membrane intrinsic protein 1A | 5.75 |
| root | Glyma.01G095000 | 521 | kunitz trypsin inhibitor 1 | 5.73 |
| root | Glyma.11G066400 | 4239 | Major facilitator superfamily protein | 5.71 |
| leaf | Glyma.13G169400 | 2441 | | 5.71 |
| root | Glyma.03G200200 | 875 | Ovate family protein | 5.70 |
| root | Glyma.17G054500 | 3652 | cytokinin oxidase 3 | 5.63 |
| root | Glyma.05G121700 | 4158 | | 5.62 |
| root | Glyma.09G134100 | 1845 | MATE efflux family protein | 5.61 |
| root | Glyma.11G035700 | 4232 | 2-oxoglutarate (2OG) and Fe(II)-dependent oxygenase superfamily protein | 5.60 |
| root | Glyma.04G109500 | 3735 | transmembrane receptors; ATP binding | 5.59 |
| leaf | Glyma.03G240700 | 897 | Protein of unknown function (DUF1068) | 5.55 |
| leaf | Glyma.07G030500 | 1420 | Tetratricopeptide repeat (TPR)-like superfamily protein | 5.54 |
| root | Glyma.18G247100 | 4518 | UDP-Glycosyltransferase superfamily protein | 5.54 |
| root | Glyma.15G220600 | 3850 | F-box and associated interaction domains-containing protein | 5.53 |
| root | Glyma.18G150300 | 3228 | Concanavalin A-like lectin protein kinase family protein | 5.53 |
| root | Glyma.19G152100 | 4012 | Protein kinase family protein | 5.52 |
| leaf | Glyma.11G035100 | 2108 | Integrase-type DNA-binding superfamily protein | 5.52 |
| root | Glyma.12G178000 | 4421 | xyloglucan endotransglucosylase/hydrolase 32 | 5.52 |
| root | Glyma.02G090100 | 654 | MATE efflux family protein | 5.52 |
| root | Glyma.05G163000 | 1159 | nitrate transporter 1:2 | 5.51 |
| leaf | Glyma.06G143300 | 1306 | expansin A8 | 5.46 |
| root | Glyma.18G047000 | 4532 | NC domain-containing protein-related | 5.46 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.18G106300 | 3208 | rhamnose biosynthesis 1 | 5.42 |
| leaf | Glyma.01G142400 | 538 | | 5.41 |
| leaf | Glyma.16G200100 | 2982 | Pyridoxal phosphate (PLP)-dependent transferases superfamily protein | 5.41 |
| root | Glyma.17G019600 | 3635 | UDP-glucosyl transferase 73B1 | 5.41 |
| root | Glyma.09G283600 | 3724 | Transcription factor jumonji (jmj) family protein/zinc finger (C5HC2 type) family protein | 5.40 |
| leaf | Glyma.11G168000 | 2190 | Basic-leucine zipper (bZIP) transcription factor family protein | 5.38 |
| root | Glyma.18G034000 | 4546 | Major facilitator superfamily protein | 5.34 |
| root | Glyma.20G152600 | 3522 | subtilase 1.3 | 5.32 |
| root | Glyma.11G150800 | 2185 | O-methyltransferase 1 | 5.31 |
| root | Glyma.13G295000 | 3901 | Tyrosine transaminase family protein | 5.29 |
| root | Glyma.05G069700 | 4174 | purine permease 10 | 5.27 |
| root | Glyma.04G198200 | 1024 | tapetum determinant 1 | 5.25 |
| leaf | Glyma.15G024300 | 2716 | Protein kinase superfamily protein | 5.24 |
| root | Glyma.15G260700 | 3840 | Eukaryotic aspartyl protease family protein | 5.21 |
| root | Glyma.03G041300 | 795 | Nuclear transport factor 2 (NTF2) family protein | 5.20 |
| leaf | Glyma.15G011700 | 2708 | | 5.17 |
| root | Glyma.16G137300 | 4581 | disease resistance protein (TIR-NBS-LRR class), putative | 5.16 |
| root | Glyma.04G227900 | 3757 | 2-oxoglutarate (2OG) and Fe(II)-dependent oxygenase superfamily protein | 5.16 |
| root | Glyma.11G196700 | 4217 | alpha carbonic anhydrase 7 | 5.13 |
| root | Glyma.08G275000 | 1728 | Concanavalin A-like lectin protein kinase family protein | 5.13 |
| root | Glyma.02G186000 | 707 | UDP-Glycosyltransferase superfamily protein | 5.13 |
| leaf | Glyma.15G001000 | 2700 | Protein of unknown function (DUF3754) | 5.10 |
| root | Glyma.17G124700 | 3651 | | 5.09 |
| root | Glyma.15G076600 | 3833 | | 5.07 |
| root | Glyma.19G259700 | 4035 | NAC (No Apical Meristem) domain transcriptional regulator superfamily protein | 5.06 |
| root | Glyma.15G025200 | 3849 | | 5.06 |
| root | Glyma.08G360400 | 4295 | senescence-associated gene 29 | 5.05 |
| root | Glyma.13G093700 | 2407 | Protein kinase superfamily protein | 5.05 |
| root | Glyma.15G213300 | 3826 | scarecrow-like 3 | 5.04 |
| leaf | Glyma.19G144600 | 3371 | cytochrome P450, family 712, subfamily A, polypeptide 1 | 5.03 |
| root | Glyma.14G052400 | 2633 | | 5.00 |
| root | Glyma.01G174400 | 4396 | Major facilitator superfamily protein | 5.00 |
| root | Glyma.13G250800 | 3925 | zinc finger protein-related | 4.98 |
| leaf | Glyma.03G260400 | 915 | | 4.95 |
| leaf | Glyma.13G273400 | 2525 | | 4.93 |
| root | Glyma.01G128300 | 4382 | iron regulated 1 | 4.92 |
| root | Glyma.10G060100 | 3583 | glutamate-ammonia ligases; catalytics; glutamate-ammonia ligases | 4.91 |
| root | Glyma.07G113100 | 3769 | Auxin efflux carrier family protein | 4.90 |
| leaf | Glyma.03G179200 | 857 | Seven transmembrane MLO family protein | 4.90 |
| root | Glyma.U014500 | 4286 | expansin B2 | 4.90 |
| root | Glyma.18G016900 | 3163 | | 4.89 |
| root | Glyma.01G156900 | 4383 | | 4.88 |
| root | Glyma.01G174500 | 4375 | Major facilitator superfamily protein | 4.87 |
| root | Glyma.10G084000 | 3623 | calcium dependent protein kinase 1 | 4.87 |
| leaf | Glyma.09G009100 | 1777 | Protein kinase superfamily protein | 4.86 |
| leaf | Glyma.07G017300 | 1411 | Integrase-type DNA-binding superfamily protein | 4.85 |
| leaf | Glyma.18G037400 | 3172 | *ROTUNDIFOLIA* like 8 | 4.84 |
| root | Glyma.17G125300 | 3678 | cytochrome P450, family 71, subfamily B, polypeptide 37 | 4.83 |
| root | Glyma.13G327600 | 3929 | NAC domain containing protein 25 | 4.82 |
| root | Glyma.02G063500 | 3937 | methyl esterase 1 | 4.81 |
| root | Glyma.10G250700 | 3626 | Protein of unknown function (DUF3049) | 4.81 |
| root | Glyma.18G263700 | 4560 | O-methyltransferase 1 | 4.80 |
| root | Glyma.02G265500 | 3941 | | 4.79 |
| leaf | Glyma.01G148700 | 542 | ASH1-related protein 2 | 4.79 |
| root | Glyma.11G028000 | 4212 | Subtilase family protein | 4.79 |
| root | Glyma.13G177600 | 3896 | OBF-binding protein 3 | 4.79 |
| root | Glyma.06G286700 | 1375 | O-methyltransferase family protein | 4.77 |
| root | Glyma.18G285300 | 4533 | | 4.75 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.09G231900 | 1904 | Plant invertase/pectin methylesterase inhibitor superfamily protein | 4.75 |
| root | Glyma.09G282700 | 3721 | cytochrome P450, family 86, subfamily B, polypeptide 1 | 4.75 |
| leaf | Glyma.13G351600 | 2585 | Pyridoxal phosphate phosphatase-related protein | 4.73 |
| leaf | Glyma.07G032300 | 1421 | Ran BP2/NZF zinc finger-like superfamily protein | 4.73 |
| root | Glyma.02G217700 | 3999 | | 4.73 |
| root | Glyma.03G102000 | 4098 | Fatty acid hydroxylase superfamily | 4.73 |
| leaf | Glyma.19G261400 | 3447 | Chlorophyll A-B binding family protein | 4.72 |
| root | Glyma.18G034500 | 4566 | Cupredoxin superfamily protein | 4.71 |
| root | Glyma.12G237400 | 4423 | MATE efflux family protein | 4.71 |
| root | Glyma.02G218300 | 725 | Glutamyl-tRNA reductase family protein | 4.70 |
| root | Glyma.04G006400 | 3759 | SAUR-like auxin-responsive protein family | 4.70 |
| root | Glyma.09G130000 | 3693 | CBS domain-containing protein with a domain of unknown function (DUF21) | 4.68 |
| leaf | Glyma.07G016900 | 1410 | | 4.67 |
| leaf | Glyma.08G318900 | 1747 | heat shock protein 21 | 4.67 |
| leaf | Glyma.06G084200 | 1270 | Phosphorylase superfamily protein | 4.66 |
| root | Glyma.06G066800 | 4454 | | 4.66 |
| leaf | Glyma.13G321100 | 2565 | terpene synthase 03 | 4.65 |
| root | Glyma.15G112700 | 3846 | ethylene-forming enzyme | 4.65 |
| root | Glyma.04G006500 | 3738 | SAUR-like auxin-responsive protein family | 4.64 |
| leaf | Glyma.04G068400 | 964 | Ran BP2/NZF zinc finger-like superfamily protein | 4.64 |
| root | Glyma.12G080100 | 4419 | xyloglucan endotransglucosylase/hydrolase 32 | 4.64 |
| leaf | Glyma.20G142300 | 3512 | | 4.63 |
| leaf | Glyma.05G011200 | 1072 | | 4.62 |
| root | Glyma.08G274600 | 4299 | Concanavalin A-like lectin protein kinase family protein | 4.61 |
| root | Glyma.13G269100 | 3887 | pathogenesis-related family protein | 4.61 |
| root | Glyma.05G133600 | 4169 | RING-H2 finger A3A | 4.59 |
| root | Glyma.06G119200 | 4455 | wall-associated kinase 2 | 4.58 |
| root | Glyma.18G274400 | 4547 | UDP-Glycosyltransferase superfamily protein | 4.57 |
| root | Glyma.20G118700 | 3496 | Protein kinase superfamily protein | 4.56 |
| root | Glyma.10G196900 | 3622 | Protein of unknown function (DUF594) | 4.54 |
| leaf | Glyma.08G171000 | 1663 | | 4.53 |
| leaf | Glyma.16G028100 | 2869 | Cytochrome b561/ferric reductase transmembrane with DOMON related domain | 4.53 |
| root | Glyma.12G149600 | 4435 | Regulator of Vps4 activity in the MVB pathway protein | 4.52 |
| root | Glyma.11G076300 | 4196 | | 4.52 |
| root | Glyma.18G173600 | 4528 | | 4.51 |
| root | Glyma.U016700 | 4285 | carotenoid cleavage dioxygenase 7 | 4.51 |
| root | Glyma.05G066300 | 4139 | | 4.51 |
| root | Glyma.08G132700 | 4353 | GTP cyclohydrolase II | 4.50 |
| root | Glyma.08G038600 | 4371 | Flavin-binding monooxygenase family protein | 4.50 |
| leaf | Glyma.08G356200 | 1766 | | 4.49 |
| root | Glyma.02G130500 | 685 | | 4.48 |
| root | Glyma.15G267400 | 3835 | Domain of unknown function (DUF966) | 4.46 |
| root | Glyma.13G291100 | 3871 | Protein of unknown function, DUF538 | 4.46 |
| leaf | Glyma.01G161000 | 545 | *Arabidopsis* protein of unknown function (DUF241) | 4.46 |
| root | Glyma.03G178700 | 4054 | | 4.45 |
| leaf | Glyma.02G051700 | 627 | beta-galactosidase 3 | 4.45 |
| leaf | Glyma.13G344600 | 2577 | | 4.45 |
| root | Glyma.08G037200 | 4311 | Major facilitator superfamily protein | 4.45 |
| root | Glyma.09G118300 | 3700 | MLP-like protein 43 | 4.44 |
| root | Glyma.06G006100 | 4485 | SAUR-like auxin-responsive protein family | 4.44 |
| leaf | Glyma.11G049700 | 2120 | | 4.41 |
| root | Glyma.14G064800 | 4242 | RAB GTPase homolog A2B | 4.40 |
| root | Glyma.15G127900 | 3824 | LOB domain-containing protein 4 | 4.39 |
| root | Glyma.02G265200 | 750 | | 4.39 |
| leaf | Glyma.06G040200 | 1241 | | 4.39 |
| root | Glyma.01G078300 | 517 | cytochrome P450, family 83, subfamily B, polypeptide 1 | 4.39 |
| root | Glyma.06G143300 | 1306 | expansin A8 | 4.38 |
| leaf | Glyma.04G028900 | 932 | cytokinin oxidase 5 | 4.36 |
| leaf | Glyma.15G103500 | 2770 | *ROTUNDIFOLIA* like 14 | 4.36 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.17G124800 | 3667 | | 4.36 |
| leaf | Glyma.08G311500 | 1745 | spermidine hydroxycinnamoyl transferase | 4.35 |
| leaf | Glyma.19G197800 | 3397 | Ovate family protein | 4.35 |
| root | Glyma.09G129700 | 3706 | CBS domain-containing protein with a domain of unknown function (DUF21) | 4.33 |
| leaf | Glyma.02G209800 | 714 | MMS ZWEI homologue 1 | 4.33 |
| leaf | Glyma.02G153200 | 698 | Thioredoxin superfamily protein | 4.33 |
| root | Glyma.02G192700 | 3949 | calcium dependent protein kinase 1 | 4.32 |
| root | Glyma.05G162900 | 4145 | Dynamin related protein 4C | 4.32 |
| root | Glyma.16G168900 | 4596 | cytochrome P450, family 707, subfamily A, polypeptide 3 | 4.32 |
| root | Glyma.08G146900 | 4354 | GRAS family transcription factor | 4.31 |
| leaf | Glyma.U033700 | 3577 | CCT motif family protein | 4.31 |
| leaf | Glyma.05G228100 | 1202 | Integrase-type DNA-binding superfamily protein | 4.30 |
| root | Glyma.08G194900 | 4334 | Pyridoxal phosphate phosphatase-related protein | 4.29 |
| leaf | Glyma.11G049600 | 2119 | Peroxidase superfamily protein | 4.29 |
| root | Glyma.07G249000 | 3786 | nuclear factor Y, subunit B5 | 4.28 |
| leaf | Glyma.11G098100 | 2148 | | 4.28 |
| root | Glyma.19G261600 | 4017 | Protein of unknown function (DUF1295) | 4.27 |
| root | Glyma.17G060400 | 3668 | heavy metal atpase 2 | 4.27 |
| root | Glyma.15G045000 | 2730 | | 4.26 |
| root | Glyma.08G102200 | 4359 | | 4.26 |
| root | Glyma.06G023900 | 1230 | Pathogenesis-related thaumatin superfamily protein | 4.25 |
| leaf | Glyma.17G197000 | 3117 | Disease resistance protein (TIR-NBS-LRR class) family | 4.25 |
| root | Glyma.02G286100 | 3996 | cellulose synthase like D4 | 4.25 |
| root | Glyma.09G033700 | 3715 | Plant invertase/pectin methylesterase inhibitor superfamily protein | 4.24 |
| leaf | Glyma.01G193300 | 581 | BTB and TAZ domain protein 4 | 4.24 |
| root | Glyma.15G055900 | 3831 | | 4.24 |
| leaf | Glyma.05G119000 | 1130 | light harvesting complex photosystem II subunit 6 | 4.23 |
| root | Glyma.08G283300 | 4370 | protein kinase family protein/peptidoglycan-binding LysM domain-containing protein | 4.23 |
| root | Glyma.09G201500 | 3711 | Concanavalin A-like lectin protein kinase family protein | 4.21 |
| leaf | Glyma.08G202200 | 1692 | | 4.20 |
| root | Glyma.06G302200 | 4463 | terpene synthase-like sequence-1,8-cineole | 4.19 |
| leaf | Glyma.13G350000 | 2584 | Protein kinase superfamily protein | 4.19 |
| root | Glyma.03G104700 | 4053 | UDP-Glycosyltransferase superfamily protein | 4.18 |
| root | Glyma.01G239800 | 4386 | Protein of unknown function (DUF3049) | 4.18 |
| root | Glyma.11G224600 | 4199 | subtilase 4.13 | 4.18 |
| leaf | Glyma.10G125000 | 1973 | Pectin lyase-like superfamily protein | 4.18 |
| leaf | Glyma.05G094700 | 1116 | | 4.18 |
| leaf | Glyma.05G029700 | 1083 | voltage dependent anion channel 1 | 4.18 |
| root | Glyma.19G120200 | 4024 | MATE efflux family protein | 4.18 |
| leaf | Glyma.08G297000 | 1736 | Integrase-type DNA-binding superfamily protein | 4.17 |
| root | Glyma.U016300 | 4291 | Pectin lyase-like superfamily protein | 4.17 |
| root | Glyma.03G246200 | 4086 | IQ-domain 19 | 4.16 |
| leaf | Glyma.13G357100 | 2590 | HD-ZIP IV family of homeobox-leucine zipper protein with lipid-binding START domain | 4.16 |
| root | Glyma.20G192100 | 4130 | OPC-8:0 CoA ligase1 | 4.16 |
| root | Glyma.12G053300 | 4430 | | 4.15 |
| leaf | Glyma.06G108400 | 1281 | | 4.15 |
| leaf | Glyma.02G209900 | 715 | pyrophosphorylase 3 | 4.15 |
| leaf | Glyma.10G198800 | 2026 | haemoglobin 2 | 4.15 |
| leaf | Glyma.08G141000 | 1645 | nuclear factor Y, subunit B3 | 4.14 |
| leaf | Glyma.18G207900 | 3245 | SEC14 cytosolic factor family protein/phosphoglyceride transfer family protein | 4.14 |
| leaf | Glyma.05G143000 | 1147 | | 4.14 |
| root | Glyma.11G097100 | 4218 | | 4.13 |
| root | Glyma.07G144700 | 1471 | phosphate transporter 4; 2 | 4.13 |
| root | Glyma.15G140200 | 3838 | ATP-citrate lyase B-1 | 4.13 |
| root | Glyma.14G064200 | 4263 | Subtilisin-like serine endopeptidase family protein | 4.13 |
| root | Glyma.05G057000 | 4172 | Bifunctional inhibitor/lipid-transfer protein/seed storage 2S albumin superfamily protein | 4.13 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.13G300600 | 3907 | Family of unknown function (DUF566) | 4.12 |
| root | Glyma.11G224200 | 4215 | Major facilitator superfamily protein | 4.12 |
| root | Glyma.11G027900 | 4236 | Subtilase family protein | 4.11 |
| leaf | Glyma.11G085800 | 2145 | Expressed protein | 4.11 |
| root | Glyma.02G083000 | 3990 | cytochrome P450, family 707, subfamily A, polypeptide 3 | 4.11 |
| root | Glyma.04G244100 | 3756 | wall-associated kinase 2 | 4.11 |
| root | Glyma.09G117200 | 3713 | AP2/B3-like transcriptional factor family protein | 4.10 |
| root | Glyma.04G222100 | 1040 | expansin A8 | 4.10 |
| root | Glyma.06G184400 | 4514 | Leucine-rich repeat protein kinase family protein | 4.09 |
| leaf | Glyma.18G057800 | 3183 | UDP-Glycosyltransferase superfamily protein | 4.09 |
| leaf | Glyma.18G030300 | 3169 | Duplicated homeodomain-like superfamily protein | 4.09 |
| leaf | Glyma.12G214300 | 2342 | | 4.08 |
| root | Glyma.09G014400 | 3704 | Bifunctional inhibitor/lipid-transfer protein/seed storage 2S albumin superfamily protein | 4.07 |
| leaf | Glyma.05G027500 | 1081 | | 4.06 |
| leaf | Glyma.03G189800 | 868 | Leucine-rich repeat protein kinase family protein | 4.06 |
| root | Glyma.20G036600 | 4128 | Protein of unknown function (DUF1666) | 4.06 |
| leaf | Glyma.03G105000 | 817 | basic helix-loop-helix (bHLH) DNA-binding superfamily protein | 4.05 |
| root | Glyma.01G020600 | 4376 | Concanavalin A-like lectin protein kinase family protein | 4.04 |
| leaf | Glyma.07G181200 | 1486 | | 4.04 |
| root | Glyma.08G012800 | 4338 | Remorin family protein | 4.04 |
| root | Glyma.08G216600 | 4361 | Integrase-type DNA-binding superfamily protein | 4.03 |
| leaf | Glyma.03G243000 | 900 | sodium hydrogen exchanger 2 | 4.03 |
| root | Glyma.01G148700 | 542 | ASH1-related protein 2 | 4.03 |
| root | Glyma.09G120000 | 3702 | Heavy metal transport/detoxification superfamily protein | 4.02 |
| root | Glyma.07G225300 | 3779 | SKU5 similar 12 | 4.01 |
| root | Glyma.16G043300 | 4586 | apyrase 2 | 4.01 |
| root | Glyma.08G063300 | 4343 | D-aminoacid aminotransferase-like PLP-dependent enzymes superfamily protein | 4.01 |
| leaf | Glyma.11G225200 | 2234 | ROP guanine nucleotide exchange factor 5 | 4.00 |
| leaf | Glyma.20G077300 | 3478 | Pectin lyase-like superfamily protein | 4.00 |
| root | Glyma.11G066000 | 4194 | Major facilitator superfamily protein | 4.00 |
| root | Glyma.06G275900 | 4466 | Peroxidase superfamily protein | 3.99 |
| leaf | Glyma.01G121700 | 531 | Rhodanese/Cell cycle control phosphatase superfamily protein | 3.99 |
| leaf | Glyma.05G137500 | 1143 | senescence-related gene 1 | 3.99 |
| leaf | Glyma.01G188800 | 575 | UDP-Glycosyltransferase superfamily protein | 3.98 |
| leaf | Glyma.10G021300 | 1934 | Thioredoxin superfamily protein | 3.98 |
| root | Glyma.08G181000 | 1670 | UDP-Glycosyltransferase superfamily protein | 3.98 |
| root | Glyma.04G033000 | 3762 | ovate family protein 7 | 3.98 |
| root | Glyma.13G364300 | 3908 | | 3.96 |
| root | Glyma.07G128700 | 3789 | effector of transcription2 | 3.95 |
| root | Glyma.09G187700 | 3703 | alpha/beta-Hydrolases superfamily protein | 3.94 |
| leaf | Glyma.01G198100 | 585 | basic helix-loop-helix (bHLH) DNA-binding superfamily protein | 3.94 |
| leaf | Glyma.13G255800 | 2514 | UDP-glucosyl transferase 78D2 | 3.93 |
| leaf | Glyma.19G074000 | 3337 | | 3.93 |
| leaf | Glyma.16G176300 | 2966 | | 3.93 |
| root | Glyma.08G200200 | 4351 | HAD superfamily, subfamily IIIB acid phosphatase | 3.93 |
| leaf | Glyma.07G258700 | 1523 | beta glucosidase 46 | 3.92 |
| root | Glyma.16G200100 | 2982 | Pyridoxal phosphate (PLP)-dependent transferases superfamily protein | 3.92 |
| root | Glyma.02G135200 | 3984 | Peroxidase superfamily protein | 3.91 |
| root | Glyma.03G157600 | 4091 | | 3.91 |
| leaf | Glyma.09G181500 | 1870 | Protein kinase superfamily protein | 3.90 |
| leaf | Glyma.14G099800 | 2651 | Mitochondrial substrate carrier family protein | 3.90 |
| root | Glyma.07G048800 | 1428 | O-methyltransferase 1 | 3.90 |
| root | Glyma.09G034900 | 3692 | GDSL-like Lipase/Acylhydrolase superfamily protein | 3.90 |
| root | Glyma.05G182800 | 4173 | cytochrome P450, family 71, subfamily A, polypeptide 22 | 3.89 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.03G131700 | 4075 | Gibberellin-regulated family protein | 3.89 |
| root | Glyma.07G183300 | 3781 | UDP-glucosyl transferase 78D2 | 3.89 |
| leaf | Glyma.08G230400 | 1709 | MLP-like protein 43 | 3.88 |
| leaf | Glyma.08G238100 | 1714 | cytochrome P450, family 72, subfamily A, polypeptide 15 | 3.88 |
| leaf | Glyma.04G255400 | 1060 | cellulose synthase like G2 | 3.88 |
| leaf | Glyma.05G069100 | 1110 | expansin-like B1 | 3.87 |
| leaf | Glyma.19G219000 | 3415 | myb domain protein 112 | 3.87 |
| leaf | Glyma.13G217700 | 2484 | Protein of unknown function, DUF642 | 3.87 |
| leaf | Glyma.17G042900 | 3027 | Pectinacetylesterase family protein | 3.87 |
| leaf | Glyma.19G047000 | 3330 | Ribulose bisphosphate carboxylase (small chain) family protein | 3.87 |
| leaf | Glyma.20G212800 | 3546 | Leucine-rich repeat protein kinase family protein | 3.87 |
| root | Glyma.18G139900 | 4522 | Pectin lyase-like superfamily protein | 3.86 |
| root | Glyma.05G051500 | 4140 | Subtilase family protein | 3.85 |
| leaf | Glyma.16G172600 | 2960 | multidrug resistance-associated protein 14 | 3.85 |
| root | Glyma.05G119900 | 4175 | Glycosyl hydrolase family protein | 3.85 |
| root | Glyma.09G021600 | 3730 | LOB domain-containing protein 4 | 3.85 |
| root | Glyma.04G003600 | 3748 | SBP (S-ribonuclease binding protein) family protein | 3.84 |
| leaf | Glyma.09G044600 | 1795 | ARM repeat superfamily protein | 3.84 |
| leaf | Glyma.16G011500 | 2863 | Chaperone DnaJ-domain superfamily protein | 3.84 |
| leaf | Glyma.02G210400 | 717 | RING/U-box superfamily protein | 3.84 |
| leaf | Glyma.17G223400 | 3124 | early nodulin-like protein 15 | 3.84 |
| root | Glyma.02G240600 | 3975 | glutathione S-transferase TAU 19 | 3.84 |
| root | Glyma.19G210700 | 4031 | multidrug resistance-associated protein 4 | 3.84 |
| root | Glyma.06G298000 | 4487 | Family of unknown function (DUF566) | 3.84 |
| root | Glyma.03G085100 | 4074 | GTP cyclohydrolase I | 3.83 |
| leaf | Glyma.07G146800 | 1472 | glycerol-3-phosphate acyltransferase 6 | 3.83 |
| leaf | Glyma.04G083100 | 972 | Glyoxalase/Bleomycin resistance protein/Dioxygenase superfamily protein | 3.83 |
| leaf | Glyma.19G021400 | 3308 | basic helix-loop-helix (bHLH) DNA-binding family protein | 3.83 |
| leaf | Glyma.20G142000 | 3511 | thiazole biosynthetic enzyme, chloroplast (ARA6) (THI1) (THI4) | 3.83 |
| root | Glyma.20G191100 | 4102 | | 3.82 |
| root | Glyma.04G090700 | 3739 | oligopeptide transporter 2 | 3.82 |
| root | Glyma.13G116500 | 3912 | Plant self-incompatibility protein S1 family | 3.82 |
| leaf | Glyma.19G207900 | 3403 | Phototropic-responsive NPH3 family protein | 3.82 |
| root | Glyma.08G285400 | 4356 | Pectin lyase-like superfamily protein | 3.82 |
| root | Glyma.12G235300 | 4447 | senescence-related gene 1 | 3.82 |
| root | Glyma.19G074000 | 3337 | | 3.81 |
| leaf | Glyma.19G079000 | 3340 | S-adenosyl-L-methionine-dependent methyltransferases superfamily protein | 3.81 |
| root | Glyma.02G176200 | 3982 | cytochrome P450, family 93, subfamily D, polypeptide 1 | 3.81 |
| root | Glyma.08G032100 | 4339 | Leucine-rich repeat (LRR) family protein | 3.81 |
| root | Glyma.07G096700 | 3798 | Bifunctional inhibitor/lipid-transfer protein/seed storage 2S albumin superfamily protein | 3.80 |
| leaf | Glyma.10G104700 | 1971 | UDP-Glycosyltransferase superfamily protein | 3.80 |
| root | Glyma.11G076400 | 4238 | | 3.80 |
| root | Glyma.12G096900 | 4444 | cellulose synthase-like B3 | 3.79 |
| root | Glyma.14G035100 | 2625 | | 3.79 |
| root | Glyma.04G220300 | 3743 | | 3.79 |
| leaf | Glyma.19G031100 | 3319 | | 3.79 |
| leaf | Glyma.11G245400 | 2248 | photosystem II BY | 3.79 |
| leaf | Glyma.18G016900 | 3163 | | 3.78 |
| leaf | Glyma.08G132800 | 1635 | homeobox protein 16 | 3.78 |
| leaf | Glyma.19G156800 | 3374 | Terpenoid cyclases/Protein prenyltransferases superfamily protein | 3.78 |
| leaf | Glyma.03G225500 | 891 | Haloacid dehalogenase-like hydrolase (HAD) superfamily protein | 3.78 |
| leaf | Glyma.09G087700 | 1823 | photosystem I subunit K | 3.78 |
| root | Glyma.17G061100 | 3682 | spermidine hydroxycinnamoyl transferase | 3.77 |
| leaf | Glyma.04G188300 | 1020 | | 3.77 |
| leaf | Glyma.10G156200 | 1989 | Protein kinase superfamily protein | 3.77 |
| root | Glyma.19G170800 | 4009 | Flavin-binding monooxygenase family protein | 3.77 |
| root | Glyma.20G031800 | 4114 | phytochrome and flowering time regulatory protein (PFT1) | 3.77 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.09G247000 | 3695 | basic helix-loop-helix (bHLH) DNA-binding superfamily protein | 3.76 |
| leaf | Glyma.04G005100 | 921 | Pollen Ole e 1 allergen and extensin family protein | 3.76 |
| leaf | Glyma.11G252400 | 2252 | Transmembrane amino acid transporter family protein | 3.76 |
| leaf | Glyma.15G275600 | 2854 | Photosystem II 5 kD protein | 3.76 |
| leaf | Glyma.07G163600 | 1479 | cytochrome b6f complex subunit (petM), putative | 3.76 |
| leaf | Glyma.13G172600 | 2446 | RAC-like 2 | 3.76 |
| leaf | Glyma.15G051400 | 2733 | UDP-Glycosyltransferase superfamily protein | 3.75 |
| root | Glyma.05G143200 | 4149 | Chaperone DnaJ-domain superfamily protein | 3.75 |
| root | Glyma.08G230400 | 1709 | MLP-like protein 43 | 3.75 |
| root | Glyma.12G090900 | 4449 | germin-like protein subfamily 2 member 2 precursor | 3.75 |
| root | Glyma.08G037100 | 4355 |  | 3.74 |
| leaf | Glyma.16G221100 | 2997 | Protein of unknown function (DUF3411) | 3.74 |
| root | Glyma.07G209100 | 3783 | 2-oxoglutarate (2OG) and Fe(II)-dependent oxygenase superfamily protein | 3.74 |
| root | Glyma.15G154100 | 3812 | 2-oxoglutarate (2OG) and Fe(II)-dependent oxygenase superfamily protein | 3.73 |
| leaf | Glyma.01G210800 | 590 | adenine phosphoribosyl transferase 3 | 3.73 |
| root | Glyma.20G159300 | 4126 | AMP-dependent synthetase and ligase family protein | 3.73 |
| root | Glyma.10G222000 | 3614 |  | 3.72 |
| root | Glyma.13G052800 | 3913 | 2-oxoglutarate (2OG) and Fe(II)-dependent oxygenase superfamily protein | 3.72 |
| leaf | Glyma.12G057900 | 2279 | myb domain protein 83 | 3.71 |
| leaf | Glyma.01G192500 | 579 | Peroxidase superfamily protein | 3.71 |
| leaf | Glyma.18G245100 | 3260 |  | 3.71 |
| leaf | Glyma.16G023800 | 2866 | Integrase-type DNA-binding superfamily protein | 3.71 |
| root | Glyma.05G041100 | 4176 | Adenine nucleotide alpha hydrolases-like superfamily protein | 3.71 |
| root | Glyma.02G265300 | 3958 |  | 3.70 |
| leaf | Glyma.01G002400 | 479 | Phospholipase A2 family protein | 3.70 |
| root | Glyma.08G308000 | 4329 | Cytochrome b561/ferric reductase transmembrane protein family | 3.70 |
| root | Glyma.09G201600 | 3685 | Concanavalin A-like lectin protein kinase family protein | 3.70 |
| leaf | Glyma.01G221900 | 594 | SPIRAL1-like2 | 3.68 |
| leaf | Glyma.17G148400 | 3094 | ureidoglycine aminohydrolase | 3.68 |
| root | Glyma.05G125800 | 4177 | FAD-binding Berberine family protein | 3.68 |
| leaf | Glyma.09G271500 | 1917 | Protein of unknown function (DUF1191) | 3.67 |
| leaf | Glyma.05G008200 | 1069 | aspartate-glutamate racemase family | 3.67 |
| root | Glyma.09G149800 | 3714 | Protein kinase superfamily protein | 3.67 |
| root | Glyma.03G171900 | 4090 | NAD(P)-binding Rossmann-fold superfamily protein | 3.66 |
| root | Glyma.19G033800 | 4025 | reversibly glycosylated polypeptide 2 | 3.66 |
| leaf | Glyma.03G175800 | 855 | aluminum sensitive 3 | 3.66 |
| root | Glyma.13G168500 | 3891 | Uncharacterised protein family (UPF0497) | 3.65 |
| leaf | Glyma.08G022300 | 1545 | glycosyl hydrolase 9C2 | 3.65 |
| leaf | Glyma.06G157900 | 1318 | cyclin-dependent kinase E; 1 | 3.65 |
| root | Glyma.02G061500 | 3985 |  | 3.65 |
| root | Glyma.14G210100 | 4255 | glutathione S-transferase TAU 19 | 3.65 |
| root | Glyma.20G070400 | 4108 | glycerol-3-phosphate acyltransferase 6 | 3.65 |
| root | Glyma.03G257000 | 4081 | cyclic nucleotide gated channel 1 | 3.65 |
| leaf | Glyma.20G155600 | 3524 | Dihydrodipicolinate reductase, bacterial/plant | 3.64 |
| leaf | Glyma.14G192400 | 2684 | josephin protein-related | 3.64 |
| root | Glyma.13G322300 | 3872 | Protein of unknown function (DUF1635) | 3.64 |
| root | Glyma.01G020700 | 4408 | Concanavalin A-like lectin protein kinase family protein | 3.63 |
| root | Glyma.07G049900 | 3771 | UDP-Glycosyltransferase superfamily protein | 3.63 |
| leaf | Glyma.07G006900 | 1407 | lipoxygenase 1 | 3.63 |
| leaf | Glyma.13G237400 | 2500 | squamosa promoter binding protein-like 3 | 3.63 |
| leaf | Glyma.08G243600 | 1717 | cytochrome P450, family 716, subfamily A, polypeptide 1 | 3.63 |
| root | Glyma.17G225400 | 3653 | ACT-like protein tyrosine kinase family protein | 3.63 |
| root | Glyma.20G119800 | 4117 | germin-like protein 10 | 3.62 |
| root | Glyma.13G308600 | 3886 |  | 3.62 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.13G328800 | 2570 | | 3.62 |
| leaf | Glyma.17G071000 | 3044 | | 3.62 |
| leaf | Glyma.05G180600 | 1169 | myo-inositol-1-phosphate synthase 3 | 3.62 |
| root | Glyma.10G007600 | 3594 | | 3.61 |
| root | Glyma.01G077000 | 4388 | expansin B2 | 3.61 |
| root | Glyma.15G009500 | 3828 | Lactoylglutathione lyase/glyoxalase I family protein | 3.61 |
| leaf | Glyma.11G080300 | 2144 | Peroxidase superfamily protein | 3.61 |
| leaf | Glyma.10G192600 | 2021 | | 3.61 |
| leaf | Glyma.17G143100 | 3093 | Oxidoreductase family protein | 3.61 |
| leaf | Glyma.07G068000 | 1438 | brassinosteroid-responsive RING-H2 | 3.61 |
| root | Glyma.13G304100 | 3915 | FASCICLIN-like arabinogalactan protein 21 precursor | 3.61 |
| root | Glyma.10G130200 | 3606 | | 3.60 |
| leaf | Glyma.09G203400 | 1883 | Zinc finger (C3HC4-type RING finger) family protein | 3.60 |
| leaf | Glyma.03G258400 | 910 | Protein of unknown function (DUF688) | 3.60 |
| root | Glyma.10G153100 | 3595 | Photosystem II reaction center PsbP family protein | 3.60 |
| leaf | Glyma.17G258300 | 3145 | tubulin beta-1 chain | 3.59 |
| leaf | Glyma.14G068000 | 2641 | expansin A4 | 3.59 |
| leaf | Glyma.16G138400 | 2929 | RAD-like 6 | 3.59 |
| leaf | Glyma.01G113200 | 529 | glycerol-3-phosphate acyltransferase 6 | 3.59 |
| root | Glyma.03G215100 | 886 | Protein of unknown function, DUF538 | 3.58 |
| root | Glyma.02G132700 | 3970 | Vacuolar import/degradation, Vid27-related protein | 3.58 |
| leaf | Glyma.09G157600 | 1863 | carboxyesterase 18 | 3.58 |
| leaf | Glyma.16G211700 | 2991 | Kunitz family trypsin and protease inhibitor protein | 3.58 |
| leaf | Glyma.01G236800 | 601 | Protein of unknown function (DUF581) | 3.58 |
| leaf | Glyma.04G076800 | 967 | Protein kinase protein with adenine nucleotide alpha hydrolases-like domain | 3.58 |
| root | Glyma.13G035600 | 3864 | gibberellin 20 oxidase 2 | 3.58 |
| root | Glyma.03G219900 | 4067 | RGA-like protein 3 | 3.57 |
| root | Glyma.08G130300 | 4327 | Transducin/WD40 repeat-like superfamily protein | 3.57 |
| leaf | Glyma.15G117900 | 2784 | | 3.57 |
| leaf | Glyma.07G001300 | 1400 | Terpenoid cyclases family protein | 3.57 |
| leaf | Glyma.17G126500 | 3645 | Pectin lyase-like superfamily protein | 3.57 |
| root | Glyma.10G108200 | 3603 | PIF1 helicase | 3.57 |
| root | Glyma.01G037100 | 4380 | Matrixin family protein | 3.56 |
| leaf | Glyma.10G038200 | 1944 | chromatin remodeling 8 | 3.56 |
| leaf | Glyma.08G080600 | 1592 | FAD-binding Berberine family protein | 3.56 |
| leaf | Glyma.16G220600 | 2996 | | 3.56 |
| root | Glyma.10G054200 | 3593 | xyloglucan endotransglucosylase/hydrolase 32 | 3.56 |
| root | Glyma.07G067000 | 3797 | Pectin lyase-like superfamily protein | 3.56 |
| root | Glyma.05G083900 | 4143 | | 3.55 |
| leaf | Glyma.08G152800 | 1648 | Leucine-rich repeat (LRR) family protein | 3.55 |
| leaf | Glyma.03G248100 | 902 | Alba DNA/RNA-binding protein | 3.55 |
| leaf | Glyma.18G285400 | 3282 | adenylate cyclases | 3.55 |
| leaf | Glyma.19G212600 | 3408 | Plant invertase/pectin methylesterase inhibitor superfamily | 3.55 |
| leaf | Glyma.20G034800 | 3466 | Nucleic acid-binding, OB-fold-like protein | 3.55 |
| leaf | Glyma.13G135100 | 2428 | RING/U-box superfamily protein | 3.55 |
| leaf | Glyma.12G205900 | 2337 | Tyrosine transaminase family protein | 3.55 |
| root | Glyma.06G055000 | 4508 | | 3.54 |
| leaf | Glyma.04G238500 | 1051 | arabinogalactan protein 16 | 3.54 |
| leaf | Glyma.01G222200 | 595 | myb domain protein 103 | 3.54 |
| leaf | Glyma.18G110500 | 3210 | GDSL-like Lipase/Acylhydrolase superfamily protein | 3.54 |
| leaf | Glyma.13G292800 | 2540 | Basic-leucine zipper (bZIP) transcription factor family protein | 3.54 |
| leaf | Glyma.11G031500 | 2106 | nitrate transporter 1.1 | 3.54 |
| leaf | Glyma.20G008600 | 3454 | cytochrome b6f complex subunit (petM), putative | 3.54 |
| leaf | Glyma.19G258300 | 3445 | | 3.54 |
| root | Glyma.08G093200 | 4322 | DNAse I-like superfamily protein | 3.54 |
| root | Glyma.05G069500 | 4154 | sterol-4alpha-methyl oxidase 1-1 | 3.54 |
| root | Glyma.06G324300 | 1398 | cellulose synthase like G1 | 3.53 |
| root | Glyma.08G105600 | 4344 | DNA primase, large subunit family | 3.53 |
| root | Glyma.06G132200 | 4473 | | 3.53 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.19G190600 | 3392 | Nucleotide-diphospho-sugar transferases superfamily protein | 3.53 |
| leaf | Glyma.09G026800 | 1784 | fatty acid hydroxylase 1 | 3.53 |
| leaf | Glyma.01G189900 | 576 | | 3.53 |
| leaf | Glyma.08G150400 | 1647 | beta glucosidase 42 | 3.53 |
| leaf | Glyma.03G114600 | 821 | photosystem II subunit Q-2 | 3.53 |
| leaf | Glyma.14G032000 | 2624 | | 3.53 |
| leaf | Glyma.12G074400 | 2284 | CCT motif family protein | 3.53 |
| root | Glyma.10G281900 | 3596 | Cupredoxin superfamily protein | 3.53 |
| root | Glyma.17G104000 | 3670 | Minichromosome maintenance (MCM2/3/5) family protein | 3.52 |
| root | Glyma.08G297700 | 4337 | | 3.52 |
| leaf | Glyma.02G308700 | 779 | FASCICLIN-like arabinogalactan 2 | 3.52 |
| leaf | Glyma.10G111200 | 1972 | TRICHOME BIREFRINGENCE-LIKE 36 | 3.52 |
| leaf | Glyma.02G225600 | 729 | josephin protein-related | 3.52 |
| leaf | Glyma.19G157000 | 3375 | Terpenoid cyclases/Protein prenyltransferases superfamily protein | 3.52 |
| leaf | Glyma.15G041100 | 2727 | myb domain protein 48 | 3.51 |
| leaf | Glyma.10G027200 | 1936 | Plant protein of unknown function (DUF868) | 3.51 |
| leaf | Glyma.07G059600 | 1435 | | 3.51 |
| leaf | Glyma.13G087800 | 2399 | Phosphoglycerate mutase family protein | 3.51 |
| root | Glyma.10G261900 | 3610 | SPX domain gene 2 | 3.51 |
| root | Glyma.17G133400 | 3676 | Subtilase family protein | 3.50 |
| root | Glyma.19G045900 | 4010 | MADS-box transcription factor family protein | 3.50 |
| leaf | Glyma.10G040600 | 1945 | photosystem II reaction center PSB28 protein | 3.50 |
| leaf | Glyma.17G192800 | 3115 | GATA transcription factor 12 | 3.50 |
| leaf | Glyma.17G135600 | 3085 | | 3.50 |
| leaf | Glyma.03G097300 | 815 | alpha/beta-Hydrolases superfamily protein | 3.50 |
| leaf | Glyma.17G103200 | 3062 | Protein of unknown function, DUF538 | 3.50 |
| root | Glyma.08G348100 | 4332 | | 3.49 |
| leaf | Glyma.04G055400 | 956 | Chaperone DnaJ-domain superfamily protein | 3.49 |
| leaf | Glyma.06G211600 | 1345 | Leucine-rich repeat protein kinase family protein | 3.49 |
| leaf | Glyma.09G028100 | 1785 | FAD-binding Berberine family protein | 3.49 |
| leaf | Glyma.12G215100 | 2343 | PsbQ-like 1 | 3.49 |
| leaf | Glyma.09G211500 | 1890 | pinoresinol reductase 1 | 3.49 |
| leaf | Glyma.03G159100 | 846 | photosystem II reaction center W | 3.49 |
| leaf | Glyma.08G082900 | 1594 | chlorophyll A/B binding protein 1 | 3.49 |
| root | Glyma.19G120400 | 4034 | 2-isopropylmalate synthase 1 | 3.49 |
| root | Glyma.19G010700 | 4003 | Protein kinase superfamily protein | 3.48 |
| leaf | Glyma.11G029100 | 2102 | Cornichon family protein | 3.48 |
| leaf | Glyma.03G192500 | 872 | pleiotropic drug resistance 6 | 3.48 |
| leaf | Glyma.02G120300 | 678 | fructokinase-like 2 | 3.48 |
| leaf | Glyma.13G326000 | 2567 | | 3.48 |
| leaf | Glyma.16G080600 | 2906 | | 3.48 |
| leaf | Glyma.19G131800 | 3363 | Glutaredoxin family protein | 3.48 |
| leaf | Glyma.09G131700 | 1842 | | 3.48 |
| leaf | Glyma.19G202900 | 3401 | alpha/beta-Hydrolases superfamily protein | 3.48 |
| root | Glyma.U013100 | 4288 | 2-isopropylmalate synthase 1 | 3.47 |
| root | Glyma.08G169800 | 4321 | Galactose oxidase/kelch repeat superfamily protein | 3.47 |
| leaf | Glyma.06G061200 | 1262 | early nodulin-like protein 14 | 3.47 |
| root | Glyma.08G084700 | 4306 | | 3.47 |
| root | Glyma.12G027100 | 4440 | disease resistance protein (TIR-NBS-LRR class), putative | 3.47 |
| root | Glyma.09G240400 | 3723 | Integrase-type DNA-binding superfamily protein | 3.46 |
| leaf | Glyma.07G049000 | 1429 | photosystem I P subunit | 3.46 |
| leaf | Glyma.02G308300 | 777 | | 3.46 |
| root | Glyma.08G057700 | 4364 | ARF-GAP domain 15 | 3.46 |
| root | Glyma.10G066400 | 3630 | PHYTOSULFOKINE 3 PRECURSOR | 3.46 |
| root | Glyma.11G128800 | 4213 | | 3.46 |
| root | Glyma.03G126800 | 4070 | F-box family protein | 3.45 |
| root | Glyma.02G248500 | 4001 | expansin A4 | 3.45 |
| root | Glyma.02G121400 | 3952 | | 3.45 |
| leaf | Glyma.11G176600 | 2196 | F-box family protein | 3.45 |
| leaf | Glyma.06G042900 | 1246 | CYCLIN D3; 1 | 3.45 |
| leaf | Glyma.13G147200 | 2431 | | 3.45 |
| leaf | Glyma.15G140500 | 2799 | | 3.45 |
| root | Glyma.01G179500 | 4389 | cytochrome P450, family 71, subfamily B, polypeptide 34 | 3.45 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.05G108600 | 4184 | Integrase-type DNA-binding superfamily protein | 3.45 |
| root | Glyma.18G274500 | 4521 | F-box family protein | 3.45 |
| root | Glyma.11G061100 | 4214 | | 3.45 |
| root | Glyma.18G214800 | 4549 | MATE efflux family protein | 3.44 |
| leaf | Glyma.02G182000 | 705 | Replication factor-A protein 1-related | 3.44 |
| leaf | Glyma.13G309900 | 2558 | mitogen-activated protein kinase kinase kinase 15 | 3.44 |
| leaf | Glyma.19G127700 | 3362 | beta-6 tubulin | 3.43 |
| leaf | Glyma.06G171700 | 1326 | Leucine-rich repeat protein kinase family protein | 3.43 |
| leaf | Glyma.15G123800 | 2788 | Eukaryotic aspartyl protease family protein | 3.43 |
| root | Glyma.05G032900 | 4170 | | 3.43 |
| root | Glyma.20G033700 | 4100 | Uncharacterised protein family (UPF0497) | 3.43 |
| root | Glyma.17G038700 | 3669 | phragmoplast orienting kinesin 1 | 3.43 |
| root | Glyma.02G159900 | 3934 | pleiotropic drug resistance 11 | 3.42 |
| leaf | Glyma.10G144300 | 1983 | S-adenosylmethionine synthetase 2 | 3.42 |
| leaf | Glyma.05G203700 | 1187 | Heavy metal transport/detoxification superfamily protein | 3.42 |
| leaf | Glyma.05G029900 | 1084 | nitrate transporter 1:2 | 3.42 |
| leaf | Glyma.08G215300 | 1699 | basic helix-loop-helix (bHLH) DNA-binding superfamily protein | 3.42 |
| root | Glyma.13G039200 | 3920 | glycolipid transfer protein 2 | 3.42 |
| root | Glyma.02G229200 | 4000 | Acyl-CoA N-acyltransferases (NAT) superfamily protein | 3.41 |
| root | Glyma.04G172900 | 3740 | ABC2 homolog 6 | 3.41 |
| root | Glyma.03G122900 | 4064 | Major facilitator superfamily protein | 3.41 |
| leaf | Glyma.06G152400 | 1313 | cell wall/vacuolar inhibitor of fructosidase 2 | 3.41 |
| leaf | Glyma.09G211600 | 1891 | pinoresinol reductase 1 | 3.41 |
| leaf | Glyma.16G024500 | 2867 | Cytochrome b561/ferric reductase transmembrane with DOMON related domain | 3.41 |
| root | Glyma.15G052200 | 3816 | Bifunctional inhibitor/lipid-transfer protein/seed storage 2S albumin superfamily protein | 3.41 |
| root | Glyma.15G217100 | 3827 | MLP-like protein 43 | 3.41 |
| root | Glyma.14G053700 | 2634 | Peroxidase superfamily protein | 3.41 |
| root | Glyma.13G236900 | 3860 | | 3.40 |
| root | Glyma.01G110300 | 4410 | Nucleotide-sugar transporter family protein | 3.40 |
| root | Glyma.10G066700 | 1959 | Aldolase superfamily protein | 3.40 |
| leaf | Glyma.03G224600 | 890 | Pectin lyase-like superfamily protein | 3.40 |
| root | Glyma.20G122900 | 4121 | fatty acyl-ACP thioesterases B | 3.40 |
| root | Glyma.17G248600 | 3640 | Protein of unknown function (DUF607) | 3.40 |
| root | Glyma.13G328800 | 2570 | | 3.39 |
| root | Glyma.19G135900 | 4050 | alpha carbonic anhydrase 4 | 3.39 |
| leaf | Glyma.09G154600 | 1858 | Leucine-rich repeat protein kinase family protein | 3.39 |
| leaf | Glyma.02G061400 | 631 | Phototropic-responsive NPH3 family protein | 3.39 |
| leaf | Glyma.07G212700 | 1501 | cytochrome P450, family 707, subfamily A, polypeptide 4 | 3.39 |
| leaf | Glyma.04G105500 | 984 | lipoxygenase 1 | 3.39 |
| root | Glyma.05G151000 | 4191 | Subtilase family protein | 3.38 |
| root | Glyma.03G256900 | 4084 | alpha/beta-Hydrolases superfamily protein | 3.38 |
| root | Glyma.03G227500 | 4056 | nitrate transporter 1:2 | 3.38 |
| root | Glyma.15G062300 | 3818 | pathogenesis-related protein-1-like | 3.38 |
| leaf | Glyma.04G238100 | 1050 | Nodulin MtN3 family protein | 3.38 |
| leaf | Glyma.02G015000 | 615 | | 3.38 |
| leaf | Glyma.03G259200 | 914 | RAB GTPase homolog A3 | 3.38 |
| leaf | Glyma.08G329900 | 1754 | FASCICLIN-like arabinogalactan 1 | 3.38 |
| leaf | Glyma.14G004200 | 2604 | FASCICLIN-like arabinogalactan 2 | 3.38 |
| leaf | Glyma.18G286500 | 3283 | PsbP-like protein 1 | 3.38 |
| leaf | Glyma.12G208000 | 2339 | RAC-like GTP binding protein 5 | 3.38 |
| root | Glyma.09G118900 | 1832 | amino acid transporter 1 | 3.37 |
| root | Glyma.14G223000 | 4244 | SKU5 similar 5 | 3.37 |
| leaf | Glyma.07G126000 | 1460 | Leucine-rich repeat (LRR) family protein | 3.37 |
| leaf | Glyma.13G129700 | 2427 | Protein of unknown function (DUF3741) | 3.37 |
| leaf | Glyma.12G203600 | 2336 | expansin B3 | 3.37 |
| leaf | Glyma.03G205400 | 880 | alpha/beta-Hydrolases superfamily protein | 3.37 |
| leaf | Glyma.18G222200 | 3250 | FASCICLIN-like arabinogalactan protein 8 | 3.37 |
| leaf | Glyma.19G060900 | 3335 | CLIP-associated protein | 3.37 |
| leaf | Glyma.06G020400 | 1228 | plastocyanin 1 | 3.37 |
| leaf | Glyma.15G176900 | 2812 | germin 3 | 3.37 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.12G164000 | 2318 | | 3.37 |
| root | Glyma.14G205400 | 4281 | | 3.37 |
| root | Glyma.04G000600 | 3768 | Plant regulator RWP-RK family protein | 3.37 |
| root | Glyma.02G031000 | 3997 | nucleobase-ascorbate transporter 7 | 3.37 |
| root | Glyma.02G001100 | 3943 | HXXXD-type acyl-transferase family protein | 3.37 |
| root | Glyma.13G098000 | 3923 | sequence-specific DNA binding transcription factors; transcription regulators | 3.36 |
| root | Glyma.05G120000 | 4157 | | 3.36 |
| leaf | Glyma.10G177500 | 2007 | | 3.36 |
| leaf | Glyma.01G033800 | 499 | nodulin MtN21/EamA-like transporter family protein | 3.36 |
| leaf | Glyma.01G040500 | 505 | | 3.36 |
| leaf | Glyma.17G151500 | 3097 | Plant invertase/pectin methylesterase inhibitor superfamily protein | 3.36 |
| leaf | Glyma.03G121500 | 825 | camelliol C synthase 1 | 3.36 |
| root | Glyma.03G115200 | 822 | Plant protein of unknown function (DUF247) | 3.36 |
| root | Glyma.09G062500 | 3686 | Leucine-rich repeat transmembrane protein kinase | 3.35 |
| root | Glyma.11G226900 | 2236 | sedoheptulose-bisphosphatase | 3.35 |
| leaf | Glyma.16G066700 | 2897 | Ubiquitin-like superfamily protein | 3.35 |
| leaf | Glyma.01G019300 | 486 | Zinc finger (C3HC4-type RING finger) family protein | 3.35 |
| leaf | Glyma.12G202500 | 2335 | photosystem II family protein | 3.35 |
| leaf | Glyma.10G045700 | 1948 | Heavy metal transport/detoxification superfamily protein | 3.35 |
| leaf | Glyma.15G128300 | 2789 | patatin-like protein 6 | 3.35 |
| leaf | Glyma.06G055700 | 1257 | Duplicated homeodomain-like superfamily protein | 3.35 |
| root | Glyma.U013200 | 4287 | methylthioalkylmalate synthase-like 4 | 3.35 |
| root | Glyma.14G068000 | 2641 | expansin A4 | 3.35 |
| root | Glyma.17G130900 | 3637 | IQ-domain 22 | 3.34 |
| root | Glyma.16G162200 | 4576 | Protein of unknown function (DUF810) | 3.34 |
| root | Glyma.11G193600 | 2211 | xyloglucan endotransglucosylase/hydrolase 32 | 3.34 |
| leaf | Glyma.01G028200 | 495 | S-adenosyl-L-methionine-dependent methyltransferases superfamily protein | 3.34 |
| leaf | Glyma.05G172300 | 1162 | photosystem II BY | 3.34 |
| root | Glyma.01G116300 | 4385 | GroES-like zinc-binding dehydrogenase family protein | 3.34 |
| root | Glyma.10G027500 | 3611 | ovate family protein 12 | 3.33 |
| root | Glyma.06G294600 | 4512 | expansin A20 | 3.33 |
| leaf | Glyma.13G212600 | 2478 | Protein kinase superfamily protein | 3.33 |
| leaf | Glyma.05G046900 | 1099 | arginosuccinate synthase family | 3.33 |
| leaf | Glyma.07G230300 | 1508 | Protein of unknown function (DUF1666) | 3.33 |
| leaf | Glyma.18G063200 | 3194 | cation exchanger 1 | 3.33 |
| leaf | Glyma.18G089900 | 3205 | microtubule-associated protein 65-2 | 3.33 |
| leaf | Glyma.09G251600 | 1912 | Auxin efflux carrier family protein | 3.33 |
| root | Glyma.05G086400 | 4181 | Cellulose-synthase-like C5 | 3.32 |
| leaf | Glyma.13G305200 | 2552 | beta-amylase 6 | 3.32 |
| leaf | Glyma.17G122500 | 3078 | Cyclophilin-like peptidyl-prolyl cis-trans isomerase family protein | 3.32 |
| leaf | Glyma.04G112800 | 985 | photosystem I subunit G | 3.32 |
| leaf | Glyma.06G194900 | 1338 | light-harvesting chlorophyll-protein complex I subunit A4 | 3.32 |
| root | Glyma.10G087500 | 3581 | alpha/beta-Hydrolases superfamily protein | 3.32 |
| root | Glyma.10G203100 | 3628 | Protein kinase superfamily protein | 3.32 |
| root | Glyma.11G224400 | 4226 | Major facilitator superfamily protein | 3.32 |
| root | Glyma.06G167800 | 4490 | | 3.31 |
| root | Glyma.10G159700 | 3598 | cysteine synthase D1 | 3.31 |
| root | Glyma.17G130600 | 3658 | | 3.31 |
| root | Glyma.01G239100 | 4381 | Late embryogenesis abundant (LEA) hydroxyproline-rich glycoprotein family | 3.31 |
| leaf | Glyma.08G099000 | 1607 | | 3.31 |
| leaf | Glyma.05G106800 | 1121 | CYCLIN D1; 1 | 3.31 |
| root | Glyma.13G150000 | 3861 | Leucine-rich repeat protein kinase family protein | 3.30 |
| leaf | Glyma.18G134100 | 3221 | Protein kinase superfamily protein | 3.30 |
| leaf | Glyma.04G018900 | 927 | Protein of unknown function (DUF630 and DUF632) | 3.30 |
| leaf | Glyma.07G149400 | 1473 | GroES-like zinc-binding dehydrogenase family protein | 3.30 |
| leaf | Glyma.14G220200 | 2698 | P-glycoprotein 13 | 3.30 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.17G015100 | 3665 | | 3.30 |
| root | Glyma.03G189800 | 868 | Leucine-rich repeat protein kinase family protein | 3.30 |
| root | Glyma.07G114000 | 3770 | ethylene-responsive element binding factor 13 | 3.30 |
| root | Glyma.05G121500 | 4151 | Vacuolar iron transporter (VIT) family protein | 3.30 |
| root | Glyma.15G119100 | 3820 | Bifunctional inhibitor/lipid-transfer protein/seed storage 2S albumin superfamily protein | 3.30 |
| root | Glyma.05G164700 | 4160 | Sulfite exporter TauE/SafE family protein | 3.30 |
| root | Glyma.14G126500 | 4246 | K+ transporter 1 | 3.29 |
| root | Glyma.10G111200 | 1972 | TRICHOME BIREFRINGENCE-LIKE 36 | 3.29 |
| root | Glyma.06G004700 | 4477 | armadillo repeat only 1 | 3.29 |
| root | Glyma.08G102300 | 4350 | DEAD/DEAH box RNA helicase family protein | 3.29 |
| leaf | Glyma.07G157100 | 1478 | Disease resistance-responsive (dirigent-like protein) family protein | 3.29 |
| leaf | Glyma.10G237500 | 2054 | Sugar isomerase (SIS) family protein | 3.29 |
| leaf | Glyma.20G140700 | 3510 | cysteine-rich RLK (RECEPTOR-like protein kinase) 25 | 3.29 |
| leaf | Glyma.07G227700 | 1506 | DHHC-type zinc finger family protein | 3.29 |
| leaf | Glyma.07G201600 | 1499 | HAESA-like 1 | 3.29 |
| leaf | Glyma.16G145800 | 2934 | photosystem I light harvesting complex gene 1 | 3.29 |
| leaf | Glyma.06G262800 | 1370 | Protein of unknown function, DUF538 | 3.29 |
| leaf | Glyma.02G064700 | 638 | photosystem I light harvesting complex gene 1 | 3.29 |
| leaf | Glyma.19G005900 | 3296 | phosphoenolpyruvate (pep)/phosphate translocator 2 | 3.29 |
| root | Glyma.12G195600 | 4417 | Peroxidase superfamily protein | 3.29 |
| leaf | Glyma.13G304200 | 2551 | | 3.28 |
| leaf | Glyma.10G067200 | 1960 | growth-regulating factor 3 | 3.28 |
| leaf | Glyma.14G201100 | 2689 | O-methyltransferase family protein | 3.28 |
| root | Glyma.18G258000 | 4559 | HXXXD-type acyl-transferase family protein | 3.28 |
| root | Glyma.08G333300 | 4312 | kinesin-like protein 1 | 3.28 |
| root | Glyma.11G185200 | 4231 | Jojoba acyl CoA reductase-related male sterility protein | 3.28 |
| root | Glyma.02G108400 | 3989 | Glucose-methanol-choline (GMC) oxidoreductase family protein | 3.27 |
| root | Glyma.18G050200 | 4552 | Protein of unknown function (DUF1191) | 3.27 |
| leaf | Glyma.19G144500 | 3370 | | 3.27 |
| leaf | Glyma.03G049300 | 801 | Leucine-rich repeat protein kinase family protein | 3.27 |
| leaf | Glyma.08G204600 | 1693 | | 3.27 |
| leaf | Glyma.11G199700 | 2221 | Leucine-rich repeat protein kinase family protein | 3.27 |
| leaf | Glyma.17G259100 | 3146 | P-glycoprotein 13 | 3.27 |
| leaf | Glyma.04G136700 | 992 | Lateral root primordium (LRP) protein-related | 3.27 |
| root | Glyma.03G152800 | 4079 | basic helix-loop-helix (bHLH) DNA-binding superfamily protein | 3.27 |
| root | Glyma.08G120400 | 4331 | Dynamin related protein 4C | 3.27 |
| root | Glyma.10G199000 | 2027 | haemoglobin 2 | 3.26 |
| root | Glyma.16G175600 | 4577 | UDP-glucosyl transferase 88A1 | 3.26 |
| root | Glyma.07G011700 | 3795 | phosphate starvation-induced gene 2 | 3.26 |
| leaf | Glyma.02G123800 | 679 | DNA glycosylase superfamily protein | 3.26 |
| leaf | Glyma.08G328900 | 1753 | | 3.26 |
| leaf | Glyma.02G283400 | 757 | PHYTOENE SYNTHASE | 3.26 |
| root | Glyma.01G048800 | 4399 | Glucose-methanol-choline (GMC) oxidoreductase family protein | 3.25 |
| root | Glyma.09G074000 | 3720 | GDSL-motif lipase 5 | 3.25 |
| root | Glyma.18G241000 | 4520 | Auxin efflux carrier family protein | 3.25 |
| leaf | Glyma.15G275700 | 2855 | Photosystem II 5 kD protein | 3.25 |
| leaf | Glyma.10G261000 | 2069 | | 3.25 |
| leaf | Glyma.16G143600 | 2931 | photosystem II subunit O-2 | 3.25 |
| leaf | Glyma.08G175800 | 1668 | Aldolase-type TIM barrel family protein | 3.25 |
| root | Glyma.09G183000 | 3705 | | 3.24 |
| leaf | Glyma.01G168400 | 548 | Lactoylglutathione lyase/glyoxalase I family protein | 3.24 |
| leaf | Glyma.09G048500 | 1796 | | 3.24 |
| leaf | Glyma.01G196800 | 583 | xyloglucan endotransglucosylase/hydrolase 6 | 3.24 |
| leaf | Glyma.04G040600 | 941 | Sulfite exporter TauE/SafE family protein | 3.24 |
| leaf | Glyma.03G119000 | 823 | | 3.24 |
| leaf | Glyma.15G164800 | 2805 | | 3.24 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
| --- | --- | --- | --- | --- |
| leaf | Glyma.11G053400 | 2125 | UDP-glucosyl transferase 73B1 | 3.24 |
| root | Glyma.01G090700 | 4397 | Protein of unknown function, DUF617 | 3.24 |
| root | Glyma.02G182200 | 3979 | curculin-like (mannose-binding) lectin family protein/PAN domain-containing protein | 3.24 |
| root | Glyma.20G024200 | 3461 | | 3.24 |
| root | Glyma.04G188500 | 3750 | | 3.23 |
| leaf | Glyma.06G295000 | 1377 | alpha/beta-Hydrolases superfamily protein | 3.23 |
| leaf | Glyma.17G012800 | 3005 | Ankyrin repeat family protein | 3.23 |
| leaf | Glyma.10G261600 | 2070 | Leucine-rich repeat protein kinase family protein | 3.23 |
| leaf | Glyma.11G018900 | 2097 | arabinogalactan protein 16 | 3.23 |
| leaf | Glyma.04G179900 | 1016 | | 3.23 |
| root | Glyma.03G225500 | 891 | Haloacid dehalogenase-like hydrolase (HAD) superfamily protein | 3.23 |
| root | Glyma.09G280300 | 3722 | Uncharacterised protein family (UPF0497) | 3.23 |
| root | Glyma.17G125100 | 3677 | quinolinate synthase | 3.23 |
| root | Glyma.04G005700 | 3758 | Plant neutral invertase family protein | 3.22 |
| leaf | Glyma.13G319700 | 2564 | Transmembrane amino acid transporter family protein | 3.22 |
| leaf | Glyma.05G119300 | 1131 | Chloroplast-targeted copper chaperone protein | 3.22 |
| leaf | Glyma.09G219300 | 1897 | SAUR-like auxin-responsive protein family | 3.22 |
| root | Glyma.05G040100 | 4193 | NAD(P)-binding Rossmann-fold superfamily protein | 3.22 |
| root | Glyma.11G071800 | 4201 | P-loop containing nucleoside triphosphate hydrolases superfamily protein | 3.22 |
| root | Glyma.17G132100 | 3081 | Glucose-methanol-choline (GMC) oxidoreductase family protein | 3.21 |
| root | Glyma.13G030200 | 3893 | Polyketide cyclase/dehydrase and lipid transport superfamily protein | 3.21 |
| leaf | Glyma.05G102100 | 1119 | arabinogalactan protein 18 | 3.21 |
| leaf | Glyma.03G255700 | 908 | arabinogalactan protein 20 | 3.21 |
| leaf | Glyma.05G233700 | 1208 | B-box type zinc finger protein with CCT domain | 3.21 |
| leaf | Glyma.05G216300 | 1198 | PA-domain containing subtilase family protein | 3.21 |
| leaf | Glyma.18G046100 | 3177 | cysteine-rich RLK (RECEPTOR-like protein kinase) 2 | 3.21 |
| leaf | Glyma.19G194900 | 3394 | | 3.21 |
| leaf | Glyma.07G117500 | 1457 | basic helix-loop-helix (bHLH) DNA-binding superfamily protein | 3.21 |
| root | Glyma.U001700 | 4516 | ABC2 homolog 7 | 3.21 |
| root | Glyma.16G172400 | 4594 | multidrug resistance-associated protein 14 | 3.20 |
| root | Glyma.17G009600 | 3646 | RPM1 interacting protein 4 | 3.20 |
| leaf | Glyma.17G238900 | 3134 | Serine/threonine-protein kinase WNK (With No Lysine)-related | 3.20 |
| leaf | Glyma.17G225700 | 3125 | cytokinin oxidase 7 | 3.20 |
| leaf | Glyma.08G120100 | 1622 | NOD26-like intrinsic protein 1; 2 | 3.20 |
| leaf | Glyma.13G312500 | 2560 | Protein of unknown function (DUF3049) | 3.20 |
| leaf | Glyma.14G008000 | 2607 | photosystem II light harvesting complex gene 2.1 | 3.20 |
| root | Glyma.04G246400 | 3742 | amino acid permease 3 | 3.20 |
| root | Glyma.20G177000 | 4123 | alpha/beta-Hydrolases superfamily protein | 3.20 |
| root | Glyma.12G179600 | 4414 | Serine carboxypeptidase S28 family protein | 3.19 |
| root | Glyma.04G058100 | 3752 | HXXXD-type acyl-transferase family protein | 3.19 |
| root | Glyma.18G225100 | 4535 | | 3.19 |
| root | Glyma.06G143400 | 4481 | E2F target gene 1 | 3.19 |
| leaf | Glyma.13G005800 | 2359 | Leucine-rich repeat (LRR) family protein | 3.19 |
| leaf | Glyma.11G111100 | 2161 | fructose-bisphosphate aldolase 2 | 3.19 |
| leaf | Glyma.09G149200 | 1857 | gibberellin 20 oxidase 2 | 3.19 |
| root | Glyma.02G276500 | 3981 | Protein kinase protein with adenine nucleotide alpha hydrolases-like domain | 3.19 |
| root | Glyma.18G208300 | 4536 | UDP-glucosyl transferase 73B5 | 3.18 |
| root | Glyma.03G019800 | 4096 | gibberellin 20 oxidase 2 | 3.18 |
| leaf | Glyma.02G292400 | 766 | | 3.18 |
| leaf | Glyma.09G218100 | 1896 | Long-chain fatty alcohol dehydrogenase family protein | 3.18 |
| leaf | Glyma.03G215100 | 886 | Protein of unknown function, DUF538 | 3.18 |
| leaf | Glyma.06G193800 | 1336 | Gibberellin-regulated family protein | 3.18 |
| leaf | Glyma.07G027400 | 1419 | basic helix-loop-helix (bHLH) DNA-binding superfamily protein | 3.18 |
| leaf | Glyma.05G183200 | 1171 | nuclear factor Y, subunit B3 | 3.18 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
| --- | --- | --- | --- | --- |
| leaf | Glyma.11G142200 | 2177 | | 3.18 |
| leaf | Glyma.06G176100 | 1327 | cytochrome P450, family 71, subfamily A, polypeptide 22 | 3.18 |
| leaf | Glyma.07G262100 | 1526 | Glycine cleavage T-protein family | 3.18 |
| leaf | Glyma.08G350800 | 1763 | cytochrome P450, family 93, subfamily D, polypeptide 1 | 3.18 |
| root | Glyma.19G026000 | 4007 | related to AP2 11 | 3.17 |
| root | Glyma.15G165000 | 3817 | OSBP(oxysterol binding protein)-related protein 4C | 3.17 |
| leaf | Glyma.18G290600 | 3289 | heat shock protein 70 | 3.17 |
| leaf | Glyma.13G049000 | 2382 | TRICHOME BIREFRINGENCE-LIKE 19 | 3.17 |
| leaf | Glyma.07G193400 | 1494 | | 3.17 |
| leaf | Glyma.11G201200 | 2223 | oxidoreductases, acting on NADH or NADPH, quinone or similar compound as acceptor | 3.17 |
| leaf | Glyma.07G051400 | 1430 | S-adenosyl-L-methionine-dependent methyltransferases superfamily protein | 3.17 |
| leaf | Glyma.12G227300 | 2354 | | 3.17 |
| root | Glyma.12G071000 | 4442 | auxin response factor 4 | 3.16 |
| leaf | Glyma.15G086100 | 2759 | FASCICLIN-like arabinogalactan-protein 11 | 3.16 |
| leaf | Glyma.17G046700 | 3030 | | 3.16 |
| leaf | Glyma.09G275400 | 1918 | Disease resistance-responsive (dirigent-like protein) family protein | 3.16 |
| leaf | Glyma.04G214900 | 1034 | Transducin/WD40 repeat-like superfamily protein | 3.16 |
| leaf | Glyma.02G104600 | 675 | UDP-glucosyl transferase 73B3 | 3.16 |
| leaf | Glyma.20G129000 | 3499 | SPX domain gene 2 | 3.16 |
| leaf | Glyma.09G099500 | 1827 | Cation efflux family protein | 3.16 |
| leaf | Glyma.07G193500 | 1495 | | 3.16 |
| leaf | Glyma.07G075100 | 1440 | | 3.16 |
| leaf | Glyma.11G127800 | 2166 | enzyme binding; tetrapyrrole binding | 3.16 |
| leaf | Glyma.08G116200 | 1614 | | 3.16 |
| leaf | Glyma.08G095100 | 1604 | inorganic carbon transport protein-related | 3.16 |
| leaf | Glyma.18G061600 | 3192 | plant peptide containing sulfated tyrosine 1 | 3.16 |
| root | Glyma.17G111100 | 3680 | Bifunctional inhibitor/lipid-transfer protein/seed storage 2S albumin superfamily protein | 3.15 |
| root | Glyma.03G049100 | 4063 | Disease resistance protein (TIR-NBS-LRR class) family | 3.15 |
| leaf | Glyma.13G279500 | 2531 | Protein of unknown function (DUF1218) | 3.15 |
| leaf | Glyma.18G149500 | 3227 | | 3.15 |
| leaf | Glyma.19G028000 | 3313 | UDP-glucosyl transferase 85A5 | 3.15 |
| leaf | Glyma.15G045000 | 2730 | | 3.15 |
| leaf | Glyma.17G208200 | 3119 | Protein of unknown function, DUF642 | 3.15 |
| leaf | Glyma.13G174900 | 2448 | HAESA-like 1 | 3.15 |
| leaf | Glyma.11G005700 | 2087 | 2Fe—2S ferredoxin-like superfamily protein | 3.15 |
| leaf | Glyma.06G019800 | 1227 | SKU5 similar 5 | 3.15 |
| leaf | Glyma.13G299200 | 2545 | photosystem II family protein | 3.15 |
| root | Glyma.10G121000 | 3588 | Bifunctional inhibitor/lipid-transfer protein/seed storage 2S albumin superfamily protein | 3.15 |
| root | Glyma.11G074700 | 4222 | HXXXD-type acyl-transferase family protein | 3.15 |
| root | Glyma.14G128400 | 4270 | gibberellin 3-oxidase 1 | 3.15 |
| root | Glyma.12G179700 | 2323 | Serine carboxypeptidase S28 family protein | 3.15 |
| root | Glyma.10G187700 | 3600 | nodulin MtN21/EamA-like transporter family protein | 3.14 |
| root | Glyma.05G057200 | 4148 | Bifunctional inhibitor/lipid-transfer protein/seed storage 2S albumin superfamily protein | 3.14 |
| leaf | Glyma.10G199100 | 2028 | haemoglobin 2 | 3.14 |
| leaf | Glyma.15G102000 | 2769 | glutamine synthetase 2 | 3.14 |
| leaf | Glyma.16G005300 | 2859 | NAD(P)-binding Rossmann-fold superfamily protein | 3.14 |
| leaf | Glyma.17G138300 | 3088 | Cupredoxin superfamily protein | 3.14 |
| leaf | Glyma.05G034800 | 1089 | | 3.14 |
| leaf | Glyma.20G166400 | 3528 | Inositol monophosphatase family protein | 3.14 |
| leaf | Glyma.10G066100 | 1958 | heat shock transcription factor A3 | 3.14 |
| leaf | Glyma.01G197500 | 584 | tubulin alpha-2 chain | 3.14 |
| leaf | Glyma.11G195000 | 2217 | | 3.14 |
| leaf | Glyma.11G155100 | 2188 | response regulator 9 | 3.14 |
| leaf | Glyma.20G112600 | 3490 | Pectin lyase-like superfamily protein | 3.14 |
| leaf | Glyma.08G159900 | 1654 | ATP-citrate lyase A-1 | 3.14 |
| leaf | Glyma.07G022000 | 1413 | early nodulin-like protein 17 | 3.14 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.05G144600 | 4179 | HXXXD-type acyl-transferase family protein | 3.14 |
| root | Glyma.18G290000 | 4556 | Acyl-CoA N-acyltransferases (NAT) superfamily protein | 3.13 |
| root | Glyma.19G140000 | 4006 | heavy metal atpase 5 | 3.13 |
| leaf | Glyma.18G280900 | 3279 | allene oxide cyclase 4 | 3.13 |
| leaf | Glyma.14G071400 | 2643 | basic leucine-zipper 44 | 3.13 |
| leaf | Glyma.06G148000 | 1308 | Protein of unknown function (DUF3511) | 3.13 |
| leaf | Glyma.13G352300 | 2587 | Mannose-binding lectin superfamily protein | 3.13 |
| leaf | Glyma.20G034600 | 3464 | Peptidase C13 family | 3.13 |
| leaf | Glyma.20G107800 | 3488 | hydroxypyruvate reductase | 3.13 |
| leaf | Glyma.11G133900 | 2171 | MATE efflux family protein | 3.13 |
| leaf | Glyma.01G180200 | 557 | Protein of unknown function, DUF547 | 3.13 |
| root | Glyma.16G204700 | 4569 | | 3.13 |
| root | Glyma.17G078700 | 3671 | RPA70-kDa subunit B | 3.13 |
| root | Glyma.17G098700 | 3654 | end binding protein 1B | 3.13 |
| root | Glyma.18G085500 | 4557 | PLC-like phosphodiesterase family protein | 3.13 |
| root | Glyma.05G002100 | 4185 | HEAT repeat-containing protein | 3.13 |
| root | Glyma.05G201700 | 4164 | basic helix-loop-helix (bHLH) DNA-binding superfamily protein | 3.12 |
| root | Glyma.19G215600 | 4015 | | 3.12 |
| root | Glyma.03G089400 | 4093 | | 3.12 |
| leaf | Glyma.11G190600 | 2210 | GDSL-like Lipase/Acylhydrolase superfamily protein | 3.12 |
| leaf | Glyma.02G287600 | 761 | galacturonosyltransferase 15 | 3.12 |
| leaf | Glyma.08G320900 | 1748 | NAD(P)-binding Rossmann-fold superfamily protein | 3.12 |
| leaf | Glyma.10G137400 | 1977 | | 3.12 |
| leaf | Glyma.13G045300 | 2378 | | 3.12 |
| leaf | Glyma.07G181900 | 1489 | Haloacid dehalogenase-like hydrolase (HAD) superfamily protein | 3.12 |
| leaf | Glyma.06G114900 | 1287 | response regulator 9 | 3.12 |
| leaf | Glyma.09G199200 | 1877 | basic helix-loop-helix (bHLH) DNA-binding superfamily protein | 3.12 |
| leaf | Glyma.17G165600 | 3106 | zinc finger protein 7 | 3.12 |
| leaf | Glyma.11G197600 | 2219 | | 3.12 |
| leaf | Glyma.10G175200 | 2002 | Protein of unknown function, DUF599 | 3.12 |
| root | Glyma.03G219200 | 4094 | Minichromosome maintenance (MCM2/3/5) family protein | 3.12 |
| root | Glyma.02G064200 | 3956 | ribonuclease 1 | 3.12 |
| root | Glyma.06G187100 | 4465 | formin 8 | 3.11 |
| root | Glyma.15G046900 | 3856 | F-box/RNI-like superfamily protein | 3.11 |
| root | Glyma.09G122600 | 3710 | Cation efflux family protein | 3.11 |
| root | Glyma.06G074600 | 4495 | potassium channel in *Arabidopsis thaliana* 3 | 3.11 |
| root | Glyma.03G193900 | 4058 | | 3.11 |
| leaf | Glyma.04G187300 | 1019 | myb domain protein 86 | 3.11 |
| leaf | Glyma.03G078000 | 811 | Duplicated homeodomain-like superfamily protein | 3.11 |
| leaf | Glyma.03G190200 | 870 | Nucleotide-diphospho-sugar transferases superfamily protein | 3.11 |
| leaf | Glyma.10G281400 | 2075 | hydroxypyruvate reductase | 3.11 |
| leaf | Glyma.12G009300 | 2255 | sterol methyltransferase 1 | 3.11 |
| leaf | Glyma.05G009800 | 1071 | | 3.11 |
| leaf | Glyma.19G188000 | 3390 | | 3.11 |
| leaf | Glyma.08G302600 | 1739 | alanine: glyoxylate aminotransferase | 3.11 |
| root | Glyma.13G310800 | 3906 | | 3.11 |
| root | Glyma.07G052800 | 1432 | RAB GTPase homolog A3 | 3.11 |
| root | Glyma.14G138200 | 4284 | Major facilitator superfamily protein | 3.11 |
| leaf | Glyma.02G308800 | 780 | 5\'-AMP-activated protein kinase beta-2 subunit protein | 3.10 |
| leaf | Glyma.10G000900 | 1924 | NAD(P)H dehydrogenase 18 | 3.10 |
| leaf | Glyma.03G094800 | 814 | | 3.10 |
| leaf | Glyma.03G184400 | 861 | | 3.10 |
| root | Glyma.17G080000 | 3644 | | 3.10 |
| root | Glyma.06G156300 | 4474 | alpha/beta-Hydrolases superfamily protein | 3.10 |
| root | Glyma.19G053500 | 4019 | NAD-dependent glycerol-3-phosphate dehydrogenase family protein | 3.10 |
| root | Glyma.08G196900 | 1686 | peptidase M20/M25/M40 family protein | 3.10 |
| root | Glyma.04G088500 | 976 | tubulin alpha-2 chain | 3.09 |
| leaf | Glyma.10G199000 | 2027 | haemoglobin 2 | 3.09 |
| leaf | Glyma.18G061700 | 3193 | alternative NAD(P)H dehydrogenase 1 | 3.09 |
| leaf | Glyma.19G144100 | 3369 | Leucine-rich repeat protein kinase family protein | 3.09 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.14G055600 | 2636 | | 3.09 |
| leaf | Glyma.04G035900 | 936 | cytochrome b6f complex subunit (petM), putative | 3.09 |
| leaf | Glyma.19G126300 | 3360 | FKBP-type peptidyl-prolyl cis-trans isomerase family protein | 3.09 |
| root | Glyma.20G145200 | 3517 | Copper amine oxidase family protein | 3.09 |
| root | Glyma.14G165300 | 4275 | heat shock protein 70 (Hsp 70) family protein | 3.08 |
| root | Glyma.03G255700 | 908 | arabinogalactan protein 20 | 3.08 |
| root | Glyma.02G105300 | 3944 | UDP-glucosyl transferase 73B3 | 3.08 |
| root | Glyma.20G183900 | 4104 | | 3.08 |
| root | Glyma.02G074800 | 3983 | GRAS family transcription factor | 3.08 |
| root | Glyma.11G222300 | 4209 | NAD(P)-binding Rossmann-fold superfamily protein | 3.08 |
| root | Glyma.18G250100 | 4541 | Subtilisin-like serine endopeptidase family protein | 3.08 |
| root | Glyma.02G109100 | 3951 | expansin A1 | 3.08 |
| root | Glyma.02G125000 | 3955 | senescence-related gene 1 | 3.08 |
| leaf | Glyma.19G161400 | 3380 | photosystem II reaction center W | 3.08 |
| leaf | Glyma.15G157300 | 2803 | Pectin lyase-like superfamily protein | 3.08 |
| leaf | Glyma.17G174700 | 3108 | Ras-related small GTP-binding family protein | 3.08 |
| leaf | Glyma.14G063500 | 2638 | RING/FYVE/PHD zinc finger superfamily protein | 3.08 |
| leaf | Glyma.08G363200 | 1771 | PEBP (phosphatidylethanolamine-binding protein) family protein | 3.08 |
| leaf | Glyma.14G175800 | 2673 | UDP-glucosyl transferase 85A3 | 3.08 |
| leaf | Glyma.08G105700 | 1609 | Immunoglobulin E-set superfamily protein | 3.08 |
| leaf | Glyma.03G115200 | 822 | Plant protein of unknown function (DUF247) | 3.08 |
| leaf | Glyma.13G112500 | 2415 | chaperonin 20 | 3.08 |
| root | Glyma.15G069800 | 3841 | Galactose oxidase/kelch repeat superfamily protein | 3.08 |
| root | Glyma.03G047100 | 4078 | inflorescence meristem receptor-like kinase 2 | 3.08 |
| root | Glyma.18G063200 | 3194 | cation exchanger 1 | 3.08 |
| root | Glyma.08G116400 | 1615 | xylem bark cysteine peptidase 3 | 3.07 |
| root | Glyma.13G252600 | 3869 | pathogenesis-related protein-1-like | 3.07 |
| root | Glyma.02G206000 | 3969 | Family of unknown function (DUF566) | 3.07 |
| root | Glyma.19G098500 | 4020 | senescence-related gene 3 | 3.07 |
| leaf | Glyma.02G304500 | 774 | ADP glucose pyrophosphorylase 1 | 3.07 |
| leaf | Glyma.07G043100 | 1426 | Chaperone DnaJ-domain superfamily protein | 3.07 |
| leaf | Glyma.06G084500 | 1271 | Glyoxalase/Bleomycin resistance protein/Dioxygenase superfamily protein | 3.07 |
| leaf | Glyma.10G065200 | 1957 | Leucine-rich repeat protein kinase family protein | 3.07 |
| leaf | Glyma.08G132600 | 1634 | endoplasmic reticulum-type calcium-transporting ATPase 3 | 3.07 |
| leaf | Glyma.06G307100 | 1385 | SKU5 similar 5 | 3.07 |
| root | Glyma.15G005000 | 3811 | basic helix-loop-helix (bHLH) DNA-binding superfamily protein | 3.06 |
| root | Glyma.11G035300 | 2109 | 2-oxoglutarate (2OG) and Fe(II)-dependent oxygenase superfamily protein | 3.06 |
| root | Glyma.03G240700 | 897 | Protein of unknown function (DUF1068) | 3.06 |
| root | Glyma.03G254300 | 4082 | chitinase A | 3.06 |
| leaf | Glyma.17G252700 | 3142 | jasmonic acid carboxyl methyltransferase | 3.06 |
| leaf | Glyma.06G056400 | 1259 | Leucine-rich receptor-like protein kinase family protein | 3.06 |
| leaf | Glyma.10G198800 | 2026 | haemoglobin 2 | 3.06 |
| leaf | Glyma.18G240500 | 3256 | Haloacid dehalogenase-like hydrolase (HAD) superfamily protein | 3.06 |
| leaf | Glyma.11G124000 | 2165 | AP2/B3-like transcriptional factor family protein | 3.06 |
| leaf | Glyma.05G202000 | 1185 | Protein kinase superfamily protein | 3.06 |
| leaf | Glyma.01G095500 | 522 | basic helix-loop-helix (bHLH) DNA-binding superfamily protein | 3.06 |
| leaf | Glyma.11G219600 | 2229 | FIZZY-related 3 | 3.06 |
| leaf | Glyma.16G026200 | 2868 | thylakoid rhodanese-like | 3.06 |
| leaf | Glyma.07G205100 | 1500 | Tetratricopeptide repeat (TPR)-like superfamily protein | 3.06 |
| leaf | Glyma.04G170500 | 1011 | 2-oxoglutarate (2OG) and Fe(II)-dependent oxygenase superfamily protein | 3.06 |
| leaf | Glyma.17G106200 | 3067 | chlororespiratory reduction 6 | 3.06 |
| root | Glyma.08G127000 | 4360 | Protein kinase superfamily protein | 3.06 |
| root | Glyma.09G159700 | 3725 | Plant protein of unknown function (DUF247) | 3.06 |
| root | Glyma.18G078200 | 4527 | | 3.06 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.13G272300 | 2524 | sodium/calcium exchanger family protein/ calcium-binding EF hand family protein | 3.06 |
| root | Glyma.12G172700 | 4434 | Protein kinase superfamily protein | 3.05 |
| root | Glyma.15G161900 | 3821 | Protein kinase family protein | 3.05 |
| root | Glyma.13G306900 | 2556 | Peroxidase superfamily protein | 3.05 |
| root | Glyma.06G049200 | 4475 | Integrase-type DNA-binding superfamily protein | 3.05 |
| root | Glyma.20G036100 | 4119 | ribonuclease 1 | 3.05 |
| leaf | Glyma.07G022300 | 1414 | fucosyltransferase 1 | 3.05 |
| leaf | Glyma.18G067600 | 3197 | Plant protein of unknown function (DUF641) | 3.05 |
| leaf | Glyma.01G032000 | 497 | NHL domain-containing protein | 3.05 |
| leaf | Glyma.01G033700 | 498 | nodulin MtN21/EamA-like transporter family protein | 3.05 |
| leaf | Glyma.02G224900 | 727 | Homeodomain-like transcriptional regulator | 3.05 |
| leaf | Glyma.13G310300 | 2559 | cellulose synthase-like B3 | 3.05 |
| leaf | Glyma.06G247100 | 1366 | protochlorophyllide oxidoreductase A | 3.05 |
| leaf | Glyma.17G113100 | 3071 | uclacyanin 1 | 3.05 |
| leaf | Glyma.16G152700 | 2944 | GATA transcription factor 9 | 3.05 |
| leaf | Glyma.04G088500 | 976 | tubulin alpha-2 chain | 3.05 |
| root | Glyma.20G216700 | 4103 | Serine/threonine-protein kinase WNK (With No Lysine)-related | 3.05 |
| root | Glyma.18G148500 | 4542 | UDP-Glycosyltransferase superfamily protein | 3.05 |
| root | Glyma.18G266900 | 4530 | glycosyl hydrolase family 81 protein | 3.05 |
| root | Glyma.05G019200 | 4152 | cytochrome P450, family 78, subfamily A, polypeptide 10 | 3.04 |
| root | Glyma.06G160600 | 4456 | Protein kinase superfamily protein | 3.04 |
| root | Glyma.07G266600 | 3778 | | 3.04 |
| root | Glyma.08G021100 | 4362 | | 3.04 |
| leaf | Glyma.17G176400 | 3110 | Protein of unknown function, DUF547 | 3.04 |
| leaf | Glyma.03G074300 | 808 | Concanavalin A-like lectin family protein | 3.04 |
| leaf | Glyma.04G020000 | 928 | HMG (high mobility group) box protein with ARID/BRIGHT DNA-binding domain | 3.04 |
| leaf | Glyma.12G065500 | 2281 | | 3.04 |
| root | Glyma.18G208600 | 4563 | UDP-glucosyl transferase 73B3 | 3.04 |
| root | Glyma.02G064300 | 3986 | ribonuclease 1 | 3.04 |
| root | Glyma.18G109600 | 4554 | Cytochrome b561/ferric reductase transmembrane protein family | 3.04 |
| root | Glyma.06G003500 | 4501 | SBP (S-ribonuclease binding protein) family protein | 3.03 |
| root | Glyma.08G092600 | 4301 | | 3.03 |
| root | Glyma.16G119500 | 4595 | Arabidopsis protein of unknown function (DUF241) | 3.03 |
| root | Glyma.12G084600 | 4418 | cellulose synthase-like A02 | 3.03 |
| leaf | Glyma.09G134100 | 1845 | MATE efflux family protein | 3.03 |
| leaf | Glyma.08G125800 | 1628 | S-locus lectin protein kinase family protein | 3.03 |
| leaf | Glyma.15G132500 | 2792 | fatty acid hydroxylase 1 | 3.03 |
| leaf | Glyma.19G179800 | 3387 | | 3.03 |
| leaf | Glyma.16G150600 | 2938 | HXXXD-type acyl-transferase family protein | 3.03 |
| leaf | Glyma.19G016400 | 3305 | ABC transporter family protein | 3.03 |
| leaf | Glyma.07G001400 | 1401 | Protein kinase protein with adenine nucleotide alpha hydrolases-like domain | 3.03 |
| leaf | Glyma.05G197900 | 1182 | SEC14 cytosolic factor family protein/ phosphoglyceride transfer family protein | 3.03 |
| leaf | Glyma.16G191600 | 2979 | Arabidopsis thaliana protein of unknown function (DUF821) | 3.03 |
| leaf | Glyma.08G120200 | 1623 | NOD26-like intrinsic protein 1;2 | 3.03 |
| leaf | Glyma.19G032600 | 3320 | Pectin lyase-like superfamily protein | 3.03 |
| leaf | Glyma.20G105900 | 3486 | Major facilitator superfamily protein | 3.03 |
| leaf | Glyma.06G119600 | 1288 | | 3.03 |
| leaf | Glyma.16G041700 | 2877 | NDH-dependent cyclic electron flow 1 | 3.03 |
| leaf | Glyma.15G242900 | 2840 | Chalcone-flavanone isomerase family protein | 3.03 |
| leaf | Glyma.16G044900 | 2883 | glyceraldehyde 3-phosphate dehydrogenase A subunit 2 | 3.03 |
| root | Glyma.02G297100 | 3935 | Leucine-rich repeat protein kinase family protein | 3.03 |
| root | Glyma.19G251200 | 4046 | | 3.03 |
| root | Glyma.11G075000 | 4198 | Lactoylglutathione lyase/glyoxalase I family protein | 3.03 |
| root | Glyma.07G124400 | 3776 | 2-oxoglutarate (2OG) and Fe(II)-dependent oxygenase superfamily protein | 3.03 |
| root | Glyma.10G215700 | 3582 | O-methyltransferase 1 | 3.02 |
| leaf | Glyma.05G036900 | 1092 | Phosphoglycerate mutase family protein | 3.02 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.10G200800 | 2029 | cytochrome P450, family 76, subfamily C, polypeptide 4 | 3.02 |
| leaf | Glyma.13G070900 | 2389 | Peroxidase superfamily protein | 3.02 |
| leaf | Glyma.11G069900 | 2141 | Tetratricopeptide repeat (TPR)-like superfamily protein | 3.02 |
| leaf | Glyma.06G057000 | 1260 | G protein alpha subunit 1 | 3.02 |
| leaf | Glyma.18G065700 | 3195 | thiaminC | 3.02 |
| leaf | Glyma.13G146200 | 2430 | triosephosphate isomerase | 3.02 |
| leaf | Glyma.17G161500 | 3100 | Phototropic-responsive NPH3 family protein | 3.02 |
| leaf | Glyma.08G008700 | 1532 | serine carboxypeptidase-like 45 | 3.02 |
| root | Glyma.08G227700 | 4367 | Integrase-type DNA-binding superfamily protein | 3.02 |
| root | Glyma.06G040900 | 4513 | heat shock transcription factor B4 | 3.02 |
| root | Glyma.02G285600 | 3947 | Magnesium transporter CorA-like family protein | 3.01 |
| root | Glyma.09G218100 | 1896 | Long-chain fatty alcohol dehydrogenase family protein | 3.01 |
| root | Glyma.17G225100 | 3681 | Mitochondrial substrate carrier family protein | 3.01 |
| root | Glyma.14G052000 | 2632 | glycine-rich protein 3 short isoform | 3.01 |
| leaf | Glyma.01G082000 | 518 | DNA glycosylase superfamily protein | 3.01 |
| leaf | Glyma.20G118700 | 3496 | Protein kinase superfamily protein | 3.01 |
| leaf | Glyma.08G041100 | 1559 | B-box type zinc finger protein with CCT domain | 3.01 |
| leaf | Glyma.11G055600 | 2126 | Remorin family protein | 3.01 |
| leaf | Glyma.20G233400 | 3556 | | 3.01 |
| leaf | Glyma.20G017900 | 3456 | Polyketide cyclase/dehydrase and lipid transport superfamily protein | 3.01 |
| leaf | Glyma.04G202300 | 1028 | Rubredoxin-like superfamily protein | 3.01 |
| leaf | Glyma.01G035600 | 501 | CYCLIN D1; 1 | 3.01 |
| root | Glyma.13G214500 | 3866 | arabinogalactan protein 26 | 3.01 |
| root | Glyma.14G175800 | 2673 | UDP-glucosyl transferase 85A3 | 3.01 |
| root | Glyma.14G097000 | 4269 | IQ-domain 6 | 3.01 |
| root | Glyma.18G295500 | 4540 | zinc finger protein 6 | 3.01 |
| root | Glyma.11G066100 | 4220 | Major facilitator superfamily protein | 3.00 |
| root | Glyma.13G055600 | 3875 | Haloacid dehalogenase-like hydrolase (HAD) superfamily protein | 3.00 |
| leaf | Glyma.05G197200 | 1180 | phosphatidylinositol-4-phosphate 5-kinase 1 | 3.00 |
| leaf | Glyma.05G178700 | 1167 | annexin 2 | 3.00 |
| leaf | Glyma.11G032500 | 2107 | | 3.00 |
| leaf | Glyma.13G249700 | 2510 | Quinone reductase family protein | 3.00 |
| leaf | Glyma.03G139900 | 835 | | 3.00 |
| leaf | Glyma.03G257500 | 909 | Cytochrome b561/ferric reductase transmembrane with DOMON related domain | 3.00 |
| root | Glyma.08G219500 | 4302 | fucosyltransferase 1 | 3.00 |
| root | Glyma.02G051700 | 627 | beta-galactosidase 3 | 3.00 |
| root | Glyma.05G136600 | 4163 | | 2.99 |
| leaf | Glyma.03G056100 | 804 | Plant protein of unknown function (DUF828) | 2.99 |
| leaf | Glyma.05G200400 | 1183 | Homeodomain-like superfamily protein | 2.99 |
| leaf | Glyma.17G029300 | 3013 | | 2.99 |
| leaf | Glyma.15G144100 | 2801 | | 2.99 |
| leaf | Glyma.06G238100 | 1361 | squamosa promoter-binding protein-like 12 | 2.99 |
| leaf | Glyma.11G044800 | 2117 | xyloglucan endotransglucosylase/hydrolase 6 | 2.99 |
| leaf | Glyma.04G247800 | 1055 | response regulator 9 | 2.99 |
| leaf | Glyma.05G201300 | 1184 | acyl carrier protein 4 | 2.99 |
| leaf | Glyma.U021100 | 3569 | ROP interactive partner 5 | 2.99 |
| leaf | Glyma.10G063800 | 1954 | FKBP-like peptidyl-prolyl cis-trans isomerase family protein | 2.99 |
| leaf | Glyma.12G179700 | 2323 | Serine carboxypeptidase S28 family protein | 2.99 |
| leaf | Glyma.09G227400 | 1899 | Nucleic acid-binding, OB-fold-like protein | 2.99 |
| leaf | Glyma.18G181700 | 3233 | expansin A4 | 2.99 |
| leaf | Glyma.03G044200 | 798 | SEC14 cytosolic factor family protein/ phosphoglyceride transfer family protein | 2.99 |
| root | Glyma.20G116800 | 4131 | endonuclease 2 | 2.99 |
| root | Glyma.07G033900 | 3785 | | 2.99 |
| root | Glyma.20G135400 | 4110 | CYCLIN D1; 1 | 2.99 |
| root | Glyma.19G144800 | 4013 | geranylgeranyl pyrophosphate synthase 1 | 2.98 |
| root | Glyma.12G192900 | 2330 | | 2.98 |
| root | Glyma.16G092600 | 2909 | Leucine-rich repeat protein kinase family protein | 2.98 |
| root | Glyma.09G211700 | 3697 | Nucleotide-diphospho-sugar transferase family protein | 2.98 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.03G192600 | 873 | pleiotropic drug resistance 6 | 2.98 |
| leaf | Glyma.19G087900 | 3341 | | 2.98 |
| leaf | Glyma.13G333200 | 2573 | myb domain protein 48 | 2.98 |
| leaf | Glyma.18G032100 | 3170 | ROP guanine nucleotide exchange factor 5 | 2.98 |
| leaf | Glyma.04G207200 | 1031 | | 2.98 |
| root | Glyma.09G062800 | 3701 | GATA type zinc finger transcription factor family protein | 2.98 |
| root | Glyma.05G129700 | 4153 | Minichromosome maintenance (MCM2/3/5) family protein | 2.98 |
| root | Glyma.04G123000 | 3737 | | 2.98 |
| root | Glyma.08G277000 | 4293 | Deoxyxylulose-5-phosphate synthase | 2.98 |
| root | Glyma.02G172200 | 3987 | Concanavalin A-like lectin protein kinase family protein | 2.97 |
| root | Glyma.13G145500 | 3921 | Protein of unknown function (DUF1624) | 2.97 |
| root | Glyma.07G141200 | 3772 | copper transporter 1 | 2.97 |
| leaf | Glyma.15G194300 | 2820 | photosystem I subunit K | 2.97 |
| leaf | Glyma.08G181900 | 1672 | Vacuolar iron transporter (VIT) family protein | 2.97 |
| leaf | Glyma.09G199600 | 1878 | Xanthine/uracil permease family protein | 2.97 |
| leaf | Glyma.12G222000 | 2350 | Protein of unknown function (DUF1218) | 2.97 |
| leaf | Glyma.13G231500 | 2496 | GDSL-like Lipase/Acylhydrolase superfamily protein | 2.97 |
| leaf | Glyma.11G115300 | 2162 | | 2.97 |
| leaf | Glyma.13G286500 | 2534 | PsbQ-like 1 | 2.97 |
| leaf | Glyma.02G217000 | 722 | | 2.97 |
| root | Glyma.02G044600 | 3933 | protein kinase family protein | 2.97 |
| root | Glyma.09G213400 | 3694 | | 2.97 |
| root | Glyma.17G195800 | 3655 | | 2.97 |
| root | Glyma.02G103200 | 3946 | basic helix-loop-helix (bHLH) DNA-binding superfamily protein | 2.96 |
| root | Glyma.15G223200 | 3832 | DNAse I-like superfamily protein | 2.96 |
| root | Glyma.13G135300 | 3889 | Protein phosphatase 2C family protein | 2.96 |
| root | Glyma.11G150200 | 4241 | scarecrow-like 3 | 2.96 |
| root | Glyma.19G224600 | 4042 | myb domain protein 61 | 2.96 |
| leaf | Glyma.17G243500 | 3138 | | 2.96 |
| leaf | Glyma.06G056000 | 1258 | ferredoxin-related | 2.96 |
| leaf | Glyma.05G000900 | 1061 | actin-11 | 2.96 |
| leaf | Glyma.17G233100 | 3131 | | 2.96 |
| leaf | Glyma.06G169300 | 1323 | thylakoid lumenal 17.9 kDa protein, chloroplast | 2.96 |
| leaf | Glyma.07G185500 | 1490 | FAD/NAD(P)-binding oxidoreductase family protein | 2.96 |
| leaf | Glyma.02G061100 | 630 | photosystem II subunit O-2 | 2.96 |
| leaf | Glyma.09G053800 | 1800 | Ankyrin repeat family protein | 2.96 |
| leaf | Glyma.09G127700 | 1839 | UDP-glucosyl transferase 88A1 | 2.96 |
| root | Glyma.13G197300 | 3930 | Lateral root primordium (LRP) protein-related | 2.96 |
| root | Glyma.12G188100 | 4439 | Leucine-rich repeat protein kinase family protein | 2.96 |
| root | Glyma.01G050100 | 508 | expansin A1 | 2.96 |
| root | Glyma.13G223800 | 3903 | nitrate transporter 1:2 | 2.96 |
| root | Glyma.15G243000 | 3815 | Carbohydrate-binding X8 domain superfamily protein | 2.95 |
| root | Glyma.15G239500 | 3830 | | 2.95 |
| root | Glyma.10G035700 | 3591 | homolog of yeast CDT1 A | 2.95 |
| leaf | Glyma.05G044600 | 1096 | GDSL-like Lipase/Acylhydrolase superfamily protein | 2.95 |
| leaf | Glyma.05G149100 | 1150 | Immunoglobulin E-set superfamily protein | 2.95 |
| leaf | Glyma.08G291000 | 1734 | CYCLIN D1; 1 | 2.95 |
| leaf | Glyma.U025800 | 3570 | squamosa promoter-binding protein-like 12 | 2.95 |
| leaf | Glyma.10G231700 | 2050 | ferric reduction oxidase 2 | 2.95 |
| leaf | Glyma.02G076100 | 641 | somatic embryogenesis receptor-like kinase 1 | 2.95 |
| leaf | Glyma.04G034000 | 933 | | 2.95 |
| leaf | Glyma.06G025100 | 1232 | glycosyl hydrolase 9B7 | 2.95 |
| leaf | Glyma.19G106800 | 3355 | glyceraldehyde 3-phosphate dehydrogenase A subunit 2 | 2.95 |
| leaf | Glyma.09G129900 | 1840 | CBS domain-containing protein with a domain of unknown function (DUF21) | 2.95 |
| leaf | Glyma.06G288500 | 1376 | NAC domain containing protein 73 | 2.95 |
| leaf | Glyma.11G107000 | 2160 | amino acid permease 2 | 2.95 |
| leaf | Glyma.04G056200 | 957 | Leucine-rich receptor-like protein kinase family protein | 2.95 |
| root | Glyma.17G146500 | 3662 | BAX inhibitor 1 | 2.95 |
| root | Glyma.08G356200 | 1766 | | 2.95 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.13G350300 | 3890 | Glucose-methanol-choline (GMC) oxidoreductase family protein | 2.95 |
| root | Glyma.13G201600 | 3888 | | 2.95 |
| root | Glyma.11G149100 | 2181 | cytokinin oxidase/dehydrogenase 6 | 2.94 |
| root | Glyma.15G274400 | 3851 | | 2.94 |
| root | Glyma.11G075100 | 4208 | ATP binding microtubule motor family protein | 2.94 |
| root | Glyma.03G018400 | 4097 | peptidoglycan-binding LysM domain-containing protein | 2.94 |
| root | Glyma.07G093800 | 3801 | Core-2/I-branching beta-1,6-N-acetylglucosaminyltransferase family protein | 2.94 |
| leaf | Glyma.10G248800 | 2063 | S-adenosyl-L-methionine-dependent methyltransferases superfamily protein | 2.94 |
| leaf | Glyma.08G273400 | 1725 | Zinc finger (C3HC4-type RING finger) family protein | 2.94 |
| leaf | Glyma.14G172400 | 2670 | pumilio 7 | 2.94 |
| leaf | Glyma.06G161800 | 1320 | GDSL-like Lipase/Acylhydrolase superfamily protein | 2.94 |
| leaf | Glyma.16G160500 | 2946 | F-box and associated interaction domains-containing protein | 2.94 |
| leaf | Glyma.11G030200 | 2104 | myb domain protein 85 | 2.94 |
| leaf | Glyma.01G236900 | 602 | | 2.94 |
| leaf | Glyma.19G107000 | 3356 | Tetratricopeptide repeat (TPR)-like superfamily protein | 2.94 |
| leaf | Glyma.01G173200 | 550 | Tetratricopeptide repeat (TPR)-like superfamily protein | 2.94 |
| root | Glyma.20G124900 | 4112 | putative fasciclin-like arabinogalactan protein 20 | 2.94 |
| root | Glyma.04G255400 | 1060 | cellulose synthase like G2 | 2.94 |
| root | Glyma.20G066500 | 4105 | Nodulin MtN3 family protein | 2.93 |
| root | Glyma.11G044000 | 4197 | | 2.93 |
| root | Glyma.19G041600 | 4029 | TRICHOME BIREFRINGENCE-LIKE 19 | 2.93 |
| leaf | Glyma.14G053700 | 2634 | Peroxidase superfamily protein | 2.93 |
| leaf | Glyma.04G167400 | 1006 | NDH dependent flow 6 | 2.93 |
| leaf | Glyma.17G152600 | 3098 | HXXXD-type acyl-transferase family protein | 2.93 |
| leaf | Glyma.11G133700 | 2170 | myb domain protein 83 | 2.93 |
| leaf | Glyma.18G065900 | 3196 | | 2.93 |
| leaf | Glyma.02G227500 | 730 | Mannose-binding lectin superfamily protein | 2.93 |
| leaf | Glyma.13G260300 | 2517 | TGACG motif-binding factor 6 | 2.93 |
| leaf | Glyma.06G004900 | 1219 | Pollen Ole e 1 allergen and extensin family protein | 2.93 |
| leaf | Glyma.07G068300 | 1439 | Dihydroneopterin aldolase | 2.93 |
| leaf | Glyma.04G098800 | 981 | | 2.93 |
| leaf | Glyma.15G103600 | 2771 | CRINKLY4 related 3 | 2.93 |
| leaf | Glyma.08G076400 | 1587 | Pyridoxal phosphate (PLP)-dependent transferases superfamily protein | 2.93 |
| leaf | Glyma.16G094000 | 2911 | | 2.93 |
| leaf | Glyma.13G302300 | 2546 | HXXXD-type acyl-transferase family protein | 2.93 |
| leaf | Glyma.13G093700 | 2407 | Protein kinase superfamily protein | 2.93 |
| leaf | Glyma.05G168400 | 1161 | 2Fe—2S ferredoxin-like superfamily protein | 2.93 |
| leaf | Glyma.08G106700 | 1610 | FKBP-type peptidyl-prolyl cis-trans isomerase family protein | 2.93 |
| leaf | Glyma.19G211700 | 3407 | Protein of unknown function, DUF538 | 2.93 |
| leaf | Glyma.01G002000 | 478 | Protein of unknown function (DUF581) | 2.93 |
| leaf | Glyma.17G138900 | 3090 | | 2.93 |
| root | Glyma.14G117200 | 4245 | cytochrome P450, family 71 subfamily B, polypeptide 7 | 2.93 |
| root | Glyma.06G176200 | 4510 | cytochrome P450, family 71, subfamily A, polypeptide 22 | 2.93 |
| root | Glyma.13G294400 | 2542 | | 2.92 |
| root | Glyma.02G104600 | 675 | UDP-glucosyl transferase 73B3 | 2.92 |
| root | Glyma.16G212300 | 4587 | disease resistance protein (TIR-NBS-LRR class), putative | 2.92 |
| leaf | Glyma.12G028300 | 2266 | cell elongation protein/DWARF1/DIMINUTO (DIM) | 2.92 |
| leaf | Glyma.05G024600 | 1079 | | 2.92 |
| leaf | Glyma.17G049800 | 3031 | germin 3 | 2.92 |
| leaf | Glyma.14G015500 | 2612 | receptor like protein 6 | 2.92 |
| leaf | Glyma.05G112900 | 1129 | | 2.92 |
| leaf | Glyma.05G225400 | 1201 | Protein of unknown function (DUF1005) | 2.92 |
| leaf | Glyma.19G255100 | 3441 | alpha/beta-Hydrolases superfamily protein | 2.92 |
| leaf | Glyma.13G164000 | 2435 | | 2.92 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.10G016800 | 1931 | | 2.92 |
| leaf | Glyma.15G085700 | 2758 | | 2.92 |
| leaf | Glyma.02G203100 | 710 | Reticulon family protein | 2.92 |
| leaf | Glyma.06G324300 | 1398 | cellulose synthase like G1 | 2.92 |
| leaf | Glyma.09G118900 | 1832 | amino acid transporter 1 | 2.92 |
| leaf | Glyma.03G130200 | 830 | strictosidine synthase-like 2 | 2.92 |
| leaf | Glyma.11G130200 | 2169 | lipoxygenase 2 | 2.92 |
| leaf | Glyma.19G022500 | 3309 | GAST1 protein homolog 4 | 2.92 |
| root | Glyma.12G062700 | 4437 | expansin A4 | 2.92 |
| root | Glyma.01G081900 | 4392 | 2-oxoacid dehydrogenases acyltransferase family protein | 2.92 |
| root | Glyma.06G051500 | 4491 | N-MYC downregulated-like 2 | 2.92 |
| root | Glyma.06G074100 | 4478 | molybdate transporter 1 | 2.92 |
| root | Glyma.02G046800 | 3998 | Glycosyl hydrolase family 38 protein | 2.91 |
| root | Glyma.17G070800 | 3674 | ARIA-interacting double AP2 domain protein | 2.91 |
| leaf | Glyma.03G015000 | 786 | | 2.91 |
| leaf | Glyma.15G107900 | 2777 | ATPase, F1 complex, gamma subunit protein | 2.91 |
| leaf | Glyma.09G081800 | 1820 | Protein kinase superfamily protein | 2.91 |
| leaf | Glyma.03G141900 | 837 | | 2.91 |
| leaf | Glyma.19G215800 | 3412 | Adenine nucleotide alpha hydrolases-like superfamily protein | 2.91 |
| leaf | Glyma.08G139100 | 1640 | FK506-binding protein 16-2 | 2.91 |
| leaf | Glyma.10G160900 | 1991 | Plant protein of unknown function (DUF868) | 2.91 |
| leaf | Glyma.13G087300 | 2398 | Protein of unknown function (DUF581) | 2.91 |
| leaf | Glyma.20G176100 | 3534 | O-methyltransferase 1 | 2.91 |
| leaf | Glyma.11G150300 | 2183 | Disease resistance-responsive (dirigent-like protein) family protein | 2.91 |
| leaf | Glyma.16G181900 | 2977 | ATP binding microtubule motor family protein | 2.91 |
| leaf | Glyma.03G047400 | 800 | Disease resistance protein (TIR-NBS-LRR class) family | 2.91 |
| root | Glyma.19G196600 | 4033 | AP2/B3-like transcriptional factor family protein | 2.91 |
| root | Glyma.13G369200 | 3870 | | 2.91 |
| root | Glyma.19G003100 | 4022 | beta-1,4-N-acetylglucosaminyltransferase family protein | 2.91 |
| root | Glyma.04G165000 | 1005 | Flavin-binding monooxygenase family protein | 2.91 |
| root | Glyma.01G221200 | 4390 | PLAC8 family protein | 2.90 |
| leaf | Glyma.02G114900 | 677 | | 2.90 |
| leaf | Glyma.19G229100 | 3423 | Protein of unknown function (DUF1645) | 2.90 |
| leaf | Glyma.06G127900 | 1299 | CCT motif family protein | 2.90 |
| leaf | Glyma.18G049600 | 3178 | oxidoreductases, acting on NADH or NADPH, quinone or similar compound as acceptor | 2.90 |
| leaf | Glyma.08G199500 | 1690 | GDSL-like Lipase/Acylhydrolase superfamily protein | 2.90 |
| leaf | Glyma.03G121600 | 826 | lupeol synthase 2 | 2.90 |
| leaf | Glyma.20G231600 | 3554 | thylakoid lumen 18.3 kDa protein | 2.90 |
| leaf | Glyma.18G106300 | 3208 | rhamnose biosynthesis 1 | 2.90 |
| leaf | Glyma.09G249200 | 1911 | thioredoxin F2 | 2.90 |
| leaf | Glyma.16G043100 | 2881 | hydroxyproline-rich glycoprotein family protein | 2.90 |
| leaf | Glyma.06G299400 | 1379 | | 2.90 |
| leaf | Glyma.05G025400 | 1080 | fucosyltransferase 1 | 2.90 |
| leaf | Glyma.20G172400 | 3532 | Oxidoreductase family protein | 2.90 |
| leaf | Glyma.08G013000 | 1537 | Myosin heavy chain-related protein | 2.90 |
| root | Glyma.17G158800 | 3675 | Protein kinase superfamily protein | 2.90 |
| root | Glyma.04G181300 | 3747 | RING/U-box superfamily protein | 2.90 |
| root | Glyma.13G289100 | 3928 | UDP-Glycosyltransferase superfamily protein | 2.90 |
| root | Glyma.05G188000 | 4187 | | 2.90 |
| root | Glyma.08G350800 | 1763 | cytochrome P450, family 93, subfamily D, polypeptide 1 | 2.89 |
| root | Glyma.15G133300 | 3848 | | 2.89 |
| root | Glyma.02G221600 | 3988 | Major facilitator superfamily protein | 2.89 |
| root | Glyma.02G098200 | 3961 | Transmembrane amino acid transporter family protein | 2.89 |
| root | Glyma.02G282300 | 3942 | | 2.89 |
| leaf | Glyma.04G182300 | 1017 | BURP domain-containing protein | 2.89 |
| leaf | Glyma.17G105800 | 3066 | DNA-binding protein phosphatase 1 | 2.89 |
| leaf | Glyma.11G226900 | 2236 | sedoheptulose-bisphosphatase | 2.89 |
| leaf | Glyma.20G097000 | 3484 | Uncharacterized protein | 2.89 |
| leaf | Glyma.01G195000 | 582 | Galactosyl transferase GMA12/MNN10 family protein | 2.89 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.10G238300 | 2055 | IQ-domain 24 | 2.89 |
| leaf | Glyma.04G161600 | 1004 | Protein of unknown function (DUF1118) | 2.89 |
| leaf | Glyma.04G196100 | 1022 | chlorsulfuron/imidazolinone resistant 1 | 2.89 |
| leaf | Glyma.15G113300 | 2782 | indole-3-butyric acid response 1 | 2.89 |
| leaf | Glyma.20G232100 | 3555 | Protein kinase superfamily protein | 2.89 |
| leaf | Glyma.07G014600 | 1409 | HAD superfamily, subfamily IIIB acid phosphatase | 2.89 |
| leaf | Glyma.07G033700 | 1422 | 2-oxoglutarate (2OG) and Fe(II)-dependent oxygenase superfamily protein | 2.89 |
| leaf | Glyma.02G080900 | 645 | cellulose synthase 6 | 2.89 |
| leaf | Glyma.12G081300 | 2289 | copper/zinc superoxide dismutase 2 | 2.89 |
| root | Glyma.19G215500 | 4021 | beta-xylosidase 2 | 2.89 |
| root | Glyma.10G203000 | 3617 | pleiotropic drug resistance 11 | 2.89 |
| root | Glyma.20G031000 | 4115 | related to AP2 11 | 2.89 |
| root | Glyma.05G044000 | 4166 | Pectin lyase-like superfamily protein | 2.89 |
| root | Glyma.06G036200 | 4470 | nitrate transporter 1:2 | 2.88 |
| root | Glyma.12G225700 | 4429 | | 2.88 |
| root | Glyma.13G125800 | 2423 | Vps51/Vps67 family (components of vesicular transport) protein | 2.88 |
| root | Glyma.14G141000 | 4264 | BURP domain-containing protein | 2.88 |
| leaf | Glyma.11G238700 | 2245 | Protein of unknown function (DUF581) | 2.88 |
| leaf | Glyma.16G165900 | 2956 | cellulose synthase 6 | 2.88 |
| leaf | Glyma.03G180300 | 859 | | 2.88 |
| leaf | Glyma.20G018000 | 3457 | phosphoglucomutase, putative/glucose phosphomutase, putative | 2.88 |
| leaf | Glyma.16G033700 | 2873 | UDP-glycosyltransferase 73B4 | 2.88 |
| leaf | Glyma.13G172500 | 2445 | GDSL-like Lipase/Acylhydrolase superfamily protein | 2.88 |
| leaf | Glyma.10G032200 | 1940 | photosystem II reaction center W | 2.88 |
| leaf | Glyma.03G044300 | 799 | Disease resistance-responsive (dirigent-like protein) family protein | 2.88 |
| leaf | Glyma.01G160100 | 544 | basic chitinase | 2.88 |
| root | Glyma.09G001700 | 3717 | organic cation/carnitine transporter 3 | 2.88 |
| root | Glyma.19G008300 | 4041 | Oxidoreductase, zinc-binding dehydrogenase family protein | 2.88 |
| root | Glyma.03G126900 | 4073 | F-box family protein | 2.88 |
| root | Glyma.05G080700 | 4178 | | 2.88 |
| root | Glyma.08G026900 | 4326 | cytochrome P450, family 716, subfamily A, polypeptide 1 | 2.87 |
| leaf | Glyma.13G115300 | 2418 | Plant invertase/pectin methylesterase inhibitor superfamily | 2.87 |
| leaf | Glyma.04G005200 | 922 | Protein of unknown function (DUF803) | 2.87 |
| leaf | Glyma.06G170400 | 1325 | purple acid phosphatase 27 | 2.87 |
| leaf | Glyma.13G057700 | 2384 | UDP-glucose 6-dehydrogenase family protein | 2.87 |
| leaf | Glyma.02G270800 | 752 | chitin elicitor receptor kinase 1 | 2.87 |
| leaf | Glyma.11G189700 | 2209 | Transmembrane amino acid transporter family protein | 2.87 |
| leaf | Glyma.03G180000 | 858 | FASCICLIN-like arabinogalactan-protein 11 | 2.87 |
| leaf | Glyma.13G294400 | 2542 | | 2.87 |
| root | Glyma.13G122400 | 3898 | RING/U-box superfamily protein | 2.87 |
| root | Glyma.06G205100 | 4459 | disease resistance protein (TIR-NBS-LRR class), putative | 2.87 |
| root | Glyma.06G061700 | 4492 | chorismate mutase 2 | 2.87 |
| root | Glyma.09G181100 | 3718 | Bifunctional inhibitor/lipid-transfer protein/seed storage 2S albumin superfamily protein | 2.87 |
| root | Glyma.11G071500 | 4202 | Heavy metal transport/detoxification superfamily protein | 2.87 |
| root | Glyma.13G053000 | 3883 | reversibly glycosylated polypeptide 2 | 2.87 |
| root | Glyma.02G279200 | 3971 | | 2.86 |
| root | Glyma.14G086200 | 4266 | CYCLIN D3; 1 | 2.86 |
| root | Glyma.06G170300 | 1324 | purple acid phosphatase 27 | 2.86 |
| leaf | Glyma.05G210900 | 1196 | Pectin lyase-like superfamily protein | 2.86 |
| leaf | Glyma.02G102600 | 671 | Protein kinase superfamily protein | 2.86 |
| leaf | Glyma.08G116400 | 1615 | xylem bark cysteine peptidase 3 | 2.86 |
| leaf | Glyma.16G107600 | 2915 | Pectinacetylesterase family protein | 2.86 |
| leaf | Glyma.12G199300 | 2333 | Cyclin D6; 1 | 2.86 |
| leaf | Glyma.13G165300 | 2436 | DNA-binding protein phosphatase 1 | 2.86 |
| leaf | Glyma.04G014500 | 925 | Photosystem II reaction center PsbP family protein | 2.86 |
| leaf | Glyma.18G244900 | 3259 | 2-phosphoglycolate phosphatase 1 | 2.86 |
| leaf | Glyma.10G211100 | 2042 | | 2.86 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.10G028400 | 1939 | DNAse I-like superfamily protein | 2.86 |
| leaf | Glyma.04G060600 | 959 | early nodulin-like protein 14 | 2.86 |
| leaf | Glyma.08G198900 | 1687 | Leucine-rich repeat protein kinase family protein | 2.86 |
| root | Glyma.12G017400 | 4426 | Target of Myb protein 1 | 2.86 |
| root | Glyma.16G072000 | 4592 | 2-oxoglutarate (2OG) and Fe(II)-dependent oxygenase superfamily protein | 2.86 |
| root | Glyma.17G229000 | 3679 | Hydroxyproline-rich glycoprotein family protein | 2.85 |
| root | Glyma.13G336600 | 3895 | expansin A4 | 2.85 |
| root | Glyma.03G104500 | 4061 | UDP-Glycosyltransferase superfamily protein | 2.85 |
| leaf | Glyma.14G085400 | 2648 | Leucine-rich repeat (LRR) family protein | 2.85 |
| leaf | Glyma.07G126600 | 1461 | myo-inositol oxygenase 2 | 2.85 |
| leaf | Glyma.03G180900 | 860 | plasma membrane intrinsic protein 2A | 2.85 |
| leaf | Glyma.01G078300 | 517 | cytochrome P450, family 83, subfamily B, polypeptide 1 | 2.85 |
| leaf | Glyma.17G066700 | 3040 | Protein kinase superfamily protein | 2.85 |
| leaf | Glyma.16G092600 | 2909 | Leucine-rich repeat protein kinase family protein | 2.85 |
| leaf | Glyma.19G057300 | 3334 | cytochrome P450, family 96, subfamily A, polypeptide 1 | 2.85 |
| leaf | Glyma.17G253200 | 3143 | basic leucine-zipper 44 | 2.85 |
| leaf | Glyma.15G107000 | 2776 | | 2.85 |
| leaf | Glyma.19G209500 | 3404 | Heavy metal transport/detoxification superfamily protein | 2.85 |
| leaf | Glyma.19G192400 | 3393 | Integrase-type DNA-binding superfamily protein | 2.85 |
| leaf | Glyma.08G272600 | 1724 | Mitochondrial substrate carrier family protein | 2.85 |
| root | Glyma.08G164400 | 4333 | zinc transporter 1 precursor | 2.85 |
| root | Glyma.04G025300 | 3745 | SAUR-like auxin-responsive protein family | 2.85 |
| root | Glyma.20G135000 | 4135 | quiescin-sulfhydryl oxidase 2 | 2.84 |
| root | Glyma.03G199100 | 4095 | alpha/beta-Hydrolases superfamily protein | 2.84 |
| root | Glyma.13G147700 | 3904 | permease, cytosine/purines, uracil, thiamine, allantoin family protein | 2.84 |
| root | Glyma.14G062400 | 4262 | Polyketide cyclase/dehydrase and lipid transport superfamily protein | 2.84 |
| root | Glyma.17G167300 | 3631 | | 2.84 |
| root | Glyma.09G016900 | 3712 | | 2.84 |
| leaf | Glyma.16G143800 | 2932 | Phototropic-responsive NPH3 family protein | 2.84 |
| leaf | Glyma.05G085700 | 1114 | Protein of unknown function (DUF579) | 2.84 |
| leaf | Glyma.16G043500 | 2882 | apyrase 2 | 2.84 |
| leaf | Glyma.18G280100 | 3278 | | 2.84 |
| leaf | Glyma.01G034900 | 500 | TRICHOME BIREFRINGENCE-LIKE 27 | 2.84 |
| leaf | Glyma.09G208000 | 1885 | alpha/beta-Hydrolases superfamily protein | 2.84 |
| leaf | Glyma.15G197400 | 2822 | PIF1 helicase | 2.84 |
| leaf | Glyma.02G289000 | 764 | glucose-6-phosphate/phosphate translocator 2 | 2.84 |
| leaf | Glyma.19G190200 | 3391 | Leucine-rich repeat protein kinase family protein | 2.84 |
| leaf | Glyma.17G100700 | 3059 | Pyridine nucleotide-disulphide oxidoreductase family protein | 2.84 |
| leaf | Glyma.11G193600 | 2211 | xyloglucan endotransglucosylase/hydrolase 32 | 2.84 |
| leaf | Glyma.18G260900 | 3270 | expansin A1 | 2.84 |
| leaf | Glyma.17G138800 | 3089 | adenine phosphoribosyl transferase 4 | 2.84 |
| leaf | Glyma.08G217100 | 1701 | C2H2 and C2HC zinc fingers superfamily protein | 2.84 |
| leaf | Glyma.06G121400 | 1292 | Thioredoxin superfamily protein | 2.84 |
| leaf | Glyma.06G014900 | 1224 | NAC (No Apical Meristem) domain transcriptional regulator superfamily protein | 2.84 |
| leaf | Glyma.09G239800 | 1908 | Galactose mutarotase-like superfamily protein | 2.84 |
| leaf | Glyma.17G027800 | 3011 | Protein of unknown function (DUF581) | 2.84 |
| root | Glyma.05G213900 | 4156 | Protein of unknown function (DUF1191) | 2.84 |
| root | Glyma.05G020600 | 4182 | RPA70-kDa subunit B | 2.84 |
| root | Glyma.01G175200 | 4400 | Sulfite exporter TauE/SafE family protein | 2.84 |
| root | Glyma.06G123900 | 4460 | glycosyl hydrolase 9A1 | 2.84 |
| root | Glyma.03G131200 | 4080 | 2-oxoglutarate (2OG) and Fe(II)-dependent oxygenase superfamily protein | 2.84 |
| root | Glyma.09G028400 | 3696 | Sec14p-like phosphatidylinositol transfer family protein | 2.83 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.05G048700 | 4155 | Pyridoxal phosphate (PLP)-dependent transferases superfamily protein | 2.83 |
| root | Glyma.15G262800 | 3857 | zinc transporter 1 precursor | 2.83 |
| root | Glyma.14G045000 | 4280 | Glycosyl hydrolase family protein | 2.83 |
| root | Glyma.19G144500 | 3370 | | 2.83 |
| root | Glyma.15G002500 | 3819 | | 2.83 |
| root | Glyma.13G094200 | 3873 | CAP (Cysteine-rich secretory proteins, Antigen 5, and Pathogenesis-related 1 protein) superfamily protein | 2.83 |
| root | Glyma.10G288400 | 3605 | Leucine-rich repeat (LRR) family protein | 2.83 |
| leaf | Glyma.17G253500 | 3144 | TRAM, LAG1 and CLN8 (TLC) lipid-sensing domain containing protein | 2.83 |
| leaf | Glyma.06G039100 | 1240 | BRI1 kinase inhibitor 1 | 2.83 |
| leaf | Glyma.07G052800 | 1432 | RAB GTPase homolog A3 | 2.83 |
| leaf | Glyma.13G034000 | 2373 | NAD(P)-binding Rossmann-fold superfamily protein | 2.83 |
| leaf | Glyma.17G016600 | 3006 | Eukaryotic aspartyl protease family protein | 2.83 |
| leaf | Glyma.07G083700 | 1445 | Phosphorylase superfamily protein | 2.83 |
| leaf | Glyma.14G035100 | 2625 | | 2.83 |
| leaf | Glyma.09G043200 | 1794 | Nodulin MtN3 family protein | 2.83 |
| leaf | Glyma.14G003400 | 2601 | photosystem I light harvesting complex gene 3 | 2.83 |
| root | Glyma.12G017900 | 4450 | Rhodanese/Cell cycle control phosphatase superfamily protein | 2.82 |
| root | Glyma.12G131300 | 4443 | senescence-associated gene 12 | 2.82 |
| root | Glyma.17G133500 | 3636 | Subtilase family protein | 2.82 |
| root | Glyma.15G128800 | 3843 | Peroxidase superfamily protein | 2.82 |
| root | Glyma.09G134900 | 3684 | Divalent ion symporter | 2.82 |
| root | Glyma.14G055900 | 4276 | inflorescence meristem receptor-like kinase 2 | 2.82 |
| root | Glyma.07G239900 | 3790 | Disease resistance-responsive (dirigent-like protein) family protein | 2.82 |
| root | Glyma.13G254700 | 3884 | UDP-Glycosyltransferase superfamily protein | 2.82 |
| root | Glyma.08G095300 | 4316 | MADS-box transcription factor family protein | 2.82 |
| root | Glyma.12G206500 | 4452 | | 2.82 |
| root | Glyma.04G105900 | 3766 | lipoxygenase 1 | 2.82 |
| leaf | Glyma.20G166100 | 3527 | Vacuolar iron transporter (VIT) family protein | 2.82 |
| leaf | Glyma.08G118800 | 1618 | glutathione S-transferase tau 7 | 2.82 |
| leaf | Glyma.17G102700 | 3061 | | 2.82 |
| leaf | Glyma.20G118300 | 3495 | Protein kinase superfamily protein | 2.82 |
| leaf | Glyma.18G133100 | 3220 | CYCLIN D1; 1 | 2.82 |
| leaf | Glyma.U030300 | 3576 | | 2.82 |
| leaf | Glyma.03G119500 | 824 | dicarboxylate diiron protein, putative (Crd1) | 2.82 |
| leaf | Glyma.05G021500 | 1074 | plasmodesmata callose-binding protein 3 | 2.82 |
| leaf | Glyma.16G151200 | 2941 | syntaxin of plants 111 | 2.82 |
| leaf | Glyma.15G104400 | 2772 | Heavy metal transport/detoxification superfamily protein | 2.82 |
| leaf | Glyma.02G293000 | 767 | | 2.82 |
| leaf | Glyma.12G079100 | 2287 | | 2.82 |
| leaf | Glyma.10G072000 | 1961 | | 2.82 |
| leaf | Glyma.06G026300 | 1233 | glyoxal oxidase-related protein | 2.82 |
| leaf | Glyma.08G124900 | 1625 | protein containing PDZ domain, a K-box domain, and a TPR region | 2.82 |
| leaf | Glyma.11G139100 | 2175 | expansin A4 | 2.82 |
| leaf | Glyma.08G224800 | 1706 | Protein of unknown function (DUF1666) | 2.82 |
| leaf | Glyma.15G044900 | 2729 | ROP interactive partner 5 | 2.82 |
| leaf | Glyma.17G238400 | 3133 | CYCLIN D3; 1 | 2.82 |
| leaf | Glyma.16G029200 | 2870 | Protein of unknown function (DUF1191) | 2.82 |
| root | Glyma.07G238400 | 3807 | minichromosome maintenance (MCM2/3/5) family protein | 2.82 |
| root | Glyma.10G150200 | 3601 | phospholipase D P2 | 2.82 |
| root | Glyma.02G182000 | 705 | Replication factor-A protein 1-related | 2.82 |
| root | Glyma.01G065400 | 4378 | Serine carboxypeptidase S28 family protein | 2.82 |
| root | Glyma.06G180300 | 4498 | Protein of Unknown Function (DUF239) | 2.82 |
| root | Glyma.07G109600 | 3782 | squamosa promoter binding protein-like 8 | 2.82 |
| root | Glyma.08G013600 | 4315 | heavy metal atpase 5 | 2.81 |
| root | Glyma.03G008800 | 4087 | U-box domain-containing protein kinase family protein | 2.81 |
| leaf | Glyma.07G099300 | 1449 | | 2.81 |
| leaf | Glyma.04G185800 | 1018 | Protein of Unknown Function (DUF239) | 2.81 |
| leaf | Glyma.15G016500 | 2714 | HD-ZIP IV family of homeobox-leucine zipper protein with lipid-binding START domain | 2.81 |
| leaf | Glyma.02G006600 | 611 | Pectinacetylesterase family protein | 2.81 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.13G075700 | 2393 | Bifunctional inhibitor/lipid-transfer protein/seed storage 2S albumin superfamily protein | 2.81 |
| leaf | Glyma.05G195500 | 1178 | fatty acid amide hydrolase | 2.81 |
| leaf | Glyma.04G102800 | 983 | Major facilitator superfamily protein | 2.81 |
| leaf | Glyma.02G302600 | 771 | Leucine-rich receptor-like protein kinase family protein | 2.81 |
| leaf | Glyma.01G186600 | 574 | alpha/beta-Hydrolases superfamily protein | 2.81 |
| leaf | Glyma.04G142800 | 996 | chloroplast thylakoid lumen protein | 2.81 |
| leaf | Glyma.01G010200 | 483 | phosphoribulokinase | 2.81 |
| leaf | Glyma.08G204800 | 1694 | photosystem I subunit H2 | 2.81 |
| leaf | Glyma.03G148800 | 842 | Protein kinase family protein | 2.81 |
| leaf | Glyma.06G271600 | 1373 | high-affinity K+ transporter 1 | 2.81 |
| leaf | Glyma.14G047900 | 2628 | Leucine-rich repeat receptor-like protein kinase family protein | 2.81 |
| leaf | Glyma.08G020800 | 1542 | Leucine-rich repeat protein kinase family protein | 2.81 |
| leaf | Glyma.16G175500 | 2964 | UDP-glucosyl transferase 88A1 | 2.81 |
| root | Glyma.12G238600 | 4438 | Leucine-rich repeat (LRR) family protein | 2.81 |
| root | Glyma.05G102700 | 4188 | PAS/LOV protein B | 2.81 |
| root | Glyma.12G121200 | 4431 | plasmodesmata callose-binding protein 5 | 2.81 |
| root | Glyma.14G196100 | 4279 | | 2.81 |
| root | Glyma.04G240100 | 3767 | nodulin MtN21/EamA-like transporter family protein | 2.80 |
| root | Glyma.10G148500 | 3599 | Protein of unknown function (DUF3511) | 2.80 |
| root | Glyma.02G028400 | 3967 | | 2.80 |
| root | Glyma.06G093600 | 4462 | Eukaryotic aspartyl protease family protein | 2.80 |
| leaf | Glyma.15G149800 | 2802 | Nodulin MtN3 family protein | 2.80 |
| leaf | Glyma.06G100300 | 1278 | Cupredoxin superfamily protein | 2.80 |
| leaf | Glyma.08G085000 | 1596 | Cytochrome b561/ferric reductase transmembrane protein family | 2.80 |
| leaf | Glyma.11G228800 | 2237 | light harvesting complex photosystem II | 2.80 |
| leaf | Glyma.11G246400 | 2249 | response regulator 11 | 2.80 |
| leaf | Glyma.10G094600 | 1969 | | 2.80 |
| leaf | Glyma.15G276100 | 2856 | Protein of unknown function, DUF642 | 2.80 |
| leaf | Glyma.04G041500 | 943 | Granulin repeat cysteine protease family protein | 2.80 |
| leaf | Glyma.10G201700 | 2030 | Nucleotide-diphospho-sugar transferases superfamily protein | 2.80 |
| leaf | Glyma.14G023300 | 2615 | Translation initiation factor SUI1 family protein | 2.80 |
| leaf | Glyma.11G164700 | 2189 | NAD(P)-binding Rossmann-fold superfamily protein | 2.80 |
| leaf | Glyma.13G212900 | 2479 | inosine-uridine preferring nucleoside hydrolase family protein | 2.80 |
| leaf | Glyma.20G184800 | 3537 | | 2.80 |
| leaf | Glyma.18G052500 | 3181 | Basic-leucine zipper (bZIP) transcription factor family protein | 2.80 |
| leaf | Glyma.02G185400 | 706 | Protein of unknown function, DUF617 | 2.80 |
| leaf | Glyma.13G263400 | 2519 | pfkB-like carbohydrate kinase family protein | 2.80 |
| root | Glyma.18G258700 | 3266 | basic helix-loop-helix (bHLH) DNA-binding family protein | 2.80 |
| root | Glyma.12G039200 | 4416 | Minichromosome maintenance (MCM2/3/5) family protein | 2.80 |
| root | Glyma.17G180400 | 3641 | SKU5 similar 17 | 2.80 |
| root | Glyma.18G182800 | 4562 | Haloacid dehalogenase-like hydrolase (HAD) superfamily protein | 2.80 |
| root | Glyma.12G046500 | 4420 | Protein of unknown function, DUF547 | 2.80 |
| root | Glyma.09G246200 | 3729 | formin homology 1 | 2.80 |
| root | Glyma.08G274700 | 4323 | Concanavalin A-like lectin protein kinase family protein | 2.80 |
| root | Glyma.04G006100 | 3734 | COBRA-like protein 1 precursor | 2.79 |
| root | Glyma.08G243600 | 1717 | cytochrome P450, family 716, subfamily A, polypeptide 1 | 2.79 |
| root | Glyma.08G087900 | 4342 | Pectin lyase-like superfamily protein | 2.79 |
| root | Glyma.10G196700 | 3629 | Disease resistance protein (CC-NBS-LRR class) family | 2.79 |
| leaf | Glyma.17G121000 | 3077 | Duplicated homeodomain-like superfamily protein | 2.79 |
| leaf | Glyma.18G282100 | 3280 | Protein kinase superfamily protein | 2.79 |
| leaf | Glyma.04G249700 | 1057 | Chlorophyll A-B binding family protein | 2.79 |
| leaf | Glyma.12G024100 | 2265 | | 2.79 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.15G133900 | 2795 | FAD-binding Berberine family protein | 2.79 |
| leaf | Glyma.18G171500 | 3232 | receptor-like protein kinase 4 | 2.79 |
| leaf | Glyma.05G175700 | 1166 | | 2.79 |
| leaf | Glyma.18G096900 | 3207 | endoribonuclease L-PSP family protein | 2.79 |
| leaf | Glyma.10G293500 | 2080 | Transketolase | 2.79 |
| leaf | Glyma.19G179100 | 3386 | Nucleotide-diphospho-sugar transferases superfamily protein | 2.79 |
| leaf | Glyma.13G348600 | 2582 | | 2.79 |
| leaf | Glyma.16G059500 | 2896 | | 2.79 |
| leaf | Glyma.05G022700 | 1075 | C2H2-like zinc finger protein | 2.79 |
| leaf | Glyma.01G076900 | 515 | basic helix-loop-helix (bHLH) DNA-binding superfamily protein | 2.79 |
| leaf | Glyma.14G132100 | 2660 | maturase K | 2.79 |
| leaf | Glyma.02G003700 | 610 | phosphate 1 | 2.79 |
| leaf | Glyma.01G182600 | 562 | homolog of Synechocystis YCF37 | 2.79 |
| leaf | Glyma.17G161700 | 3101 | Acyl-CoA N-acyltransferases (NAT) superfamily protein | 2.79 |
| root | Glyma.14G096700 | 4250 | Thioredoxin superfamily protein | 2.79 |
| root | Glyma.12G065500 | 2281 | | 2.79 |
| root | Glyma.01G057300 | 4384 | beta glucosidase 40 | 2.78 |
| root | Glyma.02G230200 | 3938 | Protein of unknown function (DUF640) | 2.78 |
| root | Glyma.15G122500 | 3834 | | 2.78 |
| root | Glyma.15G066400 | 3852 | Major facilitator superfamily protein | 2.78 |
| leaf | Glyma.11G031300 | 2105 | | 2.78 |
| leaf | Glyma.09G131900 | 1843 | glutaminyl cyclase | 2.78 |
| leaf | Glyma.06G286700 | 1375 | O-methyltransferase family protein | 2.78 |
| leaf | Glyma.19G180700 | 3388 | FASCICLIN-like arabinogalactan-protein 11 | 2.78 |
| leaf | Glyma.03G241900 | 899 | | 2.78 |
| leaf | Glyma.08G139300 | 1641 | binding | 2.78 |
| leaf | Glyma.09G018600 | 1781 | ferric reduction oxidase 7 | 2.78 |
| leaf | Glyma.14G219300 | 2697 | tubulin beta-1 chain | 2.78 |
| leaf | Glyma.04G202500 | 1029 | | 2.78 |
| leaf | Glyma.09G135700 | 1847 | NAD(P)-binding Rossmann-fold superfamily protein | 2.78 |
| leaf | Glyma.08G348500 | 1762 | UDP-glycosyltransferase 73B4 | 2.78 |
| leaf | Glyma.20G145200 | 3517 | Copper amine oxidase family protein | 2.78 |
| leaf | Glyma.15G267600 | 2850 | | 2.78 |
| leaf | Glyma.19G101500 | 3353 | | 2.78 |
| leaf | Glyma.18G295800 | 3290 | | 2.78 |
| leaf | Glyma.01G109200 | 526 | Concanavalin A-like lectin family protein | 2.78 |
| leaf | Glyma.08G339700 | 1758 | nodulin MtN21/EamA-like transporter family protein | 2.78 |
| leaf | Glyma.07G261200 | 1525 | Ankyrin repeat family protein | 2.78 |
| root | Glyma.10G187500 | 3621 | nodulin MtN21/EamA-like transporter family protein | 2.78 |
| root | Glyma.01G210800 | 590 | adenine phosphoribosyl transferase 3 | 2.78 |
| root | Glyma.14G146100 | 4268 | Integrase-type DNA-binding superfamily protein | 2.77 |
| root | Glyma.08G058700 | 4307 | | 2.77 |
| root | Glyma.08G358600 | 4308 | | 2.77 |
| root | Glyma.20G100600 | 4136 | high-mobility group box 6 | 2.77 |
| leaf | Glyma.07G023100 | 1418 | DNA glycosylase superfamily protein | 2.77 |
| leaf | Glyma.14G177200 | 2674 | ascorbate peroxidase 4 | 2.77 |
| leaf | Glyma.15G079500 | 2756 | GDSL-like Lipase/Acylhydrolase superfamily protein | 2.77 |
| leaf | Glyma.19G046000 | 3325 | O-acyltransferase (WSD1-like) family protein | 2.77 |
| leaf | Glyma.03G049800 | 802 | TRICHOME BIREFRINGENCE-LIKE 34 | 2.77 |
| leaf | Glyma.06G090500 | 1274 | tubulin alpha-2 chain | 2.77 |
| leaf | Glyma.15G031400 | 2723 | beta glucosidase 15 | 2.77 |
| leaf | Glyma.17G007100 | 3000 | | 2.77 |
| leaf | Glyma.03G014300 | 785 | NAD(P)-binding Rossmann-fold superfamily protein | 2.77 |
| leaf | Glyma.02G298000 | 768 | CCCH-type zinc fingerfamily protein with RNA-binding domain | 2.77 |
| root | Glyma.18G250700 | 4538 | Subtilisin-like serine endopeptidase family protein | 2.77 |
| root | Glyma.07G001300 | 1400 | Terpenoid cyclases family protein | 2.77 |
| root | Glyma.13G307800 | 3918 | Late embryogenesis abundant (LEA) hydroxyproline-rich glycoprotein family | 2.77 |
| root | Glyma.06G284700 | 4506 | plasmodesmata callose-binding protein 5 | 2.77 |
| root | Glyma.04G242400 | 3732 | | 2.77 |
| root | Glyma.05G160400 | 4180 | | 2.76 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.17G035000 | 3639 | minichromosome maintenance (MCM2/3/5) family protein | 2.76 |
| root | Glyma.10G036000 | 3627 | RING/U-box superfamily protein | 2.76 |
| root | Glyma.02G252000 | 3980 | RAB GTPase homolog A2B | 2.76 |
| leaf | Glyma.11G121400 | 2163 | Protein of unknown function, DUF547 | 2.76 |
| leaf | Glyma.13G246900 | 2509 | | 2.76 |
| leaf | Glyma.02G148600 | 695 | isopentenyltransferase 3 | 2.76 |
| leaf | Glyma.06G125800 | 1297 | Nodulin MtN3 family protein | 2.76 |
| leaf | Glyma.06G305300 | 1382 | | 2.76 |
| leaf | Glyma.11G136300 | 2173 | | 2.76 |
| leaf | Glyma.10G185000 | 2016 | TPX2 (targeting protein for Xklp2) protein family | 2.76 |
| leaf | Glyma.11G040100 | 2113 | SU(VAR)3-9 homolog 6 | 2.76 |
| leaf | Glyma.10G088000 | 1967 | Peptidase M28 family protein | 2.76 |
| leaf | Glyma.08G166000 | 1657 | Eukaryotic aspartyl protease family protein | 2.76 |
| leaf | Glyma.04G252600 | 1058 | C2H2-like zinc finger protein | 2.76 |
| leaf | Glyma.10G276100 | 2074 | bZIP transcription factor family protein | 2.76 |
| leaf | Glyma.16G200800 | 2984 | gibberellin 20 oxidase 2 | 2.76 |
| leaf | Glyma.01G131500 | 534 | SOS3-interacting protein 1 | 2.76 |
| leaf | Glyma.07G060700 | 1436 | | 2.76 |
| leaf | Glyma.19G112700 | 3358 | arabinogalactan protein 14 | 2.76 |
| leaf | Glyma.13G287300 | 2535 | | 2.76 |
| leaf | Glyma.16G091100 | 2908 | Calcium-dependent phosphotriesterase superfamily protein | 2.76 |
| leaf | Glyma.04G196500 | 1023 | thylakoid lumenal 17.9 kDa protein, chloroplast | 2.76 |
| leaf | Glyma.18G262800 | 3271 | related to AP2 11 | 2.76 |
| leaf | Glyma.20G142700 | 3513 | Glycoprotein membrane precursor GPI-anchored | 2.76 |
| root | Glyma.13G270400 | 3867 | phosphoenolpyruvate carboxylase 3 | 2.76 |
| root | Glyma.08G171300 | 4319 | | 2.76 |
| root | Glyma.16G181300 | 2972 | NAD(P)-binding Rossmann-fold superfamily protein | 2.76 |
| root | Glyma.19G132500 | 4026 | basic helix-loop-helix (bHLH) DNA-binding superfamily protein | 2.76 |
| root | Glyma.20G217100 | 4122 | early nodulin-like protein 8 | 2.76 |
| root | Glyma.06G059500 | 4511 | glutamine dumper 3 | 2.76 |
| root | Glyma.12G130700 | 4441 | Cysteine proteinases superfamily protein | 2.76 |
| root | Glyma.02G305300 | 3992 | ATPase E1-E2 type family protein/haloacid dehalogenase-like hydrolase family protein | 2.75 |
| root | Glyma.19G163400 | 4036 | | 2.75 |
| root | Glyma.07G256700 | 3802 | isopentenyltransferase 5 | 2.75 |
| root | Glyma.19G173800 | 4030 | nodulin MtN21/EamA-like transporter family protein | 2.75 |
| root | Glyma.18G153500 | 4565 | expansin A4 | 2.75 |
| leaf | Glyma.09G064600 | 1811 | Survival protein SurE-like phosphatase/nucleotidase | 2.75 |
| leaf | Glyma.12G036900 | 2270 | NAD(P)-binding Rossmann-fold superfamily protein | 2.75 |
| leaf | Glyma.13G356100 | 2589 | NDH-dependent cyclic electron flow 1 | 2.75 |
| leaf | Glyma.08G084800 | 1595 | urease accessory protein G | 2.75 |
| leaf | Glyma.13G213200 | 2480 | Major facilitator superfamily protein | 2.75 |
| leaf | Glyma.11G053200 | 2124 | Protein of unknown function (DUF579) | 2.75 |
| leaf | Glyma.18G290300 | 3288 | Calcium-binding EF-hand family protein | 2.75 |
| leaf | Glyma.05G126000 | 1135 | fatty acid hydroxylase 1 | 2.75 |
| leaf | Glyma.12G011600 | 2256 | IQ-domain 11 | 2.75 |
| leaf | Glyma.07G020500 | 1412 | Core-2/I-branching beta-1,6-N-acetylglucosaminyltransferase family protein | 2.75 |
| leaf | Glyma.05G045200 | 1097 | nucleoside diphosphate kinase 2 | 2.75 |
| leaf | Glyma.12G122800 | 2307 | basic helix-loop-helix (bHLH) DNA-binding superfamily protein | 2.75 |
| leaf | Glyma.08G366600 | 1772 | | 2.75 |
| leaf | Glyma.04G254400 | 1059 | | 2.75 |
| leaf | Glyma.05G100900 | 1118 | zinc finger protein 7 | 2.75 |
| leaf | Glyma.19G030200 | 3315 | chlororespiratory reduction 7 | 2.75 |
| leaf | Glyma.17G164800 | 3103 | arabinogalactan protein 18 | 2.75 |
| leaf | Glyma.18G003200 | 3154 | xyloglucan endotransglucosylase/hydrolase 16 | 2.75 |
| root | Glyma.06G109200 | 1282 | nitrate reductase 1 | 2.75 |
| root | Glyma.10G177400 | 3590 | Protein of unknown function (DUF1442) | 2.75 |
| root | Glyma.10G001800 | 3624 | 3-ketoacyl-CoA synthase 11 | 2.74 |
| root | Glyma.19G114300 | 4016 | Cupredoxin superfamily protein | 2.74 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.07G022500 | 3777 | cyclic nucleotide gated channel 8 | 2.74 |
| root | Glyma.18G056500 | 4555 | Nuclear transport factor 2 (NTF2) family protein | 2.74 |
| root | Glyma.06G043500 | 4469 | | 2.74 |
| root | Glyma.04G173200 | 3754 | | 2.74 |
| root | Glyma.15G061900 | 3825 | CBS domain-containing protein with a domain of unknown function (DUF21) | 2.74 |
| root | Glyma.08G107400 | 4335 | | 2.74 |
| leaf | Glyma.08G041000 | 1558 | Peptidoglycan-binding LysM domain-containing protein | 2.74 |
| leaf | Glyma.19G029200 | 3314 | | 2.74 |
| leaf | Glyma.04G050700 | 954 | N-MYC downregulated-like 2 | 2.74 |
| leaf | Glyma.02G154500 | 700 | | 2.74 |
| leaf | Glyma.17G056400 | 3037 | | 2.74 |
| leaf | Glyma.03G259100 | 913 | Calcium-binding EF-hand family protein | 2.74 |
| leaf | Glyma.05G192700 | 1175 | ABC-2 type transporter family protein | 2.74 |
| leaf | Glyma.01G169500 | 549 | Leucine-rich repeat (LRR) family protein | 2.74 |
| root | Glyma.06G169800 | 4472 | Pyridoxal phosphate (PLP)-dependent transferases superfamily protein | 2.74 |
| root | Glyma.19G251900 | 4002 | chitinase A | 2.74 |
| root | Glyma.06G013200 | 4461 | | 2.74 |
| root | Glyma.08G097100 | 4357 | Aldolase-type TIM barrel family protein | 2.73 |
| root | Glyma.10G216000 | 3589 | GAST1 protein homolog 3 | 2.73 |
| leaf | Glyma.13G359200 | 2592 | Late embryogenesis abundant (LEA) hydroxyproline-rich glycoprotein family | 2.73 |
| leaf | Glyma.05G022900 | 1076 | photosystem I subunit F | 2.73 |
| leaf | Glyma.13G003000 | 2358 | *Myzus persicae*-induced lipase 1 | 2.73 |
| leaf | Glyma.12G021100 | 2262 | hydroxymethylbilane synthase | 2.73 |
| leaf | Glyma.10G196500 | 2023 | Protein of unknown function (DUF1635) | 2.73 |
| leaf | Glyma.13G357300 | 2591 | photosystem I subunit H2 | 2.73 |
| leaf | Glyma.14G208900 | 2692 | Uncharacterised protein family (UPF0497) | 2.73 |
| leaf | Glyma.01G180800 | 558 | photosystem II subunit O-2 | 2.73 |
| leaf | Glyma.07G003400 | 1404 | D-3-phosphoglycerate dehydrogenase | 2.73 |
| leaf | Glyma.09G004400 | 1774 | APS reductase 3 | 2.73 |
| leaf | Glyma.06G204200 | 1339 | Protein of unknown function (DUF1118) | 2.73 |
| leaf | Glyma.15G069600 | 2749 | | 2.73 |
| root | Glyma.05G075100 | 4168 | AMP-dependent synthetase and ligase family protein | 2.73 |
| root | Glyma.19G034000 | 4043 | 2-oxoglutarate (2OG) and Fe(II)-dependent oxygenase superfamily protein | 2.73 |
| root | Glyma.11G121400 | 2163 | Protein of unknown function, DUF547 | 2.73 |
| root | Glyma.01G091800 | 4407 | EXS (ERD1/XPR1/SYG1) family protein | 2.73 |
| root | Glyma.07G022300 | 1414 | fucosyltransferase 1 | 2.73 |
| root | Glyma.08G150400 | 1647 | beta glucosidase 42 | 2.73 |
| root | Glyma.19G143300 | 4045 | Leucine-rich repeat receptor-like protein kinase family protein | 2.72 |
| root | Glyma.08G306600 | 4324 | | 2.72 |
| root | Glyma.05G150500 | 4162 | | 2.72 |
| leaf | Glyma.15G051300 | 2732 | UDP-glucosyl transferase 85A2 | 2.72 |
| leaf | Glyma.18G025600 | 3166 | LOB domain-containing protein 21 | 2.72 |
| leaf | Glyma.11G029400 | 2103 | | 2.72 |
| leaf | Glyma.02G256800 | 745 | Cytochrome P450 superfamily protein | 2.72 |
| leaf | Glyma.02G096400 | 664 | BCL-2-associated athanogene 5 | 2.72 |
| leaf | Glyma.02G001000 | 608 | P-loop containing nucleoside triphosphate hydrolases superfamily protein | 2.72 |
| leaf | Glyma.02G277600 | 754 | Cyclin family protein | 2.72 |
| leaf | Glyma.15G136500 | 2797 | HCO3- transporter family | 2.72 |
| leaf | Glyma.20G224200 | 3551 | | 2.72 |
| leaf | Glyma.19G187000 | 3389 | UDP-glucosyl transferase 73C2 | 2.72 |
| leaf | Glyma.05G188200 | 1172 | Plastid-lipid associated protein PAP/fibrillin family protein | 2.72 |
| leaf | Glyma.13G278600 | 2530 | beta glucosidase 46 | 2.72 |
| leaf | Glyma.13G250300 | 2512 | basic helix-loop-helix (bHLH) DNA-binding superfamily protein | 2.72 |
| root | Glyma.09G047300 | 3709 | minichromosome maintenance (MCM2/3/5) family protein | 2.72 |
| root | Glyma.20G145100 | 3516 | Copper amine oxidase family protein | 2.72 |
| root | Glyma.10G148600 | 3612 | Polynucleotidyl transferase, ribonuclease H-like superfamily protein | 2.72 |
| root | Glyma.19G133600 | 4040 | Gibberellin-regulated family protein | 2.71 |
| root | Glyma.12G101200 | 4451 | Peroxidase superfamily protein | 2.71 |
| root | Glyma.14G194900 | 4256 | Plant protein of unknown function (DUF828) | 2.71 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.06G174700 | 4499 | Pectin lyase-like superfamily protein | 2.71 |
| root | Glyma.02G245200 | 3977 | Protein of unknown function, DUF593 | 2.71 |
| root | Glyma.01G127200 | 4404 | Disease resistance-responsive (dirigent-like protein) family protein | 2.71 |
| root | Glyma.02G233900 | 3959 | Peroxidase superfamily protein | 2.71 |
| root | Glyma.06G294500 | 4453 | expansin B3 | 2.71 |
| leaf | Glyma.08G009400 | 1535 | Protein kinase superfamily protein | 2.71 |
| leaf | Glyma.20G152600 | 3522 | subtilase 1.3 | 2.71 |
| leaf | Glyma.20G164900 | 3526 | chitinase A | 2.71 |
| leaf | Glyma.08G277200 | 1730 | UDP-Glycosyltransferase superfamily protein | 2.71 |
| leaf | Glyma.02G164400 | 704 | Major facilitator superfamily protein | 2.71 |
| leaf | Glyma.11G150400 | 2184 | Disease resistance-responsive (dirigent-like protein) family protein | 2.71 |
| leaf | Glyma.19G142700 | 3368 | | 2.71 |
| leaf | Glyma.01G215500 | 591 | hydroxymethylglutaryl-CoA synthase/HMG-CoA synthase/3-hydroxy-3-methylglutaryl coenzyme A synthase | 2.71 |
| leaf | Glyma.12G103500 | 2303 | Auxin-responsive GH3 family protein | 2.71 |
| leaf | Glyma.13G129500 | 2426 | photosystem I subunit E-2 | 2.71 |
| leaf | Glyma.03G177300 | 856 | Homeodomain-like superfamily protein | 2.71 |
| leaf | Glyma.10G175400 | 2003 | Translation initiation factor IF6 | 2.71 |
| leaf | Glyma.10G182200 | 2010 | ENTH/VHS family protein | 2.71 |
| leaf | Glyma.14G051700 | 2629 | Copper transport protein family | 2.71 |
| leaf | Glyma.03G056200 | 805 | Plant protein of unknown function (DUF828) | 2.71 |
| leaf | Glyma.10G148200 | 1986 | | 2.71 |
| leaf | Glyma.16G005100 | 2858 | | 2.71 |
| leaf | Glyma.17G115700 | 3072 | P-loop containing nucleoside triphosphate hydrolases superfamily protein | 2.71 |
| leaf | Glyma.01G045400 | 506 | HVA22 homologue C | 2.71 |
| leaf | Glyma.17G078900 | 3050 | PLC-like phosphodiesterases superfamily protein | 2.71 |
| root | Glyma.15G061400 | 3842 | basic helix-loop-helix (bHLH) DNA-binding superfamily protein | 2.71 |
| root | Glyma.07G132100 | 3803 | ATP binding microtubule motor family protein | 2.71 |
| root | Glyma.16G057500 | 4574 | | 2.71 |
| root | Glyma.11G113300 | 4207 | Minichromosome maintenance (MCM2/3/5) family protein | 2.71 |
| root | Glyma.16G099700 | 4580 | ATPase E1-E2 type family protein/haloacid dehalogenase-like hydrolase family protein | 2.70 |
| root | Glyma.09G181500 | 1870 | Protein kinase superfamily protein | 2.70 |
| root | Glyma.12G185800 | 4424 | germin-like protein 10 | 2.70 |
| root | Glyma.09G008800 | 3687 | EPS15 homology domain 2 | 2.70 |
| root | Glyma.13G236100 | 3922 | | 2.70 |
| leaf | Glyma.14G000700 | 2598 | | 2.70 |
| leaf | Glyma.05G210800 | 1195 | SPIRAL1-like2 | 2.70 |
| leaf | Glyma.11G060200 | 2133 | cytochrome P450, family 82, subfamily C, polypeptide 4 | 2.70 |
| leaf | Glyma.05G068800 | 1109 | Plant invertase/pectin methylesterase inhibitor superfamily protein | 2.70 |
| leaf | Glyma.17G226000 | 3126 | | 2.70 |
| leaf | Glyma.08G021700 | 1543 | HMG (high mobility group) box protein | 2.70 |
| leaf | Glyma.13G363700 | 2594 | aspartate-glutamate racemase family | 2.70 |
| leaf | Glyma.18G197300 | 3237 | | 2.70 |
| leaf | Glyma.13G075100 | 2392 | serine carboxypeptidase-like 11 | 2.70 |
| leaf | Glyma.09G068400 | 1813 | nuclear factor Y, subunit A3 | 2.70 |
| leaf | Glyma.06G031600 | 1236 | AMP-dependent synthetase and ligase family protein | 2.70 |
| leaf | Glyma.05G048600 | 1100 | Protein of unknown function (DUF579) | 2.70 |
| leaf | Glyma.13G250100 | 2511 | Protein of unknown function, DUF538 | 2.70 |
| leaf | Glyma.04G147500 | 999 | Integrase-type DNA-binding superfamily protein | 2.70 |
| leaf | Glyma.15G181800 | 2814 | | 2.70 |
| leaf | Glyma.08G164600 | 1656 | cysteine synthase D1 | 2.70 |
| leaf | Glyma.02G023400 | 617 | thioredoxin 2 | 2.70 |
| leaf | Glyma.09G212800 | 1892 | DZC (Disease resistance/zinc finger/chromosome condensation-like region) domain containing protein | 2.70 |
| root | Glyma.19G026600 | 4038 | purple acid phosphatase 23 | 2.70 |
| root | Glyma.05G130600 | 4189 | gibberellin 2-oxidase | 2.70 |
| root | Glyma.19G219000 | 3415 | myb domain protein 112 | 2.70 |
| root | Glyma.04G191100 | 3764 | Pectin lyase-like superfamily protein | 2.70 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.10G108100 | 3625 | Nucleic acid-binding, OB-fold-like protein | 2.70 |
| root | Glyma.08G366600 | 1772 | | 2.70 |
| root | Glyma.08G251800 | 4325 | F-box family protein | 2.70 |
| root | Glyma.20G194900 | 4133 | Glutaredoxin family protein | 2.69 |
| root | Glyma.03G170400 | 4088 | Ankyrin repeat family protein | 2.69 |
| leaf | Glyma.02G090100 | 654 | MATE efflux family protein | 2.69 |
| leaf | Glyma.08G210700 | 1698 | Galactose oxidase/kelch repeat superfamily protein | 2.69 |
| leaf | Glyma.06G170300 | 1324 | purple acid phosphatase 27 | 2.69 |
| leaf | Glyma.05G203300 | 1186 | hydroxysteroid dehydrogenase 2 | 2.69 |
| leaf | Glyma.08G256900 | 1723 | | 2.69 |
| leaf | Glyma.07G150000 | 1474 | SGNH hydrolase-type esterase superfamily protein | 2.69 |
| leaf | Glyma.06G324200 | 1397 | GDSL-like Lipase/Acylhydrolase superfamily protein | 2.69 |
| leaf | Glyma.01G055400 | 511 | | 2.69 |
| leaf | Glyma.10G157000 | 1990 | Mog1/PsbP/DUF1795-like photosystem II reaction center PsbP family protein | 2.69 |
| leaf | Glyma.09G077600 | 1817 | Ribosomal L18p/L5e family protein | 2.69 |
| leaf | Glyma.06G301000 | 1380 | Auxin-responsive GH3 family protein | 2.69 |
| leaf | Glyma.14G070400 | 2642 | ATP-dependent protease La (LON) domain protein | 2.69 |
| leaf | Glyma.02G000300 | 607 | NAD(P)H dehydrogenase 18 | 2.69 |
| leaf | Glyma.12G067500 | 2282 | | 2.69 |
| leaf | Glyma.15G120800 | 2787 | Sec14p-like phosphatidylinositol transfer family protein | 2.69 |
| leaf | Glyma.20G145600 | 3518 | | 2.69 |
| leaf | Glyma.16G218500 | 2995 | glutamate decarboxylase 5 | 2.69 |
| leaf | Glyma.19G062800 | 3336 | 2-oxoglutarate (2OG) and Fe(II)-dependent oxygenase superfamily protein | 2.69 |
| root | Glyma.14G128800 | 4272 | mitotic-like cyclin 3B from *Arabidopsis* | 2.69 |
| root | Glyma.19G169400 | 4008 | pleiotropic drug resistance 12 | 2.69 |
| root | Glyma.12G004800 | 4432 | glycosyl hydrolase 9B1 | 2.68 |
| root | Glyma.10G004800 | 3615 | phosphate 1 | 2.68 |
| root | Glyma.12G194400 | 4413 | homeodomain GLABROUS 2 | 2.68 |
| root | Glyma.17G073200 | 3632 | alpha/beta-Hydrolases superfamily protein | 2.68 |
| root | Glyma.01G162500 | 4403 | | 2.68 |
| root | Glyma.19G188700 | 4051 | poly(A) binding protein 7 | 2.68 |
| leaf | Glyma.19G008100 | 3302 | GDSL-like Lipase/Acylhydrolase superfamily protein | 2.68 |
| leaf | Glyma.06G034200 | 1237 | | 2.68 |
| leaf | Glyma.09G079600 | 1818 | hydroxyproline-rich glycoprotein family protein | 2.68 |
| leaf | Glyma.15G003900 | 2704 | NOD26-like intrinsic protein 6; 1 | 2.68 |
| leaf | Glyma.06G205400 | 1340 | COBRA-like extracellular glycosyl-phosphatidyl inositol-anchored protein family | 2.68 |
| leaf | Glyma.13G141700 | 2429 | | 2.68 |
| leaf | Glyma.04G037500 | 939 | | 2.68 |
| leaf | Glyma.09G155500 | 1861 | Kunitz family trypsin and protease inhibitor protein | 2.68 |
| leaf | Glyma.01G114800 | 530 | plastid-specific ribosomal protein 4 | 2.68 |
| root | Glyma.11G049100 | 4204 | | 2.68 |
| root | Glyma.06G064700 | 4482 | Xanthine/uracil permease family protein | 2.68 |
| root | Glyma.14G052300 | 4257 | | 2.68 |
| root | Glyma.19G188000 | 3390 | | 2.68 |
| root | Glyma.15G181600 | 3814 | Plant invertase/pectin methylesterase inhibitor superfamily protein | 2.68 |
| root | Glyma.02G071500 | 3948 | GATA transcription factor 9 | 2.68 |
| root | Glyma.14G209600 | 2694 | AMP-dependent synthetase and ligase family protein | 2.68 |
| root | Glyma.18G180900 | 4561 | ATP binding microtubule motor family protein | 2.67 |
| root | Glyma.18G139700 | 4517 | enoyl-CoA hydratase/isomerase D | 2.67 |
| root | Glyma.10G132500 | 3586 | Bifunctional inhibitor/lipid-transfer protein/seed storage 2S albumin superfamily protein | 2.67 |
| root | Glyma.09G281600 | 3728 | ammonium transporter 2 | 2.67 |
| root | Glyma.06G288600 | 4486 | HAESA-like 1 | 2.67 |
| root | Glyma.15G032300 | 3837 | Histone superfamily protein | 2.67 |
| leaf | Glyma.04G046600 | 948 | | 2.67 |
| leaf | Glyma.01G243400 | 604 | | 2.67 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.10G189400 | 2020 | Cyclopropane-fatty-acyl-phospholipid synthase | 2.67 |
| leaf | Glyma.10G222200 | 2045 | Protein kinase superfamily protein | 2.67 |
| leaf | Glyma.16G094100 | 2912 | Domain of unknown function (DUF23) | 2.67 |
| leaf | Glyma.01G093800 | 520 | RING/U-box superfamily protein | 2.67 |
| leaf | Glyma.19G244600 | 3433 | GDP-D-mannose 3\',5\'-epimerase | 2.67 |
| leaf | Glyma.10G182900 | 2011 | Plastid-lipid associated protein PAP/fibrillin family protein | 2.67 |
| leaf | Glyma.08G215500 | 1700 | basic helix-loop-helix (bHLH) DNA-binding superfamily protein | 2.67 |
| leaf | Glyma.05G030100 | 1085 | Leucine-rich repeat protein kinase family protein | 2.67 |
| leaf | Glyma.15G097700 | 2766 | NAD(P)-binding Rossmann-fold superfamily protein | 2.67 |
| leaf | Glyma.08G017600 | 1540 | myb domain protein 103 | 2.67 |
| leaf | Glyma.16G205100 | 2986 | Leucine-rich repeat protein kinase family protein | 2.67 |
| leaf | Glyma.09G184600 | 1871 | B-box type zinc finger protein with CCT domain | 2.67 |
| leaf | Glyma.14G170100 | 2669 | Protein of unknown function (DUF581) | 2.67 |
| leaf | Glyma.11G043800 | 2116 | Leucine-rich receptor-like protein kinase family protein | 2.67 |
| leaf | Glyma.08G054700 | 1566 | Auxin efflux carrier family protein | 2.67 |
| root | Glyma.06G169900 | 4476 | Protein of unknown function (DUF579) | 2.67 |
| root | Glyma.17G236000 | 3647 | | 2.67 |
| root | Glyma.17G114700 | 3657 | SPX domain gene 2 | 2.67 |
| root | Glyma.13G289200 | 3919 | UDP-Glycosyltransferase superfamily protein | 2.67 |
| root | Glyma.08G038400 | 4304 | ovate family protein 8 | 2.67 |
| root | Glyma.02G121800 | 3936 | Adenine nucleotide alpha hydrolases-like superfamily protein | 2.66 |
| root | Glyma.19G155800 | 4037 | Protein of unknown function (DUF3049) | 2.66 |
| root | Glyma.03G005700 | 4083 | methylthioalkylmalate synthase-like 4 | 2.66 |
| root | Glyma.03G162000 | 4062 | | 2.66 |
| root | Glyma.03G076000 | 4077 | Nucleotide-sugar transporter family protein | 2.66 |
| leaf | Glyma.03G032400 | 791 | SPX domain gene 3 | 2.66 |
| leaf | Glyma.18G113100 | 3211 | spermidine hydroxycinnamoyl transferase | 2.66 |
| leaf | Glyma.17G212100 | 3121 | adenine phosphoribosyltransferase 5 | 2.66 |
| leaf | Glyma.16G181600 | 2975 | | 2.66 |
| leaf | Glyma.05G208900 | 1193 | cytochrome P450, family 86, subfamily A, polypeptide 8 | 2.66 |
| leaf | Glyma.03G057800 | 807 | Rhodanese/Cell cycle control phosphatase superfamily protein | 2.66 |
| leaf | Glyma.10G208400 | 2041 | DVL family protein | 2.66 |
| leaf | Glyma.16G124700 | 2923 | Tetratricopeptide repeat (TPR)-like superfamily protein | 2.66 |
| leaf | Glyma.20G243500 | 3558 | Transketolase | 2.66 |
| leaf | Glyma.17G252400 | 3141 | Glycosyl hydrolase superfamily protein | 2.66 |
| leaf | Glyma.05G145700 | 1149 | Remorin family protein | 2.66 |
| leaf | Glyma.19G227700 | 3419 | chloroplast RNA binding | 2.66 |
| leaf | Glyma.05G045300 | 1098 | RGA-like 1 | 2.66 |
| leaf | Glyma.07G231000 | 1509 | | 2.66 |
| leaf | Glyma.09G024900 | 1782 | Leucine-rich receptor-like protein kinase family protein | 2.66 |
| root | Glyma.11G250000 | 4237 | nuclear factor Y, subunit C13 | 2.66 |
| root | Glyma.02G134100 | 3932 | alpha/beta-Hydrolases superfamily protein | 2.66 |
| root | Glyma.06G190000 | 1333 | Leucine-rich repeat protein kinase family protein | 2.66 |
| root | Glyma.18G184600 | 4550 | 2-oxoglutarate (2OG) and Fe(II)-dependent oxygenase superfamily protein | 2.66 |
| root | Glyma.16G046800 | 4590 | | 2.66 |
| root | Glyma.15G066800 | 2746 | MYB-like 102 | 2.66 |
| root | Glyma.07G142600 | 3794 | Laccase/Diphenol oxidase family protein | 2.66 |
| root | Glyma.16G217100 | 4567 | Nucleotide-diphospho-sugar transferase family protein | 2.65 |
| root | Glyma.10G199100 | 2028 | haemoglobin 2 | 2.65 |
| root | Glyma.02G052000 | 3976 | S-adenosyl-L-methionine-dependent methyltransferases superfamily protein | 2.65 |
| root | Glyma.18G228700 | 3252 | Major Facilitator Superfamily with SPX (SYG1/Pho81/XPR1) domain-containing protein | 2.65 |
| root | Glyma.09G071300 | 3688 | cyclin-dependent kinase B2; 2 | 2.65 |
| root | Glyma.11G053400 | 2125 | UDP-glucosyl transferase 73B1 | 2.65 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.17G232600 | 3129 | growth-regulating factor 1 | 2.65 |
| leaf | Glyma.11G187500 | 2208 | MAR binding filament-like protein 1 | 2.65 |
| leaf | Glyma.06G011700 | 1222 | Glucose-1-phosphate adenylyltransferase family protein | 2.65 |
| leaf | Glyma.18G255300 | 3264 | thioredoxin H-type 5 | 2.65 |
| leaf | Glyma.08G192700 | 1680 | heat shock protein 60-3A | 2.65 |
| leaf | Glyma.07G022400 | 1415 | fucosyltransferase 1 | 2.65 |
| leaf | Glyma.06G153400 | 1314 | NAD(P)H: plastoquinone dehydrogenase complex subunit O | 2.65 |
| leaf | Glyma.08G026800 | 1547 | Ion protease 2 | 2.65 |
| leaf | Glyma.14G128500 | 2659 | 2Fe—2S ferredoxin-like superfamily protein | 2.65 |
| leaf | Glyma.01G185600 | 573 | Calcium-binding EF-hand family protein | 2.65 |
| leaf | Glyma.19G096200 | 3345 | Pollen Ole e 1 allergen and extensin family protein | 2.65 |
| leaf | Glyma.15G038800 | 2726 | | 2.65 |
| leaf | Glyma.10G141700 | 1979 | germin-like protein 10 | 2.65 |
| leaf | Glyma.12G077700 | 2286 | | 2.65 |
| leaf | Glyma.02G042000 | 622 | serine acetyltransferase 3; 2 | 2.65 |
| leaf | Glyma.10G206300 | 2034 | basic helix-loop-helix (bHLH) DNA-binding superfamily protein | 2.65 |
| leaf | Glyma.16G131800 | 2927 | beta-galactosidase 3 | 2.65 |
| leaf | Glyma.04G004200 | 920 | subtilisin-like serine protease 2 | 2.65 |
| leaf | Glyma.16G004600 | 2857 | | 2.65 |
| root | Glyma.14G203400 | 4261 | Plant protein of unknown function (DUF641) | 2.65 |
| root | Glyma.01G035500 | 4373 | | 2.65 |
| root | Glyma.20G220000 | 4138 | Subtilisin-like serine endopeptidase family protein | 2.64 |
| root | Glyma.08G024700 | 4352 | 3-ketoacyl-acyl carrier protein synthase I | 2.64 |
| root | Glyma.09G039000 | 3691 | | 2.64 |
| root | Glyma.12G069500 | 4412 | FASCICLIN-like arabinogalactan-protein 11 | 2.64 |
| root | Glyma.09G249500 | 3719 | serine carboxypeptidase-like 20 | 2.64 |
| root | Glyma.15G052000 | 3829 | sulfate transporter 1; 3 | 2.64 |
| root | Glyma.08G101000 | 4349 | HXXXD-type acyl-transferase family protein | 2.64 |
| leaf | Glyma.15G012400 | 2712 | | 2.64 |
| leaf | Glyma.14G022200 | 2613 | | 2.64 |
| leaf | Glyma.19G126700 | 3361 | Mog1/PsbP/DUF1795-like photosystem II reaction center PsbP family protein | 2.64 |
| leaf | Glyma.03G212400 | 884 | Heavy metal transport/detoxification superfamily protein | 2.64 |
| leaf | Glyma.02G039900 | 621 | Protein of unknown function (DUF707) | 2.64 |
| leaf | Glyma.09G127200 | 1838 | UDP-glucosyl transferase 88A1 | 2.64 |
| leaf | Glyma.04G245900 | 1054 | 2-oxoglutarate (2OG) and Fe(II)-dependent oxygenase superfamily protein | 2.64 |
| leaf | Glyma.09G031400 | 1788 | HCO3- transporter family | 2.64 |
| leaf | Glyma.08G022000 | 1544 | | 2.64 |
| leaf | Glyma.18G258700 | 3266 | basic helix-loop-helix (bHLH) DNA-binding family protein | 2.64 |
| leaf | Glyma.17G118500 | 3076 | plant natriuretic peptide A | 2.64 |
| leaf | Glyma.17G140200 | 3091 | Bifunctional inhibitor/lipid-transfer protein/seed storage 2S albumin superfamily protein | 2.64 |
| leaf | Glyma.02G091600 | 656 | | 2.64 |
| root | Glyma.12G226500 | 4446 | NAC (No Apical Meristem) domain transcriptional regulator superfamily protein | 2.64 |
| root | Glyma.19G236900 | 4011 | basic helix-loop-helix (bHLH) DNA-binding superfamily protein | 2.64 |
| leaf | Glyma.U029500 | 3574 | basic leucine-zipper 5 | -2.64 |
| leaf | Glyma.01G217700 | 593 | osmotin 34 | -2.64 |
| leaf | Glyma.19G046300 | 3326 | LOB domain-containing protein 41 | -2.64 |
| leaf | Glyma.08G273600 | 1726 | hydroxyproline-rich glycoprotein family protein | -2.64 |
| root | Glyma.13G222600 | 2490 | Protein of unknown function, DUF584 | -2.64 |
| root | Glyma.17G128000 | 3080 | malate synthase | -2.64 |
| root | Glyma.20G081900 | 4116 | Calcium-dependent lipid-binding (CaLB domain) family protein | -2.64 |
| root | Glyma.07G238000 | 3787 | WRKY DNA-binding protein 23 | -2.65 |
| root | Glyma.16G116900 | 4589 | Nucleic acid-binding, OB-fold-like protein | -2.65 |
| leaf | Glyma.11G004800 | 2086 | Major facilitator superfamily protein | -2.65 |
| leaf | Glyma.05G037700 | 1094 | similar to RCD one 5 | -2.65 |
| leaf | Glyma.13G030300 | 2363 | lipoxygenase 2 | -2.65 |
| leaf | Glyma.03G131600 | 832 | | -2.65 |
| leaf | Glyma.04G175800 | 1013 | NAC domain containing protein 83 | -2.65 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.18G122000 | 3215 | Galactose oxidase/kelch repeat superfamily protein | −2.65 |
| leaf | Glyma.11G194500 | 2215 | AMP-dependent synthetase and ligase family protein | −2.65 |
| leaf | Glyma.17G191100 | 3113 | | −2.65 |
| leaf | Glyma.18G060900 | 3187 | mitogen-activated protein kinase kinase kinase 14 | −2.65 |
| leaf | Glyma.06G126700 | 1298 | spermidine synthase 3 | −2.65 |
| leaf | Glyma.05G194100 | 1176 | alpha/beta-Hydrolases superfamily protein | −2.65 |
| leaf | Glyma.03G005800 | 781 | MATE efflux family protein | −2.65 |
| leaf | Glyma.15G048100 | 2731 | homolog of separase | −2.65 |
| leaf | Glyma.20G231000 | 3553 | ROP binding protein kinases 2 | −2.65 |
| leaf | Glyma.07G004600 | 1405 | proline extensin-like receptor kinase 1 | −2.65 |
| leaf | Glyma.04G223100 | 1043 | | −2.65 |
| leaf | Glyma.11G017400 | 2091 | | −2.65 |
| root | Glyma.04G079300 | 969 | | −2.65 |
| root | Glyma.10G188800 | 3620 | | −2.65 |
| root | Glyma.06G111300 | 4489 | Integrase-type DNA-binding superfamily protein | −2.65 |
| root | Glyma.03G040400 | 794 | lipid transfer protein 1 | −2.65 |
| root | Glyma.11G170000 | 2191 | mitogen-activated protein kinase kinase kinase 14 | −2.66 |
| root | Glyma.04G112400 | 3736 | LORELEI-LIKE-GPI-ANCHORED PROTEIN 1 | −2.66 |
| root | Glyma.U017900 | 3562 | Protein of unknown function (DUF793) | −2.66 |
| leaf | Glyma.06G191400 | 1335 | ABC2 homolog 6 | −2.66 |
| leaf | Glyma.09G195500 | 1875 | Tetratricopeptide repeat (TPR)-like superfamily protein | −2.66 |
| leaf | Glyma.13G253300 | 2513 | Leucine-rich receptor-like protein kinase family protein | −2.66 |
| leaf | Glyma.10G268300 | 2073 | phosphatidyl serine synthase family protein | −2.66 |
| leaf | Glyma.06G302400 | 1381 | Protein of unknown function (DUF604) | −2.66 |
| leaf | Glyma.20G164200 | 3525 | Protein kinase superfamily protein | −2.66 |
| leaf | Glyma.15G011900 | 2709 | pleiotropic drug resistance 12 | −2.66 |
| leaf | Glyma.14G201200 | 2690 | Major facilitator superfamily protein | −2.66 |
| leaf | Glyma.13G257800 | 2516 | hydroxyproline-rich glycoprotein family protein | −2.66 |
| leaf | Glyma.06G099800 | 1277 | RING/U-box superfamily protein | −2.66 |
| root | Glyma.12G023600 | 2263 | plasma membrane intrinsic protein 2 | −2.66 |
| root | Glyma.13G095300 | 2408 | xyloglucan endotransglycosylase 6 | −2.66 |
| root | Glyma.17G092400 | 3664 | spermidine synthase 1 | −2.66 |
| root | Glyma.19G038600 | 4044 | ATPase E1-E2 type family protein/haloacid dehalogenase-like hydrolase family protein | −2.67 |
| root | Glyma.08G079100 | 1589 | polygalacturonase inhibiting protein 1 | −2.67 |
| leaf | Glyma.13G347500 | 2579 | lipoxygenase 1 | −2.67 |
| leaf | Glyma.18G199200 | 3241 | Leucine-rich repeat protein kinase family protein | −2.67 |
| leaf | Glyma.14G035600 | 2626 | CRT (chloroquine-resistance transporter)-like transporter 3 | −2.67 |
| leaf | Glyma.19G148500 | 3373 | | −2.67 |
| leaf | Glyma.02G075000 | 640 | sucrose-proton symporter 2 | −2.67 |
| leaf | Glyma.14G078300 | 2645 | | −2.67 |
| leaf | Glyma.04G152800 | 1000 | | −2.67 |
| leaf | Glyma.02G277000 | 753 | nuclear factor Y, subunit C11 | −2.67 |
| leaf | Glyma.14G181400 | 2677 | beta carbonic anhydrase 5 | −2.67 |
| leaf | Glyma.12G137700 | 2310 | GRAS family transcription factor | −2.67 |
| leaf | Glyma.14G216400 | 2696 | SHI-related sequence 7 | −2.67 |
| leaf | Glyma.18G118300 | 3212 | | −2.67 |
| root | Glyma.16G135300 | 4578 | | −2.67 |
| root | Glyma.08G205000 | 4300 | D-isomer specific 2-hydroxyacid dehydrogenase family protein | −2.68 |
| root | Glyma.14G116300 | 4278 | Core-2/I-branching beta-1,6-N-acetylglucosaminyltransferase family protein | −2.68 |
| leaf | Glyma.05G068400 | 1108 | SBP (S-ribonuclease binding protein) family protein | −2.68 |
| leaf | Glyma.08G156800 | 1652 | callose synthase 5 | −2.68 |
| leaf | Glyma.08G314100 | 1746 | Ankyrin-repeat containing protein | −2.68 |
| leaf | Glyma.14G073300 | 2644 | phloem protein 2-B10 | −2.68 |
| leaf | Glyma.03G261400 | 916 | Late embryogenesis abundant (LEA) hydroxyproline-rich glycoprotein family | −2.68 |
| leaf | Glyma.03G201300 | 878 | Late embryogenesis abundant (LEA) hydroxyproline-rich glycoprotein family | −2.68 |
| leaf | Glyma.14G113100 | 2653 | Protein kinase superfamily protein | −2.68 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.11G202800 | 2224 | | −2.68 |
| leaf | Glyma.06G239900 | 1364 | early nodulin-like protein 1 | −2.69 |
| leaf | Glyma.11G178300 | 2197 | calmodulin-binding receptor-like cytoplasmic kinase 1 | −2.69 |
| leaf | Glyma.15G066800 | 2746 | MYB-like 102 | −2.69 |
| leaf | Glyma.17G151200 | 3096 | Plant invertase/pectin methylesterase inhibitor superfamily protein | −2.69 |
| leaf | Glyma.12G082100 | 2290 | Pheophorbide a oxygenase family protein with Rieske [2Fe—2S] domain | −2.69 |
| leaf | Glyma.16G152600 | 2943 | O-Glycosyl hydrolases family 17 protein | −2.69 |
| leaf | Glyma.08G059700 | 1573 | sugar transporter 1 | −2.69 |
| leaf | Glyma.08G355000 | 1765 | S-locus lectin protein kinase family protein | −2.69 |
| leaf | Glyma.09G173200 | 1867 | glutamine synthase clone R1 | −2.69 |
| leaf | Glyma.01G139900 | 537 | glycoprotease 1 | −2.69 |
| leaf | Glyma.13G102300 | 2412 | Membrane fusion protein Use1 | −2.69 |
| leaf | Glyma.10G207700 | 2039 | FAD-dependent oxidoreductase family protein | −2.69 |
| leaf | Glyma.15G074800 | 2755 | Protein of unknown function (DUF506) | −2.69 |
| root | Glyma.11G058600 | 4228 | Homeodomain-like superfamily protein | −2.69 |
| leaf | Glyma.20G008400 | 3453 | | −2.70 |
| leaf | Glyma.02G034200 | 619 | ARM repeat superfamily protein | −2.70 |
| leaf | Glyma.07G080600 | 1443 | receptor like protein 7 | −2.70 |
| leaf | Glyma.19G003700 | 3295 | Sucrase/ferredoxin-like family protein | −2.70 |
| leaf | Glyma.05G009600 | 1070 | | −2.70 |
| leaf | Glyma.07G007500 | 1408 | Protein of unknown function (DUF3511) | −2.70 |
| leaf | Glyma.06G149900 | 1311 | Duplicated homeodomain-like superfamily protein | −2.70 |
| root | Glyma.07G013900 | 3808 | myo-inositol oxygenase 1 | −2.70 |
| root | Glyma.06G107000 | 4471 | | −2.71 |
| root | Glyma.11G067900 | 4225 | | −2.71 |
| leaf | Glyma.02G284800 | 759 | Eukaryotic aspartyl protease family protein | −2.71 |
| leaf | Glyma.16G212500 | 2992 | Kunitz family trypsin and protease inhibitor protein | −2.71 |
| leaf | Glyma.19G030500 | 3316 | HXXXD-type acyl-transferase family protein | −2.71 |
| leaf | Glyma.12G185400 | 2326 | Calcium-binding EF-hand family protein | −2.71 |
| leaf | Glyma.U029600 | 3575 | phytosulfokine 4 precursor | −2.71 |
| leaf | Glyma.07G214200 | 1502 | | −2.71 |
| leaf | Glyma.18G045200 | 3176 | oxidative stress 3 | −2.71 |
| leaf | Glyma.05G209000 | 1194 | BTB/POZ domain with WD40/YVTN repeat-like protein | −2.71 |
| root | Glyma.15G071300 | 2752 | Aluminium induced protein with YGL and LRDR motifs | −2.71 |
| root | Glyma.07G220000 | 1505 | Glycosyl hydrolase superfamily protein | −2.71 |
| root | Glyma.07G178100 | 3806 | Cupredoxin superfamily protein | −2.71 |
| root | Glyma.13G095200 | 3899 | xyloglucan endotransglycosylase 6 | −2.71 |
| root | Glyma.12G237100 | 4436 | Expressed protein | −2.72 |
| leaf | Glyma.03G036700 | 793 | ARM repeat superfamily protein | −2.72 |
| leaf | Glyma.06G310000 | 1386 | Disease resistance protein (TIR-NBS-LRR class) family | −2.72 |
| leaf | Glyma.13G168700 | 2439 | formate dehydrogenase | −2.72 |
| leaf | Glyma.19G158500 | 3379 | Bifunctional inhibitor/lipid-transfer protein/seed storage 2S albumin superfamily protein | −2.72 |
| leaf | Glyma.11G026300 | 2100 | MATE efflux family protein | −2.72 |
| leaf | Glyma.15G175500 | 2809 | zinc finger WD40 repeat protein 1 | −2.72 |
| leaf | Glyma.06G021400 | 1229 | RING/U-box superfamily protein | −2.72 |
| leaf | Glyma.06G242300 | 1365 | hydrolases, acting on ester bonds | −2.72 |
| leaf | Glyma.09G070300 | 1815 | aldehyde dehydrogenase 7B4 | −2.72 |
| leaf | Glyma.09G277000 | 1919 | SOS3-interacting protein 1 | −2.72 |
| leaf | Glyma.08G280300 | 1731 | dicarboxylate carrier 2 | −2.72 |
| root | Glyma.14G030400 | 4274 | phytoene desaturation 1 | −2.72 |
| root | Glyma.01G121000 | 4391 | Homeodomain-like superfamily protein | −2.72 |
| root | Glyma.16G151500 | 4568 | NAC domain containing protein 47 | −2.73 |
| root | Glyma.08G125100 | 1626 | cytochrome P450, family 716, subfamily A, polypeptide 1 | −2.73 |
| root | Glyma.13G000700 | 3878 | FAR1-related sequence 5 | −2.73 |
| leaf | Glyma.09G067100 | 1812 | | −2.73 |
| leaf | Glyma.03G239700 | 896 | Eukaryotic aspartyl protease family protein | −2.73 |
| leaf | Glyma.19G239000 | 3430 | Major facilitator superfamily protein | −2.73 |
| leaf | Glyma.13G354900 | 2588 | NADP-malic enzyme 4 | −2.73 |
| leaf | Glyma.08G096000 | 1605 | | −2.73 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.14G189500 | 2682 | Heavy metal transport/detoxification superfamily protein | −2.73 |
| leaf | Glyma.05G230400 | 1206 | RHO guanyl-nucleotide exchange factor 11 | −2.73 |
| leaf | Glyma.04G216900 | 1035 | | −2.73 |
| leaf | Glyma.20G119900 | 3498 | | −2.73 |
| leaf | Glyma.03G076100 | 810 | plant uncoupling mitochondrial protein 1 | −2.73 |
| leaf | Glyma.16G053300 | 2891 | HXXXD-type acyl-transferase family protein | −2.73 |
| leaf | Glyma.10G236000 | 2051 | CAP160 protein | −2.73 |
| leaf | Glyma.03G230500 | 892 | plus-3 domain-containing protein | −2.73 |
| leaf | Glyma.08G225200 | 1707 | SAUR-like auxin-responsive protein family | −2.73 |
| leaf | Glyma.07G246300 | 1516 | multifunctional protein 2 | −2.73 |
| leaf | Glyma.17G260700 | 3149 | RING/U-box superfamily protein | −2.73 |
| root | Glyma.08G079200 | 4313 | polygalacturonase inhibiting protein 1 | −2.74 |
| leaf | Glyma.14G009800 | 2608 | | −2.74 |
| leaf | Glyma.02G252800 | 743 | HSP20-like chaperones superfamily protein | −2.74 |
| leaf | Glyma.20G221300 | 3550 | Protein of Unknown Function (DUF239) | −2.74 |
| leaf | Glyma.09G140200 | 1855 | F-box/RNI-like superfamily protein | −2.74 |
| leaf | Glyma.08G253400 | 1721 | Nucleic acid-binding, OB-fold-like protein | −2.74 |
| leaf | Glyma.U038200 | 3578 | hydroxyproline-rich glycoprotein family protein | −2.74 |
| leaf | Glyma.U025900 | 3571 | Protein phosphatase 2C family protein | −2.74 |
| leaf | Glyma.09G231500 | 1903 | Glycosyl hydrolases family 32 protein | −2.74 |
| leaf | Glyma.12G199600 | 2334 | MYB-like 102 | −2.74 |
| root | Glyma.02G208300 | 3939 | EXORDIUM like 2 | −2.75 |
| root | Glyma.06G114700 | 4488 | PDI-like 1-1 | −2.75 |
| root | Glyma.19G192100 | 4048 | Plant protein of unknown function (DUF868) | −2.75 |
| root | Glyma.07G125600 | 3799 | oxidative stress 3 | −2.75 |
| leaf | Glyma.12G039400 | 2271 | Papain family cysteine protease | −2.75 |
| leaf | Glyma.19G025600 | 3312 | Protein of unknown function (DUF1997) | −2.75 |
| leaf | Glyma.20G087900 | 3480 | Helicase protein with RING/U-box domain | −2.75 |
| leaf | Glyma.16G115600 | 2919 | Tetratricopeptide repeat (TPR)-like superfamily protein | −2.75 |
| leaf | Glyma.20G132200 | 3505 | | −2.75 |
| leaf | Glyma.19G111300 | 3357 | SOS3-interacting protein 1 | −2.75 |
| root | Glyma.13G029600 | 3914 | DNA-directed DNA polymerases | −2.75 |
| root | Glyma.13G179200 | 2451 | Protein of unknown function (DUF506) | −2.75 |
| root | Glyma.20G202000 | 4109 | | −2.75 |
| root | Glyma.10G017600 | 3607 | senescence-associated gene 21 | −2.75 |
| root | Glyma.17G065100 | 3650 | xyloglucan endotransglycosylase 6 | −2.76 |
| root | Glyma.17G209100 | 3663 | cytochrome P450, family 71, subfamily B, polypeptide 37 | −2.76 |
| leaf | Glyma.05G197400 | 1181 | GroES-like zinc-binding alcohol dehydrogenase family protein | −2.76 |
| leaf | Glyma.09G048700 | 1797 | cytochrome P450, family 81, subfamily D, polypeptide 3 | −2.76 |
| leaf | Glyma.19G162100 | 3381 | cytochrome P450, family 94, subfamily B, polypeptide 1 | −2.76 |
| leaf | Glyma.18G272300 | 3275 | brassinosteroid-6-oxidase 2 | −2.76 |
| leaf | Glyma.01G022400 | 490 | Protein kinase superfamily protein | −2.76 |
| leaf | Glyma.05G143500 | 1148 | Remorin family protein | −2.76 |
| leaf | Glyma.13G212300 | 2477 | DNAse I-like superfamily protein | −2.76 |
| leaf | Glyma.09G201200 | 1879 | cinnamyl alcohol dehydrogenase 9 | −2.76 |
| leaf | Glyma.16G035000 | 2874 | ubiquitin-conjugating enzyme 5 | −2.76 |
| leaf | Glyma.16G086200 | 2907 | | −2.76 |
| leaf | Glyma.19G033300 | 3321 | Mitochondrial substrate carrier family protein | −2.76 |
| leaf | Glyma.11G141400 | 2176 | | −2.76 |
| leaf | Glyma.20G112900 | 3491 | Major facilitator superfamily protein | −2.76 |
| root | Glyma.05G107600 | 1122 | ACT domain repeat 1 | −2.76 |
| root | Glyma.18G060900 | 3187 | mitogen-activated protein kinase kinase kinase 14 | −2.76 |
| root | Glyma.01G073100 | 4379 | GATA transcription factor 12 | −2.77 |
| root | Glyma.20G186200 | 4137 | AP2/B3 transcription factor family protein | −2.77 |
| leaf | Glyma.13G063200 | 2387 | myb domain protein 30 | −2.77 |
| leaf | Glyma.01G166000 | 546 | Chaperone DnaJ-domain superfamily protein | −2.77 |
| leaf | Glyma.20G167400 | 3529 | HSP20-like chaperones superfamily protein | −2.77 |
| leaf | Glyma.11G225600 | 2235 | UDP-Glycosyltransferase superfamily protein | −2.77 |
| leaf | Glyma.12G012600 | 2258 | | −2.77 |
| leaf | Glyma.04G052600 | 955 | Putative lysine decarboxylase family protein | −2.77 |
| leaf | Glyma.10G212300 | 2044 | Seven transmembrane MLO family protein | −2.77 |
| leaf | Glyma.09G003100 | 1773 | receptor-like protein kinase 1 | −2.77 |
| leaf | Glyma.01G025600 | 491 | plant intracellular ras group-related LRR 3 | −2.77 |
| leaf | Glyma.01G244000 | 606 | | −2.77 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.15G202600 | 2824 | | −2.77 |
| leaf | Glyma.01G182100 | 560 | Transducin/WD40 repeat-like superfamily protein | −2.77 |
| leaf | Glyma.02G095500 | 662 | sulfate transporter 4.1 | −2.78 |
| leaf | Glyma.10G297900 | 2084 | Protein phosphatase 2C family protein | −2.78 |
| leaf | Glyma.16G196300 | 2980 | PEBP (phosphatidylethanolamine-binding protein) family protein | −2.78 |
| leaf | Glyma.11G060500 | 2134 | | −2.78 |
| leaf | Glyma.10G152200 | 1987 | respiratory burst oxidase homolog B | −2.78 |
| leaf | Glyma.08G219000 | 1703 | Acyl-CoA N-acyltransferases (NAT) superfamily protein | −2.78 |
| leaf | Glyma.16G072600 | 2900 | | −2.78 |
| leaf | Glyma.12G110100 | 2304 | | −2.78 |
| leaf | Glyma.03G174500 | 854 | Ankyrin repeat family protein | −2.78 |
| leaf | Glyma.09G059800 | 1803 | chloroplast import apparatus 2 | −2.78 |
| root | Glyma.03G219100 | 888 | Signal transduction histidine kinase | −2.78 |
| root | Glyma.17G064900 | 3642 | Xyloglucan endotransglucosylase/hydrolase family protein | −2.79 |
| leaf | Glyma.08G069200 | 1581 | | −2.79 |
| leaf | Glyma.14G061200 | 2637 | ortholog of sugar beet HS1 PRO-1 2 | −2.79 |
| leaf | Glyma.15G198900 | 2823 | serine-rich protein-related | −2.79 |
| leaf | Glyma.10G078200 | 1964 | E2F transcription factor 3 | −2.79 |
| leaf | Glyma.04G042400 | 946 | S-locus lectin protein kinase family protein | −2.79 |
| leaf | Glyma.10G265000 | 2071 | | −2.79 |
| leaf | Glyma.10G295200 | 2081 | C2H2-like zinc finger protein | −2.79 |
| leaf | Glyma.17G101400 | 3060 | expansin A15 | −2.79 |
| leaf | Glyma.18G002800 | 3152 | selenium-binding protein 1 | −2.79 |
| root | Glyma.03G201200 | 4071 | Late embryogenesis abundant (LEA) hydroxyproline-rich glycoprotein family | −2.80 |
| root | Glyma.13G242600 | 3902 | | −2.80 |
| root | Glyma.18G294300 | 4551 | Class I glutamine amidotransferase-like superfamily protein | −2.80 |
| leaf | Glyma.10G142100 | 1980 | Pectinacetylesterase family protein | −2.80 |
| leaf | Glyma.13G095300 | 2408 | xyloglucan endotransglycosylase 6 | −2.80 |
| leaf | Glyma.20G010000 | 3455 | Cupredoxin superfamily protein | −2.80 |
| leaf | Glyma.09G087200 | 1821 | inositol transporter 2 | −2.80 |
| leaf | Glyma.08G244500 | 1718 | UDP-Glycosyltransferase superfamily protein | −2.80 |
| leaf | Glyma.15G172900 | 2808 | hydroxyproline-rich glycoprotein family protein | −2.80 |
| leaf | Glyma.20G018200 | 3459 | Glycosyl hydrolase superfamily protein | −2.80 |
| leaf | Glyma.02G269600 | 751 | Protein kinase superfamily protein | −2.80 |
| leaf | Glyma.18G219200 | 3249 | cysteine-rich RLK (RECEPTOR-like protein kinase) 25 | −2.80 |
| root | Glyma.07G250500 | 3796 | Thioredoxin superfamily protein | −2.80 |
| root | Glyma.14G082400 | 4247 | Calcium-binding EF-hand family protein | −2.81 |
| leaf | Glyma.15G131200 | 2790 | 6-phosphogluconate dehydrogenase family protein | −2.81 |
| leaf | Glyma.08G033800 | 1550 | Protein phosphatase 2C family protein | −2.81 |
| leaf | Glyma.14G188700 | 2681 | Protein of unknown function, DUF599 | −2.81 |
| leaf | Glyma.04G049000 | 950 | | −2.81 |
| leaf | Glyma.05G099300 | 1117 | | −2.81 |
| leaf | Glyma.20G220200 | 3549 | phloem protein 2-B10 | −2.81 |
| leaf | Glyma.03G042700 | 797 | WRKY DNA-binding protein 33 | −2.81 |
| root | Glyma.18G119200 | 4519 | | −2.81 |
| root | Glyma.05G162500 | 4150 | NOD26-like intrinsic protein 1; 2 | −2.81 |
| root | Glyma.14G177400 | 4273 | | −2.82 |
| root | Glyma.14G147500 | 4271 | Integrase-type DNA-binding superfamily protein | −2.82 |
| root | Glyma.19G067600 | 4028 | | −2.82 |
| root | Glyma.05G040300 | 4141 | Raffinose synthase family protein | −2.82 |
| leaf | Glyma.20G018100 | 3458 | Calcium-dependent lipid-binding (CaLB domain) family protein | −2.82 |
| leaf | Glyma.10G027700 | 1937 | | −2.82 |
| leaf | Glyma.11G059800 | 2132 | GDSL-like Lipase/Acylhydrolase superfamily protein | −2.82 |
| leaf | Glyma.20G148900 | 3519 | homocysteine S-methyltransferase 3 | −2.82 |
| leaf | Glyma.04G145700 | 997 | | −2.82 |
| leaf | Glyma.12G116900 | 2306 | Zinc finger C-x8-C-x5-C-x3-H type family protein | −2.82 |
| root | Glyma.16G013400 | 4584 | Protein of unknown function (DUF567) | −2.82 |
| root | Glyma.10G227700 | 3619 | chitinase A | −2.83 |
| leaf | Glyma.04G223000 | 1042 | response regulator 17 | −2.83 |

TABLE 8D-continued

Genes that are significantly up- or down- regulated in soybean plants grown from seeds treated with Strain C but that are not found to be significantly up- or down- regulated in soybean plants grown from seeds treated with either Strain A or Strain B. Fold change is expressed as Strain C versus formulation control.

| Tissue | GeneName | SEQ ID | Gene Description | FoldChange |
| --- | --- | --- | --- | --- |
| leaf | Glyma.02G094600 | 661 | F-box family protein | −2.83 |
| leaf | Glyma.13G032100 | 2366 | Protein kinase superfamily protein | −2.83 |
| leaf | Glyma.03G219000 | 887 | RING/FYVE/PHD zinc finger superfamily protein | −2.83 |
| leaf | Glyma.08G300300 | 1738 | chitinase A | −2.83 |
| leaf | Glyma.06G042000 | 1242 | | −2.83 |
| leaf | Glyma.03G021200 | 788 | cytochrome P450, family 76, subfamily C, polypeptide 4 | −2.83 |
| leaf | Glyma.17G076100 | 3048 | Glycosyl hydrolase family protein with chitinase insertion domain | −2.83 |
| root | Glyma.13G363300 | 2593 | Late embryogenesis abundant protein (LEA) family protein | −2.84 |
| root | Glyma.18G205600 | 4548 | receptor like protein 24 | −2.84 |
| leaf | Glyma.13G239300 | 2501 | callose synthase 5 | −2.84 |
| leaf | Glyma.20G199700 | 3539 | Calcium-dependent lipid-binding (CaLB domain) family protein | −2.84 |
| leaf | Glyma.11G017700 | 2093 | Pleckstrin homology (PH) domain-containing protein | −2.84 |
| leaf | Glyma.09G224800 | 1898 | Pectin lyase-like superfamily protein | −2.84 |
| leaf | Glyma.02G286200 | 760 | | −2.84 |
| leaf | Glyma.08G058900 | 1572 | F-box family protein | −2.84 |
| leaf | Glyma.16G102400 | 2914 | Sec14p-like phosphatidylinositol transfer family protein | −2.84 |
| leaf | Glyma.04G083000 | 971 | Plant protein of unknown function (DUF828) with plant pleckstrin homology-like region | −2.84 |
| leaf | Glyma.10G146600 | 1984 | iron-regulated protein 3 | −2.84 |
| leaf | Glyma.14G215700 | 2695 | Protein of unknown function DUF2359, transmembrane | −2.84 |
| leaf | Glyma.06G190800 | 1334 | WRKY DNA-binding protein 72 | −2.84 |
| root | Glyma.20G201000 | 4106 | caleosin-related family protein | −2.84 |
| leaf | Glyma.01G181600 | 559 | GDSL-like Lipase/Acylhydrolase superfamily protein | −2.85 |
| leaf | Glyma.18G287200 | 3284 | C2H2 and C2HC zinc fingers superfamily protein | −2.85 |
| leaf | Glyma.05G124900 | 1133 | FAD-binding Berberine family protein | −2.85 |
| leaf | Glyma.13G293700 | 2541 | Thioredoxin superfamily protein | −2.85 |
| leaf | Glyma.08G079100 | 1589 | polygalacturonase inhibiting protein 1 | −2.85 |
| leaf | Glyma.06G275700 | 1374 | aspartate aminotransferase 1 | −2.85 |
| leaf | Glyma.13G242100 | 2504 | Aluminium induced protein with YGL and LRDR motifs | −2.85 |
| leaf | Glyma.15G253500 | 2845 | Protein kinase superfamily protein | −2.85 |
| leaf | Glyma.06G149400 | 1310 | nodulin MtN21/EamA-like transporter family protein | −2.85 |
| leaf | Glyma.06G091900 | 1276 | hydroxyproline-rich glycoprotein family protein | −2.85 |
| leaf | Glyma.18G158200 | 3230 | O-Glycosyl hydrolases family 17 protein | −2.85 |
| leaf | Glyma.05G042400 | 1095 | quinolinate synthase | −2.85 |
| root | Glyma.16G156800 | 4597 | sucrose-proton symporter 2 | −2.86 |
| root | Glyma.15G026300 | 3809 | lipoxygenase 1 | −2.86 |
| leaf | Glyma.08G148800 | 1646 | homeobox from *Arabidopsis thaliana* | −2.86 |
| leaf | Glyma.08G336600 | 1756 | amino acid permease 7 | −2.86 |
| leaf | Glyma.06G215600 | 1346 | Protein kinase superfamily protein | −2.86 |
| leaf | Glyma.12G161400 | 2316 | flavodoxin-like quinone reductase 1 | −2.86 |
| leaf | Glyma.11G145200 | 2179 | glycosyltransferase family protein 2 | −2.86 |
| leaf | Glyma.07G168900 | 1482 | tolB protein-related | −2.86 |
| root | Glyma.07G062700 | 3773 | S-adenosyl-L-methionine-dependent methyltransferases superfamily protein | −2.86 |
| root | Glyma.07G080600 | 1443 | receptor like protein 7 | −2.86 |
| root | Glyma.10G175600 | 3609 | | −2.86 |
| root | Glyma.04G167800 | 1007 | expansin A15 | −2.86 |
| root | Glyma.17G247800 | 3634 | protein kinase family protein/peptidoglycan-binding LysM domain-containing protein | −2.87 |
| root | Glyma.02G153100 | 3964 | Thioredoxin superfamily protein | −2.87 |
| root | Glyma.17G030000 | 3633 | MLP-like protein 423 | −2.87 |
| leaf | Glyma.10G187300 | 2019 | electron transfer flavoprotein beta | −2.87 |
| leaf | Glyma.08G239400 | 1715 | Late embryogenesis abundant protein (LEA) family protein | −2.87 |
| leaf | Glyma.17G039000 | 3022 | S-adenosylmethionine synthetase family protein | −2.87 |
| leaf | Glyma.14G029400 | 2617 | | −2.87 |
| leaf | Glyma.13G261200 | 2518 | Calcium-dependent lipid-binding (CaLB domain) family protein | −2.87 |

TABLE 8D-continued

Genes that are significantly up- or down- regulated in soybean plants grown from seeds treated with Strain C but that are not found to be significantly up- or down- regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.11G010500 | 2088 | 4-coumarate: CoA ligase 3 | −2.87 |
| root | Glyma.04G009900 | 923 | dehydrin LEA | −2.87 |
| root | Glyma.03G129300 | 4052 | S-adenosyl-L-methionine-dependent methyltransferases superfamily protein | −2.88 |
| root | Glyma.13G208000 | 2472 | Eukaryotic aspartyl protease family protein | −2.88 |
| root | Glyma.12G023300 | 4422 | SKU5 similar 5 | −2.88 |
| leaf | Glyma.13G221800 | 2486 | Metallo-hydrolase/oxidoreductase superfamily protein | −2.88 |
| leaf | Glyma.04G018400 | 926 | | −2.88 |
| leaf | Glyma.17G032700 | 3015 | Haem oxygenase-like, multi-helical | −2.88 |
| leaf | Glyma.06G310700 | 1387 | nodulin MtN21/EamA-like transporter family protein | −2.88 |
| leaf | Glyma.06G114300 | 1286 | aldehyde dehydrogenase 3H1 | −2.88 |
| root | Glyma.01G178500 | 4411 | Protein of unknown function (DUF607) | −2.88 |
| root | Glyma.14G145900 | 2664 | Regulator of chromosome condensation (RCC1) family protein | −2.88 |
| root | Glyma.11G097300 | 4210 | SKU5 similar 5 | −2.89 |
| leaf | Glyma.04G220800 | 1039 | AZA-guanine resistant1 | −2.89 |
| leaf | Glyma.08G284500 | 1732 | Plant protein of unknown function (DUF828) | −2.89 |
| leaf | Glyma.08G058300 | 1570 | syntaxin of plants 124 | −2.89 |
| leaf | Glyma.15G248200 | 2841 | ubiquitin-specific protease 15 | −2.89 |
| leaf | Glyma.11G039400 | 2112 | chloroplast beta-amylase | −2.89 |
| root | Glyma.08G172800 | 1666 | | −2.89 |
| root | Glyma.09G163900 | 3707 | Kunitz family trypsin and protease inhibitor protein | −2.89 |
| leaf | Glyma.17G038000 | 3021 | Protein phosphatase 2C family protein | −2.90 |
| leaf | Glyma.16G019900 | 2864 | D-arabinono-1,4-lactone oxidase family protein | −2.90 |
| leaf | Glyma.01G109800 | 527 | O-fucosyltransferase family protein | −2.90 |
| leaf | Glyma.14G156400 | 2666 | alcohol dehydrogenase 1 | −2.90 |
| leaf | Glyma.15G256000 | 2847 | | −2.90 |
| leaf | Glyma.18G278700 | 3277 | Late embryogenesis abundant protein (LEA) family protein | −2.90 |
| leaf | Glyma.10G142700 | 1982 | Low temperature and salt responsive protein family | −2.90 |
| leaf | Glyma.11G091400 | 2146 | farnesylated protein 6 | −2.90 |
| leaf | Glyma.U028900 | 3573 | | −2.90 |
| leaf | Glyma.06G068100 | 1266 | S-domain-2 5 | −2.90 |
| leaf | Glyma.04G041200 | 942 | DREB and EAR motif protein 3 | −2.90 |
| root | Glyma.01G231200 | 4401 | Integrase-type DNA-binding superfamily protein | −2.90 |
| leaf | Glyma.16G176500 | 2967 | P-loop containing nucleoside triphosphate hydrolases superfamily protein | −2.91 |
| leaf | Glyma.13G127500 | 2424 | multidrug resistance-associated protein 5 | −2.91 |
| leaf | Glyma.09G217600 | 1894 | | −2.91 |
| leaf | Glyma.18G259000 | 3267 | Protein of unknown function (DUF1666) | −2.91 |
| leaf | Glyma.08G077400 | 1588 | G-box binding factor 4 | −2.91 |
| leaf | Glyma.13G214400 | 2481 | Protein kinase family protein with ARM repeat domain | −2.91 |
| leaf | Glyma.01G051300 | 509 | NAC-like, activated by AP3/PI | −2.91 |
| leaf | Glyma.11G234600 | 2238 | Transmembrane amino acid transporter family protein | −2.91 |
| leaf | Glyma.13G091300 | 2403 | | −2.91 |
| leaf | Glyma.14G189700 | 2683 | | −2.91 |
| root | Glyma.02G301800 | 3995 | oligopeptide transporter 5 | −2.92 |
| leaf | Glyma.18G203500 | 3243 | Stress induced protein | −2.92 |
| leaf | Glyma.02G186000 | 707 | UDP-Glycosyltransferase superfamily protein | −2.92 |
| leaf | Glyma.20G154900 | 3523 | peptidoglycan-binding LysM domain-containing protein | −2.92 |
| leaf | Glyma.16G123300 | 2922 | | −2.92 |
| leaf | Glyma.17G039900 | 3023 | Protein of unknown function, DUF538 | −2.92 |
| leaf | Glyma.07G104500 | 1453 | glutamine synthase clone R1 | −2.92 |
| leaf | Glyma.10G139400 | 1978 | Haloacid dehalogenase-like hydrolase (HAD) superfamily protein | −2.92 |
| leaf | Glyma.17G192000 | 3114 | amino acid permease 6 | −2.92 |
| leaf | Glyma.03G232400 | 893 | Calmodulin-binding protein | −2.92 |
| leaf | Glyma.13G033500 | 2371 | Protein kinase superfamily protein | −2.92 |
| root | Glyma.18G203500 | 3243 | Stress induced protein | −2.92 |
| root | Glyma.15G016800 | 2715 | PLAC8 family protein | −2.92 |
| root | Glyma.13G291800 | 2538 | late embryogenesis abundant domain-containing protein/LEA domain-containing protein | −2.92 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.13G302000 | 3880 | Wound-responsive family protein | −2.93 |
| root | Glyma.17G065000 | 3659 | xyloglucan endotransglycosylase 6 | −2.93 |
| root | Glyma.16G209800 | 4570 | alpha-galactosidase 2 | −2.93 |
| leaf | Glyma.18G256400 | 3265 | Protein of unknown function (DUF1637) | −2.93 |
| leaf | Glyma.11G194700 | 2216 | ABC transporter family protein | −2.93 |
| leaf | Glyma.18G214000 | 3248 | Protein kinase superfamily protein | −2.93 |
| leaf | Glyma.16G200900 | 2985 | carboxyesterase 20 | −2.93 |
| root | Glyma.05G225600 | 4161 | profilin 5 | −2.94 |
| root | Glyma.16G172200 | 4585 | disease resistance family protein/LRR family protein | −2.94 |
| root | Glyma.14G156400 | 2666 | alcohol dehydrogenase 1 | −2.94 |
| leaf | Glyma.05G125200 | 1134 | FAD-binding Berberine family protein | −2.94 |
| leaf | Glyma.05G196300 | 1179 | SAUR-like auxin-responsive protein family | −2.94 |
| leaf | Glyma.16G130800 | 2926 | | −2.94 |
| leaf | Glyma.10G044700 | 1947 | pyrophosphorylase 4 | −2.94 |
| leaf | Glyma.17G137300 | 3086 | Bifunctional inhibitor/lipid-transfer protein/seed storage 2S albumin superfamily protein | −2.94 |
| leaf | Glyma.12G094100 | 2298 | FAD/NAD(P)-binding oxidoreductase family protein | −2.94 |
| root | Glyma.01G216600 | 4374 | MATE efflux family protein | −2.94 |
| root | Glyma.06G166100 | 4503 | | −2.95 |
| root | Glyma.11G024100 | 2098 | glutathione peroxidase 6 | −2.95 |
| leaf | Glyma.10G211300 | 2043 | PATATIN-like protein 6 | −2.95 |
| leaf | Glyma.13G289600 | 2536 | DNAJ heat shock N-terminal domain-containing protein | −2.95 |
| leaf | Glyma.08G200700 | 1691 | phytochrome-associated protein 1 | −2.95 |
| leaf | Glyma.02G287900 | 762 | HVA22-like protein F | −2.95 |
| leaf | Glyma.03G160400 | 847 | | −2.95 |
| leaf | Glyma.02G009500 | 613 | NIM1-interacting 1 | −2.95 |
| leaf | Glyma.16G218200 | 2994 | cyclic nucleotide-binding transporter 1 | −2.95 |
| leaf | Glyma.04G179400 | 1015 | Putative thiol-disulphide oxidoreductase DCC | −2.95 |
| root | Glyma.10G174400 | 3616 | Aquaporin-like superfamily protein | −2.95 |
| root | Glyma.13G105800 | 3879 | calmodulin-binding family protein | −2.95 |
| root | Glyma.05G082400 | 1111 | Disease resistance protein (CC-NBS-LRR class) family | −2.95 |
| root | Glyma.17G230600 | 3649 | Protein phosphatase 2C family protein | −2.96 |
| root | Glyma.14G145800 | 2662 | Regulator of chromosome condensation (RCC1) family protein | −2.96 |
| root | Glyma.20G210100 | 3544 | Eukaryotic aspartyl protease family protein | −2.96 |
| leaf | Glyma.08G305000 | 1740 | | −2.96 |
| leaf | Glyma.11G024100 | 2098 | glutathione peroxidase 6 | −2.96 |
| leaf | Glyma.10G172700 | 2001 | methionine gamma-lyase | −2.96 |
| leaf | Glyma.10G155300 | 1988 | NAD(P)-binding Rossmann-fold superfamily protein | −2.96 |
| leaf | Glyma.02G254600 | 744 | HXXXD-type acyl-transferase family protein | −2.97 |
| leaf | Glyma.07G139600 | 1466 | glutathione S-transferase tau 7 | −2.97 |
| leaf | Glyma.11G247500 | 2250 | B12D protein | −2.97 |
| leaf | Glyma.08G055100 | 1567 | | −2.97 |
| leaf | Glyma.13G119000 | 2422 | P-glycoprotein 11 | −2.97 |
| root | Glyma.17G147600 | 3656 | expansin-like B1 | −2.97 |
| root | Glyma.18G095100 | 4543 | GDSL-like Lipase/Acylhydrolase superfamily protein | −2.98 |
| root | Glyma.06G235500 | 4458 | Tyrosine transaminase family protein | −2.98 |
| leaf | Glyma.11G104200 | 2157 | homolog of X-ray repair cross complementing 2 (XRCC2) | −2.98 |
| leaf | Glyma.18G124200 | 3216 | IQ-domain 28 | −2.98 |
| leaf | Glyma.14G106400 | 2652 | receptor like protein 6 | −2.98 |
| leaf | Glyma.08G307600 | 1744 | Eukaryotic aspartyl protease family protein | −2.98 |
| leaf | Glyma.16G042900 | 2878 | *Arabidopsis* NAC domain containing protein 87 | −2.98 |
| leaf | Glyma.15G002000 | 2702 | Rad23 UV excision repair protein family | −2.98 |
| leaf | Glyma.17G005200 | 2998 | Plant protein of unknown function (DUF827) | −2.98 |
| leaf | Glyma.10G016500 | 1930 | Integrase-type DNA-binding superfamily protein | −2.98 |
| leaf | Glyma.18G159300 | 3231 | disease resistance family protein/LRR family protein | −2.98 |
| leaf | Glyma.13G346700 | 2578 | homolog of carrot EP3-3 chitinase | −2.98 |
| leaf | Glyma.13G245600 | 2507 | Protein of unknown function (DUF761) | −2.98 |
| leaf | Glyma.15G219400 | 2832 | Ca(2)-dependent phospholipid-binding protein (Copine) family | −2.98 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| root | Glyma.13G270100 | 2520 | D-mannose binding lectin protein with Apple-like carbohydrate-binding domain | −2.98 |
| root | Glyma.04G199400 | 1027 | | −2.99 |
| leaf | Glyma.02G131500 | 689 | 3-methylcrotonyl-CoA carboxylase | −2.99 |
| leaf | Glyma.13G030900 | 2364 | NAC (No Apical Meristem) domain transcriptional regulator superfamily protein | −2.99 |
| leaf | Glyma.13G201200 | 2468 | RING/U-box superfamily protein | −2.99 |
| leaf | Glyma.05G192100 | 1174 | plant U-box 25 | −2.99 |
| leaf | Glyma.17G030400 | 3014 | MLP-like protein 423 | −2.99 |
| leaf | Glyma.14G030800 | 2619 | | −2.99 |
| leaf | Glyma.15G055700 | 2735 | GTP cyclohydrolase II | −2.99 |
| root | Glyma.17G022000 | 3638 | | −2.99 |
| root | Glyma.15G064500 | 3813 | basic helix-loop-helix (bHLH) DNA-binding superfamily protein | −3.00 |
| leaf | Glyma.05G030800 | 1087 | calcium-dependent protein kinase 30 | −3.00 |
| leaf | Glyma.03G245600 | 901 | Plant protein of unknown function (DUF868) | −3.00 |
| leaf | Glyma.13G042200 | 2377 | 2-oxoglutarate (2OG) and Fe(II)-dependent oxygenase superfamily protein | −3.00 |
| leaf | Glyma.20G091300 | 3483 | Low temperature and salt responsive protein family | −3.00 |
| leaf | Glyma.13G156700 | 2434 | | −3.00 |
| leaf | Glyma.12G116800 | 2305 | Protein phosphatase 2C family protein | −3.00 |
| leaf | Glyma.15G158200 | 2804 | VQ motif-containing protein | −3.00 |
| leaf | Glyma.18G071600 | 3198 | myb domain protein 103 | −3.00 |
| leaf | Glyma.09G061500 | 1804 | plant intracellular ras group-related LRR 6 | −3.00 |
| root | Glyma.09G012700 | 3689 | | −3.01 |
| root | Glyma.07G250600 | 1518 | Glutaredoxin family protein | −3.01 |
| leaf | Glyma.19G198700 | 3400 | Late embryogenesis abundant (LEA) hydroxyproline-rich glycoprotein family | −3.01 |
| leaf | Glyma.13G117700 | 2421 | polyubiquitin 10 | −3.01 |
| leaf | Glyma.19G158100 | 3378 | Protein of unknown function (DUF581) | −3.01 |
| leaf | Glyma.10G006300 | 1925 | Regulator of chromosome condensation (RCC1) family protein | −3.01 |
| leaf | Glyma.08G118900 | 1619 | glutathione S-transferase tau 7 | −3.01 |
| leaf | Glyma.07G179900 | 1485 | 2-oxoglutarate (2OG) and Fe(II)-dependent oxygenase superfamily protein | −3.01 |
| leaf | Glyma.15G270100 | 2853 | | −3.01 |
| leaf | Glyma.13G062500 | 2386 | cycling DOF factor 2 | −3.01 |
| root | Glyma.08G158100 | 4328 | | −3.01 |
| leaf | Glyma.05G002500 | 1062 | glucuronokinase G | −3.02 |
| leaf | Glyma.17G103400 | 3064 | Leucine-rich repeat protein kinase family protein | −3.02 |
| leaf | Glyma.09G051900 | 1799 | VQ motif-containing protein | −3.02 |
| root | Glyma.14G176400 | 4252 | Phosphate-responsive 1 family protein | −3.02 |
| leaf | Glyma.13G168200 | 2438 | Lactoylglutathione lyase/glyoxalase I family protein | −3.03 |
| leaf | Glyma.14G199900 | 2687 | | −3.03 |
| leaf | Glyma.08G092800 | 1602 | senescence-related gene 1 | −3.03 |
| leaf | Glyma.02G155500 | 701 | | −3.03 |
| leaf | Glyma.16G039500 | 2875 | spermidine hydroxycinnamoyl transferase | −3.03 |
| leaf | Glyma.13G330200 | 2571 | Protein kinase superfamily protein | −3.03 |
| leaf | Glyma.04G132000 | 991 | Protein kinase superfamily protein | −3.03 |
| leaf | Glyma.15G134300 | 2796 | FAD-binding Berberine family protein | −3.03 |
| root | Glyma.06G031100 | 4468 | | −3.03 |
| root | Glyma.06G157000 | 1316 | | −3.03 |
| root | Glyma.02G243200 | 3960 | RING/FYVE/PHD zinc finger superfamily protein | −3.04 |
| leaf | Glyma.01G225800 | 598 | UDP-D-glucose/UDP-D-galactose 4-epimerase 5 | −3.04 |
| leaf | Glyma.03G006400 | 782 | | −3.04 |
| leaf | Glyma.13G037000 | 2376 | | −3.04 |
| leaf | Glyma.03G102800 | 816 | DYNAMIN-like 1E | −3.04 |
| leaf | Glyma.18G110200 | 3209 | Eukaryotic aspartyl protease family protein | −3.04 |
| leaf | Glyma.13G033000 | 2368 | Protein kinase superfamily protein | −3.04 |
| leaf | Glyma.18G301500 | 3293 | NAC domain containing protein 83 | −3.04 |
| leaf | Glyma.18G030100 | 3168 | Mitochondrial substrate carrier family protein | −3.04 |
| leaf | Glyma.11G106300 | 2159 | Major facilitator superfamily protein | −3.04 |
| root | Glyma.01G177000 | 4406 | RmlC-like cupins superfamily protein | −3.04 |
| root | Glyma.19G231800 | 3425 | alpha/beta-Hydrolases superfamily protein | −3.05 |
| leaf | Glyma.09G049200 | 1798 | cytochrome P450, family 81, subfamily D, polypeptide 3 | −3.05 |
| leaf | Glyma.19G217700 | 3413 | stachyose synthase | −3.05 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.12G012000 | 2257 | purple acid phosphatase 27 | −3.05 |
| leaf | Glyma.15G013900 | 2713 | Coatomer, beta\' subunit | −3.05 |
| leaf | Glyma.09G203500 | 1884 | phosphoenolpyruvate carboxykinase 1 | −3.05 |
| leaf | Glyma.19G100000 | 3352 | GRAM domain family protein | −3.05 |
| leaf | Glyma.13G222600 | 2490 | Protein of unknown function, DUF584 | −3.05 |
| root | Glyma.17G065400 | 3648 | xyloglucan endotransglycosylase 6 | −3.05 |
| leaf | Glyma.09G029100 | 1786 | Major facilitator superfamily protein | −3.06 |
| leaf | Glyma.03G130900 | 831 | Patatin-like phospholipase family protein | −3.06 |
| leaf | Glyma.06G105200 | 1280 | Transducin/WD40 repeat-like superfamily protein | −3.06 |
| leaf | Glyma.02G013700 | 614 | alpha/beta-Hydrolases superfamily protein | −3.06 |
| leaf | Glyma.16G021700 | 2865 | P-loop containing nucleoside triphosphate hydrolases superfamily protein | −3.06 |
| leaf | Glyma.17G041200 | 3024 | P-glycoprotein 11 | −3.06 |
| leaf | Glyma.17G023900 | 3008 | Thioredoxin superfamily protein | −3.06 |
| leaf | Glyma.05G084200 | 1113 | P-loop containing nucleoside triphosphate hydrolases superfamily protein | −3.06 |
| leaf | Glyma.04G082400 | 970 | | −3.06 |
| root | Glyma.15G256000 | 2847 | | −3.06 |
| root | Glyma.20G091800 | 4118 | | −3.07 |
| leaf | Glyma.14G116000 | 2657 | Protein kinase superfamily protein | −3.07 |
| leaf | Glyma.02G216200 | 721 | | −3.07 |
| leaf | Glyma.07G243600 | 1514 | MLP-like protein 423 | −3.07 |
| leaf | Glyma.05G236600 | 1210 | Plant invertase/pectin methylesterase inhibitor superfamily protein | −3.07 |
| leaf | Glyma.12G179800 | 2324 | Eukaryotic aspartyl protease family protein | −3.07 |
| leaf | Glyma.06G044800 | 1249 | cytochrome B5 isoform D | −3.07 |
| leaf | Glyma.03G134800 | 833 | Glycosyltransferase family 61 protein | −3.07 |
| root | Glyma.07G154700 | 1476 | | −3.07 |
| root | Glyma.01G119600 | 4405 | Stress induced protein | −3.07 |
| leaf | Glyma.06G258200 | 1368 | S-locus lectin protein kinase family protein | −3.08 |
| leaf | Glyma.09G138600 | 1852 | Copper transport protein family | −3.08 |
| leaf | Glyma.09G138100 | 1850 | AMP-dependent synthetase and ligase family protein | −3.08 |
| leaf | Glyma.04G050400 | 953 | ferrochelatase 1 | −3.08 |
| leaf | Glyma.15G062500 | 2739 | basic pathogenesis-related protein 1 | −3.08 |
| leaf | Glyma.13G183900 | 2460 | SNF2 domain-containing protein/helicase domain-containing protein/zinc finger protein-related | −3.08 |
| leaf | Glyma.08G228800 | 1708 | aminophospholipid ATPase 1 | −3.08 |
| leaf | Glyma.10G014400 | 1927 | alpha/beta-Hydrolases superfamily protein | −3.08 |
| leaf | Glyma.01G239600 | 603 | alpha/beta-Hydrolases superfamily protein | −3.08 |
| root | Glyma.08G318400 | 4341 | GDSL-like Lipase/Acylhydrolase superfamily protein | −3.08 |
| leaf | Glyma.02G210300 | 716 | | −3.09 |
| leaf | Glyma.07G247800 | 1517 | | −3.09 |
| leaf | Glyma.08G058400 | 1571 | sphingosine kinase 1 | −3.09 |
| leaf | Glyma.08G359500 | 1770 | | −3.09 |
| leaf | Glyma.17G053600 | 3034 | calmodulin-binding family protein | −3.09 |
| leaf | Glyma.14G030700 | 2618 | NAC domain containing protein 42 | −3.09 |
| leaf | Glyma.14G200200 | 2688 | WRKY DNA-binding protein 33 | −3.09 |
| leaf | Glyma.08G356800 | 1767 | Pectin lyase-like superfamily protein | −3.09 |
| leaf | Glyma.17G175600 | 3109 | | −3.09 |
| leaf | Glyma.13G246600 | 2508 | NAD(P)H dehydrogenase B2 | −3.10 |
| leaf | Glyma.15G211300 | 2828 | NAD(P)-binding Rossmann-fold superfamily protein | −3.10 |
| leaf | Glyma.U019900 | 3565 | isovaleryl-CoA-dehydrogenase | −3.10 |
| leaf | Glyma.18G205400 | 3244 | | −3.10 |
| leaf | Glyma.15G068900 | 2747 | glycine-rich protein | −3.10 |
| leaf | Glyma.15G110600 | 2780 | Stigma-specific Stig1 family protein | −3.10 |
| leaf | Glyma.10G244800 | 2058 | | −3.10 |
| leaf | Glyma.09G280900 | 1922 | glutaredoxin-related | −3.10 |
| root | Glyma.04G049200 | 951 | branched-chain amino acid transaminase 2 | −3.10 |
| root | Glyma.08G342000 | 4309 | kunitz trypsin inhibitor 1 | −3.11 |
| leaf | Glyma.12G193100 | 2331 | | −3.11 |
| leaf | Glyma.15G254000 | 2846 | NAC domain containing protein 1 | −3.11 |
| leaf | Glyma.18G296300 | 3291 | Mannose-6-phosphate isomerase, type I | −3.11 |
| leaf | Glyma.08G131400 | 1632 | Melibiase family protein | −3.11 |
| leaf | Glyma.15G062400 | 2738 | basic pathogenesis-related protein 1 | −3.11 |
| leaf | Glyma.02G238500 | 739 | Protein of unknown function (DUF607) | −3.11 |
| leaf | Glyma.12G023600 | 2263 | plasma membrane intrinsic protein 2 | −3.12 |
| leaf | Glyma.10G178000 | 2008 | AT hook motif DNA-binding family protein | −3.12 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.03G191900 | 871 | Plant protein of unknown function (DUF247) | −3.12 |
| leaf | Glyma.11G051900 | 2123 | maternal effect embryo arrest 59 | −3.12 |
| leaf | Glyma.08G034500 | 1551 | | −3.12 |
| leaf | Glyma.09G014900 | 1779 | Wall-associated kinase family protein | −3.12 |
| root | Glyma.06G147100 | 4502 | WRKY DNA-binding protein 51 | −3.12 |
| root | Glyma.11G018000 | 2094 | highly ABA-induced PP2C gene 3 | −3.13 |
| leaf | Glyma.04G232200 | 1048 | P-loop containing nucleoside triphosphate hydrolases superfamily protein | −3.13 |
| leaf | Glyma.04G230400 | 1045 | | −3.13 |
| leaf | Glyma.08G009800 | 1536 | DHHC-type zinc finger family protein | −3.13 |
| leaf | Glyma.06G007500 | 1221 | arginine decarboxylase 2 | −3.13 |
| leaf | Glyma.08G119000 | 1620 | ATP binding; GTP binding; nucleotide binding; nucleoside-triphosphatases | −3.13 |
| leaf | Glyma.18G190200 | 3236 | glutathione S-transferase TAU 8 | −3.13 |
| leaf | Glyma.13G228400 | 2494 | CBL-interacting protein kinase 12 | −3.13 |
| leaf | Glyma.05G191500 | 1173 | | −3.13 |
| leaf | Glyma.03G214100 | 885 | SPX (SYG1/Pho81/XPR1) domain-containing protein | −3.14 |
| leaf | Glyma.14G054000 | 2635 | Protein of unknown function (DUF567) | −3.14 |
| leaf | Glyma.05G127600 | 1142 | WRKY DNA-binding protein 28 | −3.14 |
| leaf | Glyma.12G140200 | 2311 | receptor kinase 3 | −3.14 |
| leaf | Glyma.06G295400 | 1378 | | −3.14 |
| leaf | Glyma.08G171400 | 1664 | | −3.14 |
| root | Glyma.18G141500 | 4545 | cysteine-rich RLK (RECEPTOR-like protein kinase) 2 | −3.14 |
| root | Glyma.06G154300 | 4500 | Thiamin diphosphate-binding fold (THDP-binding) superfamily protein | −3.14 |
| leaf | Glyma.05G194400 | 1177 | Regulator of chromosome condensation (RCC1) family protein | −3.15 |
| leaf | Glyma.08G060400 | 1574 | PLAC8 family protein | −3.15 |
| leaf | Glyma.17G236700 | 3132 | acyl-CoA-binding domain 3 | −3.15 |
| leaf | Glyma.20G214200 | 3548 | Peroxidase superfamily protein | −3.15 |
| leaf | Glyma.02G148100 | 692 | F-box family protein | −3.15 |
| leaf | Glyma.04G209200 | 1033 | amino acid permease 2 | −3.15 |
| leaf | Glyma.14G081300 | 2647 | phospholipase A 2A | −3.15 |
| leaf | Glyma.10G076100 | 1963 | AP2/B3-like transcriptional factor family protein | −3.15 |
| leaf | Glyma.17G159000 | 3099 | phytosulfokine 5 precursor | −3.15 |
| root | Glyma.02G088400 | 653 | Nodulin MtN3 family protein | −3.15 |
| root | Glyma.03G148800 | 842 | Protein kinase family protein | −3.16 |
| leaf | Glyma.09G080100 | 1819 | Cytidine/deoxycytidylate deaminase family protein | −3.16 |
| leaf | Glyma.15G098100 | 2767 | beta-amylase 3 | −3.16 |
| leaf | Glyma.11G242100 | 2246 | | −3.16 |
| leaf | Glyma.09G099200 | 1826 | S-locus lectin protein kinase family protein | −3.16 |
| leaf | Glyma.16G181300 | 2972 | NAD(P)-binding Rossmann-fold superfamily protein | −3.16 |
| root | Glyma.11G077900 | 4229 | Rhodanese/Cell cycle control phosphatase superfamily protein | −3.16 |
| leaf | Glyma.11G129900 | 2168 | beta glucosidase 17 | −3.17 |
| leaf | Glyma.17G164200 | 3102 | Late embryogenesis abundant protein, group 6 | −3.17 |
| leaf | Glyma.18G009800 | 3156 | B12D protein | −3.17 |
| root | Glyma.15G139800 | 3836 | | −3.17 |
| root | Glyma.16G164800 | 2948 | Integrase-type DNA-binding superfamily protein | −3.18 |
| leaf | Glyma.07G121900 | 1458 | multidrug resistance-associated protein 9 | −3.18 |
| leaf | Glyma.17G245100 | 3139 | Protein of unknown function (DUF1645) | −3.18 |
| leaf | Glyma.04G194800 | 1021 | calmodulin-like 38 | −3.18 |
| leaf | Glyma.13G302400 | 2547 | MYB-like 102 | −3.18 |
| leaf | Glyma.09G194100 | 1874 | RING/U-box superfamily protein | −3.18 |
| leaf | Glyma.13G335900 | 2574 | Protein of unknown function (DUF3741) | −3.19 |
| leaf | Glyma.17G104600 | 3065 | | −3.20 |
| leaf | Glyma.01G203400 | 586 | chloroplast beta-amylase | −3.20 |
| leaf | Glyma.08G119300 | 1621 | ER lumen protein retaining receptor family protein | −3.20 |
| leaf | Glyma.16G048300 | 2885 | phytosulfokin receptor 1 | −3.20 |
| leaf | Glyma.20G083100 | 3479 | Transmembrane amino acid transporter family protein | −3.20 |
| leaf | Glyma.18G127200 | 3218 | nitrate transporter 1.7 | −3.20 |
| leaf | Glyma.11G135200 | 2172 | maternal effect embryo arrest 60 | −3.20 |
| leaf | Glyma.03G029600 | 790 | SAUR-like auxin-responsive protein family | −3.21 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
| --- | --- | --- | --- | --- |
| leaf | Glyma.05G238100 | 1211 | nudix hydrolase homolog 17 | −3.21 |
| leaf | Glyma.18G037900 | 3173 | TRF-like 9 | −3.21 |
| leaf | Glyma.13G167700 | 2437 | Major facilitator superfamily protein | −3.21 |
| root | Glyma.04G011200 | 3763 | Arabidopsis protein of unknown function (DUF241) | −3.21 |
| root | Glyma.U038700 | 3580 | | −3.22 |
| leaf | Glyma.15G016800 | 2715 | PLAC8 family protein | −3.22 |
| leaf | Glyma.06G124700 | 1296 | Leucine-rich repeat protein kinase family protein | −3.22 |
| leaf | Glyma.03G147900 | 841 | Disease resistance-responsive (dirigent-like protein) family protein | −3.22 |
| leaf | Glyma.02G086900 | 652 | Pectin lyase-like superfamily protein | −3.22 |
| root | Glyma.19G195800 | 4004 | NAC domain containing protein 61 | −3.22 |
| leaf | Glyma.05G138700 | 1144 | xyloglucan endotransglucosylase/hydrolase 28 | −3.23 |
| leaf | Glyma.12G059100 | 2280 | NAD(P)-binding Rossmann-fold superfamily protein | −3.23 |
| leaf | Glyma.11G017500 | 2092 | | −3.23 |
| leaf | Glyma.01G007500 | 482 | Protein kinase family protein with leucine-rich repeat domain | −3.23 |
| leaf | Glyma.05G126900 | 1141 | | −3.24 |
| leaf | Glyma.19G217800 | 3414 | WRKY DNA-binding protein 23 | −3.24 |
| leaf | Glyma.17G036800 | 3018 | Protein of unknown function, DUF538 | −3.24 |
| leaf | Glyma.02G098800 | 667 | myb-like transcription factor family protein | −3.24 |
| leaf | Glyma.01G235000 | 600 | Bifunctional inhibitor/lipid-transfer protein/seed storage 2S albumin superfamily protein | −3.24 |
| leaf | Glyma.19G047800 | 3331 | abscisic acid (aba)-deficient 4 | −3.24 |
| leaf | Glyma.15G071200 | 2751 | | −3.24 |
| leaf | Glyma.20G108600 | 3489 | Homeodomain-like superfamily protein | −3.24 |
| leaf | Glyma.13G209600 | 2476 | Family of unknown function (DUF716) | −3.25 |
| leaf | Glyma.17G211900 | 3120 | Myosin heavy chain-related protein | −3.25 |
| leaf | Glyma.12G054200 | 2278 | beta glucosidase 17 | −3.25 |
| leaf | Glyma.07G191300 | 1492 | | −3.25 |
| root | Glyma.15G099200 | 3859 | | −3.25 |
| leaf | Glyma.18G073300 | 3200 | Duplicated homeodomain-like superfamily protein | −3.26 |
| leaf | Glyma.04G167800 | 1007 | expansin A15 | −3.26 |
| leaf | Glyma.14G002300 | 2600 | Protein of unknown function (DUF630 and DUF632) | −3.26 |
| root | Glyma.20G201800 | 4099 | | −3.27 |
| leaf | Glyma.12G030700 | 2267 | Chaperone DnaJ-domain superfamily protein | −3.27 |
| leaf | Glyma.03G052200 | 803 | PEBP (phosphatidylethanolamine-binding protein) family protein | −3.27 |
| leaf | Glyma.12G053900 | 2277 | beta glucosidase 13 | −3.27 |
| leaf | Glyma.06G151200 | 1312 | CYS, MET, PRO, and GLY protein 2 | −3.27 |
| leaf | Glyma.13G314400 | 2562 | | −3.27 |
| leaf | Glyma.04G085600 | 975 | | −3.28 |
| leaf | Glyma.08G193900 | 1683 | cytochrome P450, family 90, subfamily D, polypeptide 1 | −3.28 |
| leaf | Glyma.08G002000 | 1529 | F-box family protein | −3.28 |
| root | Glyma.19G185500 | 4049 | Major facilitator superfamily protein | −3.28 |
| leaf | Glyma.08G352400 | 1764 | S-locus lectin protein kinase family protein | −3.29 |
| leaf | Glyma.17G109300 | 3068 | | −3.29 |
| leaf | Glyma.16G077900 | 2904 | 2-oxoglutarate (2OG) and Fe(II)-dependent oxygenase superfamily protein | −3.29 |
| leaf | Glyma.10G028200 | 1938 | Bifunctional inhibitor/lipid-transfer protein/seed storage 2S albumin superfamily protein | −3.29 |
| root | Glyma.14G219100 | 4251 | GAST1 protein homolog 1 | −3.29 |
| leaf | Glyma.08G019800 | 1541 | | −3.30 |
| leaf | Glyma.13G033200 | 2369 | Protein kinase superfamily protein | −3.30 |
| leaf | Glyma.17G166600 | 3107 | | −3.30 |
| leaf | Glyma.16G059300 | 2895 | calmodulin-like 38 | −3.30 |
| leaf | Glyma.18G199100 | 3240 | Leucine-rich repeat receptor-like protein kinase family protein | −3.30 |
| leaf | Glyma.06G321600 | 1395 | FAD-binding Berberine family protein | −3.30 |
| leaf | Glyma.09G123800 | 1833 | Caleosin-related family protein | −3.30 |
| leaf | Glyma.13G035200 | 2374 | alcohol dehydrogenase 1 | −3.30 |
| leaf | Glyma.08G358700 | 1769 | Transducin/WD40 repeat-like superfamily protein | −3.31 |
| leaf | Glyma.05G003900 | 1063 | Raffinose synthase family protein | −3.31 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.03G221900 | 889 | myb domain protein 2 | −3.31 |
| leaf | Glyma.18G300300 | 3292 | Transducin/WD40 repeat-like superfamily protein | −3.31 |
| leaf | Glyma.13G291700 | 2537 | TRICHOME BIREFRINGENCE-LIKE 39 | −3.31 |
| leaf | Glyma.17G232900 | 3130 | | −3.31 |
| leaf | Glyma.05G005100 | 1064 | cysteine-rich RLK (RECEPTOR-like protein kinase) 42 | −3.31 |
| leaf | Glyma.18G045100 | 3175 | polyamine oxidase 4 | −3.31 |
| root | Glyma.06G031000 | 4504 | | −3.31 |
| root | Glyma.08G160800 | 4297 | | −3.32 |
| leaf | Glyma.17G026200 | 3009 | alanine-tRNA ligases; nucleic acid binding; ligases, forming aminoacyl-tRNA and related compounds; nucleotide binding; ATP binding | −3.32 |
| leaf | Glyma.03G253600 | 906 | Protein kinase superfamily protein | −3.32 |
| leaf | Glyma.04G230500 | 1046 | Leucine-rich repeat protein kinase family protein | −3.32 |
| leaf | Glyma.16G073400 | 2901 | Protein of unknown function (DUF1645) | −3.32 |
| leaf | Glyma.13G033600 | 2372 | SKU5 similar 2 | −3.32 |
| leaf | Glyma.01G217600 | 592 | osmotin 34 | −3.32 |
| leaf | Glyma.08G172800 | 1666 | | −3.32 |
| leaf | Glyma.18G080000 | 3202 | serine acetyltransferase 2; 2 | −3.32 |
| leaf | Glyma.03G074900 | 809 | O-fucosyltransferase family protein | −3.33 |
| leaf | Glyma.06G148400 | 1309 | Integrase-type DNA-binding superfamily protein | −3.33 |
| leaf | Glyma.15G138500 | 2798 | | −3.33 |
| leaf | Glyma.08G071300 | 1583 | EXORDIUM like 2 | −3.33 |
| root | Glyma.13G242100 | 2504 | Aluminium induced protein with YGL and LRDR motifs | −3.35 |
| leaf | Glyma.20G151000 | 3520 | DNA repair (Rad51) family protein | −3.35 |
| leaf | Glyma.19G258100 | 3444 | P-loop containing nucleoside triphosphate hydrolases superfamily protein | −3.35 |
| leaf | Glyma.05G033600 | 1088 | | −3.35 |
| leaf | Glyma.19G094100 | 3344 | WRKY DNA-binding protein 75 | −3.35 |
| leaf | Glyma.02G228100 | 731 | glutamine-dependent asparagine synthase 1 | −3.35 |
| leaf | Glyma.19G096900 | 3347 | exocyst subunit exo70 family protein C2 | −3.36 |
| leaf | Glyma.14G092800 | 2649 | gamma vacuolar processing enzyme | −3.36 |
| leaf | Glyma.18G080900 | 3203 | multidrug resistance-associated protein 3 | −3.36 |
| leaf | Glyma.09G004800 | 1775 | F-box family protein with a domain of unknown function (DUF295) | −3.37 |
| leaf | Glyma.20G117000 | 3493 | myb domain protein 62 | −3.37 |
| leaf | Glyma.07G236000 | 1511 | Plant neutral invertase family protein | −3.37 |
| leaf | Glyma.13G363300 | 2593 | Late embryogenesis abundant protein (LEA) family protein | −3.37 |
| leaf | Glyma.13G312700 | 2561 | plant U-box 23 | −3.37 |
| leaf | Glyma.09G112100 | 1828 | Late Embryogenesis Abundant 4-5 | −3.37 |
| leaf | Glyma.03G201100 | 877 | Late embryogenesis abundant (LEA) hydroxyproline-rich glycoprotein family | −3.37 |
| leaf | Glyma.14G052000 | 2632 | glycine-rich protein 3 short isoform | −3.37 |
| root | Glyma.11G250400 | 4233 | DNA-binding HORMA family protein | −3.38 |
| leaf | Glyma.09G087300 | 1822 | Leucine-rich repeat (LRR) family protein | −3.38 |
| leaf | Glyma.11G214400 | 2227 | transmembrane kinase 1 | −3.38 |
| leaf | Glyma.09G126200 | 1835 | chitinase A | −3.38 |
| leaf | Glyma.12G174900 | 2320 | Putative lysine decarboxylase family protein | −3.38 |
| root | Glyma.20G201900 | 4101 | | −3.38 |
| root | Glyma.05G149700 | 1151 | phragmoplast-associated kinesin-related protein, putative | −3.38 |
| root | Glyma.11G065800 | 4206 | RmlC-like cupins superfamily protein | −3.39 |
| leaf | Glyma.12G044400 | 2273 | | −3.39 |
| leaf | Glyma.09G069900 | 1814 | Protein kinase superfamily protein | −3.39 |
| leaf | Glyma.19G211600 | 3406 | senescence-associated gene 21 | −3.39 |
| leaf | Glyma.07G090400 | 1448 | | −3.40 |
| leaf | Glyma.08G060900 | 1577 | S-locus lectin protein kinase family protein | −3.40 |
| leaf | Glyma.16G132500 | 2928 | alpha/beta-Hydrolases superfamily protein | −3.40 |
| leaf | Glyma.18G134600 | 3223 | P-loop containing nucleoside triphosphate hydrolases superfamily protein | −3.40 |
| leaf | Glyma.10G242600 | 2057 | ATP sulfurylase 1 | −3.40 |
| leaf | Glyma.17G067800 | 3043 | trehalose phosphatase/synthase 11 | −3.41 |
| leaf | Glyma.09G092800 | 1825 | Kunitz family trypsin and protease inhibitor protein | −3.41 |
| leaf | Glyma.15G065100 | 2743 | receptor kinase 3 | −3.41 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.02G084400 | 650 | 2-oxoglutarate (2OG) and Fe(II)-dependent oxygenase superfamily protein | −3.41 |
| leaf | Glyma.17G243200 | 3137 | origin recognition complex second largest subunit 2 | −3.41 |
| leaf | Glyma.06G208900 | 1342 | ATPase E1-E2 type family protein/haloacid dehalogenase-like hydrolase family protein | −3.41 |
| leaf | Glyma.15G132800 | 2793 | FAD-binding Berberine family protein | −3.42 |
| leaf | Glyma.07G192500 | 1493 | SNF2 domain-containing protein/helicase domain-containing protein/zinc finger protein-related | −3.42 |
| root | Glyma.02G042500 | 623 | basic chitinase | −3.43 |
| leaf | Glyma.04G203300 | 1030 | Clp ATPase | −3.43 |
| leaf | Glyma.02G128800 | 682 | Protein of unknown function (DUF1262) | −3.43 |
| leaf | Glyma.17G053700 | 3035 | heat shock transcription factor A2 | −3.43 |
| root | Glyma.01G081600 | 4393 | Major facilitator superfamily protein | −3.43 |
| root | Glyma.17G055600 | 3036 | | −3.44 |
| leaf | Glyma.12G178900 | 2322 | C2H2-type zinc finger family protein | −3.44 |
| leaf | Glyma.09G198700 | 1876 | Protein kinase superfamily protein | −3.44 |
| leaf | Glyma.06G265500 | 1371 | GRAS family transcription factor | −3.44 |
| root | Glyma.06G090900 | 1275 | transcription factor-related | −3.44 |
| root | Glyma.16G175800 | 2965 | Glycosyl hydrolases family 32 protein | −3.44 |
| leaf | Glyma.10G022300 | 1935 | | −3.45 |
| leaf | Glyma.11G077400 | 2143 | Chaperone DnaJ-domain superfamily protein | −3.45 |
| leaf | Glyma.13G234400 | 2499 | Seven transmembrane MLO family protein | −3.45 |
| leaf | Glyma.06G042200 | 1243 | | −3.45 |
| leaf | Glyma.15G082100 | 2757 | ARM repeat superfamily protein | −3.45 |
| leaf | Glyma.02G128700 | 681 | | −3.46 |
| leaf | Glyma.15G269100 | 2852 | homeobox from *Arabidopsis thaliana* | −3.46 |
| leaf | Glyma.12G134300 | 2309 | Protein of unknown function (DUF1223) | −3.46 |
| leaf | Glyma.14G209000 | 2693 | oxidative stress 3 | −3.46 |
| leaf | Glyma.07G153800 | 1475 | ammonium transporter 2 | −3.46 |
| leaf | Glyma.04G079300 | 969 | | −3.47 |
| leaf | Glyma.10G285400 | 2077 | | −3.47 |
| leaf | Glyma.02G042500 | 623 | basic chitinase | −3.47 |
| leaf | Glyma.17G096400 | 3057 | Major facilitator superfamily protein | −3.48 |
| leaf | Glyma.13G092500 | 2404 | trehalose phosphatase/synthase 11 | −3.49 |
| leaf | Glyma.08G094400 | 1603 | Protein kinase superfamily protein | −3.49 |
| leaf | Glyma.08G241600 | 1716 | Cyclic nucleotide-regulated ion channel family protein | −3.50 |
| leaf | Glyma.07G177600 | 1483 | Protein of unknown function (DUF1645) | −3.50 |
| leaf | Glyma.07G076600 | 1442 | BON association protein 2 | −3.50 |
| leaf | Glyma.03G137900 | 834 | seed imbibition 2 | −3.50 |
| leaf | Glyma.10G295300 | 2082 | homogentisate phytyltransferase 1 | −3.50 |
| leaf | Glyma.20G090500 | 3481 | Pectinacetylesterase family protein | −3.50 |
| leaf | Glyma.16G197800 | 2981 | phloem protein 2-A13 | −3.51 |
| leaf | Glyma.07G081400 | 1444 | glutaredoxin-related | −3.51 |
| leaf | Glyma.02G235700 | 738 | with no lysine (K) kinase 4 | −3.51 |
| leaf | Glyma.10G082500 | 1966 | syntaxin of plants 121 | −3.52 |
| leaf | Glyma.03G212200 | 883 | | −3.52 |
| leaf | Glyma.10G231200 | 2048 | beta-hydroxylase 1 | −3.52 |
| leaf | Glyma.17G165500 | 3105 | Auxin-responsive GH3 family protein | −3.52 |
| leaf | Glyma.11G235300 | 2239 | SOS3-interacting protein 1 | −3.52 |
| leaf | Glyma.20G236200 | 3557 | respiratory burst oxidase homolog B | −3.52 |
| root | Glyma.01G225100 | 596 | highly ABA-induced PP2C gene 3 | −3.53 |
| leaf | Glyma.07G168500 | 1480 | 2-oxoglutarate (2OG) and Fe(II)-dependent oxygenase superfamily protein | −3.53 |
| leaf | Glyma.11G025600 | 2099 | osmotin 34 | −3.53 |
| root | Glyma.18G260000 | 3269 | nitrate transporter 1.5 | −3.54 |
| leaf | Glyma.13G149100 | 2432 | Sulfite exporter TauE/SafE family protein | −3.54 |
| leaf | Glyma.10G187200 | 2018 | P-loop containing nucleoside triphosphate hydrolases superfamily protein | −3.54 |
| leaf | Glyma.06G160400 | 1319 | Scorpion toxin-like knottin superfamily protein | −3.54 |
| leaf | Glyma.03G189900 | 869 | cytochrome P450, family 76, subfamily G, polypeptide 1 | −3.54 |
| leaf | Glyma.12G033400 | 2269 | SBP (S-ribonuclease binding protein) family protein | −3.54 |
| leaf | Glyma.12G081100 | 2288 | CHY-type/CTCHY-type/RING-type Zinc finger protein | −3.54 |
| root | Glyma.U020300 | 3566 | RmlC-like cupins superfamily protein | −3.55 |
| leaf | Glyma.01G031500 | 496 | aldehyde dehydrogenase 2B7 | −3.55 |
| leaf | Glyma.07G243500 | 1513 | MLP-like protein 423 | −3.55 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.01G047900 | 507 | homeobox protein 22 | −3.55 |
| leaf | Glyma.19G051500 | 3332 | RING domain ligase1 | −3.55 |
| leaf | Glyma.16G153400 | 2945 | glutamate dehydrogenase 1 | −3.56 |
| leaf | Glyma.18G265800 | 3272 | UDP-Glycosyltransferase superfamily protein | −3.56 |
| leaf | Glyma.17G036900 | 3019 | serine carboxypeptidase-like 33 | −3.56 |
| leaf | Glyma.06G088400 | 1273 | Protein kinase family protein with leucine-rich repeat domain | −3.56 |
| leaf | Glyma.20G151500 | 3521 | ATP sulfurylase 1 | −3.57 |
| leaf | Glyma.11G252300 | 2251 | K-box region and MADS-box transcription factor family protein | −3.57 |
| leaf | Glyma.05G205400 | 1190 | CLAVATA3/ESR-RELATED 14 | −3.58 |
| leaf | Glyma.10G061800 | 1953 | Pathogenesis-related thaumatin superfamily protein | −3.58 |
| leaf | Glyma.06G154200 | 1315 | cation/hydrogen exchanger 15 | −3.58 |
| root | Glyma.13G216200 | 2483 | Glutaredoxin family protein | −3.58 |
| leaf | Glyma.12G084500 | 2291 | Transmembrane amino acid transporter family protein | −3.59 |
| leaf | Glyma.11G137500 | 2174 | laccase 2 | −3.59 |
| leaf | Glyma.01G179400 | 556 | cytochrome P450, family 71, subfamily B, polypeptide 34 | −3.60 |
| leaf | Glyma.18G198800 | 3238 | Protein kinase family protein with leucine-rich repeat domain | −3.60 |
| leaf | Glyma.16G057800 | 2894 | | −3.60 |
| leaf | Glyma.17G086900 | 3052 | | −3.60 |
| leaf | Glyma.12G233400 | 2355 | TRICHOME BIREFRINGENCE-LIKE 41 | −3.61 |
| leaf | Glyma.18G284400 | 3281 | | −3.62 |
| leaf | Glyma.18G129800 | 3219 | | −3.62 |
| leaf | Glyma.07G243700 | 1515 | | −3.62 |
| leaf | Glyma.01G134600 | 535 | homogentisate phytyltransferase 1 | −3.62 |
| root | Glyma.15G096600 | 2765 | Thioredoxin superfamily protein | −3.62 |
| leaf | Glyma.07G256300 | 1522 | Family of unknown function (DUF716) | −3.63 |
| leaf | Glyma.06G189400 | 1332 | Nodulin-like/Major Facilitator Superfamily protein | −3.63 |
| root | Glyma.03G015900 | 787 | BON association protein 2 | −3.64 |
| leaf | Glyma.08G182300 | 1673 | Inositol monophosphatase family protein | −3.64 |
| leaf | Glyma.18G202800 | 3242 | acyl-CoA oxidase 4 | −3.64 |
| leaf | Glyma.09G210400 | 1888 | NB-ARC domain-containing disease resistance protein | −3.64 |
| root | Glyma.13G181000 | 2453 | Aluminium induced protein with YGL and LRDR motifs | −3.64 |
| leaf | Glyma.08G060500 | 1575 | S-locus lectin protein kinase family protein | −3.65 |
| leaf | Glyma.20G248900 | 3561 | Protein phosphatase 2C family protein | −3.65 |
| leaf | Glyma.05G059300 | 1105 | Nucleotide-diphospho-sugar transferases superfamily protein | −3.66 |
| leaf | Glyma.15G268200 | 2851 | | −3.66 |
| leaf | Glyma.14G098100 | 2650 | Chalcone-flavanone isomerase family protein | −3.66 |
| leaf | Glyma.17G189300 | 3112 | Major facilitator superfamily protein | −3.67 |
| leaf | Glyma.08G082400 | 1593 | WRKY DNA-binding protein 28 | −3.67 |
| leaf | Glyma.16G048200 | 2884 | phytosulfokin receptor 1 | −3.67 |
| root | Glyma.13G171400 | 2443 | | −3.68 |
| leaf | Glyma.19G115600 | 3359 | Protein of unknown function (DUF1637) | −3.68 |
| leaf | Glyma.03G042300 | 796 | jasmonic acid carboxyl methyltransferase | −3.69 |
| root | Glyma.15G001300 | 2701 | autoinhibited Ca(2+)-ATPase 9 | −3.70 |
| leaf | Glyma.20G033300 | 3463 | NAC-like, activated by AP3/PI | −3.70 |
| leaf | Glyma.08G338900 | 1757 | UDP-Glycosyltransferase superfamily protein | −3.70 |
| leaf | Glyma.15G177900 | 2813 | Protein kinase superfamily protein | −3.70 |
| leaf | Glyma.06G229900 | 1356 | phosphoenolpyruvate carboxylase 3 | −3.71 |
| leaf | Glyma.08G156700 | 1651 | | −3.71 |
| leaf | Glyma.U038600 | 3579 | lipases; hydrolases, acting on ester bonds | −3.71 |
| leaf | Glyma.01G105600 | 525 | | −3.71 |
| leaf | Glyma.10G043800 | 1946 | | −3.72 |
| leaf | Glyma.14G080500 | 2646 | serine carboxypeptidase-like 40 | −3.73 |
| leaf | Glyma.16G173000 | 2961 | chitinase A | −3.73 |
| leaf | Glyma.13G215000 | 2482 | beta-amylase 3 | −3.73 |
| leaf | Glyma.07G181300 | 1487 | hydroxyproline-rich glycoprotein family protein | −3.73 |
| root | Glyma.11G059100 | 2130 | Reticulan like protein B13 | −3.74 |
| leaf | Glyma.01G011600 | 484 | Mono-/di-acylglycerol lipase, N-terminal; Lipase, class 3 | −3.74 |
| leaf | Glyma.04G121700 | 986 | | −3.75 |
| leaf | Glyma.16G057600 | 2893 | chloride channel B | −3.75 |
| leaf | Glyma.08G091400 | 1601 | glutamate decarboxylase | −3.76 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.01G182400 | 561 | Protein kinase superfamily protein | −3.76 |
| leaf | Glyma.U017900 | 3562 | Protein of unknown function (DUF793) | −3.77 |
| leaf | Glyma.10G184700 | 2015 | Serine protease inhibitor, potato inhibitor I-type family protein | −3.78 |
| root | Glyma.06G154200 | 1315 | cation/hydrogen exchanger 15 | −3.78 |
| leaf | Glyma.04G099200 | 982 | | −3.79 |
| leaf | Glyma.18G038700 | 3174 | plastid movement impaired 2 | −3.79 |
| leaf | Glyma.17G097700 | 3058 | aldehyde dehydrogenase 12A1 | −3.80 |
| leaf | Glyma.02G035500 | 620 | | −3.80 |
| leaf | Glyma.12G024000 | 2264 | Plant neutral invertase family protein | −3.80 |
| leaf | Glyma.17G150100 | 3095 | chloroplast beta-amylase | −3.80 |
| root | Glyma.04G061300 | 960 | WRKY DNA-binding protein 40 | −3.81 |
| leaf | Glyma.04G175900 | 1014 | Nodulin-like/Major Facilitator Superfamily protein | −3.81 |
| leaf | Glyma.02G244000 | 740 | glutamine synthase clone R1 | −3.81 |
| leaf | Glyma.04G245000 | 1053 | Calcium-binding EF-hand family protein | −3.81 |
| leaf | Glyma.19G231800 | 3425 | alpha/beta-Hydrolases superfamily protein | −3.82 |
| leaf | Glyma.08G346600 | 1761 | Plant EC metallothionein-like protein, family 15 | −3.82 |
| leaf | Glyma.06G248900 | 1367 | NAC (No Apical Meristem) domain transcriptional regulator superfamily protein | −3.82 |
| leaf | Glyma.07G083900 | 1446 | Phosphorylase superfamily protein | −3.82 |
| leaf | Glyma.08G306200 | 1741 | PHYTOENE SYNTHASE | −3.82 |
| leaf | Glyma.19G011700 | 3304 | Peroxidase superfamily protein | −3.83 |
| leaf | Glyma.18G085800 | 3204 | UDP-Glycosyltransferase superfamily protein | −3.83 |
| root | Glyma.03G197900 | 874 | NAC domain containing protein 90 | −3.84 |
| leaf | Glyma.13G065400 | 2388 | H(+)-ATPase 11 | −3.84 |
| leaf | Glyma.10G202000 | 2031 | Cysteine proteinases superfamily protein | −3.84 |
| leaf | Glyma.18G199000 | 3239 | Leucine-rich repeat receptor-like protein kinase family protein | −3.85 |
| leaf | Glyma.03G219100 | 888 | Signal transduction histidine kinase | −3.85 |
| root | Glyma.09G091800 | 1824 | | −3.85 |
| leaf | Glyma.11G198500 | 2220 | glutathione S-transferase TAU 19 | −3.86 |
| root | Glyma.10G072400 | 1962 | | −3.86 |
| leaf | Glyma.05G204800 | 1189 | osmotin 34 | −3.87 |
| root | Glyma.08G181100 | 1671 | xylem NAC domain 1 | −3.87 |
| leaf | Glyma.07G240100 | 1512 | Acyl-CoA N-acyltransferases (NAT) superfamily protein | −3.88 |
| leaf | Glyma.06G162200 | 1321 | Clp ATPase | −3.88 |
| leaf | Glyma.12G047800 | 2274 | Transducin/WD40 repeat-like superfamily protein | −3.88 |
| leaf | Glyma.12G207400 | 2338 | Thioredoxin superfamily protein | −3.88 |
| root | Glyma.13G230300 | 2495 | Pollen Ole e 1 allergen and extensin family protein | −3.88 |
| leaf | Glyma.13G036600 | 2375 | RNI-like superfamily protein | −3.89 |
| leaf | Glyma.07G156200 | 1477 | Integrase-type DNA-binding superfamily protein | −3.89 |
| leaf | Glyma.16G164200 | 2947 | Peroxidase superfamily protein | −3.90 |
| leaf | Glyma.13G033400 | 2370 | Protein kinase superfamily protein | −3.90 |
| leaf | Glyma.04G147000 | 998 | EIN3-binding F box protein 1 | −3.90 |
| leaf | Glyma.01G192600 | 580 | LOB domain-containing protein 38 | −3.91 |
| leaf | Glyma.09G155700 | 1862 | plastid movement impaired1 | −3.92 |
| leaf | Glyma.06G072000 | 1267 | | −3.92 |
| leaf | Glyma.06G013300 | 1223 | | −3.93 |
| leaf | Glyma.13G285300 | 2533 | cytochrome P450, family 82, subfamily C, polypeptide 4 | −3.94 |
| leaf | Glyma.13G321900 | 2566 | C2H2-type zinc finger family protein | −3.94 |
| leaf | Glyma.09G132200 | 1844 | beta-hydroxylase 1 | −3.94 |
| leaf | Glyma.01G070500 | 512 | | −3.94 |
| leaf | Glyma.09G145700 | 1856 | phloem protein 2-A13 | −3.95 |
| leaf | Glyma.16G031300 | 2871 | Late embryogenesis abundant protein | −3.95 |
| leaf | Glyma.09G161100 | 1864 | Protein kinase family protein with leucine-rich repeat domain | −3.96 |
| leaf | Glyma.01G112900 | 528 | HXXXD-type acyl-transferase family protein | −3.96 |
| leaf | Glyma.12G072000 | 2283 | LOB domain-containing protein 1 | −3.97 |
| leaf | Glyma.15G232200 | 2839 | sigma factor binding protein 1 | −3.97 |
| leaf | Glyma.05G161400 | 1157 | glutathione S-transferase tau 7 | −3.97 |
| leaf | Glyma.20G118100 | 3494 | Core-2/I-branching beta-1,6-N-acetylglucosaminyltransferase family protein | −3.98 |
| leaf | Glyma.06G142300 | 1305 | response regulator 17 | −3.98 |
| leaf | Glyma.09G005700 | 1776 | WRKY family transcription factor | −3.99 |
| leaf | Glyma.16G032200 | 2872 | ACC synthase 1 | −3.99 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.05G180100 | 1168 | acyl-CoA oxidase 2 | −3.99 |
| leaf | Glyma.20G183100 | 3535 | FAD-dependent oxidoreductase family protein | −3.99 |
| leaf | Glyma.01G175500 | 551 | Cytochrome P450 superfamily protein | −4.00 |
| leaf | Glyma.13G032600 | 2367 | Protein kinase superfamily protein | −4.00 |
| leaf | Glyma.08G070300 | 1582 | arabinogalactan protein 1 | −4.01 |
| leaf | Glyma.13G202600 | 2470 | Expressed protein | −4.01 |
| leaf | Glyma.13G326800 | 2568 | Galactose oxidase/kelch repeat superfamily protein | −4.01 |
| leaf | Glyma.03G129100 | 829 | pyrroline-5-carboxylate (P5C) reductase | −4.02 |
| leaf | Glyma.02G129500 | 683 | ATPase E1-E2 type family protein/haloacid dehalogenase-like hydrolase family protein | −4.02 |
| leaf | Glyma.04G137100 | 993 | | −4.02 |
| root | Glyma.17G092800 | 3054 | Gibberellin-regulated family protein | −4.02 |
| leaf | Glyma.13G201300 | 2469 | Dehydrin family protein | −4.03 |
| leaf | Glyma.10G192900 | 2022 | glutathione S-transferase TAU 15 | −4.03 |
| leaf | Glyma.02G002100 | 609 | calmodulin 8 | −4.03 |
| root | Glyma.02G110600 | 676 | EXS (ERD1/XPR1/SYG1) family protein | −4.06 |
| leaf | Glyma.19G157900 | 3377 | | −4.06 |
| leaf | Glyma.13G278000 | 2529 | low-molecular-weight cysteine-rich 66 | −4.06 |
| leaf | Glyma.02G234300 | 735 | RING/U-box superfamily protein with ARM repeat domain | −4.06 |
| leaf | Glyma.11G170000 | 2191 | mitogen-activated protein kinase kinase kinase 14 | −4.07 |
| leaf | Glyma.07G076200 | 1441 | BON association protein 2 | −4.07 |
| root | Glyma.13G150100 | 2433 | SAUR-like auxin-responsive protein family | −4.07 |
| leaf | Glyma.06G260800 | 1369 | Auxin-responsive GH3 family protein | −4.08 |
| leaf | Glyma.02G289300 | 765 | Ras-related small GTP-binding family protein | −4.09 |
| leaf | Glyma.15G072400 | 2753 | Aluminium induced protein with YGL and LRDR motifs | −4.09 |
| leaf | Glyma.19G132900 | 3364 | Patatin-like phospholipase family protein | −4.09 |
| leaf | Glyma.02G086500 | 651 | Cyclin family protein | −4.09 |
| leaf | Glyma.09G238100 | 1907 | Transmembrane amino acid transporter family protein | −4.10 |
| leaf | Glyma.11G220300 | 2230 | Eukaryotic aspartyl protease family protein | −4.10 |
| leaf | Glyma.20G133200 | 3506 | salt tolerance zinc finger | −4.10 |
| leaf | Glyma.01G137500 | 536 | SAUR-like auxin-responsive protein family | −4.10 |
| root | Glyma.08G079700 | 1590 | | −4.10 |
| leaf | Glyma.09G216800 | 1893 | Pectinacetylesterase family protein | −4.11 |
| leaf | Glyma.12G211300 | 2341 | Protein of unknown function (DUF688) | −4.12 |
| leaf | Glyma.02G190000 | 708 | Patatin-like phospholipase family protein | −4.13 |
| leaf | Glyma.05G067800 | 1107 | Protein kinase superfamily protein | −4.13 |
| leaf | Glyma.16G078900 | 2905 | Protein kinase family protein with leucine-rich repeat domain | −4.13 |
| leaf | Glyma.15G203500 | 2825 | cytochrome P450, family 82, subfamily C, polypeptide 4 | −4.14 |
| leaf | Glyma.19G229400 | 3424 | Calmodulin-binding protein | −4.14 |
| leaf | Glyma.08G254200 | 1722 | Transmembrane amino acid transporter family protein | −4.16 |
| leaf | Glyma.09G116300 | 1831 | Protein kinase superfamily protein | −4.16 |
| leaf | Glyma.05G030400 | 1086 | Major facilitator superfamily protein | −4.16 |
| root | Glyma.01G139900 | 537 | glycoprotease 1 | −4.17 |
| leaf | Glyma.11G015100 | 2089 | hydroxysteroid dehydrogenase 5 | −4.17 |
| leaf | Glyma.10G130500 | 1975 | Ran BP2/NZF zinc finger-like superfamily protein | −4.17 |
| leaf | Glyma.19G257400 | 3443 | myb domain protein 4 | −4.17 |
| leaf | Glyma.19G018700 | 3307 | AAA-ATPase 1 | −4.18 |
| leaf | Glyma.02G131300 | 687 | inflorescence deficient in abscission (IDA)-like 1 | −4.18 |
| leaf | Glyma.04G061300 | 960 | WRKY DNA-binding protein 40 | −4.18 |
| leaf | Glyma.20G113000 | 3492 | Major facilitator superfamily protein | −4.18 |
| leaf | Glyma.08G244800 | 1719 | UDP-Glycosyltransferase superfamily protein | −4.18 |
| leaf | Glyma.20G130000 | 3502 | Plant basic secretory protein (BSP) family protein | −4.18 |
| leaf | Glyma.05G052800 | 1104 | Protein of unknown function (DUF1442) | −4.19 |
| leaf | Glyma.08G140600 | 1644 | ferulic acid 5-hydroxylase 1 | −4.20 |
| leaf | Glyma.15G143700 | 2800 | beta-xylosidase 1 | −4.20 |
| leaf | Glyma.08G307300 | 1743 | receptor-like protein kinase 1 | −4.20 |
| leaf | Glyma.04G217400 | 1036 | Integrase-type DNA-binding superfamily protein | −4.21 |
| leaf | Glyma.08G173400 | 1667 | NAC domain containing protein 1 | −4.21 |
| leaf | Glyma.07G139700 | 1467 | glutathione S-transferase TAU 8 | −4.22 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.10G187000 | 2017 | Integrase-type DNA-binding superfamily protein | −4.23 |
| leaf | Glyma.14G011800 | 2611 | RING/U-box superfamily protein | −4.23 |
| leaf | Glyma.04G127100 | 990 | cysteine-rich RLK (RECEPTOR-like protein kinase) 10 | −4.23 |
| leaf | Glyma.04G044800 | 947 | LOB domain-containing protein 39 | −4.23 |
| leaf | Glyma.19G245400 | 3434 | pathogenesis-related 4 | −4.24 |
| leaf | Glyma.19G018600 | 3306 | AAA-ATPase 1 | −4.24 |
| leaf | Glyma.01G019200 | 485 | phosphoenolpyruvate carboxykinase 1 | −4.24 |
| leaf | Glyma.02G260200 | 747 | Transmembrane amino acid transporter family protein | −4.24 |
| leaf | Glyma.16G054400 | 2892 | WRKY DNA-binding protein 75 | −4.24 |
| leaf | Glyma.04G218700 | 1038 | WRKY DNA-binding protein 51 | −4.24 |
| leaf | Glyma.04G199300 | 1026 | Protein kinase superfamily protein | −4.25 |
| leaf | Glyma.15G012000 | 2710 | pleiotropic drug resistance 12 | −4.25 |
| leaf | Glyma.09G138300 | 1851 | *Arabidopsis thaliana* protein of unknown function (DUF821) | −4.25 |
| leaf | Glyma.02G100300 | 668 | Protein kinase superfamily protein | −4.26 |
| leaf | Glyma.06G052800 | 1254 | IQ-domain 6 | −4.27 |
| leaf | Glyma.17G037500 | 3020 | myb domain protein 108 | −4.27 |
| leaf | Glyma.19G033500 | 3322 | COBRA-like extracellular glycosyl-phosphatidyl inositol-anchored protein family | −4.27 |
| leaf | Glyma.20G129900 | 3501 | Plant basic secretory protein (BSP) family protein | −4.29 |
| leaf | Glyma.16G146700 | 2935 | phosphate transporter 3; 1 | −4.29 |
| leaf | Glyma.04G028100 | 931 | Integrase-type DNA-binding superfamily protein | −4.31 |
| leaf | Glyma.11G153000 | 2187 | disease resistance protein (TIR-NBS-LRR class), putative | −4.33 |
| leaf | Glyma.08G062700 | 1578 | BAK1-interacting receptor-like kinase 1 | −4.34 |
| leaf | Glyma.15G170500 | 2807 | basic helix-loop-helix (bHLH) DNA-binding family protein | −4.36 |
| leaf | Glyma.18G056600 | 3182 | WRKY DNA-binding protein 33 | −4.36 |
| leaf | Glyma.10G257900 | 2068 | zinc-finger protein 1 | −4.37 |
| leaf | Glyma.06G017400 | 1226 | Domain of unknown function (DUF23) | −4.37 |
| leaf | Glyma.10G019000 | 1932 | multidrug resistance-associated protein 4 | −4.38 |
| root | Glyma.16G207500 | 2988 | Peroxidase superfamily protein | −4.38 |
| leaf | Glyma.17G023000 | 3007 | Uncharacterised protein family (UPF0497) | −4.39 |
| leaf | Glyma.03G168900 | 851 | RmlC-like cupins superfamily protein | −4.39 |
| leaf | Glyma.04G123800 | 987 | alternative oxidase 1A | −4.41 |
| leaf | Glyma.13G193800 | 2467 | sigma factor binding protein 1 | −4.41 |
| leaf | Glyma.09G029800 | 1787 | WRKY DNA-binding protein 14 | −4.42 |
| leaf | Glyma.02G258700 | 746 | | −4.42 |
| leaf | Glyma.02G128000 | 680 | Adenosylmethionine decarboxylase family protein | −4.42 |
| leaf | Glyma.01G053800 | 510 | WRKY DNA-binding protein 3 | −4.42 |
| leaf | Glyma.01G190600 | 577 | Auxin-responsive GH3 family protein | −4.44 |
| leaf | Glyma.15G211500 | 2829 | Kunitz family trypsin and protease inhibitor protein | −4.46 |
| leaf | Glyma.09G123900 | 1834 | | −4.47 |
| leaf | Glyma.12G049300 | 2275 | | −4.47 |
| leaf | Glyma.01G004200 | 480 | S-adenosyl-L-methionine-dependent methyltransferases superfamily protein | −4.50 |
| leaf | Glyma.13G208000 | 2472 | Eukaryotic aspartyl protease family protein | −4.52 |
| leaf | Glyma.09G135600 | 1846 | | −4.52 |
| leaf | Glyma.03G040400 | 794 | lipid transfer protein 1 | −4.53 |
| leaf | Glyma.18G096700 | 3206 | | −4.54 |
| leaf | Glyma.20G205800 | 3541 | Serine protease inhibitor, potato inhibitor I-type family protein | −4.55 |
| leaf | Glyma.04G035000 | 934 | allene oxide synthase | −4.55 |
| leaf | Glyma.13G100000 | 2411 | OSBP(oxysterol binding protein)-related protein 4B | −4.55 |
| leaf | Glyma.15G257700 | 2848 | NAC (No Apical Meristem) domain transcriptional regulator superfamily protein | −4.56 |
| leaf | Glyma.18G004200 | 3155 | MAC/Perforin domain-containing protein | −4.57 |
| leaf | Glyma.09G055600 | 1801 | heavy metal atpase 2 | −4.57 |
| leaf | Glyma.16G127700 | 2925 | Chaperone DnaJ-domain superfamily protein | −4.58 |
| leaf | Glyma.03G078200 | 812 | HXXXD-type acyl-transferase family protein | −4.60 |
| leaf | Glyma.07G110000 | 1455 | Integrase-type DNA-binding superfamily protein | −4.60 |
| leaf | Glyma.20G134000 | 3507 | | −4.63 |
| leaf | Glyma.U020900 | 3568 | LOB domain-containing protein 1 | −4.65 |

TABLE 8D-continued

Genes that are significantly up- or down- regulated in soybean plants grown from seeds treated with Strain C but that are not found to be significantly up- or down- regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.02G018800 | 616 | polyamine oxidase 1 | −4.67 |
| leaf | Glyma.10G184600 | 2014 | Serine protease inhibitor, potato inhibitor I-type family protein | −4.68 |
| leaf | Glyma.04G040000 | 940 | HXXXD-type acyl-transferase family protein | −4.69 |
| leaf | Glyma.01G227900 | 599 | hydroxysteroid dehydrogenase 5 | −4.70 |
| leaf | Glyma.07G139800 | 1468 | glutathione S-transferase TAU 8 | −4.71 |
| leaf | Glyma.13G208100 | 2473 | Eukaryotic aspartyl protease family protein | −4.72 |
| leaf | Glyma.15G110300 | 2779 | WRKY family transcription factor | −4.72 |
| leaf | Glyma.13G097900 | 2409 | H(+)-ATPase 2 | −4.72 |
| leaf | Glyma.13G056100 | 2383 | HXXXD-type acyl-transferase family protein | −4.72 |
| leaf | Glyma.08G177300 | 1669 | GTP cyclohydrolase II | −4.73 |
| leaf | Glyma.03G143700 | 840 | cytochrome P450, family 93, subfamily D, polypeptide 1 | −4.73 |
| leaf | Glyma.08G327200 | 1749 | cytochrome P450, family 71, subfamily B, polypeptide 23 | −4.74 |
| leaf | Glyma.19G210900 | 3405 | SPX (SYG1/Pho81/XPR1) domain-containing protein | −4.74 |
| root | Glyma.02G208600 | 712 | Protein of unknown function (DUF1637) | −4.74 |
| leaf | Glyma.03G157800 | 845 | calmodulin-like 11 | −4.75 |
| leaf | Glyma.02G283500 | 758 | HXXXD-type acyl-transferase family protein | −4.75 |
| leaf | Glyma.13G221700 | 2485 | | −4.76 |
| leaf | Glyma.15G115200 | 2783 | tonoplast dicarboxylate transporter | −4.76 |
| leaf | Glyma.10G130400 | 1974 | Ran BP2/NZF zinc finger-like superfamily protein | −4.77 |
| root | Glyma.20G200900 | 3540 | seed gene 1 | −4.77 |
| leaf | Glyma.10G239700 | 2056 | peptidoglycan-binding LysM domain-containing protein | −4.78 |
| leaf | Glyma.06G220800 | 1348 | blue-copper-binding protein | −4.78 |
| leaf | Glyma.07G250600 | 1518 | Glutaredoxin family protein | −4.79 |
| leaf | Glyma.17G118300 | 3075 | K+ transporter 1 | −4.81 |
| leaf | Glyma.05G234600 | 1209 | myb domain protein 116 | −4.82 |
| leaf | Glyma.07G188800 | 1491 | S-locus lectin protein kinase family protein | −4.82 |
| leaf | Glyma.19G137400 | 3367 | Glycosyltransferase family 61 protein | −4.83 |
| leaf | Glyma.09G073600 | 1816 | sucrose synthase 4 | −4.85 |
| leaf | Glyma.08G172300 | 1665 | | −4.88 |
| leaf | Glyma.13G032000 | 2365 | Protein kinase superfamily protein | −4.90 |
| leaf | Glyma.13G277800 | 2528 | Dynein light chain type 1 family protein | −4.91 |
| leaf | Glyma.11G180800 | 2201 | NAD(P)-binding Rossmann-fold superfamily protein | −4.94 |
| leaf | Glyma.13G302500 | 2548 | HXXXD-type acyl-transferase family protein | −4.95 |
| leaf | Glyma.04G097900 | 980 | MATE efflux family protein | −4.95 |
| leaf | Glyma.12G173500 | 2319 | Galactose oxidase/kelch repeat superfamily protein | −4.96 |
| root | Glyma.18G242400 | 3257 | RING/FYVE/PHD zinc finger superfamily protein | −4.97 |
| root | Glyma.06G062000 | 1263 | | −4.97 |
| leaf | Glyma.12G007300 | 2254 | Leucine-rich repeat receptor-like protein kinase family protein | −4.98 |
| leaf | Glyma.13G091100 | 2400 | nodulin MtN21/EamA-like transporter family protein | −4.98 |
| leaf | Glyma.05G139500 | 1145 | Protein kinase superfamily protein | −4.99 |
| leaf | Glyma.19G264200 | 3449 | myb domain protein 78 | −5.00 |
| leaf | Glyma.02G094500 | 660 | C2H2 and C2HC zinc fingers superfamily protein | −5.01 |
| leaf | Glyma.11G129300 | 2167 | beta glucosidase 15 | −5.02 |
| leaf | Glyma.06G235600 | 1360 | | −5.05 |
| leaf | Glyma.08G307300 | 1742 | receptor-like protein kinase 1 | −5.06 |
| leaf | Glyma.10G257200 | 2067 | | −5.07 |
| leaf | Glyma.11G143100 | 2178 | tonoplast intrinsic protein 1; 3 | −5.09 |
| leaf | Glyma.15G223900 | 2834 | 12-oxophytodienoate reductase 2 | −5.09 |
| leaf | Glyma.13G125800 | 2423 | Vps51/Vps67 family (components of vesicular transport) protein | −5.09 |
| leaf | Glyma.03G263000 | 917 | RING/U-box superfamily protein | −5.12 |
| leaf | Glyma.01G097400 | 523 | phosphoenolpyruvate carboxykinase 1 | −5.12 |
| leaf | Glyma.11G218400 | 2228 | | −5.15 |
| leaf | Glyma.02G158700 | 702 | dihydroflavonol 4-reductase | −5.15 |
| root | Glyma.20G191800 | 3538 | Peroxidase superfamily protein | −5.16 |
| leaf | Glyma.12G098900 | 2299 | aconitase 3 | −5.16 |
| leaf | Glyma.14G178600 | 2676 | 2-oxoglutarate (2OG) and Fe(II)-dependent oxygenase superfamily protein | −5.16 |
| leaf | Glyma.02G308600 | 778 | Protein kinase superfamily protein | −5.20 |
| leaf | Glyma.05G013700 | 1073 | | −5.21 |

TABLE 8D-continued

Genes that are significantly up- or down- regulated in soybean plants grown from seeds treated with Strain C but that are not found to be significantly up- or down- regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.03G171500 | 853 | cation/H+ exchanger 20 | −5.21 |
| leaf | Glyma.15G226000 | 2837 | Protein of unknown function, DUF584 | −5.21 |
| leaf | Glyma.16G051300 | 2888 | Esterase/lipase/thioesterase family protein | −5.22 |
| leaf | Glyma.04G199400 | 1027 | | −5.26 |
| leaf | Glyma.14G222400 | 2699 | | −5.29 |
| leaf | Glyma.09G064200 | 1810 | basic helix-loop-helix (bHLH) DNA-binding family protein | −5.30 |
| leaf | Glyma.06G270400 | 1372 | | −5.30 |
| leaf | Glyma.02G194200 | 709 | | −5.30 |
| leaf | Glyma.04G062600 | 961 | C2H2 and C2HC zinc fingers superfamily protein | −5.30 |
| leaf | Glyma.02G072200 | 639 | glutamate dehydrogenase 3 | −5.31 |
| leaf | Glyma.04G236900 | 1049 | NADH-dependent glutamate synthase 1 | −5.31 |
| leaf | Glyma.11G105800 | 2158 | Chaperone DnaJ-domain superfamily protein | −5.31 |
| leaf | Glyma.14G195300 | 2685 | mitogen-activated protein kinase kinase kinase 14 | −5.32 |
| leaf | Glyma.02G061600 | 632 | Thioredoxin superfamily protein | −5.36 |
| leaf | Glyma.07G168600 | 1481 | nudix hydrolase homolog 17 | −5.38 |
| leaf | Glyma.U027400 | 3572 | laccase 7 | −5.40 |
| root | Glyma.05G112000 | 1128 | Late embryogenesis abundant protein, group 1 protein | −5.41 |
| leaf | Glyma.06G060100 | 1261 | Peroxidase superfamily protein | −5.43 |
| leaf | Glyma.14G168100 | 2668 | structural constituent of ribosome | −5.45 |
| leaf | Glyma.17G042200 | 3026 | polyubiquitin 10 | −5.46 |
| leaf | Glyma.12G149100 | 2312 | NAC (No Apical Meristem) domain transcriptional regulator superfamily protein | −5.48 |
| leaf | Glyma.11G123800 | 2164 | | −5.51 |
| leaf | Glyma.13G076200 | 2394 | disease resistance protein (TIR-NBS-LRR class), putative | −5.53 |
| leaf | Glyma.12G100500 | 2301 | isocitrate lyase | −5.55 |
| root | Glyma.05G223400 | 1199 | S-adenosyl-L-methionine-dependent methyltransferases superfamily protein | −5.56 |
| leaf | Glyma.05G224500 | 1200 | myo-inositol oxygenase 4 | −5.57 |
| leaf | Glyma.04G249600 | 1056 | Plant protein of unknown function (DUF869) | −5.57 |
| leaf | Glyma.02G088400 | 653 | Nodulin MtN3 family protein | −5.63 |
| leaf | Glyma.05G126800 | 1139 | | −5.65 |
| leaf | Glyma.13G365800 | 2597 | Cystathionine beta-synthase (CBS) protein | −5.68 |
| leaf | Glyma.15G252200 | 2844 | glutathione S-transferase TAU 19 | −5.71 |
| leaf | Glyma.19G175200 | 3383 | exocyst subunit exo70 family protein H4 | −5.73 |
| leaf | Glyma.17G165300 | 3104 | Auxin-responsive GH3 family protein | −5.73 |
| leaf | Glyma.08G235400 | 1712 | kunitz trypsin inhibitor 1 | −5.78 |
| leaf | Glyma.16G167100 | 2957 | | −5.81 |
| leaf | Glyma.01G036000 | 502 | UDP-glucosyl transferase 74B1 | −5.89 |
| root | Glyma.14G209000 | 2693 | oxidative stress 3 | −5.89 |
| leaf | Glyma.13G186200 | 2462 | 12-oxophytodienoate reductase 2 | −5.91 |
| leaf | Glyma.19G233900 | 3426 | respiratory burst oxidase homolog B | −5.91 |
| leaf | Glyma.06G239500 | 1362 | UDP-glucosyl transferase 72E1 | −5.92 |
| leaf | Glyma.11G051800 | 2121 | cytochrome P450, family 81, subfamily D, polypeptide 3 | −5.95 |
| leaf | Glyma.10G064400 | 1955 | embryonic cell protein 63 | −6.01 |
| leaf | Glyma.19G227800 | 3420 | galactinol synthase 2 | −6.07 |
| root | Glyma.20G175800 | 3533 | GAST1 protein homolog 3 | −6.12 |
| leaf | Glyma.15G071300 | 2752 | Aluminium induced protein with YGL and LRDR motifs | −6.25 |
| leaf | Glyma.07G056800 | 1433 | alpha/beta-Hydrolases superfamily protein | −6.26 |
| leaf | Glyma.09G032100 | 1790 | myb domain protein 78 | −6.28 |
| leaf | Glyma.03G168000 | 849 | pleiotropic drug resistance 12 | −6.29 |
| leaf | Glyma.12G076600 | 2285 | glycosyltransferase family protein 2 | −6.40 |
| leaf | Glyma.10G169700 | 1998 | phloem protein 2-B2 | −6.41 |
| leaf | Glyma.09G115200 | 1829 | Core-2/I-branching beta-1,6-N-acetylglucosaminyltransferase family protein | −6.49 |
| leaf | Glyma.08G235300 | 1710 | Kunitz family trypsin and protease inhibitor protein | −6.54 |
| leaf | Glyma.13G270100 | 2520 | D-mannose binding lectin protein with Apple-like carbohydrate-binding domain | −6.55 |
| leaf | Glyma.04G049200 | 951 | branched-chain amino acid transaminase 2 | −6.67 |
| leaf | Glyma.13G181000 | 2453 | Aluminium induced protein with YGL and LRDR motifs | −6.69 |
| leaf | Glyma.10G245300 | 2059 | Acyl-CoA N-acyltransferases (NAT) superfamily protein | −6.70 |
| leaf | Glyma.03G258700 | 911 | myb domain protein 4 | −6.76 |

TABLE 8D-continued

Genes that are significantly up- or down- regulated in soybean plants grown from seeds treated with Strain C but that are not found to be significantly up- or down-regulated in soybean plants grown from seeds treated with either Strain A or Strain B. Fold change is expressed as Strain C versus formulation control.

| Tissue | GeneName | SEQ ID | Gene Description | FoldChange |
|---|---|---|---|---|
| leaf | Glyma.02G080200 | 642 | Integrase-type DNA-binding superfamily protein | −6.82 |
| leaf | Glyma.15G007300 | 2706 | Cystathionine beta-synthase (CBS) protein | −6.86 |
| leaf | Glyma.11G214000 | 2226 | ARM repeat superfamily protein | −6.89 |
| leaf | Glyma.09G173300 | 1868 | | −6.94 |
| leaf | Glyma.11G184100 | 2203 | NAD+ ADP-ribosyltransferases; NAD+ ADP-ribosyltransferases | −6.99 |
| leaf | Glyma.20G139200 | 3508 | cysteine-rich RLK (RECEPTOR-like protein kinase) 29 | −7.02 |
| leaf | Glyma.02G302400 | 769 | RING/U-box superfamily protein | −7.05 |
| leaf | Glyma.19G076800 | 3338 | lysine histidine transporter 1 | −7.09 |
| leaf | Glyma.10G237100 | 2052 | | −7.20 |
| leaf | Glyma.13G109800 | 2414 | oxophytodienoate-reductase 3 | −7.26 |
| leaf | Glyma.14G051900 | 2630 | | −7.76 |
| leaf | Glyma.13G291800 | 2538 | late embryogenesis abundant domain-containing protein/LEA domain-containing protein | −8.02 |
| leaf | Glyma.15G024600 | 2717 | Glycosyl hydrolases family 32 protein | −8.16 |
| leaf | Glyma.15G071000 | 2750 | | −8.31 |
| leaf | Glyma.05G248100 | 1217 | alpha/beta-Hydrolases superfamily protein | −8.41 |
| leaf | Glyma.01G021000 | 488 | elicitor-activated gene 3-2 | −8.55 |
| leaf | Glyma.07G220000 | 1505 | Glycosyl hydrolase superfamily protein | −8.62 |
| leaf | Glyma.18G121000 | 3213 | | −9.19 |
| leaf | Glyma.04G070000 | 965 | | −9.23 |
| leaf | Glyma.18G231500 | 3253 | | −9.41 |
| leaf | Glyma.U020300 | 3566 | RmlC-like cupins superfamily protein | −9.48 |
| leaf | Glyma.10G046000 | 1949 | exocyst subunit exo70 family protein H4 | −9.54 |
| leaf | Glyma.17G033300 | 3016 | Acyl-CoA N-acyltransferases (NAT) superfamily protein | −9.85 |
| leaf | Glyma.12G223500 | 2352 | Dynein light chain type 1 family protein | −9.99 |
| leaf | Glyma.14G145800 | 2662 | Regulator of chromosome condensation (RCC1) family protein | −10.02 |
| leaf | Glyma.17G135100 | 3083 | Protein of unknown function (DUF1442) | −10.16 |
| leaf | Glyma.13G179200 | 2451 | Protein of unknown function (DUF506) | −10.66 |
| leaf | Glyma.06G062000 | 1263 | | −10.69 |
| leaf | Glyma.08G330000 | 1755 | | −11.05 |
| leaf | Glyma.08G042100 | 1560 | myb domain protein 62 | −11.30 |
| leaf | Glyma.06G050100 | 1250 | branched-chain amino acid transaminase 2 | −15.00 |

TABLE 8E

Genes that are up- or down- regulated at least 5 fold higher or lower in the beneficial *Streptomyces* strain Strain C as compared to the control *Streptomyces* strain Strain A.

| Tissue | StrainC/StrainA | GeneName | SEQ ID | Gene Description |
|---|---|---|---|---|
| Leaf | 40.03 | Glyma.01G178800 | 552 | PQ-loop repeat family protein/transmembrane family protein |
| Leaf | 26.97 | Glyma.03G113200 | 818 | NAD(P)-binding Rossmann-fold superfamily protein |
| Root | 23.37 | Glyma.05G051400 | 1102 | Subtilase family protein |
| Leaf | 21.49 | Glyma.08G131300 | 1630 | senescence associated gene 18 |
| Root | 19.80 | Glyma.05G246100 | 1213 | beta-6 tubulin |
| Leaf | 19.61 | Glyma.13G183200 | 2456 | |
| Root | 18.09 | Glyma.02G235300 | 736 | cytochrome P450, family 71, subfamily A, polypeptide 19 |
| Root | 17.53 | Glyma.20G056200 | 3471 | serine carboxypeptidase-like 40 |
| Leaf | 15.55 | Glyma.06G028300 | 1234 | Integrase-type DNA-binding superfamily protein |
| Leaf | 15.47 | Glyma.06G307000 | 1383 | small and basic intrinsic protein 1A |
| Leaf | 15.40 | Glyma.15G186100 | 2817 | Cytidine/deoxycytidylate deaminase family protein |
| Leaf | 15.10 | Glyma.16G165200 | 2950 | light-harvesting chlorophyll-protein complex II subunit B1 |
| Root | 14.80 | Glyma.12G217200 | 2344 | nuclear factor Y, subunit C4 |
| Leaf | 14.73 | Glyma.02G055900 | 628 | RAD-like 6 |
| Leaf | 14.64 | Glyma.15G057600 | 2736 | |
| Leaf | 14.03 | Glyma.02G215700 | 719 | matrix metalloproteinase |
| Leaf | 13.72 | Glyma.03G252700 | 904 | GDSL-like Lipase/Acylhydrolase superfamily protein |
| Leaf | 13.71 | Glyma.17G115900 | 3073 | Lactoylglutathione lyase/glyoxalase I family protein |
| Root | 13.68 | Glyma.09G280500 | 1920 | UDP-glucosyl transferase 73B5 |
| Leaf | 13.51 | Glyma.06G050100 | 1250 | branched-chain amino acid transaminase 2 |
| Root | 13.47 | Glyma.11G238500 | 2242 | slufate transporter 2; 1 |
| Root | 13.41 | Glyma.09G245900 | 1909 | Uridine diphosphate glycosyltransferase 74E2 |

TABLE 8E-continued

Genes that are up- or down- regulated at least 5 fold higher or lower in the beneficial *Streptomyces* strain Strain C as compared to the control *Streptomyces* strain Strain A.

| Tissue | StrainC/ StrainA | GeneName | SEQ ID | Gene Description |
|---|---|---|---|---|
| Leaf | 13.21 | Glyma.19G033900 | 3323 | brassinosteroid-6-oxidase 2 |
| Leaf | 13.14 | Glyma.03G234500 | 894 | alpha/beta-Hydrolases superfamily protein |
| Root | 13.07 | Glyma.19G251500 | 3438 | Subtilase family protein |
| Leaf | 12.98 | Glyma.10G168200 | 1996 | ammonium transporter 1; 2 |
| Leaf | 12.93 | Glyma.06G043000 | 1247 | N-terminal nucleophile aminohydrolases (Ntn hydrolases) superfamily protein |
| Leaf | 12.91 | Glyma.07G038500 | 1423 | germin-like protein 1 |
| Root | 12.61 | Glyma.20G129000 | 3499 | SPX domain gene 2 |
| Leaf | 12.36 | Glyma.09G062900 | 1805 | beta-galactosidase 12 |
| Root | 12.13 | Glyma.10G183400 | 2012 | PLAC8 family protein |
| Leaf | 12.04 | Glyma.01G184600 | 563 | Protein of unknown function, DUF547 |
| Root | 11.83 | Glyma.08G054000 | 1564 | beta-6 tubulin |
| Leaf | 11.83 | Glyma.06G123200 | 1293 | nodulin MtN21/EamA-like transporter family protein |
| Root | 11.66 | Glyma.09G129900 | 1840 | CBS domain-containing protein with a domain of unknown function (DUF21) |
| Leaf | 11.63 | Glyma.04G083200 | 973 | tonoplast intrinsic protein 4; 1 |
| Leaf | 11.59 | Glyma.20G065300 | 3475 | Exostosin family protein |
| Root | 11.57 | Glyma.17G073400 | 3046 | early nodulin-like protein 15 |
| Root | 11.53 | Glyma.19G167000 | 3382 | peptide transporter 3 |
| Root | 11.47 | Glyma.09G135900 | 1848 | NAD(P)-binding Rossmann-fold superfamily protein |
| Leaf | 11.45 | Glyma.11G171400 | 2194 | glutamine-dependent asparagine synthase 1 |
| Root | 11.43 | Glyma.03G187400 | 866 | don-glucosyltransferase 1 |
| Root | 11.41 | Glyma.11G223400 | 2232 | Cupredoxin superfamily protein |
| Root | 11.30 | Glyma.18G147800 | 3225 | U-box domain-containing protein kinase family protein |
| Leaf | 11.27 | Glyma.11G170300 | 2192 | glutamine-dependent asparagine synthase 1 |
| Root | 11.27 | Glyma.06G055300 | 1255 | ACT-like protein tyrosine kinase family protein |
| Leaf | 11.18 | Glyma.06G218000 | 1347 | Thioredoxin superfamily protein |
| Root | 11.16 | Glyma.18G000600 | 3150 | PHYTOENE SYNTHASE |
| Root | 11.14 | Glyma.19G157000 | 3375 | Terpenoid cyclases/Protein prenyltransferases superfamily protein |
| Leaf | 10.95 | Glyma.05G007100 | 1065 | carbonic anhydrase 1 |
| Leaf | 10.91 | Glyma.16G165800 | 2954 | light-harvesting chlorophyll-protein complex II subunit B1 |
| Root | 10.51 | Glyma.08G055500 | 1568 | ABC-2 type transporter family protein |
| Leaf | 10.42 | Glyma.05G160900 | 1155 | |
| Root | 10.35 | Glyma.10G177100 | 2005 | FAD-binding Berberine family protein |
| Leaf | 10.21 | Glyma.07G138900 | 1464 | RHO guanyl-nucleotide exchange factor 11 |
| Root | 10.20 | Glyma.05G108500 | 1126 | NAD(P)-binding Rossmann-fold superfamily protein |
| Leaf | 10.15 | Glyma.08G042100 | 1560 | myb domain protein 62 |
| Root | 9.97 | Glyma.02G083200 | 648 | cytochrome P450, family 707, subfamily A, polypeptide 3 |
| Leaf | 9.96 | Glyma.04G065600 | 962 | Bifunctional inhibitor/lipid-transfer protein/seed storage 2S albumin superfamily protein |
| Root | 9.94 | Glyma.06G139500 | 1303 | ATP binding cassette subfamily B19 |
| Leaf | 9.84 | Glyma.14G005500 | 2605 | |
| Leaf | 9.82 | Glyma.02G130500 | 685 | |
| Leaf | 9.81 | Glyma.18G228700 | 3252 | Major Facilitator Superfamily with SPX (SYG1/Pho81/XPR1) domain-containing protein |
| Leaf | 9.78 | Glyma.13G179200 | 2451 | Protein of unknown function (DUF506) |
| Root | 9.77 | Glyma.18G012300 | 3159 | Pectate lyase family protein |
| Leaf | 9.69 | Glyma.16G164800 | 2948 | Integrase-type DNA-binding superfamily protein |
| Root | 9.66 | Glyma.11G101900 | 2155 | ATPase E1-E2 type family protein/haloacid dehalogenase-like hydrolase family protein |
| Root | 9.64 | Glyma.16G180400 | 2970 | Calcium-dependent lipid-binding (CaLB domain) family protein |
| Leaf | 9.61 | Glyma.08G330000 | 1755 | |
| Leaf | 9.56 | Glyma.02G063300 | 634 | methyl esterase 1 |
| Leaf | 9.43 | Glyma.07G023000 | 1416 | NDH-dependent cyclic electron flow 1 |
| Leaf | 9.40 | Glyma.10G015500 | 1928 | |
| Root | 9.30 | Glyma.03G263900 | 918 | GDSL-motif lipase 5 |
| Root | 9.20 | Glyma.05G229600 | 1203 | Transducin/WD40 repeat-like superfamily protein |
| Root | 9.11 | Glyma.03G142000 | 838 | cytochrome P450, family 93, subfamily D, polypeptide 1 |
| Leaf | 9.11 | Glyma.06G062000 | 1263 | |
| Leaf | 9.10 | Glyma.18G061100 | 3188 | glutamine-dependent asparagine synthase 1 |
| Leaf | 9.10 | Glyma.17G135100 | 3083 | Protein of unknown function (DUF1442) |
| Root | 9.09 | Glyma.04G036100 | 937 | Major facilitator superfamily protein |
| Leaf | 9.08 | Glyma.08G015300 | 1538 | plasma membrane intrinsic protein 1; 4 |
| Leaf | 9.05 | Glyma.16G068700 | 2898 | GDSL-like Lipase/Acylhydrolase superfamily protein |
| Root | 8.93 | Glyma.03G007800 | 783 | Peroxidase superfamily protein |
| Leaf | 8.93 | Glyma.13G274900 | 2526 | squamosa promoter-binding protein-like 12 |
| Root | 8.90 | Glyma.16G053000 | 2889 | GRAS family transcription factor |
| Leaf | 8.89 | Glyma.12G223500 | 2352 | Dynein light chain type 1 family protein |
| Leaf | 8.89 | Glyma.14G145800 | 2662 | Regulator of chromosome condensation (RCC1) family protein |
| Leaf | 8.86 | Glyma.20G144800 | 3514 | Haloacid dehalogenase-like hydrolase (HAD) superfamily protein |
| Root | 8.84 | Glyma.20G000800 | 3450 | DNAse I-like superfamily protein |
| Root | 8.80 | Glyma.08G166600 | 1660 | Eukaryotic aspartyl protease family protein |
| Leaf | 8.77 | Glyma.06G132600 | 1300 | Rhodanese/Cell cycle control phosphatase superfamily protein |
| Leaf | 8.73 | Glyma.02G043300 | 624 | GDSL-like Lipase/Acylhydrolase superfamily protein |
| Root | 8.72 | Glyma.10G056200 | 1952 | SAUR-like auxin-responsive protein family |
| Leaf | 8.69 | Glyma.12G088300 | 2293 | NAD+ ADP-ribosyltransferases; NAD+ ADP-ribosyltransferases |
| Leaf | 8.68 | Glyma.17G033300 | 3016 | Acyl-CoA N-acyltransferases (NAT) superfamily protein |
| Root | 8.68 | Glyma.04G126000 | 988 | Protein kinase superfamily protein |
| Leaf | 8.62 | Glyma.17G044300 | 3028 | lysine-ketoglutarate reductase/saccharopine dehydrogenase bifunctional enzyme |

TABLE 8E-continued

Genes that are up- or down- regulated at least 5 fold higher or lower in the beneficial
*Streptomyces* strain Strain C as compared to the control *Streptomyces* strain Strain A.

| Tissue | StrainC/StrainA | GeneName | SEQ ID | Gene Description |
|---|---|---|---|---|
| Leaf | 8.55 | Glyma.18G121000 | 3213 | |
| Leaf | 8.51 | Glyma.15G213600 | 2830 | S-locus lectin protein kinase family protein |
| Leaf | 8.49 | Glyma.01G021000 | 488 | elicitor-activated gene 3-2 |
| Leaf | 8.47 | Glyma.U020300 | 3566 | RmlC-like cupins superfamily protein |
| Root | 8.46 | Glyma.01G073200 | 513 | carotenoid cleavage dioxygenase 7 |
| Leaf | 8.45 | Glyma.05G208300 | 1192 | basic helix-loop-helix (bHLH) DNA-binding superfamily protein |
| Root | 8.44 | Glyma.15G105900 | 2774 | glucose-6-phosphate/phosphate translocator 2 |
| Leaf | 8.40 | Glyma.11G098500 | 2151 | proline-rich protein 4 |
| Leaf | 8.39 | Glyma.17G259500 | 3147 | GDSL-like Lipase/Acylhydrolase superfamily protein |
| Root | 8.38 | Glyma.13G076400 | 2396 | Neutral/alkaline non-lysosomal ceramidase |
| Root | 8.35 | Glyma.01G027100 | 493 | protein kinase family protein/peptidoglycan-binding LysM domain-containing protein |
| Root | 8.33 | Glyma.05G241300 | 1212 | ENTH/ANTH/VHS superfamily protein |
| Leaf | 8.29 | Glyma.04G070000 | 965 | |
| Leaf | 8.27 | Glyma.13G048000 | 2380 | kinase interacting (KIP1-like) family protein |
| Leaf | 8.24 | Glyma.11G098400 | 2149 | |
| Leaf | 8.23 | Glyma.09G258400 | 1913 | |
| Leaf | 8.23 | Glyma.15G118500 | 2785 | Heavy metal transport/detoxification superfamily protein |
| Root | 8.23 | Glyma.02G102700 | 672 | PLC-like phosphodiesterases superfamily protein |
| Leaf | 8.23 | Glyma.05G036800 | 1090 | basic helix-loop-helix (bHLH) DNA-binding superfamily protein |
| Leaf | 8.10 | Glyma.09G139600 | 1853 | CAP160 protein |
| Leaf | 8.09 | Glyma.18G231500 | 3253 | |
| Leaf | 8.08 | Glyma.07G220000 | 1505 | Glycosyl hydrolase superfamily protein |
| Root | 8.08 | Glyma.16G168600 | 2958 | cytochrome P450, family 707, subfamily A, polypeptide 3 |
| Leaf | 8.04 | Glyma.05G082400 | 1111 | Disease resistance protein (CC-NBS-LRR class) family |
| Leaf | 8.03 | Glyma.10G207100 | 2037 | Papain family cysteine protease |
| Root | 8.01 | Glyma.03G187200 | 864 | don-glucosyltransferase 1 |
| Leaf | 8.00 | Glyma.14G031200 | 2622 | PHYTOENE SYNTHASE |
| Leaf | 7.97 | Glyma.02G281400 | 755 | Bifunctional inhibitor/lipid-transfer protein/seed storage 2S albumin superfamily protein |
| Leaf | 7.95 | Glyma.15G071000 | 2750 | |
| Leaf | 7.94 | Glyma.10G046000 | 1949 | exocyst subunit exo70 family protein H4 |
| Leaf | 7.93 | Glyma.02G148200 | 693 | Eukaryotic aspartyl protease family protein |
| Root | 7.92 | Glyma.16G043000 | 2879 | hydroxyproline-rich glycoprotein family protein |
| Leaf | 7.88 | Glyma.05G248100 | 1217 | alpha/beta-Hydrolases superfamily protein |
| Leaf | 7.84 | Glyma.04G222100 | 1040 | expansin A8 |
| Leaf | 7.84 | Glyma.18G011800 | 3157 | photosystem II BY |
| Leaf | 7.84 | Glyma.06G209800 | 1343 | Hydroxyproline-rich glycoprotein family protein |
| Leaf | 7.80 | Glyma.08G138200 | 1637 | myo-inositol-1-phosphate synthase 3 |
| Leaf | 7.79 | Glyma.12G150400 | 2313 | protochlorophyllide oxidoreductase A |
| Root | 7.79 | Glyma.10G169800 | 1999 | Subtilisin-like serine endopeptidase family protein |
| Leaf | 7.77 | Glyma.19G214300 | 3410 | |
| Leaf | 7.77 | Glyma.19G198500 | 3398 | Eukaryotic aspartyl protease family protein |
| Leaf | 7.77 | Glyma.13G115500 | 2419 | lysine-ketoglutarate reductase/saccharopine dehydrogenase bifunctional enzyme |
| Root | 7.70 | Glyma.03G184900 | 862 | Protein of unknown function (DUF1624) |
| Root | 7.70 | Glyma.08G089500 | 1598 | cytochrome P450, family 81, subfamily D, polypeptide 3 |
| Root | 7.70 | Glyma.09G170100 | 1865 | Uncharacterised protein family (UPF0497) |
| Root | 7.64 | Glyma.08G274900 | 1727 | Concanavalin A-like lectin protein kinase family protein |
| Root | 7.63 | Glyma.13G093600 | 2405 | Protein kinase superfamily protein |
| Leaf | 7.57 | Glyma.16G007700 | 2860 | germin-like protein 1 |
| Root | 7.55 | Glyma.08G327200 | 1749 | cytochrome P450, family 71, subfamily B, polypeptide 23 |
| Leaf | 7.55 | Glyma.01G146500 | 540 | RING/U-box superfamily protein |
| Leaf | 7.54 | Glyma.15G206800 | 2826 | Glycosyl hydrolase family protein with chitinase insertion domain |
| Leaf | 7.51 | Glyma.10G168100 | 1994 | ammonium transporter 1; 2 |
| Leaf | 7.50 | Glyma.11G063400 | 2135 | PQ-loop repeat family protein/transmembrane family protein |
| Leaf | 7.50 | Glyma.04G090800 | 977 | |
| Root | 7.49 | Glyma.02G029700 | 618 | |
| Leaf | 7.49 | Glyma.03G125000 | 827 | RAD-like 1 |
| Leaf | 7.48 | Glyma.14G145900 | 2664 | Regulator of chromosome condensation (RCC1) family protein |
| Root | 7.47 | Glyma.12G002600 | 2253 | |
| Leaf | 7.43 | Glyma.11G018000 | 2094 | highly ABA-induced PP2C gene 3 |
| Root | 7.38 | Glyma.19G237800 | 3427 | glutathione synthetase 2 |
| Root | 7.37 | Glyma.01G036400 | 504 | |
| Root | 7.35 | Glyma.16G181400 | 2973 | NAD(P)-binding Rossmann-fold superfamily protein |
| Root | 7.34 | Glyma.02G245600 | 741 | Gibberellin-regulated family protein |
| Leaf | 7.30 | Glyma.10G223200 | 2046 | Integrase-type DNA-binding superfamily protein |
| Root | 7.29 | Glyma.08G297000 | 1736 | Integrase-type DNA-binding superfamily protein |
| Leaf | 7.27 | Glyma.19G007700 | 3297 | carbonic anhydrase 1 |
| Root | 7.26 | Glyma.13G351600 | 2585 | Pyridoxal phosphate phosphatase-related protein |
| Root | 7.25 | Glyma.06G227400 | 1355 | cytochrome P450, family 72, subfamily A, polypeptide 15 |
| Root | 7.21 | Glyma.04G218000 | 1037 | Protein kinase superfamily protein |
| Leaf | 7.21 | Glyma.06G319700 | 1391 | Leucine-rich repeat (LRR) family protein |
| Leaf | 7.20 | Glyma.13G291800 | 2538 | late embryogenesis abundant domain-containing protein/LEA domain-containing protein |
| Leaf | 7.20 | Glyma.11G057600 | 2129 | Protein of unknown function, DUF547 |
| Root | 7.19 | Glyma.03G211700 | 881 | indeterminate(ID)-domain 2 |
| Leaf | 7.17 | Glyma.08G224100 | 1704 | |

TABLE 8E-continued

Genes that are up- or down- regulated at least 5 fold higher or lower in the beneficial
*Streptomyces* strain Strain C as compared to the control *Streptomyces* strain Strain A.

| Tissue | StrainC/ StrainA | GeneName | SEQ ID | Gene Description |
|---|---|---|---|---|
| Root | 7.17 | Glyma.12G087600 | 2292 | Subtilisin-like serine endopeptidase family protein |
| Leaf | 7.16 | Glyma.13G222700 | 2491 | Pentatricopeptide repeat (PPR) superfamily protein |
| Root | 7.15 | Glyma.18G052300 | 3179 | extra-large G-protein 1 |
| Root | 7.15 | Glyma.03G032400 | 791 | SPX domain gene 3 |
| Root | 7.11 | Glyma.06G312600 | 1388 | Protein kinase superfamily protein |
| Leaf | 7.09 | Glyma.16G208300 | 2989 | carboxyesterase 18 |
| Leaf | 7.08 | Glyma.20G210100 | 3544 | Eukaryotic aspartyl protease family protein |
| Root | 7.06 | Glyma.05G229700 | 1205 | Major facilitator superfamily protein |
| Leaf | 7.03 | Glyma.15G024600 | 2717 | Glycosyl hydrolases family 32 protein |
| Leaf | 7.01 | Glyma.12G192900 | 2330 | |
| Root | 7.00 | Glyma.20G213100 | 3547 | FAD-binding Berberine family protein |
| Leaf | 6.96 | Glyma.14G010900 | 2609 | Aldolase superfamily protein |
| Leaf | 6.95 | Glyma.03G113300 | 820 | |
| Root | 6.94 | Glyma.09G188700 | 1872 | sulfate transporter 3; 1 |
| Leaf | 6.94 | Glyma.17G026300 | 3010 | F-box family protein |
| Root | 6.92 | Glyma.07G250800 | 1519 | |
| Leaf | 6.90 | Glyma.04G169600 | 1009 | GAST1 protein homolog 4 |
| Root | 6.89 | Glyma.14G137700 | 2661 | Leucine-rich repeat protein kinase family protein |
| Root | 6.88 | Glyma.12G017100 | 2259 | Polyketide cyclase/dehydrase and lipid transport superfamily protein |
| Root | 6.88 | Glyma.12G161500 | 2317 | Tyrosine transaminase family protein |
| Root | 6.88 | Glyma.20G063100 | 3473 | zinc transporter 1 precursor |
| Root | 6.87 | Glyma.17G202900 | 3118 | O-Glycosyl hydrolases family 17 protein |
| Root | 6.87 | Glyma.05G126200 | 1136 | RmlC-like cupins superfamily protein |
| Root | 6.85 | Glyma.18G289800 | 3286 | Uncharacterised protein family (UPF0497) |
| Root | 6.82 | Glyma.10G197800 | 2024 | OPC-8:0 CoA ligase1 |
| Root | 6.82 | Glyma.01G020000 | 487 | ABC-2 type transporter family protein |
| Leaf | 6.78 | Glyma.05G107600 | 1122 | ACT domain repeat 1 |
| Root | 6.77 | Glyma.10G206800 | 2035 | |
| Leaf | 6.76 | Glyma.06G035900 | 1238 | cytochrome b6f complex subunit (petM), putative |
| Leaf | 6.75 | Glyma.16G173500 | 2962 | SLAC1 homologue 3 |
| Root | 6.74 | Glyma.08G190700 | 1678 | multidrug resistance-associated protein 6 |
| Root | 6.73 | Glyma.12G190900 | 2328 | |
| Root | 6.72 | Glyma.20G044100 | 3467 | alpha/beta-Hydrolases superfamily protein |
| Leaf | 6.71 | Glyma.01G185400 | 571 | Cyclin-dependent kinase inhibitor family protein |
| Root | 6.69 | Glyma.13G177100 | 2449 | |
| Leaf | 6.69 | Glyma.09G236200 | 1906 | expansin A1 |
| Leaf | 6.67 | Glyma.13G240300 | 2502 | Aluminium induced protein with YGL and LRDR motifs |
| Leaf | 6.67 | Glyma.14G209600 | 2694 | AMP-dependent synthetase and ligase family protein |
| Leaf | 6.67 | Glyma.17G226100 | 3127 | Leucine-rich receptor-like protein kinase family protein |
| Leaf | 6.67 | Glyma.17G112000 | 3069 | Calcium-binding EF-hand family protein |
| Root | 6.66 | Glyma.06G321500 | 1393 | FAD-binding Berberine family protein |
| Leaf | 6.66 | Glyma.06G042700 | 1244 | Serine/threonine-protein kinase WNK (With No Lysine)-related |
| Leaf | 6.66 | Glyma.01G207100 | 587 | RING/U-box superfamily protein |
| Root | 6.65 | Glyma.01G025900 | 492 | |
| Root | 6.64 | Glyma.19G196900 | 3395 | NAD(P)-binding Rossmann-fold superfamily protein |
| Leaf | 6.64 | Glyma.10G237100 | 2052 | |
| Leaf | 6.63 | Glyma.17G055600 | 3036 | |
| Leaf | 6.63 | Glyma.13G109800 | 2414 | oxophytodienoate-reductase 3 |
| Leaf | 6.62 | Glyma.01G050100 | 508 | expansin A1 |
| Leaf | 6.62 | Glyma.02G305400 | 775 | photosystem II light harvesting complex gene 2.1 |
| Root | 6.62 | Glyma.16G048800 | 2886 | beta-galactosidase 7 |
| Root | 6.61 | Glyma.18G072900 | 3199 | |
| Leaf | 6.61 | Glyma.16G109300 | 2916 | cytochrome P450, family 707, subfamily A, polypeptide 1 |
| Root | 6.61 | Glyma.02G044300 | 626 | NEP-interacting protein 2 |
| Leaf | 6.61 | Glyma.14G051900 | 2630 | |
| Root | 6.61 | Glyma.02G092600 | 657 | Uncharacterised protein family (UPF0497) |
| Leaf | 6.59 | Glyma.19G093500 | 3342 | |
| Leaf | 6.59 | Glyma.14G186400 | 2679 | |
| Leaf | 6.58 | Glyma.06G109200 | 1282 | nitrate reductase 1 |
| Leaf | 6.58 | Glyma.14G115500 | 2654 | Bifunctional inhibitor/lipid-transfer protein/seed storage 2S albumin superfamily protein |
| Root | 6.58 | Glyma.02G153900 | 699 | indeterminate(ID)-domain 2 |
| Leaf | 6.57 | Glyma.19G250200 | 3436 | Li-tolerant lipase 1 |
| Leaf | 6.57 | Glyma.02G303000 | 772 | Aldolase superfamily protein |
| Leaf | 6.56 | Glyma.08G188500 | 1674 | 2Fe—2S ferredoxin-like superfamily protein |
| Leaf | 6.55 | Glyma.01G225100 | 596 | highly ABA-induced PP2C gene 3 |
| Leaf | 6.55 | Glyma.10G246300 | 2061 | cupin family protein |
| Root | 6.54 | Glyma.08G245600 | 1720 | glycosyl hydrolase family 81 protein |
| Root | 6.53 | Glyma.07G061200 | 1437 | |
| Root | 6.51 | Glyma.14G064400 | 2639 | Subtilase family protein |
| Root | 6.51 | Glyma.03G154700 | 843 | Terpenoid cyclases/Protein prenyltransferases superfamily protein |
| Leaf | 6.49 | Glyma.19G076800 | 3338 | lysine histidine transporter 1 |
| Root | 6.49 | Glyma.06G085100 | 1272 | carotenoid cleavage dioxygenase 1 |
| Leaf | 6.48 | Glyma.12G151300 | 2315 | |
| Leaf | 6.47 | Glyma.09G154700 | 1859 | light harvesting complex of photosystem II 5 |

TABLE 8E-continued

Genes that are up- or down- regulated at least 5 fold higher or lower in the beneficial
*Streptomyces* strain Strain C as compared to the control *Streptomyces* strain Strain A.

| Tissue | StrainC/ StrainA | GeneName | SEQ ID | Gene Description |
|---|---|---|---|---|
| Leaf | 6.47 | Glyma.13G072000 | 2390 | spermidine hydroxycinnamoyl transferase |
| Root | 6.47 | Glyma.13G191600 | 2465 | sulfotransferase 2A |
| Leaf | 6.47 | Glyma.19G030800 | 3317 | HXXXD-type acyl-transferase family protein |
| Leaf | 6.47 | Glyma.13G349300 | 2583 | Glycosyl hydrolases family 32 protein |
| Leaf | 6.46 | Glyma.02G302400 | 769 | RING/U-box superfamily protein |
| Leaf | 6.46 | Glyma.07G154700 | 1476 | |
| Root | 6.44 | Glyma.06G222500 | 1350 | Zinc-binding dehydrogenase family protein |
| Leaf | 6.43 | Glyma.15G063000 | 2741 | basic helix-loop-helix (bHLH) DNA-binding superfamily protein |
| Leaf | 6.43 | Glyma.18G210500 | 3246 | PYRIMIDINE 4 |
| Leaf | 6.42 | Glyma.08G357400 | 1768 | Leucine-rich repeat transmembrane protein kinase family protein |
| Leaf | 6.42 | Glyma.08G074000 | 1585 | light harvesting complex photosystem II subunit 6 |
| Leaf | 6.41 | Glyma.11G194400 | 2213 | BRI1 suppressor 1 (BSU1)-like 2 |
| Root | 6.40 | Glyma.16G075300 | 2902 | RING/U-box superfamily protein |
| Root | 6.39 | Glyma.15G183000 | 2815 | GDSL-motif lipase 5 |
| Root | 6.39 | Glyma.04G154900 | 1001 | Integrase-type DNA-binding superfamily protein |
| Root | 6.39 | Glyma.08G166200 | 1658 | Eukaryotic aspartyl protease family protein |
| Root | 6.38 | Glyma.11G193900 | 2212 | SERINE CARBOXYPEPTIDASE-LIKE 49 |
| Leaf | 6.38 | Glyma.16G151000 | 2939 | PEBP (phosphatidylethanolamine-binding protein) family protein |
| Leaf | 6.38 | Glyma.02G097400 | 665 | Leucine-rich receptor-like protein kinase family protein |
| Leaf | 6.37 | Glyma.11G042200 | 2114 | glycine decarboxylase complex H |
| Root | 6.36 | Glyma.16G121900 | 2920 | NEP-interacting protein 2 |
| Root | 6.36 | Glyma.15G176200 | 2810 | |
| Root | 6.36 | Glyma.13G364400 | 2595 | |
| Root | 6.36 | Glyma.17G103300 | 3063 | Plant protein of unknown function (DUF827) |
| Leaf | 6.34 | Glyma.14G004100 | 2602 | 5\'-AMP-activated protein kinase beta-2 subunit protein |
| Root | 6.34 | Glyma.13G342600 | 2575 | AMP-dependent synthetase and ligase family protein |
| Leaf | 6.34 | Glyma.20G139200 | 3508 | cysteine-rich RLK (RECEPTOR-like protein kinase) 29 |
| Leaf | 6.34 | Glyma.12G219300 | 2348 | light-harvesting chlorophyll B-binding protein 3 |
| Leaf | 6.34 | Glyma.15G007300 | 2706 | Cystathionine beta-synthase (CBS) protein |
| Root | 6.34 | Glyma.06G005800 | 1220 | COBRA-like protein 1 precursor |
| Root | 6.32 | Glyma.18G012700 | 3161 | P-glycoprotein 18 |
| Leaf | 6.31 | Glyma.08G218800 | 1702 | NDH-dependent cyclic electron flow 1 |
| Leaf | 6.29 | Glyma.11G149100 | 2181 | cytokinin oxidase/dehydrogenase 6 |
| Root | 6.28 | Glyma.10G197900 | 2025 | OPC-8:0 CoA ligase1 |
| Leaf | 6.26 | Glyma.07G104300 | 1451 | |
| Leaf | 6.25 | Glyma.11G180700 | 2198 | BRI1-associated receptor kinase |
| Leaf | 6.25 | Glyma.17G092800 | 3054 | Gibberellin-regulated family protein |
| Leaf | 6.24 | Glyma.12G197100 | 2332 | beta-amylase 6 |
| Leaf | 6.23 | Glyma.09G173300 | 1868 | |
| Leaf | 6.22 | Glyma.08G118300 | 1616 | |
| Leaf | 6.22 | Glyma.16G165500 | 2952 | light-harvesting chlorophyll-protein complex II subunit B1 |
| Leaf | 6.22 | Glyma.11G237600 | 2240 | MAR binding filament-like protein 1 |
| Root | 6.22 | Glyma.06G225200 | 1353 | Integrase-type DNA-binding superfamily protein |
| Leaf | 6.21 | Glyma.09G063300 | 1808 | |
| Leaf | 6.20 | Glyma.08G008800 | 1533 | acyl carrier protein 4 |
| Leaf | 6.20 | Glyma.13G221900 | 2487 | serine carboxypeptidase-like 12 |
| Root | 6.19 | Glyma.07G005800 | 1406 | |
| Leaf | 6.19 | Glyma.11G214000 | 2226 | ARM repeat superfamily protein |
| Leaf | 6.18 | Glyma.03G254900 | 907 | GDSL-like Lipase/Acylhydrolase superfamily protein |
| Root | 6.18 | Glyma.15G260600 | 2849 | Eukaryotic aspartyl protease family protein |
| Leaf | 6.17 | Glyma.07G219600 | 1503 | CLAVATA3/ESR-RELATED 17 |
| Leaf | 6.17 | Glyma.08G193500 | 1681 | beta galactosidase 1 |
| Leaf | 6.16 | Glyma.14G031000 | 2620 | glutathione S-transferase PHI 9 |
| Leaf | 6.13 | Glyma.03G258700 | 911 | myb domain protein 4 |
| Leaf | 6.12 | Glyma.10G245300 | 2059 | Acyl-CoA N-acyltransferases (NAT) superfamily protein |
| Leaf | 6.11 | Glyma.03G028000 | 789 | Arginase/deacetylase superfamily protein |
| Root | 6.10 | Glyma.18G125200 | 3217 | Integrase-type DNA-binding superfamily protein |
| Leaf | 6.10 | Glyma.12G076600 | 2285 | glycosyltransferase family protein 2 |
| Leaf | 6.09 | Glyma.06G110400 | 1284 | cold shock domain protein 1 |
| Root | 6.08 | Glyma.08G065500 | 1579 | Concanavalin A-like lectin protein kinase family protein |
| Root | 6.08 | Glyma.09G202400 | 1882 | ABC-2 type transporter family protein |
| Root | 6.07 | Glyma.08G275400 | 1729 | Concanavalin A-like lectin protein kinase family protein |
| Leaf | 6.06 | Glyma.11G184100 | 2203 | NAD+ ADP-ribosyltransferases; NAD+ ADP-ribosyltransferases |
| Leaf | 6.06 | Glyma.09G115200 | 1829 | Core-2/I-branching beta-1,6-N-acetylglucosaminyltransferase family protein |
| Leaf | 6.06 | Glyma.07G197100 | 1496 | Protein of unknown function (DUF506) |
| Leaf | 6.05 | Glyma.13G270600 | 2522 | general regulatory factor 9 |
| Leaf | 6.05 | Glyma.02G080800 | 644 | light-harvesting chlorophyll-protein complex II subunit B1 |
| Root | 6.03 | Glyma.10G036800 | 1942 | phosphate transporter 1; 4 |
| Root | 6.02 | Glyma.08G215300 | 1699 | basic helix-loop-helix (bHLH) DNA-binding superfamily protein |
| Leaf | 6.01 | Glyma.19G024200 | 3310 | expansin A15 |
| Root | 6.00 | Glyma.13G182800 | 2454 | Protein of unknown function (DUF1218) |
| Leaf | 5.99 | Glyma.08G199300 | 1688 | myo-inositol oxygenase 1 |
| Leaf | 5.99 | Glyma.17G012300 | 3004 | SKU5 similar 4 |
| Leaf | 5.99 | Glyma.13G327100 | 2569 | FASCICLIN-like arabinogalactan-protein 11 |

TABLE 8E-continued

Genes that are up- or down- regulated at least 5 fold higher or lower in the beneficial *Streptomyces* strain Strain C as compared to the control *Streptomyces* strain Strain A.

| Tissue | StrainC/ StrainA | GeneName | SEQ ID | Gene Description |
|---|---|---|---|---|
| Root | 5.98 | Glyma.17G127500 | 3079 | RGA-like 1 |
| Root | 5.98 | Glyma.11G099700 | 2153 | serine carboxypeptidase-like 34 |
| Root | 5.98 | Glyma.15G118500 | 2785 | Heavy metal transport/detoxification superfamily protein |
| Leaf | 5.96 | Glyma.04G049200 | 951 | branched-chain amino acid transaminase 2 |
| Leaf | 5.94 | Glyma.17G248700 | 3140 | Protein of unknown function (DUF607) |
| Leaf | 5.93 | Glyma.09G209700 | 1886 | Tetratricopeptide repeat (TPR)-like superfamily protein |
| Root | 5.93 | Glyma.08G037000 | 1552 | Transducin/WD40 repeat-like superfamily protein |
| Root | 5.92 | Glyma.05G175500 | 1165 | GTP cyclohydrolase II |
| Root | 5.92 | Glyma.12G090800 | 2295 | germin-like protein 10 |
| Leaf | 5.91 | Glyma.17G239100 | 3135 | |
| Leaf | 5.90 | Glyma.08G125100 | 1626 | cytochrome P450, family 716, subfamily A, polypeptide 1 |
| Root | 5.90 | Glyma.16G011000 | 2862 | ATP binding cassette subfamily B19 |
| Leaf | 5.89 | Glyma.U018200 | 3563 | responsive to abscisic acid 28 |
| Root | 5.88 | Glyma.08G102100 | 1608 | NAD(P)-binding Rossmann-fold superfamily protein |
| Root | 5.87 | Glyma.13G183500 | 2458 | |
| Leaf | 5.87 | Glyma.20G130300 | 3503 | |
| Leaf | 5.86 | Glyma.10G169700 | 1998 | phloem protein 2-B2 |
| Leaf | 5.86 | Glyma.13G270100 | 2520 | D-mannose binding lectin protein with Apple-like carbohydrate-binding domain |
| Root | 5.85 | Glyma.10G268200 | 2072 | fatty acyl-ACP thioesterases B |
| Root | 5.85 | Glyma.09G262600 | 1916 | NAD(P)-binding Rossmann-fold superfamily protein |
| Leaf | 5.84 | Glyma.05G050100 | 1101 | Glucose-methanol-choline (GMC) oxidoreductase family protein |
| Leaf | 5.84 | Glyma.03G168000 | 849 | pleiotropic drug resistance 12 |
| Leaf | 5.84 | Glyma.09G032100 | 1790 | myb domain protein 78 |
| Leaf | 5.84 | Glyma.13G181000 | 2453 | Aluminium induced protein with YGL and LRDR motifs |
| Leaf | 5.82 | Glyma.06G157000 | 1316 | |
| Root | 5.82 | Glyma.17G196200 | 3116 | Leucine-rich repeat protein kinase family protein |
| Leaf | 5.81 | Glyma.07G181400 | 1488 | |
| Leaf | 5.81 | Glyma.18G289200 | 3285 | |
| Leaf | 5.80 | Glyma.08G235300 | 1710 | Kunitz family trypsin and protease inhibitor protein |
| Leaf | 5.80 | Glyma.12G218900 | 2346 | Dynein light chain type 1 family protein |
| Leaf | 5.79 | Glyma.10G248900 | 2064 | Haloacid dehalogenase-like hydrolase (HAD) superfamily protein |
| Root | 5.79 | Glyma.03G165900 | 848 | peptide transporter 3 |
| Root | 5.78 | Glyma.04G242900 | 1052 | Protein kinase superfamily protein |
| Leaf | 5.77 | Glyma.13G306600 | 2554 | cyclin p2; 1 |
| Leaf | 5.77 | Glyma.13G172100 | 2444 | glutamate receptor 2.7 |
| Leaf | 5.75 | Glyma.08G342100 | 1759 | kunitz trypsin inhibitor 1 |
| Root | 5.75 | Glyma.11G097800 | 2147 | plasma membrane intrinsic protein 1A |
| Root | 5.73 | Glyma.02G101400 | 669 | 2-oxoglutarate (2OG) and Fe(II)-dependent oxygenase superfamily protein |
| Leaf | 5.73 | Glyma.13G231900 | 2497 | |
| Leaf | 5.72 | Glyma.08G140200 | 1643 | alanine: glyoxylate aminotransferase 2 |
| Root | 5.71 | Glyma.17G008900 | 3002 | |
| Leaf | 5.71 | Glyma.04G208700 | 1032 | |
| Root | 5.71 | Glyma.20G047000 | 3469 | Protein kinase protein with adenine nucleotide alpha hydrolases-like domain |
| Leaf | 5.71 | Glyma.11G051800 | 2121 | cytochrome P450, family 81, subfamily D, polypeptide 3 |
| Root | 5.70 | Glyma.10G078500 | 1965 | Putative lysine decarboxylase family protein |
| Leaf | 5.70 | Glyma.10G167800 | 1992 | ammonium transporter 1; 2 |
| Leaf | 5.69 | Glyma.12G032900 | 2268 | Protein kinase protein with adenine nucleotide alpha hydrolases-like domain |
| Root | 5.69 | Glyma.06G194700 | 1337 | |
| Leaf | 5.69 | Glyma.05G126700 | 1138 | |
| Leaf | 5.68 | Glyma.01G036000 | 502 | UDP-glucosyl transferase 74B1 |
| Leaf | 5.68 | Glyma.18G057900 | 3184 | NAD(P)-binding Rossmann-fold superfamily protein |
| Leaf | 5.68 | Glyma.07G000700 | 1399 | HXXXD-type acyl-transferase family protein |
| Leaf | 5.67 | Glyma.02G080200 | 642 | Integrase-type DNA-binding superfamily protein |
| Leaf | 5.66 | Glyma.13G332500 | 2572 | UDP-N-acetylglucosamine (UAA) transporter family |
| Leaf | 5.66 | Glyma.20G168500 | 3530 | Integrase-type DNA-binding superfamily protein |
| Leaf | 5.66 | Glyma.08G205800 | 1695 | Mitochondrial substrate carrier family protein |
| Leaf | 5.66 | Glyma.06G190000 | 1333 | Leucine-rich repeat protein kinase family protein |
| Leaf | 5.66 | Glyma.05G108200 | 1124 | basic leucine-zipper 5 |
| Root | 5.66 | Glyma.04G231300 | 1047 | |
| Leaf | 5.64 | Glyma.15G105900 | 2774 | glucose-6-phosphate/phosphate translocator 2 |
| Leaf | 5.64 | Glyma.06G235000 | 1358 | UDP-Glycosyltransferase superfamily protein |
| Leaf | 5.64 | Glyma.U038700 | 3580 | |
| Leaf | 5.63 | Glyma.07G056800 | 1433 | alpha/beta-Hydrolases superfamily protein |
| Root | 5.63 | Glyma.14G209000 | 2693 | oxidative stress 3 |
| Root | 5.62 | Glyma.11G070700 | 2142 | ATPase family associated with various cellular activities (AAA) |
| Leaf | 5.61 | Glyma.17G132100 | 3081 | Glucose-methanol-choline (GMC) oxidoreductase family protein |
| Root | 5.61 | Glyma.15G088200 | 2760 | nitrate transporter 1:2 |
| Root | 5.60 | Glyma.18G018900 | 3164 | slufate transporter 2; 1 |
| Root | 5.60 | Glyma.07G113500 | 1456 | H(+)-ATPase 11 |
| Root | 5.60 | Glyma.10G252600 | 2066 | |
| Leaf | 5.60 | Glyma.08G109100 | 1612 | UDP-D-glucuronate 4-epimerase 6 |
| Leaf | 5.59 | Glyma.19G175200 | 3383 | exocyst subunit exo70 family protein H4 |
| Root | 5.58 | Glyma.05G023700 | 1077 | Flavin-binding monooxygenase family protein |
| Root | 5.57 | Glyma.18G246000 | 3261 | basic helix-loop-helix (bHLH) DNA-binding superfamily protein |

TABLE 8E-continued

Genes that are up- or down- regulated at least 5 fold higher or lower in the beneficial
*Streptomyces* strain Strain C as compared to the control *Streptomyces* strain Strain A.

| Tissue | StrainC/ StrainA | GeneName | SEQ ID | Gene Description |
|---|---|---|---|---|
| Leaf | 5.57 | Glyma.15G251700 | 2842 | glutathione S-transferase TAU 19 |
| Root | 5.56 | Glyma.09G026000 | 1783 | RmlC-like cupins superfamily protein |
| Root | 5.55 | Glyma.06G123300 | 1295 | nodulin MtN21/EamA-like transporter family protein |
| Leaf | 5.55 | Glyma.15G089600 | 2761 | Protein of unknown function, DUF584 |
| Root | 5.55 | Glyma.18G186800 | 3235 | NAD(P)-binding Rossmann-fold superfamily protein |
| Leaf | 5.54 | Glyma.16G180200 | 2969 | MATE efflux family protein |
| Leaf | 5.54 | Glyma.06G239500 | 1362 | UDP-glucosyl transferase 72E1 |
| Leaf | 5.53 | Glyma.07G001800 | 1402 | Mitochondrial substrate carrier family protein |
| Leaf | 5.52 | Glyma.10G205700 | 2032 | |
| Leaf | 5.52 | Glyma.15G100100 | 2768 | Protein kinase superfamily protein |
| Root | 5.50 | Glyma.13G298400 | 2544 | alpha/beta-Hydrolases superfamily protein |
| Leaf | 5.50 | Glyma.13G244100 | 2505 | |
| Leaf | 5.49 | Glyma.04G160100 | 1002 | COBRA-like extracellular glycosyl-phosphatidyl inositol-anchored protein family |
| Root | 5.48 | Glyma.06G207100 | 1341 | signal peptide peptidase |
| Root | 5.47 | Glyma.09G134100 | 1845 | MATE efflux family protein |
| Leaf | 5.46 | Glyma.19G227800 | 3420 | galactinol synthase 2 |
| Root | 5.46 | Glyma.08G208200 | 1697 | |
| Root | 5.45 | Glyma.04G138900 | 994 | scarecrow-like 3 |
| Root | 5.45 | Glyma.06G015700 | 1225 | Seven transmembrane MLO family protein |
| Leaf | 5.45 | Glyma.11G056700 | 2127 | Cyclin-dependent kinase inhibitor family protein |
| Leaf | 5.45 | Glyma.09G126400 | 1836 | |
| Leaf | 5.45 | Glyma.15G071300 | 2752 | Aluminium induced protein with YGL and LRDR motifs |
| Leaf | 5.44 | Glyma.04G023900 | 929 | tubulin beta-1 chain |
| Leaf | 5.44 | Glyma.04G042300 | 944 | myb domain protein 73 |
| Root | 5.44 | Glyma.09G201400 | 1880 | Concanavalin A-like lectin protein kinase family protein |
| Root | 5.44 | Glyma.15G025300 | 2720 | calmodulin-binding family protein |
| Leaf | 5.44 | Glyma.02G153000 | 696 | Glutaredoxin family protein |
| Leaf | 5.44 | Glyma.07G179800 | 1484 | 2-oxoglutarate (2OG) and Fe(II)-dependent oxygenase superfamily protein |
| Root | 5.43 | Glyma.03G200200 | 875 | Ovate family protein |
| Root | 5.43 | Glyma.05G137500 | 1143 | senescence-related gene 1 |
| Leaf | 5.43 | Glyma.08G189600 | 1676 | lipoxygenase 1 |
| Leaf | 5.43 | Glyma.02G095700 | 663 | Plant protein 1589 of unknown function |
| Leaf | 5.43 | Glyma.10G047100 | 1951 | aluminum sensitive 3 |
| Root | 5.43 | Glyma.16G126400 | 2924 | Glycosyl hydrolase family 38 protein |
| Leaf | 5.41 | Glyma.13G169400 | 2441 | |
| Root | 5.40 | Glyma.11G035500 | 2110 | 2-oxoglutarate (2OG) and Fe(II)-dependent oxygenase superfamily protein |
| Leaf | 5.40 | Glyma.06G177800 | 1328 | C2 calcium/lipid-binding and GRAM domain containing protein |
| Leaf | 5.40 | Glyma.18G157800 | 3229 | Plant EC metallothionein-like protein, family 15 |
| Root | 5.39 | Glyma.05G181500 | 1170 | Heavy metal transport/detoxification superfamily protein |
| Leaf | 5.39 | Glyma.11G035100 | 2108 | Integrase-type DNA-binding superfamily protein |
| Root | 5.39 | Glyma.09G009700 | 1778 | Protein of unknown function (DUF506) |
| Root | 5.38 | Glyma.05G163000 | 1159 | nitrate transporter 1:2 |
| Leaf | 5.37 | Glyma.10G064400 | 1955 | embryonic cell protein 63 |
| Leaf | 5.37 | Glyma.15G032100 | 2724 | |
| Leaf | 5.37 | Glyma.17G041400 | 3025 | P-glycoprotein 11 |
| Root | 5.37 | Glyma.07G107600 | 1454 | Uncharacterised protein family (UPF0497) |
| Root | 5.37 | Glyma.13G305400 | 2553 | proline-rich family protein |
| Leaf | 5.37 | Glyma.02G088400 | 653 | Nodulin MtN3 family protein |
| Leaf | 5.36 | Glyma.20G106200 | 3487 | Amino acid permease family protein |
| Leaf | 5.35 | Glyma.16G200100 | 2982 | Pyridoxal phosphate (PLP)-dependent transferases superfamily protein |
| Leaf | 5.35 | Glyma.19G233900 | 3426 | respiratory burst oxidase homolog B |
| Root | 5.34 | Glyma.15G228000 | 2838 | |
| Leaf | 5.33 | Glyma.20G008300 | 3452 | |
| Root | 5.33 | Glyma.08G159000 | 1653 | Domain of unknown function (DUF966) |
| Root | 5.32 | Glyma.19G096400 | 3346 | GRAS family transcription factor |
| Root | 5.31 | Glyma.13G113000 | 2416 | |
| Leaf | 5.31 | Glyma.05G126800 | 1139 | |
| Root | 5.31 | Glyma.05G223400 | 1199 | S-adenosyl-L-methionine-dependent methyltransferases superfamily protein |
| Leaf | 5.31 | Glyma.12G052500 | 2276 | enzyme binding; tetrapyrrole binding |
| Leaf | 5.30 | Glyma.10G089300 | 1968 | Photosystem II 5 kD protein |
| Leaf | 5.30 | Glyma.02G260400 | 748 | alpha-soluble NSF attachment protein 2 |
| Leaf | 5.30 | Glyma.09G036400 | 1792 | nicotianamine synthase 4 |
| Root | 5.29 | Glyma.09G260500 | 1915 | |
| Leaf | 5.29 | Glyma.11G059100 | 2130 | Reticulan like protein B13 |
| Leaf | 5.29 | Glyma.13G272300 | 2524 | sodium/calcium exchanger family protein/calcium-binding EF hand family protein |
| Leaf | 5.28 | Glyma.03G240700 | 897 | Protein of unknown function (DUF1068) |
| Leaf | 5.28 | Glyma.17G165300 | 3104 | Auxin-responsive GH3 family protein |
| Root | 5.27 | Glyma.20G175800 | 3533 | GAST1 protein homolog 3 |
| Leaf | 5.26 | Glyma.15G108800 | 2778 | DNA/RNA polymerases superfamily protein |
| Leaf | 5.26 | Glyma.13G186200 | 2462 | 12-oxophytodienoate reductase 2 |
| Root | 5.25 | Glyma.08G162400 | 1655 | Eukaryotic aspartyl protease family protein |
| Root | 5.25 | Glyma.13G303300 | 2550 | |
| Root | 5.23 | Glyma.09G228000 | 1900 | Protein of unknown function, DUF642 |
| Root | 5.23 | Glyma.14G204200 | 2691 | extra-large G-protein 1 |

TABLE 8E-continued

Genes that are up- or down- regulated at least 5 fold higher or lower in the beneficial
*Streptomyces* strain Strain C as compared to the control *Streptomyces* strain Strain A.

| Tissue | StrainC/ StrainA | GeneName | SEQ ID | Gene Description |
|---|---|---|---|---|
| Leaf | 5.23 | Glyma.02G093100 | 659 | light-harvesting chlorophyll B-binding protein 3 |
| Leaf | 5.23 | Glyma.13G282000 | 2532 | protein kinases; ubiquitin-protein ligases |
| Root | 5.22 | Glyma.05G088400 | 1115 | protein kinases; ubiquitin-protein ligases |
| Leaf | 5.22 | Glyma.17G128000 | 3080 | malate synthase |
| Leaf | 5.21 | Glyma.02G228300 | 732 | mitogen-activated protein kinase kinase kinase 14 |
| Leaf | 5.19 | Glyma.13G008600 | 2360 | |
| Leaf | 5.19 | Glyma.07G133900 | 1463 | laccase 17 |
| Root | 5.18 | Glyma.04G077100 | 968 | Leucine-rich repeat protein kinase family protein |
| Root | 5.18 | Glyma.06G120400 | 1290 | Protein kinase superfamily protein |
| Leaf | 5.18 | Glyma.11G168000 | 2190 | Basic-leucine zipper (bZIP) transcription factor family protein |
| Leaf | 5.17 | Glyma.15G094700 | 2763 | Protein of unknown function, DUF642 |
| Leaf | 5.17 | Glyma.08G156600 | 1649 | |
| Root | 5.16 | Glyma.19G105500 | 3354 | GRF zinc finger/Zinc knuckle protein |
| Leaf | 5.16 | Glyma.17G090000 | 3053 | Protein kinase superfamily protein |
| Root | 5.16 | Glyma.04G198200 | 1024 | tapetum determinant 1 |
| Leaf | 5.15 | Glyma.16G167100 | 2957 | |
| Leaf | 5.15 | Glyma.11G017100 | 2090 | UDP-D-glucose/UDP-D-galactose 4-epimerase 5 |
| Root | 5.15 | Glyma.02G063600 | 636 | methyl esterase 1 |
| Root | 5.14 | Glyma.06G182700 | 1331 | carbonic anhydrase 2 |
| Leaf | 5.14 | Glyma.06G065400 | 1265 | |
| Leaf | 5.13 | Glyma.18G028400 | 3167 | light harvesting complex photosystem II |
| Leaf | 5.13 | Glyma.02G194200 | 709 | |
| Root | 5.13 | Glyma.07G042900 | 1425 | acyl carrier protein 4 |
| Leaf | 5.13 | Glyma.15G226000 | 2837 | Protein of unknown function, DUF584 |
| Leaf | 5.13 | Glyma.08G235400 | 1712 | kunitz trypsin inhibitor 1 |
| Root | 5.12 | Glyma.06G227300 | 1354 | cytochrome P450, family 72, subfamily A, polypeptide 14 |
| Leaf | 5.11 | Glyma.18G183500 | 3234 | laccase 17 |
| Leaf | 5.11 | Glyma.05G149700 | 1151 | phragmoplast-associated kinesin-related protein, putative |
| Leaf | 5.10 | Glyma.15G252200 | 2844 | glutathione S-transferase TAU 19 |
| Leaf | 5.08 | Glyma.06G143300 | 1306 | expansin A8 |
| Leaf | 5.08 | Glyma.05G013700 | 1073 | |
| Leaf | 5.08 | Glyma.15G133000 | 2794 | |
| Root | 5.07 | Glyma.10G288100 | 2078 | Eukaryotic aspartyl protease family protein |
| Leaf | 5.07 | Glyma.16G076300 | 2903 | Long-chain fatty alcohol dehydrogenase family protein |
| Leaf | 5.06 | Glyma.10G096300 | 1970 | |
| Leaf | 5.06 | Glyma.13G365800 | 2597 | Cystathionine beta-synthase (CBS) protein |
| Leaf | 5.06 | Glyma.04G009900 | 923 | dehydrin LEA |
| Leaf | 5.05 | Glyma.07G168600 | 1481 | nudix hydrolase homolog 17 |
| Leaf | 5.04 | Glyma.09G064200 | 1810 | basic helix-loop-helix (bHLH) DNA-binding family protein |
| Root | 5.04 | Glyma.11G150800 | 2185 | O-methyltransferase 1 |
| Leaf | 5.03 | Glyma.11G185100 | 2207 | Jojoba acyl CoA reductase-related male sterility protein |
| Leaf | 5.03 | Glyma.06G120300 | 1289 | Thiamin diphosphate-binding fold (THDP-binding) superfamily protein |
| Root | 5.02 | Glyma.02G064400 | 637 | ribonuclease 1 |
| Root | 5.02 | Glyma.01G095000 | 521 | kunitz trypsin inhibitor 1 |
| Leaf | 5.01 | Glyma.13G125800 | 2423 | Vps51/Vps67 family (components of vesicular transport) protein |
| Leaf | 5.01 | Glyma.11G208600 | 2225 | Uncharacterised protein family (UPF0497) |
| Leaf | 5.00 | Glyma.05G174200 | 1163 | Melibiase family protein |
| Leaf | −4.98 | Glyma.14G168100 | 2668 | structural constituent of ribosome |
| Leaf | −5.04 | Glyma.08G307300 | 1742 | receptor-like protein kinase 1 |
| Root | −5.06 | Glyma.17G007200 | 3001 | cytochrome P450, family 71, subfamily B, polypeptide 34 |
| Leaf | −5.06 | Glyma.15G001000 | 2700 | Protein of unknown function (DUF3754) |
| Root | −5.08 | Glyma.05G112000 | 1128 | Late embryogenesis abundant protein, group 1 protein |
| Root | −5.10 | Glyma.08G275000 | 1728 | Concanavalin A-like lectin protein kinase family protein |
| Root | −5.12 | Glyma.03G041300 | 795 | Nuclear transport factor 2 (NTF2) family protein |
| Root | −5.12 | Glyma.04G058800 | 958 | glutamine dumper 4 |
| Root | −5.27 | Glyma.09G229200 | 1901 | purple acid phosphatase 10 |
| Leaf | −5.30 | Glyma.13G076200 | 2394 | disease resistance protein (TIR-NBS-LRR class), putative |
| Leaf | −5.39 | Glyma.15G074300 | 2754 | PLAT/LH2 domain-containing lipoxygenase family protein |
| Leaf | −5.50 | Glyma.04G225300 | 1044 | Vacuolar iron transporter (VIT) family protein |
| Root | −5.53 | Glyma.18G150300 | 3228 | Concanavalin A-like lectin protein kinase family protein |
| Root | −5.55 | Glyma.07G033700 | 1422 | 2-oxoglutarate (2OG) and Fe(II)-dependent oxygenase superfamily protein |
| Root | −6.30 | Glyma.15G031300 | 2721 | beta glucosidase 17 |
| Root | −6.39 | Glyma.08G195000 | 1684 | Pyridoxal phosphate phosphatase-related protein |
| Root | −6.64 | Glyma.15G132100 | 2791 | RmlC-like cupins superfamily protein |
| Root | −6.68 | Glyma.14G174300 | 2671 | NOD26-like intrinsic protein 3; 1 |
| Root | −6.91 | Glyma.08G079800 | 1591 | Ankyrin repeat family protein |
| Root | −6.97 | Glyma.20G205900 | 3542 | Serine protease inhibitor, potato inhibitor I-type family protein |
| Root | −7.26 | Glyma.11G184800 | 2205 | Subtilisin-like serine endopeptidase family protein |
| Leaf | −7.38 | Glyma.06G023900 | 1230 | Pathogenesis-related thaumatin superfamily protein |
| Root | −8.54 | Glyma.05G247100 | 1215 | ABC-2 type transporter family protein |
| Root | −8.85 | Glyma.17G066800 | 3041 | Protein kinase superfamily protein |
| Root | −9.71 | Glyma.19G244400 | 3431 | ammonium transporter 2 |

TABLE 8E-continued

Genes that are up- or down- regulated at least 5 fold higher or lower in the beneficial *Streptomyces* strain Strain C as compared to the control *Streptomyces* strain Strain A.

| Tissue | StrainC/ StrainA | GeneName | SEQ ID | Gene Description |
|---|---|---|---|---|
| Root | −10.74 | Glyma.08G120500 | 1624 | Major facilitator superfamily protein |
| Root | −11.87 | Glyma.08G327300 | 1751 | cytochrome P450, family 71, subfamily B, polypeptide 35 |

TABLE 8F

Transcripts that are up- or down- regulated at least 5 fold higher or lower in the beneficial *Streptomyces* strain Strain C as compared to to the control *Streptomyces* strain Strain A.

| Tissue | StrainC/ StrainA | TranscriptName | SEQ ID | Transcript Description |
|---|---|---|---|---|
| leaf | 226.9 | Glyma.19G007700.4 | 3300 | carbonic anhydrase 1 |
| leaf | 76.4 | Glyma.01G178800.1 | 553 | PQ-loop repeat family protein/transmembrane family protein |
| leaf | 65.5 | Glyma.18G134200.5 | 3222 | Duplicated homeodomain-like superfamily protein |
| leaf | 64.8 | Glyma.19G247200.1 | 3435 | Plant protein of unknown function (DUF946) |
| leaf | 64.7 | Glyma.20G246900.1 | 3560 | Emsy N Terminus (ENT)/plant Tudor-like domains-containing protein |
| leaf | 55.5 | Glyma.18G227000.1 | 3251 | |
| leaf | 55.3 | Glyma.19G099400.2 | 3349 | Esterase/lipase/thioesterase family protein |
| leaf | 55.0 | Glyma.19G255200.4 | 3442 | Plant protein 1589 of unknown function |
| leaf | 51.7 | Glyma.17G092800.2 | 3056 | Gibberellin-regulated family protein |
| leaf | 49.9 | Glyma.12G180700.1 | 2325 | PHD finger family protein |
| leaf | 46.7 | Glyma.08G007900.2 | 1531 | magnesium-protoporphyrin IX methyltransferase |
| leaf | 43.0 | Glyma.19G178400.1 | 3385 | Leucine-rich repeat protein kinase family protein |
| leaf | 41.3 | Glyma.13G099600.1 | 2410 | heavy metal atpase 2 |
| leaf | 37.8 | Glyma.10G207800.2 | 2040 | pseudouridine synthase family protein |
| leaf | 36.5 | Glyma.01G207400.2 | 589 | ubiquitin-protein ligases |
| leaf | 36.3 | Glyma.08G060500.1 | 1576 | S-locus lectin protein kinase family protein |
| leaf | 32.3 | Glyma.15G053000.6 | 2734 | dentin sialophosphoprotein-related |
| root | 32.3 | Glyma.15G053000.6 | 2734 | dentin sialophosphoprotein-related |
| leaf | 32.2 | Glyma.01G178800.3 | 555 | PQ-loop repeat family protein/transmembrane family protein |
| leaf | 31.6 | Glyma.13G183900.3 | 2461 | SNF2 domain-containing protein/helicase domain-containing protein/zinc finger protein-related |
| leaf | 28.3 | Glyma.02G225000.1 | 728 | Glycosyl hydrolase family protein |
| leaf | 27.3 | Glyma.06G322600.1 | 1396 | KCBP-interacting protein kinase |
| leaf | 27.0 | Glyma.06G178400.4 | 1330 | Copper amine oxidase family protein |
| leaf | 26.9 | Glyma.13G256300.7 | 2515 | RNA-binding KH domain-containing protein |
| leaf | 26.5 | Glyma.19G222400.2 | 3418 | Pectinacetylesterase family protein |
| leaf | 25.2 | Glyma.08G137600.2 | 1636 | Integrase-type DNA-binding superfamily protein |
| leaf | 25.2 | Glyma.11G038800.2 | 2111 | Protein kinase superfamily protein |
| leaf | 25.2 | Glyma.03G113200.1 | 819 | NAD(P)-binding Rossmann-fold superfamily protein |
| leaf | 24.1 | Glyma.12G222200.2 | 2351 | protochlorophyllide oxidoreductase A |
| root | 22.6 | Glyma.17G078700.1 | 3049 | RPA70-kDa subunit B |
| leaf | 22.6 | Glyma.17G078700.1 | 3049 | RPA70-kDa subunit B |
| leaf | 22.1 | Glyma.11G065900.2 | 2137 | Protein phosphatase 2C family protein |
| leaf | 22.0 | Glyma.11G069300.3 | 2140 | ARM repeat superfamily protein |
| leaf | 21.9 | Glyma.19G099400.5 | 3351 | Esterase/lipase/thioesterase family protein |
| leaf | 21.8 | Glyma.14G161200.9 | 2667 | DNAJ heat shock N-terminal domain-containing protein |
| root | 21.3 | Glyma.11G222100.3 | 2231 | Tetratricopeptide repeat (TPR)-like superfamily protein |
| leaf | 21.3 | Glyma.11G222100.3 | 2231 | Tetratricopeptide repeat (TPR)-like superfamily protein |
| leaf | 21.0 | Glyma.12G236500.3 | 2357 | NB-ARC domain-containing disease resistance protein |
| root | 21.0 | Glyma.12G236500.3 | 2357 | NB-ARC domain-containing disease resistance protein |
| leaf | 20.9 | Glyma.08G015300.1 | 1539 | plasma membrane intrinsic protein 1; 4 |
| leaf | 20.9 | Glyma.03G011400.2 | 784 | magnesium ion binding; thiamin pyrophosphate binding; hydro-lyases; catalytics; 2-succinyl-5-enolpyruvyl-6-hydroxy-3-cyclohexene-1-carboxylic-acid synthases |
| leaf | 20.9 | Glyma.06G104800.1 | 1279 | Haloacid dehalogenase-like hydrolase (HAD) superfamily protein |
| leaf | 20.7 | Glyma.19G134600.3 | 3366 | |
| leaf | 20.6 | Glyma.18G259500.2 | 3268 | NOD26-like intrinsic protein 4; 2 |
| root | 20.2 | Glyma.18G139900.1 | 3224 | Pectin lyase-like superfamily protein |
| leaf | 20.2 | Glyma.18G139900.1 | 3224 | Pectin lyase-like superfamily protein |
| leaf | 19.9 | Glyma.10G175400.1 | 2004 | Translation initiation factor IF6 |
| leaf | 19.8 | Glyma.19G099400.3 | 3350 | Esterase/lipase/thioesterase family protein |
| root | 19.8 | Glyma.19G099400.3 | 3350 | Esterase/lipase/thioesterase family protein |
| leaf | 19.7 | Glyma.02G233600.4 | 734 | Pseudouridine synthase family protein |
| leaf | 19.2 | Glyma.13G183200.1 | 2457 | |
| leaf | 18.8 | Glyma.16G149800.2 | 2936 | P-loop containing nucleoside triphosphate hydrolases superfamily protein |
| leaf | 18.8 | Glyma.06G028300.1 | 1235 | Integrase-type DNA-binding superfamily protein |
| leaf | 18.7 | Glyma.18G003000.2 | 3153 | Leucine-rich repeat protein kinase family protein |
| leaf | 18.6 | Glyma.03G140100.2 | 836 | NIMA-related kinase 5 |
| leaf | 18.6 | Glyma.20G067600.4 | 3477 | Protein kinase superfamily protein |
| leaf | 18.3 | Glyma.13G348400.5 | 2581 | IQ-domain 6 |
| leaf | 18.1 | Glyma.08G032900.4 | 1549 | heat shock protein 81-2 |
| leaf | 18.0 | Glyma.08G039800.8 | 1557 | Fibronectin type III domain-containing protein |

TABLE 8F-continued

Transcripts that are up- or down- regulated at least 5 fold higher or lower in the beneficial
*Streptomyces* strain Strain C as compared to to the control *Streptomyces* strain Strain A.

| Tissue | StrainC/StrainA | TranscriptName | SEQ ID | Transcript Description |
|---|---|---|---|---|
| leaf | 17.9 | Glyma.17G052500.5 | 3033 | homology to ABI2 |
| leaf | 17.9 | Glyma.14G128300.3 | 2658 | LisH dimerisation motif; WD40/YVTN repeat-like-containing domain |
| leaf | 17.8 | Glyma.17G059400.4 | 3038 | pathogenesis related homeodomain protein A |
| leaf | 17.8 | Glyma.08G090700.5 | 1600 | Tetratricopeptide repeat (TPR)-like superfamily protein |
| leaf | 17.2 | Glyma.01G121700.2 | 532 | Rhodanese/Cell cycle control phosphatase superfamily protein |
| leaf | 17.0 | Glyma.08G022600.4 | 1546 | Pleckstrin homology (PH) domain-containing protein |
| leaf | 16.8 | Glyma.08G039800.7 | 1556 | Fibronectin type III domain-containing protein |
| leaf | 16.8 | Glyma.11G147400.4 | 2180 | Galactose oxidase/kelch repeat superfamily protein |
| leaf | 16.7 | Glyma.11G199700.4 | 2222 | Leucine-rich repeat protein kinase family protein |
| root | 16.7 | Glyma.11G199700.4 | 2222 | Leucine-rich repeat protein kinase family protein |
| root | 16.3 | Glyma.17G080000.1 | 3051 | |
| leaf | 16.3 | Glyma.17G080000.1 | 3051 | |
| leaf | 16.2 | Glyma.07G234900.4 | 1510 | |
| root | 16.0 | Glyma.05G158800.1 | 1153 | Leucine-rich repeat protein kinase family protein |
| leaf | 16.0 | Glyma.05G158800.1 | 1153 | Leucine-rich repeat protein kinase family protein |
| leaf | 15.8 | Glyma.08G131300.1 | 1631 | senescence associated gene 18 |
| leaf | 15.8 | Glyma.01G184600.6 | 568 | Protein of unknown function, DUF547 |
| leaf | 15.7 | Glyma.08G088000.2 | 1597 | NAD(P)-binding Rossmann-fold superfamily protein |
| leaf | 15.6 | Glyma.05G037400.1 | 1093 | peroxin 14 |
| leaf | 15.4 | Glyma.19G157000.2 | 3376 | Terpenoid cyclases/Protein prenyltransferases superfamily protein |
| root | 15.4 | Glyma.19G157000.2 | 3376 | Terpenoid cyclases/Protein prenyltransferases superfamily protein |
| leaf | 14.9 | Glyma.17G061900.2 | 3039 | homogentisate phytyltransferase 1 |
| leaf | 14.9 | Glyma.04G011900.2 | 924 | Glucose-1-phosphate adenylyltransferase family protein |
| leaf | 14.8 | Glyma.01G243900.3 | 605 | DNA-directed DNA polymerases |
| leaf | 14.8 | Glyma.05G246100.1 | 1214 | beta-6 tubulin |
| root | 14.8 | Glyma.05G246100.1 | 1214 | beta-6 tubulin |
| leaf | 14.8 | Glyma.02G055900.1 | 629 | RAD-like 6 |
| leaf | 14.3 | Glyma.02G235300.1 | 737 | cytochrome P450, family 71, subfamily A, polypeptide 19 |
| root | 14.3 | Glyma.02G235300.1 | 737 | cytochrome P450, family 71, subfamily A, polypeptide 19 |
| leaf | 14.1 | Glyma.15G186100.2 | 2819 | Cytidine/deoxycytidylate deaminase family protein |
| leaf | 14.1 | Glyma.16G181700.3 | 2976 | C2H2-like zinc finger protein |
| leaf | 13.9 | Glyma.16G143800.1 | 2933 | Phototropic-responsive NPH3 family protein |
| leaf | 13.9 | Glyma.16G151900.1 | 2942 | O-Glycosyl hydrolases family 17 protein |
| leaf | 13.6 | Glyma.11G244000.3 | 2247 | Copine (Calcium-dependent phospholipid-binding protein) family |
| leaf | 13.3 | Glyma.14G040300.6 | 2627 | trigalactosyldiacylglycerol2 |
| leaf | 13.2 | Glyma.02G215700.1 | 720 | matrix metalloproteinase |
| leaf | 13.2 | Glyma.06G307000.1 | 1384 | small and basic intrinsic protein 1A |
| leaf | 13.2 | Glyma.20G048400.2 | 3470 | trigalactosyldiacylglycerol2 |
| leaf | 13.1 | Glyma.06G163100.6 | 1322 | crumpled leaf |
| leaf | 12.7 | Glyma.07G121900.1 | 1459 | multidrug resistance-associated protein 9 |
| root | 12.7 | Glyma.15G066700.1 | 2745 | Protein kinase superfamily protein |
| leaf | 12.7 | Glyma.15G066700.1 | 2745 | Protein kinase superfamily protein |
| leaf | 12.7 | Glyma.10G007400.3 | 1926 | Uncharacterised protein family (UPF0497) |
| leaf | 12.6 | Glyma.19G219200.5 | 3416 | ADP-ribosylation factor A1E |
| leaf | 12.6 | Glyma.18G076100.3 | 3201 | Polynucleotidyl transferase, ribonuclease H-like superfamily protein |
| leaf | 12.5 | Glyma.17G006200.2 | 2999 | Heavy metal transport/detoxification superfamily protein |
| leaf | 12.4 | Glyma.17G215800.3 | 3123 | aberrant lateral root formation 4 |
| root | 12.4 | Glyma.17G215800.3 | 3123 | aberrant lateral root formation 4 |
| root | 12.4 | Glyma.13G208600.3 | 2475 | GTP-binding protein 1 |
| leaf | 12.4 | Glyma.19G227800.2 | 3422 | Nucleotide-diphospho-sugar transferases superfamily protein |
| leaf | 12.4 | Glyma.01G184600.16 | 565 | Protein of unknown function, DUF547 |
| leaf | 12.4 | Glyma.13G208600.3 | 2475 | GTP-binding protein 1 |
| leaf | 12.3 | Glyma.13G316600.1 | 2563 | Homeodomain-like superfamily protein |
| leaf | 12.2 | Glyma.09G280500.1 | 1921 | UDP-glucosyl transferase 73B5 |
| leaf | 12.2 | Glyma.08G190400.3 | 1677 | ATPase E1-E2 type family protein/haloacid dehalogenase-like hydrolase family protein |
| root | 12.2 | Glyma.09G280500.1 | 1921 | UDP-glucosyl transferase 73B5 |
| leaf | 12.0 | Glyma.01G184600.18 | 566 | Protein of unknown function, DUF547 |
| leaf | 12.0 | Glyma.20G056200.1 | 3472 | serine carboxypeptidase-like 40 |
| root | 11.9 | Glyma.20G056200.1 | 3472 | serine carboxypeptidase-like 40 |
| leaf | 11.8 | Glyma.13G291800.1 | 2539 | late embryogenesis abundant domain-containing protein/LEA domain-containing protein |
| leaf | 11.7 | Glyma.19G033900.1 | 3324 | brassinosteroid-6-oxidase 2 |
| leaf | 11.6 | Glyma.07G038500.1 | 1424 | germin-like protein 1 |
| leaf | 11.6 | Glyma.04G049200.2 | 952 | branched-chain amino acid transaminase 2 |
| leaf | 11.5 | Glyma.06G143800.9 | 1307 | potassium transporter 2 |
| leaf | 11.5 | Glyma.10G182000.7 | 2009 | |
| leaf | 11.5 | Glyma.09G031500.3 | 1789 | |
| leaf | 11.5 | Glyma.13G173600.1 | 2447 | O-methyltransferase family protein |
| root | 11.5 | Glyma.10G182000.7 | 2009 | |
| root | 11.5 | Glyma.13G173600.1 | 2447 | O-methyltransferase family protein |
| root | 11.5 | Glyma.16G099100.2 | 2913 | ARM repeat superfamily protein |
| leaf | 11.5 | Glyma.09G062900.1 | 1806 | beta-galactosidase 12 |
| leaf | 11.5 | Glyma.16G099100.2 | 2913 | ARM repeat superfamily protein |
| leaf | 11.4 | Glyma.08G045400.3 | 1562 | Rubisco methyltransferase family protein |
| leaf | 11.4 | Glyma.15G057600.1 | 2737 | |

TABLE 8F-continued

Transcripts that are up- or down- regulated at least 5 fold higher or lower in the beneficial *Streptomyces* strain Strain C as compared to to the control *Streptomyces* strain Strain A.

| Tissue | StrainC/ StrainA | TranscriptName | SEQ ID | Transcript Description |
|---|---|---|---|---|
| leaf | 11.3 | Glyma.10G168200.1 | 1997 | ammonium transporter 1; 2 |
| leaf | 11.3 | Glyma.05G212800.3 | 1197 | VIRB2-interacting protein 2 |
| root | 11.2 | Glyma.16G121900.4 | 2921 | NEP-interacting protein 2 |
| leaf | 11.2 | Glyma.05G007100.3 | 1067 | carbonic anhydrase 1 |
| leaf | 11.2 | Glyma.16G121900.4 | 2921 | NEP-interacting protein 2 |
| leaf | 11.2 | Glyma.17G215000.1 | 3122 | RING/U-box superfamily protein |
| leaf | 11.1 | Glyma.15G225300.3 | 2836 | myb domain protein 33 |
| leaf | 11.0 | Glyma.05G007100.2 | 1066 | carbonic anhydrase 1 |
| leaf | 11.0 | Glyma.11G171400.1 | 2195 | glutamine-dependent asparagine synthase 1 |
| leaf | 10.9 | Glyma.08G026800.1 | 1548 | Ion protease 2 |
| leaf | 10.9 | Glyma.06G043000.1 | 1248 | N-terminal nucleophile aminohydrolases (Ntn hydrolases) superfamily protein |
| leaf | 10.8 | Glyma.10G231600.2 | 2049 | ferric reduction oxidase 4 |
| leaf | 10.7 | Glyma.07G259300.2 | 1524 | tobamovirus multiplication 1 |
| leaf | 10.7 | Glyma.16G165200.1 | 2951 | light-harvesting chlorophyll-protein complex II subunit B1 |
| leaf | 10.7 | Glyma.07G266200.1 | 1527 | Inositol monophosphatase family protein |
| root | 10.7 | Glyma.07G259300.2 | 1524 | tobamovirus multiplication 1 |
| leaf | 10.7 | Glyma.15G197300.2 | 2821 | CBL-interacting protein kinase 23 |
| root | 10.6 | Glyma.15G197300.2 | 2821 | CBL-interacting protein kinase 23 |
| root | 10.6 | Glyma.13G256300.7 | 2515 | RNA-binding KH domain-containing protein |
| leaf | 10.6 | Glyma.05G119400.7 | 1132 | Galactose oxidase/kelch repeat superfamily protein |
| leaf | 10.6 | Glyma.13G256300.7 | 2515 | RNA-binding KH domain-containing protein |
| leaf | 10.5 | Glyma.01G184600.7 | 569 | Protein of unknown function, DUF547 |
| leaf | 10.5 | Glyma.20G129000.1 | 3500 | SPX domain gene 2 |
| root | 10.5 | Glyma.20G129000.1 | 3500 | SPX domain gene 2 |
| leaf | 10.4 | Glyma.16G164800.1 | 2949 | Integrase-type DNA-binding superfamily protein |
| leaf | 10.3 | Glyma.11G170300.1 | 2193 | glutamine-dependent asparagine synthase 1 |
| leaf | 10.3 | Glyma.03G252700.1 | 905 | GDSL-like Lipase/Acylhydrolase superfamily protein |
| root | 10.3 | Glyma.13G348400.3 | 2580 | IQ-domain 6 |
| leaf | 10.3 | Glyma.U020300.1 | 3567 | RmlC-like cupins superfamily protein |
| leaf | 10.3 | Glyma.13G348400.3 | 2580 | IQ-domain 6 |
| leaf | 10.2 | Glyma.04G065600.1 | 963 | Bifunctional inhibitor/lipid-transfer protein/seed storage 2S albumin superfamily protein |
| leaf | 10.1 | Glyma.02G208600.1 | 713 | Protein of unknown function (DUF1637) |
| leaf | 10.1 | Glyma.12G217200.1 | 2345 | nuclear factor Y, subunit C4 |
| leaf | 10.1 | Glyma.14G004100.4 | 2603 | 5\'-AMP-activated protein kinase beta-2 subunit protein |
| root | 10.1 | Glyma.02G208600.1 | 713 | Protein of unknown function (DUF1637) |
| root | 10.1 | Glyma.12G217200.1 | 2345 | nuclear factor Y, subunit C4 |
| root | 10.1 | Glyma.14G004100.4 | 2603 | 5\'-AMP-activated protein kinase beta-2 subunit protein |
| leaf | 10.0 | Glyma.16G165800.1 | 2955 | light-harvesting chlorophyll-protein complex II subunit B1 |
| leaf | 9.9 | Glyma.15G069200.1 | 2748 | Protein of unknown function (DUF707) |
| leaf | 9.9 | Glyma.04G083200.1 | 974 | tonoplast intrinsic protein 4; 1 |
| root | 9.9 | Glyma.13G168700.4 | 2440 | formate dehydrogenase |
| leaf | 9.9 | Glyma.19G134600.2 | 3365 | |
| leaf | 9.9 | Glyma.13G168700.4 | 2440 | formate dehydrogenase |
| leaf | 9.9 | Glyma.06G123200.1 | 1294 | nodulin MtN21/EamA-like transporter family protein |
| leaf | 9.7 | Glyma.03G251500.1 | 903 | type one serine/threonine protein phosphatase 4 |
| leaf | 9.6 | Glyma.01G021000.1 | 489 | elicitor-activated gene 3-2 |
| leaf | 9.6 | Glyma.09G139600.1 | 1854 | CAP160 protein |
| leaf | 9.6 | Glyma.19G007700.7 | 3301 | carbonic anhydrase 1 |
| root | 9.5 | Glyma.19G251500.1 | 3439 | Subtilase family protein |
| leaf | 9.5 | Glyma.18G061100.3 | 3191 | glutamine-dependent asparagine synthase 1 |
| leaf | 9.5 | Glyma.19G251500.1 | 3439 | Subtilase family protein |
| leaf | 9.5 | Glyma.20G065300.1 | 3476 | Exostosin family protein |
| leaf | 9.5 | Glyma.07G133000.3 | 1462 | TRF-like 2 |
| leaf | 9.5 | Glyma.19G250200.1 | 3437 | Li-tolerant lipase 1 |
| leaf | 9.4 | Glyma.03G204300.1 | 879 | FASCICLIN-like arabinogalactan protein 16 precursor |
| leaf | 9.4 | Glyma.17G135100.1 | 3084 | Protein of unknown function (DUF1442) |
| leaf | 9.3 | Glyma.16G040900.1 | 2876 | adenosine-5\'-phosphosulfate (APS) kinase 3 |
| leaf | 9.3 | Glyma.07G138900.1 | 1465 | RHO guanyl-nucleotide exchange factor 11 |
| leaf | 9.3 | Glyma.11G151500.1 | 2186 | |
| leaf | 9.2 | Glyma.03G234500.1 | 895 | alpha/beta-Hydrolases superfamily protein |
| leaf | 9.2 | Glyma.08G042100.1 | 1561 | myb domain protein 62 |
| leaf | 9.2 | Glyma.18G121000.1 | 3214 | |
| leaf | 9.1 | Glyma.10G177100.1 | 2006 | FAD-binding Berberine family protein |
| leaf | 9.1 | Glyma.20G168500.1 | 3531 | Integrase-type DNA-binding superfamily protein |
| root | 9.1 | Glyma.10G177100.5 | 2006 | FAD-binding Berberine family protein |
| leaf | 9.1 | Glyma.06G050100.5 | 1253 | branched-chain amino acid transaminase 2 |
| leaf | 9.0 | Glyma.05G029000.1 | 1082 | WRKY DNA-binding protein 72 |
| leaf | 9.0 | Glyma.11G238500.3 | 2244 | slufate transporter 2; 1 |
| leaf | 9.0 | Glyma.11G101900.1 | 2156 | ATPase E1-E2 type family protein/haloacid dehalogenase-like hydrolase family protein |
| root | 9.0 | Glyma.11G238500.3 | 2244 | slufate transporter 2; 1 |
| root | 9.0 | Glyma.11G101900.1 | 2156 | ATPase E1-E2 type family protein/haloacid dehalogenase-like hydrolase family protein |
| leaf | 9.0 | Glyma.02G130500.1 | 686 | |
| leaf | 9.0 | Glyma.06G050100.1 | 1251 | branched-chain amino acid transaminase 2 |
| leaf | 8.9 | Glyma.09G062900.2 | 1807 | beta-galactosidase 12 |

TABLE 8F-continued

Transcripts that are up- or down- regulated at least 5 fold higher or lower in the beneficial *Streptomyces* strain Strain C as compared to to the control *Streptomyces* strain Strain A.

| Tissue | StrainC/ StrainA | TranscriptName | SEQ ID | Transcript Description |
|---|---|---|---|---|
| leaf | 8.9 | Glyma.17G259500.1 | 3148 | GDSL-like Lipase/Acylhydrolase superfamily protein |
| root | 8.9 | Glyma.06G055300.1 | 1256 | ACT-like protein tyrosine kinase family protein |
| leaf | 8.9 | Glyma.20G144800.2 | 3515 | Haloacid dehalogenase-like hydrolase (HAD) superfamily protein |
| leaf | 8.9 | Glyma.06G055300.1 | 1256 | ACT-like protein tyrosine kinase family protein |
| leaf | 8.8 | Glyma.08G054000.1 | 1565 | beta-6 tubulin |
| leaf | 8.8 | Glyma.16G007700.1 | 2861 | germin-like protein 1 |
| leaf | 8.8 | Glyma.05G051400.1 | 1103 | Subtilase family protein |
| leaf | 8.8 | Glyma.13G060300.1 | 2385 | CDC2C |
| root | 8.8 | Glyma.08G054000.1 | 1565 | beta-6 tubulin |
| root | 8.8 | Glyma.05G051400.1 | 1103 | Subtilase family protein |
| root | 8.8 | Glyma.13G060300.1 | 2385 | CDC2C |
| leaf | 8.7 | Glyma.10G282200.2 | 2076 | FAD/NAD(P)-binding oxidoreductase family protein |
| leaf | 8.7 | Glyma.13G091100.3 | 2402 | nodulin MtN21/EamA-like transporter family protein |
| leaf | 8.6 | Glyma.01G184600.8 | 570 | Protein of unknown function, DUF547 |
| leaf | 8.6 | Glyma.05G229600.1 | 1204 | Transducin/WD40 repeat-like superfamily protein |
| leaf | 8.6 | Glyma.05G007100.4 | 1068 | carbonic anhydrase 1 |
| leaf | 8.6 | Glyma.15G105900.1 | 2775 | glucose-6-phosphate/phosphate translocator 2 |
| root | 8.6 | Glyma.05G229600.1 | 1204 | Transducin/WD40 repeat-like superfamily protein |
| root | 8.6 | Glyma.15G105900.1 | 2775 | glucose-6-phosphate/phosphate translocator 2 |
| root | 8.6 | Glyma.09G129900.1 | 1841 | CBS domain-containing protein with a domain of unknown function (DUF21) |
| leaf | 8.6 | Glyma.19G214300.1 | 3411 | |
| leaf | 8.6 | Glyma.09G129900.1 | 1841 | CBS domain-containing protein with a domain of unknown function (DUF21) |
| leaf | 8.6 | Glyma.02G148200.1 | 694 | Eukaryotic aspartyl protease family protein |
| leaf | 8.5 | Glyma.11G098400.1 | 2150 | |
| leaf | 8.5 | Glyma.03G056400.2 | 806 | acyl-CoA oxidase 4 |
| leaf | 8.5 | Glyma.19G007700.1 | 3298 | carbonic anhydrase 1 |
| leaf | 8.5 | Glyma.05G248100.4 | 1218 | alpha/beta-Hydrolases superfamily protein |
| leaf | 8.5 | Glyma.02G131400.1 | 688 | pectin methylesterase inhibitor 1 |
| leaf | 8.4 | Glyma.20G034600.1 | 3465 | Peptidase C13 family |
| leaf | 8.4 | Glyma.18G231500.1 | 3254 | |
| leaf | 8.4 | Glyma.13G179200.1 | 2452 | Protein of unknown function (DUF506) |
| leaf | 8.4 | Glyma.13G191200.1 | 2464 | annexin 8 |
| leaf | 8.3 | Glyma.15G213600.2 | 2831 | lectin protein kinase family protein |
| leaf | 8.3 | Glyma.15G003200.3 | 2703 | uridylyltransferase-related |
| leaf | 8.2 | Glyma.16G189900.1 | 2978 | CAP160 protein |
| leaf | 8.2 | Glyma.12G088300.1 | 2294 | NAD+ ADP-ribosyltransferases; NAD+ ADP-ribosyltransferases |
| leaf | 8.2 | Glyma.02G043300.1 | 625 | GDSL-like Lipase/Acylhydrolase superfamily protein |
| leaf | 8.2 | Glyma.06G109200.1 | 1283 | nitrate reductase 1 |
| root | 8.2 | Glyma.02G043300.1 | 625 | GDSL-like Lipase/Acylhydrolase superfamily protein |
| leaf | 8.2 | Glyma.15G206800.1 | 2827 | Glycosyl hydrolase family protein with chitinase insertion domain |
| leaf | 8.2 | Glyma.05G036800.1 | 1091 | basic helix-loop-helix (bHLH) DNA-binding superfamily protein |
| leaf | 8.2 | Glyma.11G098500.1 | 2152 | proline-rich protein 4 |
| leaf | 8.2 | Glyma.14G031200.1 | 2623 | PHYTOENE SYNTHASE |
| leaf | 8.1 | Glyma.17G044300.1 | 3029 | lysine-ketoglutarate reductase/saccharopine dehydrogenase bifunctional enzyme |
| root | 8.1 | Glyma.20G099300.2 | 3485 | Ras-related small GTP-binding family protein |
| leaf | 8.1 | Glyma.20G099300.2 | 3485 | Ras-related small GTP-binding family protein |
| leaf | 8.1 | Glyma.01G184600.1 | 564 | Protein of unknown function, DUF547 |
| leaf | 8.1 | Glyma.07G199900.2 | 1498 | polyubiquitin 10 |
| leaf | 8.0 | Glyma.01G146500.1 | 541 | RING/U-box superfamily protein |
| root | 8.0 | Glyma.17G073400.1 | 3047 | early nodulin-like protein 15 |
| leaf | 8.0 | Glyma.17G073400.1 | 3047 | early nodulin-like protein 15 |
| leaf | 8.0 | Glyma.19G076800.1 | 3339 | lysine histidine transporter 1 |
| leaf | 7.9 | Glyma.10G032400.4 | 1941 | galacturonosyltransferase 6 |
| leaf | 7.9 | Glyma.05G160900.1 | 1156 | |
| leaf | 7.9 | Glyma.18G273700.2 | 3276 | Regulator of chromosome condensation (RCC1) family protein |
| root | 7.9 | Glyma.10G032400.4 | 1941 | galacturonosyltransferase 6 |
| leaf | 7.9 | Glyma.08G053100.6 | 1563 | ATP binding; nucleic acid binding; helicases |
| leaf | 7.8 | Glyma.10G015500.1 | 1929 | |
| root | 7.8 | Glyma.18G000600.1 | 3151 | PHYTOENE SYNTHASE |
| leaf | 7.8 | Glyma.07G043100.6 | 1427 | Chaperone DnaJ-domain superfamily protein |
| leaf | 7.8 | Glyma.08G289900.1 | 1733 | P-loop containing nucleoside triphosphate hydrolases superfamily protein |
| leaf | 7.8 | Glyma.02G063300.1 | 635 | methyl esterase 1 |
| leaf | 7.8 | Glyma.11G018000.1 | 2095 | highly ABA-induced PP2C gene 3 |
| leaf | 7.8 | Glyma.16G068700.1 | 2899 | GDSL-like Lipase/Acylhydrolase superfamily protein |
| leaf | 7.8 | Glyma.18G000600.1 | 3151 | PHYTOENE SYNTHASE |
| root | 7.7 | Glyma.15G043400.3 | 2728 | P-loop containing nucleoside triphosphate hydrolases superfamily protein |
| leaf | 7.7 | Glyma.15G043400.3 | 2728 | P-loop containing nucleoside triphosphate hydrolases superfamily protein |
| leaf | 7.7 | Glyma.15G096200.19 | 2764 | Galactose oxidase/kelch repeat superfamily protein |
| leaf | 7.7 | Glyma.14G145800.1 | 2663 | Regulator of chromosome condensation (RCC1) family protein |
| leaf | 7.7 | Glyma.14G029000.4 | 2616 | Protein kinase superfamily protein |
| leaf | 7.6 | Glyma.05G107600.2 | 1123 | ACT domain repeat 1 |
| leaf | 7.6 | Glyma.06G138300.2 | 1302 | nodulin MtN21/EamA-like transporter family protein |
| leaf | 7.5 | Glyma.14G010900.1 | 2610 | Aldolase superfamily protein |
| leaf | 7.5 | Glyma.07G023000.1 | 1417 | NDH-dependent cyclic electron flow 1 |

TABLE 8F-continued

Transcripts that are up- or down- regulated at least 5 fold higher or lower in the beneficial *Streptomyces* strain Strain C as compared to to the control *Streptomyces* strain Strain A.

| Tissue | StrainC/ StrainA | TranscriptName | SEQ ID | Transcript Description |
|---|---|---|---|---|
| leaf | 7.5 | Glyma.01G178800.2 | 554 | PQ-loop repeat family protein/transmembrane family protein |
| root | 7.5 | Glyma.12G131300.1 | 2308 | senescence-associated gene 12 |
| leaf | 7.5 | Glyma.12G131300.1 | 2308 | senescence-associated gene 12 |
| root | 7.4 | Glyma.01G073200.1 | 514 | carotenoid cleavage dioxygenase 7 |
| leaf | 7.4 | Glyma.11G149100.1 | 2182 | cytokinin oxidase/dehydrogenase 6 |
| leaf | 7.4 | Glyma.01G073200.1 | 514 | carotenoid cleavage dioxygenase 7 |
| leaf | 7.4 | Glyma.18G011800.1 | 3158 | photosystem II BY |
| leaf | 7.4 | Glyma.02G217600.10 | 723 | Phosphoglycerate mutase family protein |
| leaf | 7.3 | Glyma.04G126000.1 | 989 | Protein kinase superfamily protein |
| leaf | 7.3 | Glyma.09G016000.4 | 1780 | calcineurin B-like protein 2 |
| root | 7.3 | Glyma.04G126000.1 | 989 | Protein kinase superfamily protein |
| root | 7.3 | Glyma.01G104600.2 | 524 | |
| leaf | 7.3 | Glyma.10G207100.1 | 2038 | Papain family cysteine protease |
| leaf | 7.3 | Glyma.13G306600.1 | 2555 | cyclin p2; 1 |
| leaf | 7.3 | Glyma.18G233000.7 | 3255 | Protein of unknown function (DUF3245) |
| leaf | 7.3 | Glyma.05G082400.2 | 1112 | Disease resistance protein (CC-NBS-LRR class) family |
| leaf | 7.3 | Glyma.01G184600.2 | 567 | Protein of unknown function, DUF547 |
| leaf | 7.3 | Glyma.01G104600.2 | 524 | |
| leaf | 7.2 | Glyma.10G246300.1 | 2062 | cupin family protein |
| leaf | 7.2 | Glyma.13G115500.1 | 2420 | lysine-ketoglutarate reductase/saccharopine dehydrogenase bifunctional enzyme |
| leaf | 7.2 | Glyma.18G243100.2 | 3258 | Eukaryotic aspartyl protease family protein |
| leaf | 7.2 | Glyma.13G302800.3 | 2549 | Major facilitator superfamily protein |
| root | 7.2 | Glyma.09G135900.1 | 1849 | NAD(P)-binding Rossmann-fold superfamily protein |
| root | 7.2 | Glyma.20G023000.2 | 3460 | Transducin/WD40 repeat-like superfamily protein |
| root | 7.2 | Glyma.02G221600.1 | 726 | Major facilitator superfamily protein |
| leaf | 7.2 | Glyma.09G135900.1 | 1849 | NAD(P)-binding Rossmann-fold superfamily protein |
| leaf | 7.2 | Glyma.03G125000.1 | 828 | RAD-like 1 |
| leaf | 7.2 | Glyma.18G061100.2 | 3190 | glutamine-dependent asparagine synthase 1 |
| leaf | 7.2 | Glyma.20G023000.2 | 3460 | Transducin/WD40 repeat-like superfamily protein |
| leaf | 7.2 | Glyma.02G221600.1 | 726 | Major facilitator superfamily protein |
| leaf | 7.2 | Glyma.11G018000.2 | 2096 | Protein phosphatase 2C family protein |
| leaf | 7.2 | Glyma.08G342100.1 | 1760 | kunitz trypsin inhibitor 1 |
| leaf | 7.1 | Glyma.06G209800.1 | 1344 | Hydroxyproline-rich glycoprotein family protein |
| leaf | 7.1 | Glyma.12G100100.3 | 2300 | homeodomain GLABROUS 2 |
| leaf | 7.1 | Glyma.13G106700.3 | 2413 | |
| leaf | 7.1 | Glyma.05G158800.3 | 1154 | Leucine-rich repeat protein kinase family protein |
| leaf | 7.1 | Glyma.13G048000.1 | 2381 | kinase interacting (KIP1-like) family protein |
| leaf | 7.1 | Glyma.15G223200.2 | 2833 | DNAse I-like superfamily protein |
| root | 7.1 | Glyma.13G106700.3 | 2413 | |
| root | 7.1 | Glyma.05G158800.3 | 1154 | Leucine-rich repeat protein kinase family protein |
| root | 7.1 | Glyma.11G223400.1 | 2233 | Cupredoxin superfamily protein |
| root | 7.1 | Glyma.04G036100.1 | 938 | Major facilitator superfamily protein |
| root | 7.1 | Glyma.08G055500.1 | 1569 | ABC-2 type transporter family protein |
| root | 7.1 | Glyma.03G187400.1 | 867 | don-glucosyltransferase 1 |
| leaf | 7.1 | Glyma.02G303000.1 | 773 | Aldolase superfamily protein |
| leaf | 7.1 | Glyma.11G223400.1 | 2233 | Cupredoxin superfamily protein |
| leaf | 7.1 | Glyma.04G036100.1 | 938 | Major facilitator superfamily protein |
| leaf | 7.1 | Glyma.12G043300.1 | 2272 | |
| leaf | 7.1 | Glyma.08G055500.1 | 1569 | ABC-2 type transporter family protein |
| leaf | 7.1 | Glyma.03G187400.1 | 867 | don-glucosyltransferase 1 |
| leaf | 7.0 | Glyma.19G221700.2 | 3417 | WRKY family transcription factor |
| leaf | 7.0 | Glyma.18G147800.1 | 3226 | U-box domain-containing protein kinase family protein |
| leaf | 7.0 | Glyma.20G000800.1 | 3451 | DNAse I-like superfamily protein |
| leaf | 7.0 | Glyma.03G142000.1 | 839 | cytochrome P450, family 93, subfamily D, polypeptide 1 |
| leaf | 7.0 | Glyma.12G234200.5 | 2356 | trehalose-6-phosphate synthase |
| leaf | 7.0 | Glyma.U018200.1 | 3564 | responsive to abscisic acid 28 |
| root | 7.0 | Glyma.18G147800.1 | 3226 | U-box domain-containing protein kinase family protein |
| root | 7.0 | Glyma.20G000800.1 | 3451 | DNAse I-like superfamily protein |
| root | 7.0 | Glyma.03G142000.1 | 839 | cytochrome P450, family 93, subfamily D, polypeptide 1 |
| root | 7.0 | Glyma.12G234200.5 | 2356 | trehalose-6-phosphate synthase |
| root | 7.0 | Glyma.03G169900.2 | 852 | RNI-like superfamily protein |
| leaf | 7.0 | Glyma.03G169900.2 | 852 | RNI-like superfamily protein |
| leaf | 7.0 | Glyma.13G027300.1 | 2361 | |
| leaf | 6.9 | Glyma.16G180400.1 | 2971 | Calcium-dependent lipid-binding (CaLB domain) family protein |
| leaf | 6.9 | Glyma.16G208300.1 | 2990 | carboxyesterase 18 |
| leaf | 6.9 | Glyma.14G145900.1 | 2665 | Regulator of chromosome condensation (RCC1) family protein |
| root | 6.9 | Glyma.16G180400.1 | 2971 | Calcium-dependent lipid-binding (CaLB domain) family protein |
| root | 6.9 | Glyma.11G238500.2 | 2243 | slufate transporter 2; 1 |
| leaf | 6.9 | Glyma.11G238500.2 | 2243 | slufate transporter 2; 1 |
| leaf | 6.9 | Glyma.10G237100.1 | 2053 | |
| leaf | 6.8 | Glyma.09G154700.1 | 1860 | light harvesting complex of photosystem II 5 |
| leaf | 6.8 | Glyma.07G104300.1 | 1452 | |
| leaf | 6.8 | Glyma.04G070000.1 | 966 | |
| leaf | 6.8 | Glyma.03G184900.1 | 863 | Protein of unknown function (DUF1624) |

TABLE 8F-continued

Transcripts that are up- or down- regulated at least 5 fold higher or lower in the beneficial *Streptomyces* strain Strain C as compared to to the control *Streptomyces* strain Strain A.

| Tissue | StrainC/ StrainA | TranscriptName | SEQ ID | Transcript Description |
|---|---|---|---|---|
| root | 6.8 | Glyma.03G184900.1 | 863 | Protein of unknown function (DUF1624) |
| root | 6.8 | Glyma.02G245600.1 | 742 | Gibberellin-regulated family protein |
| leaf | 6.8 | Glyma.10G168100.1 | 1995 | ammonium transporter 1; 2 |
| leaf | 6.8 | Glyma.17G033300.1 | 3017 | Acyl-CoA N-acyltransferases (NAT) superfamily protein |
| leaf | 6.8 | Glyma.08G140100.1 | 1642 | bZIP transcription factor family protein |
| leaf | 6.8 | Glyma.02G245600.1 | 742 | Gibberellin-regulated family protein |
| leaf | 6.7 | Glyma.17G028000.2 | 3012 | 2-oxoacid dehydrogenases acyltransferase family protein |
| leaf | 6.7 | Glyma.18G012300.1 | 3160 | Pectate lyase family protein |
| leaf | 6.7 | Glyma.04G169600.1 | 1010 | GAST1 protein homolog 4 |
| leaf | 6.7 | Glyma.09G258400.1 | 1914 | |
| leaf | 6.7 | Glyma.09G063300.1 | 1809 | |
| leaf | 6.7 | Glyma.07G001800.1 | 1403 | Mitochondrial substrate carrier family protein |
| leaf | 6.7 | Glyma.10G245300.1 | 2060 | Acyl-CoA N-acyltransferases (NAT) superfamily protein |
| root | 6.7 | Glyma.18G012300.1 | 3160 | Pectate lyase family protein |
| root | 6.7 | Glyma.03G187200.1 | 865 | don-glucosyltransferase 1 |
| leaf | 6.7 | Glyma.03G187200.1 | 865 | don-glucosyltransferase 1 |
| leaf | 6.7 | Glyma.08G118300.1 | 1617 | |
| leaf | 6.6 | Glyma.14G186400.1 | 2680 | |
| leaf | 6.6 | Glyma.08G138200.2 | 1639 | myo-inositol-1-phosphate synthase 3 |
| leaf | 6.6 | Glyma.06G312600.1 | 1389 | Protein kinase superfamily protein |
| leaf | 6.6 | Glyma.04G090800.1 | 978 | |
| leaf | 6.6 | Glyma.08G235300.1 | 1711 | Kunitz family trypsin and protease inhibitor protein |
| leaf | 6.6 | Glyma.12G017100.1 | 2260 | Polyketide cyclase/dehydrase and lipid transport superfamily protein |
| leaf | 6.6 | Glyma.02G081900.1 | 647 | nodulin MtN21/EamA-like transporter family protein |
| root | 6.6 | Glyma.06G312600.1 | 1389 | Protein kinase superfamily protein |
| root | 6.6 | Glyma.12G017100.1 | 2260 | Polyketide cyclase/dehydrase and lipid transport superfamily protein |
| root | 6.6 | Glyma.03G032400.1 | 792 | SPX domain gene 3 |
| root | 6.6 | Glyma.10G142500.1 | 1981 | neurofilament protein-related |
| root | 6.6 | Glyma.09G245900.1 | 1910 | Uridine diphosphate glycosyltransferase 74E2 |
| leaf | 6.6 | Glyma.06G035900.1 | 1239 | cytochrome b6f complex subunit (petM), putative |
| leaf | 6.6 | Glyma.11G180700.2 | 2199 | somatic embryogenesis receptor-like kinase 1 |
| leaf | 6.6 | Glyma.08G129000.1 | 1629 | Subtilase family protein |
| leaf | 6.6 | Glyma.03G032400.1 | 792 | SPX domain gene 3 |
| leaf | 6.6 | Glyma.10G142500.1 | 1981 | neurofilament protein-related |
| leaf | 6.6 | Glyma.09G245900.1 | 1910 | Uridine diphosphate glycosyltransferase 74E2 |
| leaf | 6.6 | Glyma.06G319700.1 | 1392 | Leucine-rich repeat (LRR) family protein |
| leaf | 6.5 | Glyma.02G090100.1 | 655 | MATE efflux family protein |
| leaf | 6.5 | Glyma.10G169800.1 | 2000 | Subtilisin-like serine endopeptidase family protein |
| leaf | 6.5 | Glyma.10G223200.1 | 2047 | Integrase-type DNA-binding superfamily protein |
| leaf | 6.5 | Glyma.06G132600.1 | 1301 | Rhodanese/Cell cycle control phosphatase superfamily protein |
| root | 6.5 | Glyma.02G090100.1 | 655 | MATE efflux family protein |
| root | 6.5 | Glyma.10G169800.1 | 2000 | Subtilisin-like serine endopeptidase family protein |
| root | 6.5 | Glyma.10G206800.1 | 2036 | |
| leaf | 6.5 | Glyma.10G206800.1 | 2036 | |
| leaf | 6.5 | Glyma.01G185400.1 | 572 | Cyclin-dependent kinase inhibitor family protein |
| leaf | 6.4 | Glyma.08G190700.1 | 1679 | multidrug resistance-associated protein 6 |
| leaf | 6.4 | Glyma.03G263900.1 | 919 | GDSL-motif lipase 5 |
| root | 6.4 | Glyma.08G190700.1 | 1679 | multidrug resistance-associated protein 6 |
| root | 6.4 | Glyma.03G263900.1 | 919 | GDSL-motif lipase 5 |
| root | 6.4 | Glyma.02G102700.1 | 673 | PLC-like phosphodiesterases superfamily protein |
| leaf | 6.4 | Glyma.15G186100.1 | 2818 | Cytidine/deoxycytidylate deaminase family protein |
| leaf | 6.4 | Glyma.11G184100.1 | 2204 | NAD+ ADP-ribosyltransferases; NAD+ ADP-ribosyltransferases |
| leaf | 6.4 | Glyma.09G173300.1 | 1869 | |
| leaf | 6.4 | Glyma.02G102900.2 | 674 | plant U-box 26 |
| leaf | 6.4 | Glyma.20G210100.1 | 3545 | Eukaryotic aspartyl protease family protein |
| leaf | 6.4 | Glyma.07G056800.1 | 1434 | alpha/beta-Hydrolases superfamily protein |
| leaf | 6.4 | Glyma.02G102700.1 | 673 | PLC-like phosphodiesterases superfamily protein |
| leaf | 6.4 | Glyma.18G036400.1 | 3171 | rubisco activase |
| leaf | 6.4 | Glyma.19G175200.1 | 3384 | exocyst subunit exo70 family protein H4 |
| leaf | 6.3 | Glyma.11G196400.1 | 2218 | |
| leaf | 6.3 | Glyma.02G145000.3 | 690 | NIMA-related kinase 4 |
| leaf | 6.3 | Glyma.11G028000.1 | 2101 | Subtilase family protein |
| leaf | 6.3 | Glyma.15G025200.1 | 2719 | |
| leaf | 6.3 | Glyma.05G204500.4 | 1188 | CBS/octicosapeptide/Phox/Bemp1 (PB1) domains-containing protein |
| leaf | 6.3 | Glyma.05G063000.4 | 1106 | PPPDE putative thiol peptidase family protein |
| leaf | 6.3 | Glyma.10G167800.1 | 1993 | ammonium transporter 1; 2 |
| root | 6.3 | Glyma.11G028000.1 | 2101 | Subtilase family protein |
| root | 6.3 | Glyma.15G025200.1 | 2719 | |
| root | 6.3 | Glyma.05G204500.4 | 1188 | CBS/octicosapeptide/Phox/Bemp1 (PB1) domains-containing protein |
| root | 6.3 | Glyma.05G063000.4 | 1106 | PPPDE putative thiol peptidase family protein |
| root | 6.3 | Glyma.13G183500.1 | 2459 | |
| leaf | 6.3 | Glyma.13G183500.1 | 2459 | |
| leaf | 6.3 | Glyma.13G274900.1 | 2527 | squamosa promoter-binding protein-like 12 |
| leaf | 6.3 | Glyma.15G007300.1 | 2707 | Cystathionine beta-synthase (CBS) protein |

TABLE 8F-continued

Transcripts that are up- or down- regulated at least 5 fold higher or lower in the beneficial *Streptomyces* strain Strain C as compared to to the control *Streptomyces* strain Strain A.

| Tissue | StrainC/ StrainA | TranscriptName | SEQ ID | Transcript Description |
|---|---|---|---|---|
| leaf | 6.3 | Glyma.12G223500.1 | 2353 | Dynein light chain type 1 family protein |
| leaf | 6.3 | Glyma.18G270400.1 | 3274 | 3-ketoacyl-acyl carrier protein synthase 1 |
| leaf | 6.2 | Glyma.15G005000.3 | 2705 | basic helix-loop-helix (bHLH) DNA-binding superfamily protein |
| leaf | 6.2 | Glyma.15G063000.1 | 2742 | basic helix-loop-helix (bHLH) DNA-binding superfamily protein |
| leaf | 6.2 | Glyma.05G152400.3 | 1152 | |
| leaf | 6.2 | Glyma.13G240300.1 | 2503 | Aluminium induced protein with YGL and LRDR motifs |
| leaf | 6.2 | Glyma.02G305400.1 | 776 | photosystem II light harvesting complex gene 2.1 |
| leaf | 6.2 | Glyma.06G239500.1 | 1363 | UDP-glucosyl transferase 72E1 |
| leaf | 6.2 | Glyma.13G127700.1 | 2425 | hydroxyproline-rich glycoprotein family protein |
| leaf | 6.2 | Glyma.02G217600.4 | 724 | Phosphoglycerate mutase family protein |
| leaf | 6.2 | Glyma.19G196900.1 | 3396 | NAD(P)-binding Rossmann-fold superfamily protein |
| root | 6.2 | Glyma.05G152400.3 | 1152 | |
| root | 6.2 | Glyma.19G196900.1 | 3396 | NAD(P)-binding Rossmann-fold superfamily protein |
| leaf | 6.2 | Glyma.03G168000.1 | 850 | pleiotropic drug resistance 12 |
| leaf | 6.2 | Glyma.08G235400.1 | 1713 | kunitz trypsin inhibitor 1 |
| leaf | 6.2 | Glyma.16G165500.1 | 2953 | light-harvesting chlorophyll-protein complex II subunit B1 |
| leaf | 6.2 | Glyma.15G118500.1 | 2786 | Heavy metal transport/detoxification superfamily protein |
| leaf | 6.2 | Glyma.19G198500.1 | 3399 | Eukaryotic aspartyl protease family protein |
| leaf | 6.1 | Glyma.18G057900.3 | 3185 | NAD(P)-binding Rossmann-fold superfamily protein |
| root | 6.1 | Glyma.13G076400.1 | 2397 | Neutral/alkaline non-lysosomal ceramidase |
| root | 6.1 | Glyma.18G012700.1 | 3162 | P-glycoprotein 18 |
| leaf | 6.1 | Glyma.11G051800.1 | 2122 | cytochrome P450, family 81, subfamily D, polypeptide 3 |
| leaf | 6.1 | Glyma.13G076400.1 | 2397 | Neutral/alkaline non-lysosomal ceramidase |
| leaf | 6.1 | Glyma.16G093800.12 | 2910 | Helicase/SANT-associated, DNA binding protein |
| leaf | 6.1 | Glyma.18G012700.1 | 3162 | P-glycoprotein 18 |
| leaf | 6.1 | Glyma.08G074000.1 | 1586 | light harvesting complex photosystem II subunit 6 |
| leaf | 6.1 | Glyma.01G167200.1 | 547 | Plant protein of unknown function (DUF869) |
| leaf | 6.1 | Glyma.08G038600.1 | 1555 | Flavin-binding monooxygenase family protein |
| leaf | 6.0 | Glyma.13G093600.1 | 2406 | Protein kinase superfamily protein |
| leaf | 6.0 | Glyma.13G191600.1 | 2466 | sulfotransferase 2A |
| leaf | 6.0 | Glyma.17G112000.1 | 3070 | Calcium-binding EF-hand family protein |
| leaf | 6.0 | Glyma.03G154700.1 | 844 | Terpenoid cyclases/Protein prenyltransferases superfamily protein |
| leaf | 6.0 | Glyma.13G072000.1 | 2391 | spermidine hydroxycinnamoyl transferase |
| leaf | 6.0 | Glyma.12G219300.1 | 2349 | light-harvesting chlorophyll B-binding protein 3 |
| leaf | 6.0 | Glyma.13G222700.2 | 2493 | Pentatricopeptide repeat (PPR) superfamily protein |
| root | 6.0 | Glyma.08G038600.1 | 1555 | Flavin-binding monooxygenase family protein |
| root | 6.0 | Glyma.13G093600.1 | 2406 | Protein kinase superfamily protein |
| root | 6.0 | Glyma.13G191600.1 | 2466 | sulfotransferase 2A |
| root | 6.0 | Glyma.03G154700.1 | 844 | Terpenoid cyclases/Protein prenyltransferases superfamily protein |
| root | 6.0 | Glyma.18G289800.1 | 3287 | Uncharacterised protein family (UPF0497) |
| root | 6.0 | Glyma.08G327300.1 | 1752 | cytochrome P450, family 71, subfamily B, polypeptide 35 |
| root | 6.0 | Glyma.09G188700.1 | 1873 | sulfate transporter 3; 1 |
| leaf | 6.0 | Glyma.15G037300.4 | 2725 | TRF-like 2 |
| leaf | 6.0 | Glyma.18G289800.1 | 3287 | Uncharacterised protein family (UPF0497) |
| leaf | 6.0 | Glyma.08G327300.1 | 1752 | cytochrome P450, family 71, subfamily B, polypeptide 35 |
| leaf | 6.0 | Glyma.09G188700.1 | 1873 | sulfate transporter 3; 1 |
| leaf | 6.0 | Glyma.18G210500.1 | 3247 | PYRIMIDINE 4 |
| leaf | 6.0 | Glyma.07G102700.1 | 1450 | S-adenosyl-L-methionine-dependent methyltransferases superfamily protein |
| leaf | 6.0 | Glyma.06G222500.1 | 1351 | Zinc-binding dehydrogenase family protein |
| leaf | 5.9 | Glyma.20G063100.1 | 3474 | zinc transporter 1 precursor |
| leaf | 5.9 | Glyma.13G270100.1 | 2521 | D-mannose binding lectin protein with Apple-like carbohydrate-binding domain |
| leaf | 5.9 | Glyma.08G205800.1 | 1696 | Mitochondrial substrate carrier family protein |
| leaf | 5.9 | Glyma.16G173500.1 | 2963 | SLAC1 homologue 3 |
| leaf | 5.9 | Glyma.09G170100.1 | 1866 | Uncharacterised protein family (UPF0497) |
| leaf | 5.9 | Glyma.17G226100.1 | 3128 | Leucine-rich receptor-like protein kinase family protein |
| leaf | 5.9 | Glyma.10G183400.1 | 2013 | PLAC8 family protein |
| leaf | 5.9 | Glyma.03G258700.1 | 912 | myb domain protein 4 |
| leaf | 5.9 | Glyma.19G237800.1 | 3428 | glutathione synthetase 2 |
| root | 5.9 | Glyma.06G222500.1 | 1351 | Zinc-binding dehydrogenase family protein |
| root | 5.9 | Glyma.20G063100.1 | 3474 | zinc transporter 1 precursor |
| root | 5.9 | Glyma.09G170100.1 | 1866 | Uncharacterised protein family (UPF0497) |
| root | 5.9 | Glyma.10G183400.1 | 2013 | PLAC8 family protein |
| root | 5.9 | Glyma.19G237800.1 | 3428 | glutathione synthetase 2 |
| root | 5.9 | Glyma.03G211700.1 | 882 | indeterminate(ID)-domain 2 |
| leaf | 5.9 | Glyma.19G051500.1 | 3333 | RING domain ligase1 |
| leaf | 5.9 | Glyma.17G115900.1 | 3074 | Lactoylglutathione lyase/glyoxalase I family protein |
| leaf | 5.9 | Glyma.16G109300.1 | 2917 | cytochrome P450, family 707, subfamily A, polypeptide 1 |
| leaf | 5.9 | Glyma.03G211700.1 | 882 | indeterminate(ID)-domain 2 |
| leaf | 5.9 | Glyma.19G260600.1 | 3446 | photosystem I P subunit |
| leaf | 5.9 | Glyma.13G221900.1 | 2488 | serine carboxypeptidase-like 12 |
| leaf | 5.9 | Glyma.06G042700.1 | 1245 | Serine/threonine-protein kinase WNK (With No Lysine)-related |
| leaf | 5.8 | Glyma.02G009200.4 | 612 | shaggy-related kinase 11 |
| leaf | 5.8 | Glyma.15G024600.1 | 2718 | Glycosyl hydrolases family 32 protein |
| leaf | 5.8 | Glyma.08G193500.1 | 1682 | beta galactosidase 1 |

TABLE 8F-continued

Transcripts that are up- or down- regulated at least 5 fold higher or lower in the beneficial
*Streptomyces* strain Strain C as compared to to the control *Streptomyces* strain Strain A.

| Tissue | StrainC/ StrainA | TranscriptName | SEQ ID | Transcript Description |
|---|---|---|---|---|
| leaf | 5.8 | Glyma.02G083200.1 | 649 | cytochrome P450, family 707, subfamily A, polypeptide 3 |
| leaf | 5.8 | Glyma.09G058000.1 | 1802 | Protein of unknown function (DUF630 and DUF632) |
| leaf | 5.8 | Glyma.16G177100.2 | 2968 | Tic22-like family protein |
| leaf | 5.8 | Glyma.02G302400.1 | 770 | RING/U-box superfamily protein |
| leaf | 5.8 | Glyma.16G200100.1 | 2983 | Pyridoxal phosphate (PLP)-dependent transferases superfamily protein |
| root | 5.8 | Glyma.02G009200.4 | 612 | shaggy-related kinase 11 |
| root | 5.8 | Glyma.02G083200.1 | 649 | cytochrome P450, family 707, subfamily A, polypeptide 3 |
| root | 5.8 | Glyma.09G058000.1 | 1802 | Protein of unknown function (DUF630 and DUF632) |
| root | 5.8 | Glyma.16G177100.2 | 2968 | Tic22-like family protein |
| root | 5.8 | Glyma.16G181400.1 | 2974 | NAD(P)-binding Rossmann-fold superfamily protein |
| root | 5.8 | Glyma.01G027100.1 | 494 | protein kinase family protein/peptidoglycan-binding LysM domain-containing protein |
| root | 5.8 | Glyma.13G351600.1 | 2586 | Pyridoxal phosphate phosphatase-related protein |
| leaf | 5.8 | Glyma.16G181400.1 | 2974 | NAD(P)-binding Rossmann-fold superfamily protein |
| leaf | 5.8 | Glyma.11G042200.1 | 2115 | glycine decarboxylase complex H |
| leaf | 5.8 | Glyma.01G027100.1 | 494 | protein kinase family protein/peptidoglycan-binding LysM domain-containing protein |
| leaf | 5.8 | Glyma.10G064400.1 | 1956 | embryonic cell protein 63 |
| leaf | 5.8 | Glyma.13G351600.1 | 2586 | Pyridoxal phosphate phosphatase-related protein |
| leaf | 5.8 | Glyma.16G151000.1 | 2940 | PEBP (phosphatidylethanolamine-binding protein) family protein |
| leaf | 5.7 | Glyma.06G321500.1 | 1394 | FAD-binding Berberine family protein |
| leaf | 5.7 | Glyma.13G177100.1 | 2450 | |
| leaf | 5.7 | Glyma.19G024200.1 | 3311 | expansin A15 |
| leaf | 5.7 | Glyma.04G168500.1 | 1008 | GDSL-like Lipase/Acylhydrolase superfamily protein |
| leaf | 5.7 | Glyma.03G200200.1 | 876 | Ovate family protein |
| leaf | 5.7 | Glyma.08G224100.1 | 1705 | |
| leaf | 5.7 | Glyma.13G364400.1 | 2596 | |
| leaf | 5.7 | Glyma.07G219600.1 | 1504 | CLAVATA3/ESR-RELATED 17 |
| root | 5.7 | Glyma.06G321500.1 | 1394 | FAD-binding Berberine family protein |
| root | 5.7 | Glyma.13G177100.1 | 2450 | |
| root | 5.7 | Glyma.04G168500.1 | 1008 | GDSL-like Lipase/Acylhydrolase superfamily protein |
| root | 5.7 | Glyma.03G200200.1 | 876 | Ovate family protein |
| root | 5.7 | Glyma.13G364400.1 | 2596 | |
| root | 5.7 | Glyma.08G089500.1 | 1599 | cytochrome P450, family 81, subfamily D, polypeptide 3 |
| root | 5.7 | Glyma.09G201400.1 | 1881 | Concanavalin A-like lectin protein kinase family protein |
| leaf | 5.7 | Glyma.08G188500.1 | 1675 | 2Fe-2S ferredoxin-like superfamily protein |
| leaf | 5.7 | Glyma.15G251700.1 | 2843 | glutathione S-transferase TAU 19 |
| leaf | 5.7 | Glyma.14G031000.1 | 2621 | glutathione S-transferase PHI 9 |
| leaf | 5.7 | Glyma.06G050100.3 | 1252 | branched-chain amino acid transaminase 2 |
| leaf | 5.7 | Glyma.08G089500.1 | 1599 | cytochrome P450, family 81, subfamily D, polypeptide 3 |
| leaf | 5.7 | Glyma.11G059100.1 | 2131 | Reticulan like protein B13 |
| leaf | 5.7 | Glyma.17G239100.1 | 3136 | |
| leaf | 5.7 | Glyma.04G160100.1 | 1003 | COBRA-like extracellular glycosyl-phosphatidyl inositol-anchored protein family |
| leaf | 5.7 | Glyma.09G201400.1 | 1881 | Concanavalin A-like lectin protein kinase family protein |
| leaf | 5.7 | Glyma.07G266200.2 | 1528 | Inositol monophosphatase family protein |
| leaf | 5.7 | Glyma.02G281400.1 | 756 | Bifunctional inhibitor/lipid-transfer protein/seed storage 2S albumin superfamily protein |
| leaf | 5.6 | Glyma.08G132100.1 | 1633 | Protein of unknown function (DUF707) |
| leaf | 5.6 | Glyma.02G092600.1 | 658 | Uncharacterised protein family (UPF0497) |
| leaf | 5.6 | Glyma.11G003200.1 | 2085 | gibberellin 2-oxidase 8 |
| leaf | 5.6 | Glyma.17G092800.1 | 3055 | Gibberellin-regulated family protein |
| leaf | 5.6 | Glyma.16G109300.2 | 2918 | cytochrome P450, family 707, subfamily A, polypeptide 1 |
| leaf | 5.6 | Glyma.09G281200.3 | 1923 | Mitochondrial substrate carrier family protein |
| leaf | 5.6 | Glyma.19G011300.3 | 3303 | nodulin MtN21/EamA-like transporter family protein |
| leaf | 5.6 | Glyma.01G142400.1 | 539 | |
| leaf | 5.6 | Glyma.10G046000.1 | 1950 | exocyst subunit exo70 family protein H4 |
| root | 5.6 | Glyma.02G092600.1 | 658 | Uncharacterised protein family (UPF0497) |
| root | 5.6 | Glyma.09G281200.3 | 1923 | Mitochondrial substrate carrier family protein |
| root | 5.6 | Glyma.12G017400.1 | 2261 | Target of Myb protein 1 |
| root | 5.6 | Glyma.11G066600.1 | 2139 | Major facilitator superfamily protein |
| leaf | 5.6 | Glyma.13G244100.1 | 2506 | |
| leaf | 5.6 | Glyma.05G174200.3 | 1164 | Melibiase family protein |
| leaf | 5.6 | Glyma.06G062000.1 | 1264 | |
| leaf | 5.6 | Glyma.12G017400.1 | 2261 | Target of Myb protein 1 |
| leaf | 5.6 | Glyma.11G066600.1 | 2139 | Major facilitator superfamily protein |
| leaf | 5.6 | Glyma.14G115500.1 | 2655 | Bifunctional inhibitor/lipid-transfer protein/seed storage 2S albumin superfamily protein |
| leaf | 5.6 | Glyma.11G237600.1 | 2241 | MAR binding filament-like protein 1 |
| leaf | 5.6 | Glyma.14G209700.1 | 1887 | Tetratricopeptide repeat (TPR)-like superfamily protein |
| leaf | 5.5 | Glyma.12G150400.1 | 2314 | protochlorophyllide oxidoreductase A |
| leaf | 5.5 | Glyma.12G218900.1 | 2347 | Dynein light chain type 1 family protein |
| leaf | 5.5 | Glyma.06G235000.1 | 1359 | UDP-Glycosyltransferase superfamily protein |
| leaf | 5.5 | Glyma.06G234500.2 | 1357 | RING/U-box superfamily protein |
| leaf | 5.5 | Glyma.09G231900.1 | 1905 | Plant invertase/pectin methylesterase inhibitor superfamily protein |
| leaf | 5.5 | Glyma.10G205700.1 | 2033 | |
| leaf | 5.5 | Glyma.05G208000.4 | 1191 | Mitochondrial substrate carrier family protein |
| leaf | 5.5 | Glyma.06G110400.1 | 1285 | cold shock domain protein 1 |
| leaf | 5.5 | Glyma.05G023700.1 | 1078 | Flavin-binding monooxygenase family protein |

TABLE 8F-continued

Transcripts that are up- or down- regulated at least 5 fold higher or lower in the beneficial
*Streptomyces* strain Strain C as compared to to the control *Streptomyces* strain Strain A.

| Tissue | StrainC/ StrainA | TranscriptName | SEQ ID | Transcript Description |
|---|---|---|---|---|
| leaf | 5.5 | Glyma.06G139500.1 | 1304 | ATP binding cassette subfamily B19 |
| root | 5.5 | Glyma.05G023700.1 | 1078 | Flavin-binding monooxygenase family protein |
| root | 5.5 | Glyma.06G139500.1 | 1304 | ATP binding cassette subfamily B19 |
| root | 5.5 | Glyma.08G297000.1 | 1737 | Integrase-type DNA-binding superfamily protein |
| root | 5.5 | Glyma.18G269700.1 | 3273 | PLC-like phosphodiesterases superfamily protein |
| root | 5.5 | Glyma.06G224200.2 | 1352 | chloroplast thylakoid lumen protein |
| root | 5.5 | Glyma.16G043000.1 | 2880 | hydroxyproline-rich glycoprotein family protein |
| leaf | 5.5 | Glyma.13G091100.2 | 2401 | nodulin MtN21/EamA-like transporter family protein |
| leaf | 5.5 | Glyma.08G199300.1 | 1689 | myo-inositol oxygenase 1 |
| leaf | 5.5 | Glyma.08G297000.1 | 1737 | Integrase-type DNA-binding superfamily protein |
| leaf | 5.5 | Glyma.18G269700.1 | 3273 | PLC-like phosphodiesterases superfamily protein |
| leaf | 5.5 | Glyma.18G057900.4 | 3186 | NAD(P)-binding Rossmann-fold superfamily protein |
| leaf | 5.5 | Glyma.06G224200.2 | 1352 | chloroplast thylakoid lumen protein |
| leaf | 5.5 | Glyma.06G157000.2 | 1317 | |
| leaf | 5.5 | Glyma.17G176400.2 | 3111 | Protein of unknown function, DUF547 |
| leaf | 5.5 | Glyma.13G270600.1 | 2523 | general regulatory factor 9 |
| leaf | 5.5 | Glyma.13G169400.1 | 2442 | |
| leaf | 5.5 | Glyma.16G043000.1 | 2880 | hydroxyproline-rich glycoprotein family protein |
| leaf | 5.5 | Glyma.11G099700.1 | 2154 | serine carboxypeptidase-like 34 |
| leaf | 5.4 | Glyma.11G063400.1 | 2136 | PQ-loop repeat family protein/transmembrane family protein |
| leaf | 5.4 | Glyma.05G106000.4 | 1120 | Homeodomain-like/winged-helix DNA-binding family protein |
| leaf | 5.4 | Glyma.15G176200.1 | 2811 | |
| leaf | 5.4 | Glyma.04G198200.2 | 1025 | tapetum determinant 1 |
| leaf | 5.4 | Glyma.08G156600.1 | 1650 | |
| leaf | 5.4 | Glyma.15G066400.1 | 2744 | Major facilitator superfamily protein |
| leaf | 5.4 | Glyma.17G050100.1 | 3032 | DENN (AEX-3) domain-containing protein |
| leaf | 5.4 | Glyma.19G093500.1 | 3343 | |
| leaf | 5.4 | Glyma.08G109100.1 | 1613 | UDP-D-glucuronate 4-epimerase 6 |
| root | 5.4 | Glyma.1G099700.1 | 2154 | serine carboxypeptidase-like 34 |
| root | 5.4 | Glyma.15G176200.1 | 2811 | |
| root | 5.4 | Glyma.04G198200.2 | 1025 | tapetum determinant 1 |
| root | 5.4 | Glyma.15G066400.1 | 2744 | Major facilitator superfamily protein |
| root | 5.4 | Glyma.17G133500.1 | 3082 | Subtilase family protein |
| root | 5.4 | Glyma.08G166600.1 | 1661 | Eukaryotic aspartyl protease family protein |
| root | 5.4 | Glyma.16G168600.1 | 2959 | cytochrome P450, family 707, subfamily A, polypeptide 3 |
| leaf | 5.4 | Glyma.02G153000.1 | 697 | Glutaredoxin family protein |
| leaf | 5.4 | Glyma.17G133500.1 | 3082 | Subtilase family protein |
| leaf | 5.4 | Glyma.11G180700.4 | 2200 | somatic embryogenesis receptor-like kinase 1 |
| leaf | 5.4 | Glyma.05G108200.1 | 1125 | basic leucine-zipper 5 |
| leaf | 5.4 | Glyma.08G166600.1 | 1661 | Eukaryotic aspartyl protease family protein |
| leaf | 5.4 | Glyma.11G180800.1 | 2202 | NAD(P)-binding Rossmann-fold superfamily protein |
| leaf | 5.4 | Glyma.08G073900.1 | 1584 | Thioesterase superfamily protein |
| leaf | 5.4 | Glyma.02G158700.3 | 703 | dihydroflavonol 4-reductase |
| leaf | 5.4 | Glyma.02G080200.1 | 643 | Integrase-type DNA-binding superfamily protein |
| leaf | 5.4 | Glyma.16G168600.1 | 2959 | cytochrome P450, family 707, subfamily A, polypeptide 3 |
| leaf | 5.4 | Glyma.18G247100.1 | 3262 | UDP-Glycosyltransferase superfamily protein |
| leaf | 5.3 | Glyma.19G099400.1 | 3348 | Esterase/lipase/thioesterase family protein |
| leaf | 5.3 | Glyma.01G192400.5 | 578 | |
| leaf | 5.3 | Glyma.18G018900.1 | 3165 | slufate transporter 2; 1 |
| leaf | 5.3 | Glyma.05G163000.1 | 1160 | nitrate transporter 1:2 |
| leaf | 5.3 | Glyma.08G008800.1 | 1534 | acyl carrier protein 4 |
| leaf | 5.3 | Glyma.04G023900.1 | 930 | tubulin beta-1 chain |
| leaf | 5.3 | Glyma.04G042300.1 | 945 | myb domain protein 73 |
| root | 5.3 | Glyma.18G247100.1 | 3262 | UDP-Glycosyltransferase superfamily protein |
| root | 5.3 | Glyma.18G018900.1 | 3165 | slufate transporter 2; 1 |
| root | 5.3 | Glyma.05G163000.1 | 1160 | nitrate transporter 1:2 |
| root | 5.3 | Glyma.02G101400.1 | 670 | 2-oxoglutarate (2OG) and Fe(II)-dependent oxygenase superfamily protein |
| root | 5.3 | Glyma.08G037000.1 | 1553 | Transducin/WD40 repeat-like superfamily protein |
| root | 5.3 | Glyma.12G185800.1 | 2327 | germin-like protein 10 |
| leaf | 5.3 | Glyma.02G101400.1 | 670 | 2-oxoglutarate (2OG) and Fe(II)-dependent oxygenase superfamily protein |
| leaf | 5.3 | Glyma.19G261400.1 | 3448 | Chlorophyll A-B binding family protein |
| leaf | 5.3 | Glyma.11G056700.1 | 2128 | Cyclin-dependent kinase inhibitor family protein |
| leaf | 5.3 | Glyma.09G126400.1 | 1837 | |
| leaf | 5.3 | Glyma.19G046600.2 | 3328 | Ribulose bisphosphate carboxylase (small chain) family protein |
| leaf | 5.3 | Glyma.10G248900.1 | 2065 | Haloacid dehalogenase-like hydrolase (HAD) superfamily protein |
| leaf | 5.3 | Glyma.08G037000.1 | 1553 | Transducin/WD40 repeat-like superfamily protein |
| leaf | 5.3 | Glyma.01G085600.1 | 519 | UDP-Glycosyltransferase superfamily protein |
| leaf | 5.3 | Glyma.02G228300.1 | 733 | mitogen-activated protein kinase kinase kinase 14 |
| leaf | 5.3 | Glyma.14G051900.1 | 2631 | |
| leaf | 5.3 | Glyma.04G035000.1 | 935 | allene oxide synthase |
| leaf | 5.3 | Glyma.14G005500.1 | 2606 | |
| leaf | 5.3 | Glyma.06G177800.1 | 1329 | C2 calcium/lipid-binding and GRAM domain containing protein |
| leaf | 5.3 | Glyma.12G185800.1 | 2327 | germin-like protein 10 |
| leaf | 5.2 | Glyma.08G125100.2 | 1627 | cytochrome P450, family 716, subfamily A, polypeptide 1 |

TABLE 8F-continued

Transcripts that are up- or down- regulated at least 5 fold higher or lower in the beneficial *Streptomyces* strain Strain C as compared to to the control *Streptomyces* strain Strain A.

| Tissue | StrainC/ StrainA | TranscriptName | SEQ ID | Transcript Description |
|---|---|---|---|---|
| leaf | 5.2 | Glyma.19G144600.1 | 3372 | cytochrome P450, family 712, subfamily A, polypeptide 1 |
| leaf | 5.2 | Glyma.08G065500.1 | 1580 | Concanavalin A-like lectin protein kinase family protein |
| leaf | 5.2 | Glyma.18G052300.1 | 3180 | extra-large G-protein 1 |
| leaf | 5.2 | Glyma.11G194400.1 | 2214 | BRI1 suppressor 1 (BSU1)-like 2 |
| leaf | 5.2 | Glyma.15G012300.2 | 2711 | Pyridoxal phosphate (PLP)-dependent transferases superfamily protein |
| leaf | 5.2 | Glyma.15G062600.1 | 2740 | basic helix-loop-helix (bHLH) DNA-binding superfamily protein |
| leaf | 5.2 | Glyma.08G138200.1 | 1638 | myo-inositol-1-phosphate synthase 3 |
| leaf | 5.2 | Glyma.13G113000.1 | 2417 | |
| root | 5.2 | Glyma.08G065500.1 | 1580 | Concanavalin A-like lectin protein kinase family protein |
| root | 5.2 | Glyma.18G052300.1 | 3180 | extra-large G-protein 1 |
| root | 5.2 | Glyma.13G113000.1 | 2417 | |
| root | 5.2 | Glyma.05G126200.1 | 1137 | RmlC-like cupins superfamily protein |
| root | 5.2 | Glyma.16G048800.1 | 2887 | beta-galactosidase 7 |
| root | 5.2 | Glyma.05G108500.1 | 1127 | NAD(P)-binding Rossmann-fold superfamily protein |
| root | 5.2 | Glyma.08G327200.1 | 1750 | cytochrome P450, family 71, subfamily B, polypeptide 23 |
| root | 5.2 | Glyma.14G064400.1 | 2640 | Subtilase family protein |
| leaf | 5.2 | Glyma.10G146600.2 | 1985 | iron-regulated protein 3 |
| leaf | 5.2 | Glyma.05G126200.1 | 1137 | RmlC-like cupins superfamily protein |
| leaf | 5.2 | Glyma.16G048800.1 | 2887 | beta-galactosidase 7 |
| leaf | 5.2 | Glyma.09G032100.1 | 1791 | myb domain protein 78 |
| leaf | 5.2 | Glyma.14G195300.1 | 2686 | mitogen-activated protein kinase kinase kinase 14 |
| leaf | 5.2 | Glyma.20G139200.2 | 3509 | cysteine-rich RLK (RECEPTOR-like protein kinase) 29 |
| leaf | 5.2 | Glyma.19G007700.2 | 3299 | carbonic anhydrase 1 |
| leaf | 5.2 | Glyma.05G108500.1 | 1127 | NAD(P)-binding Rossmann-fold superfamily protein |
| leaf | 5.2 | Glyma.08G327200.1 | 1750 | cytochrome P450, family 71, subfamily B, polypeptide 23 |
| leaf | 5.2 | Glyma.02G061600.1 | 633 | Thioredoxin superfamily protein |
| leaf | 5.2 | Glyma.14G064400.1 | 2640 | Subtilase family protein |
| leaf | 5.1 | Glyma.03G240700.1 | 898 | Protein of unknown function (DUF1068) |
| leaf | 5.1 | Glyma.15G183000.1 | 2816 | GDSL-motif lipase 5 |
| leaf | 5.1 | Glyma.12G210200.1 | 2340 | Protein of unknown function, DUF538 |
| leaf | 5.1 | Glyma.15G223900.1 | 2835 | 12-oxophytodienoate reductase 2 |
| leaf | 5.1 | Glyma.14G115700.7 | 2656 | adenine phosphoribosyltransferase 5 |
| leaf | 5.1 | Glyma.04G096400.1 | 979 | Cystatin/monellin superfamily protein |
| leaf | 5.1 | Glyma.18G249400.2 | 3263 | Mitochondrial transcription termination factor family protein |
| leaf | 5.1 | Glyma.13G222700.1 | 2492 | Pentatricopeptide repeat (PPR) superfamily protein |
| leaf | 5.1 | Glyma.02G081000.3 | 646 | UDP-Glycosyltransferase superfamily protein |
| leaf | 5.1 | Glyma.07G197100.1 | 1497 | Protein of unknown function (DUF506) |
| leaf | 5.1 | Glyma.19G030800.1 | 3318 | HXXXD-type acyl-transferase family protein |
| leaf | 5.1 | Glyma.01G036000.1 | 503 | UDP-glucosyl transferase 74B1 |
| leaf | 5.1 | Glyma.08G038200.9 | 1554 | protein kinase family protein |
| root | 5.1 | Glyma.15G183000.1 | 2816 | GDSL-motif lipase 5 |
| root | 5.1 | Glyma.12G210200.1 | 2340 | Protein of unknown function, DUF538 |
| root | 5.1 | Glyma.14G115700.7 | 2656 | adenine phosphoribosyltransferase 5 |
| root | 5.1 | Glyma.04G096400.1 | 979 | Cystatin/monellin superfamily protein |
| root | 5.1 | Glyma.12G090800.1 | 2296 | germin-like protein 10 |
| root | 5.1 | Glyma.12G092400.1 | 2297 | germin-like protein 10 |
| root | 5.1 | Glyma.10G036800.1 | 1943 | phosphate transporter 1; 4 |
| root | 5.1 | Glyma.06G120400.1 | 1291 | Protein kinase superfamily protein |
| root | 5.1 | Glyma.13G182800.1 | 2455 | Protein of unknown function (DUF1218) |
| leaf | 5.1 | Glyma.03G083200.2 | 813 | Haloacid dehalogenase-like hydrolase (HAD) superfamily protein |
| leaf | 5.1 | Glyma.08G167600.2 | 1662 | proteasome subunit PAB1 |
| leaf | 5.1 | Glyma.15G168000.2 | 2806 | Nucleotide/sugar transporter family protein |
| leaf | 5.1 | Glyma.09G115200.1 | 1830 | Core-2/I-branching beta-1,6-N-acetylglucosaminyltransferase family protein |
| leaf | 5.1 | Glyma.07G139800.1 | 1469 | glutathione S-transferase TAU 8 |
| leaf | 5.1 | Glyma.02G130400.1 | 684 | Chalcone and stilbene synthase family protein |
| leaf | 5.1 | Glyma.12G090800.1 | 2296 | germin-like protein 10 |
| leaf | 5.1 | Glyma.12G092400.1 | 2297 | germin-like protein 10 |
| leaf | 5.1 | Glyma.01G225100.1 | 597 | highly ABA-induced PP2C gene 3 |
| leaf | 5.1 | Glyma.10G036800.1 | 1943 | phosphate transporter 1; 4 |
| leaf | 5.1 | Glyma.15G089600.1 | 2762 | Protein of unknown function, DUF584 |
| leaf | 5.1 | Glyma.06G120400.1 | 1291 | Protein kinase superfamily protein |
| leaf | 5.1 | Glyma.10G019000.1 | 1933 | multidrug resistance-associated protein 4 |
| leaf | 5.1 | Glyma.13G231900.1 | 2498 | |
| leaf | 5.1 | Glyma.13G182800.1 | 2455 | Protein of unknown function (DUF1218) |
| leaf | 5.1 | Glyma.20G130300.1 | 3504 | |
| leaf | 5.0 | Glyma.19G206300.4 | 3402 | Kinase interacting (KIP1-like) family protein |
| leaf | 5.0 | Glyma.19G000900.1 | 3294 | actin-11 |
| leaf | 5.0 | Glyma.13G028500.1 | 2362 | serine carboxypeptidase-like 40 |
| leaf | 5.0 | Glyma.19G227800.1 | 3421 | galactinol synthase 2 |
| leaf | 5.0 | Glyma.01G207100.1 | 588 | RING/U-box superfamily protein |
| leaf | 5.0 | Glyma.06G220800.1 | 1349 | blue-copper-binding protein |
| leaf | 5.0 | Glyma.12G190900.1 | 2329 | |
| leaf | 5.0 | Glyma.13G342600.1 | 2576 | AMP-dependent synthetase and ligase family protein |
| leaf | 5.0 | Glyma.08G166200.1 | 1659 | Eukaryotic aspartyl protease family protein |

TABLE 8F-continued

Transcripts that are up- or down- regulated at least 5 fold higher or lower in the beneficial
*Streptomyces* strain Strain C as compared to to the control *Streptomyces* strain Strain A.

| Tissue | StrainC/StrainA | TranscriptName | SEQ ID | Transcript Description |
|---|---|---|---|---|
| leaf | 5.0 | Glyma.16G053000.1 | 2890 | GRAS family transcription factor |
| root | 5.0 | Glyma.13G028500.1 | 2362 | serine carboxypeptidase-like 40 |
| root | 5.0 | Glyma.12G190900.1 | 2329 | |
| root | 5.0 | Glyma.13G342600.1 | 2576 | AMP-dependent synthetase and ligase family protein |
| root | 5.0 | Glyma.08G166200.1 | 1659 | Eukaryotic aspartyl protease family protein |
| root | 5.0 | Glyma.16G053000.1 | 2890 | GRAS family transcription factor |
| root | 5.0 | Glyma.08G275400.1 | 4735 | Concanavalin A-like lectin protein kinase family protein |
| root | 5.0 | Glyma.08G007900.1 | 4723 | magnesium-protoporphyrin IX methyltransferase |
| root | 5.0 | Glyma.13G040200.1 | 4640 | phosphate transporter 1; 1 |
| leaf | −5.1 | Glyma.09G229200.1 | 1902 | purple acid phosphatase 10 |
| root | −5.1 | Glyma.09G229200.1 | 1902 | purple acid phosphatase 10 |
| root | −5.2 | Glyma.20G205900.1 | 3543 | Serine protease inhibitor, potato inhibitor I-type family protein |
| leaf | −5.2 | Glyma.05G231800.1 | 1207 | aldehyde dehydrogenase 2C4 |
| leaf | −5.2 | Glyma.20G205900.1 | 3543 | Serine protease inhibitor, potato inhibitor I-type family protein |
| leaf | −5.3 | Glyma.20G044100.1 | 3468 | alpha/beta-Hydrolases superfamily protein |
| root | −5.3 | Glyma.20G044100.1 | 3468 | alpha/beta-Hydrolases superfamily protein |
| root | −5.3 | Glyma.07G253800.4 | 1521 | RING/U-box superfamily protein |
| leaf | −5.3 | Glyma.07G253800.4 | 1521 | RING/U-box superfamily protein |
| leaf | −5.4 | Glyma.13G076200.3 | 2395 | disease resistance protein (TIR-NBS-LRR class), putative |
| leaf | −5.4 | Glyma.15G031300.1 | 2722 | beta glucosidase 17 |
| root | −5.4 | Glyma.15G031300.1 | 2722 | beta glucosidase 17 |
| root | −5.4 | Glyma.08G107400.11 | 1611 | |
| leaf | −5.4 | Glyma.08G107400.11 | 1611 | |
| root | −5.5 | Glyma.05G247100.1 | 1216 | ABC-2 type transporter family protein |
| leaf | −5.6 | Glyma.05G247100.1 | 1216 | ABC-2 type transporter family protein |
| leaf | −5.6 | Glyma.01G152500.2 | 543 | |
| root | −5.6 | Glyma.01G152500.2 | 543 | |
| root | −5.6 | Glyma.13G297500.3 | 2543 | DTW domain-containing protein |
| leaf | −5.7 | Glyma.13G297500.3 | 2543 | DTW domain-containing protein |
| leaf | −5.7 | Glyma.05G126800.1 | 1140 | |
| root | −5.8 | Glyma.20G119800.1 | 3497 | germin-like protein 10 |
| leaf | −5.8 | Glyma.20G119800.1 | 3497 | germin-like protein 10 |
| leaf | −5.9 | Glyma.08G195000.1 | 1685 | Pyridoxal phosphate phosphatase-related protein |
| root | −5.9 | Glyma.08G195000.1 | 1685 | Pyridoxal phosphate phosphatase-related protein |
| root | −6.2 | Glyma.20G183900.1 | 3536 | |
| leaf | −6.2 | Glyma.20G183900.1 | 3536 | |
| leaf | −6.3 | Glyma.19G244400.1 | 3432 | ammonium transporter 2 |
| root | −6.3 | Glyma.19G244400.1 | 3432 | ammonium transporter 2 |
| leaf | −6.5 | Glyma.11G184800.1 | 2206 | Subtilisin-like serine endopeptidase family protein |
| leaf | −6.5 | Glyma.09G217700.1 | 1895 | |
| root | −6.5 | Glyma.11G184800.1 | 2206 | Subtilisin-like serine endopeptidase family protein |
| leaf | −6.6 | Glyma.14G174300.1 | 2672 | NOD26-like intrinsic protein 3; 1 |
| root | −6.6 | Glyma.14G174300.1 | 2672 | NOD26-like intrinsic protein 3; 1 |
| leaf | −7.4 | Glyma.04G047500.2 | 949 | CW7 |
| root | −7.6 | Glyma.17G066800.1 | 3042 | Protein kinase superfamily protein |
| leaf | −7.6 | Glyma.04G222100.1 | 1041 | expansin A8 |
| leaf | −7.6 | Glyma.17G066800.1 | 3042 | Protein kinase superfamily protein |
| leaf | −7.7 | Glyma.06G023900.1 | 1231 | Pathogenesis-related thaumatin superfamily protein |
| leaf | −8.1 | Glyma.20G229100.1 | 3552 | ARM repeat superfamily protein |
| leaf | −9.5 | Glyma.18G061100.1 | 3189 | glutamine-dependent asparagine synthase 1 |
| leaf | −11.8 | Glyma.02G097400.2 | 666 | Leucine-rich receptor-like protein kinase family protein |
| leaf | −16.8 | Glyma.20G090500.1 | 3482 | Pectinacetylesterase family protein |

TABLE 9

QUANTIFICATION OF SUGAR TRANSPORTER TRANSCRIPTS IN PLANTS GROWN
FROM SEEDS TREATED WITH BENEFICIAL *STREPTOMYCES* STRAINS
The *Streptomyces* strains Strain C and Strain B effected upregulation of sugar transporter transcripts
in plants (grown from seeds treated with said Strains), while the plants grown from seeds treated
with the control *Streptomyces* strain Strain A displayed downregulation of those same genes.

| Tissue | Gene Name | SEQ ID | Strain C | Strain B | Strain A | Best hit *Arabidopsis* | *Arabidopsis* Gene Symbol | *Arabidopsis* Gene Description |
|---|---|---|---|---|---|---|---|---|
| Leaf | Glyma.06G313500 | 1390 | 1.16 | 1.02 | −1.10 | AT5G13750.1 | ZIFL1 | zinc induced facilitator-like 1 |
| Leaf | Glyma.07G144700 | 1471 | 1.23 | 1.30 | −1.08 | AT2G38060.1 | PHT4; 2 | phosphate transporter 4; 2 |
| Leaf | Glyma.07G252800 | 1520 | 1.56 | 1.85 | −1.01 | AT5G18840.1 | | Major facilitator superfamily protein |
| Leaf | Glyma.08G098400 | 1606 | 2.34 | 2.05 | −1.04 | AT1G30220.1 | ATINT2, INT2 | inositol transporter 2 |
| Leaf | Glyma.10G296100 | 2083 | 1.64 | 1.33 | −1.01 | AT2G43330.1 | ATINT1, INT1 | inositol transporter 1 |
| Leaf | Glyma.16G141000 | 2930 | 2.60 | 2.30 | −1.03 | AT2G18480.1 | | Major facilitator superfamily protein |

TABLE 9-continued

QUANTIFICATION OF SUGAR TRANSPORTER TRANSCRIPTS IN PLANTS GROWN
FROM SEEDS TREATED WITH BENEFICIAL *STREPTOMYCES* STRAINS
The *Streptomyces* strains Strain C and Strain B effected upregulation of sugar transporter transcripts
in plants (grown from seeds treated with said Strains), while the plants grown from seeds treated
with the control *Streptomyces* strain Strain A displayed downregulation of those same genes.

| Tissue | Gene Name | SEQ ID | Strain C | Strain B | Strain A | Best hit *Arabidopsis* | *Arabidopsis* Gene Symbol | *Arabidopsis* Gene Description |
|---|---|---|---|---|---|---|---|---|
| Leaf | Glyma.20G246300 | 3559 | 1.26 | 1.06 | −1.18 | AT2G43330.1 | ATINT1, INT1 | inositol transporter 1 |
| Leaf | Glyma.19G253600 | 3440 | 1.29 | 1.20 | −1.05 | AT5G41760.1 | | Nucleotide-sugar transporter family protein |
| Root | Glyma.04G171800 | 1012 | 1.34 | 1.55 | −1.08 | AT1G79360.1 | ATOCT2, OCT2 | organic cation/carnitine transporter 2 |
| Root | Glyma.06G313500 | 1390 | 1.31 | 1.41 | −1.11 | AT5G13750.1 | ZIFL1 | zinc induced facilitator-like 1 |
| Root | Glyma.07G086000 | 1447 | 1.21 | 1.22 | −1.11 | AT3G18830.1 | ATPLT5, ATPMT5, PMT5 | polyol/monosaccharide transporter 5 |
| Root | Glyma.11G066500 | 2138 | 1.61 | 1.56 | −1.02 | AT4G36670.1 | | Major facilitator superfamily protein |
| Root | Glyma.13G186700 | 2463 | 1.32 | 1.26 | −1.02 | AT5G13750.1 | ZIFL1 | zinc induced facilitator-like 1 |
| Root | Glyma.16G216500 | 2993 | 2.05 | 2.04 | −1.04 | AT1G73220.1 | AtOCT1 | organic cation/carnitine transporter1 |
| Root | Glyma.19G238700 | 3429 | 2.08 | 1.29 | −1.03 | AT1G54730.2 | | Major facilitator superfamily protein |
| Root | Glyma.05G142400 | 1146 | 1.28 | 1.29 | −1.04 | AT1G30220.1 | ATINT2, INT2 | inositol transporter 2 |
| Root | Glyma.14G000900 | 2599 | 1.62 | 1.51 | −1.09 | AT4G35300.1 | TMT2 | tonoplast monosaccharide transporter2 |

Table 10: Hormone Analysis Results

TABLE 10A

Plant hormone analysis of Strain C-treated plants under normal watering conditions. The values indicate Strain C/control fold change. Mass spectra of 8 plant hormones were obtained: jasmonic acid (JA), jasmonic acid- isoleucine (JA-Ile), salicylic acid (SA), abscisic acid (ABA), 12-oxo-phytodienoic acid (OPDA), 10-oxo-11 phytoenoic acid (OPEA), traumatic acid (TA) and cinnaminic acid (CA).

| | ABA | SA | CA | JA | JA-Ile | TA | OPDA | OPEA |
|---|---|---|---|---|---|---|---|---|
| Root | 8.06 | 8.03 | 3.15 | 0.74 | 0.64 | 7.42 | 0.67 | 0.61 |
| Stem | 0.73 | 0.77 | 0.43 | 1.07 | 1.32 | 1.24 | 2.05 | 0.41 |
| Leaf | 1.16 | 1.77 | 1.39 | 1.31 | 1.97 | 2.23 | 0.78 | 0.19 |

TABLE 10B

Plant hormone analysis of Strain C-treated plants under water-limited conditions, where a number above 1 indicates an increase in the amount of the hormone in Strain C-treated plants as compared to control, and a number below 1 indicates a decrease in the amount of the hormone in Strain C-treated plants as compared to control. Mass spectra of 8 plant hormones were obtained: jasmonic acid (JA), jasmonic acid- isoleucine (JA-Ile), salicylic acid (SA), abscisic acid (ABA), 12-oxo-phytodienoic acid (OPDA), 10-oxo-11 phytoenoic acid (OPEA), traumatic acid (TA) and cinnaminic acid (CA).

| | ABA | SA | CA | JA | JA-Ile | TA | OPDA | OPEA |
|---|---|---|---|---|---|---|---|---|
| Root | 0.841 | 0.736 | 0.996 | 0.449 | 0.652 | 0.548 | 0.689 | 0.932 |
| Stem | 0.857 | 0.776 | 0.826 | 0.563 | 0.381 | 0.454 | 2.395 | 1.027 |
| Leaf | 0.778 | 1.007 | 1.187 | 0.529 | 0.214 | 0.327 | 4.373 | 1.446 |

Table 11: Metabolomics Results

TABLE 11A

Metabolic analysis of Strain C-treated plants under normal (well-watered) conditions. "+" and "−" denote a relative increase or decrease, respectively, when compared to control plants grown in similar conditions (formulation control).

| Metabolic process | | well-watered | | |
|---|---|---|---|---|
| | | root | stem | leaf |
| Alkaloid metabolism | | | | |
| | tryptophan | | + | + |
| | phenylalanine | | | + |
| | tyrosine | | | + |
| | tryptamine | | | |
| | benzoic acid | | | + |
| | pipecolic acid | + | | |
| | nicotinic acid | | | + |
| Phenylpropanoid metabolism | | | | |
| | phenylalanine | | | + |
| | shikimic acid | | | + |
| | tyrosine | | | |
| | quinic acid | | | + |
| | sinapic acid | | | + |
| | ferulic acid | | | |
| | caffeic acid | | + | |
| Flavonoid/isoflavonoid biosynthesis | | | | |
| | quinic acid | | | + |
| | shikimic acid | | | + |
| | hesperetin | | | + |
| | daidzein | | + | + |
| Lipid metabolism/ fatty alcohols | | | | |
| | ethanolamine | | | + |
| | ethanolaminephosphate | | − | + |
| | sphingosine | | | + |
| | glycerol | | | + |
| | hexadecanoic acid | | − | + |
| | octadecadienoic acid | | | |
| | octadecanoic acid | | + | + |
| | dodecanol | | | + |
| | campesterol | | | + |
| Nitrogen metabolism/ amino acids | | | | |
| | alanine | | | + |
| | β-alanine | | | |
| | allantoin | | + | + |
| | asparagine | | − | + |
| | aspartic acid | − | | |

TABLE 11A-continued

Metabolic analysis of Strain C-treated plants under normal (well-watered) conditions. "+" and "−" denote a relative increase or decrease, respectively, when compared to control plants grown in similar conditions (formulation control).

| Metabolic process | | well-watered | | |
|---|---|---|---|---|
| | | root | stem | leaf |
| | glutamic acid | − | | |
| | glutamine | | + | + |
| | histidine | − | | + |
| | isoleucine | | + | + |
| | leucine | | + | + |
| | methionine | | | |
| | phenylalanine | | | + |
| | proline | | + | + |
| | serine | − | | |
| | threonine | | | + |
| | tryptophan | | + | + |
| | tyrosine | | | + |
| | valine | | | + |
| Carbohydrates | | | | |
| | D-glucopyranose | − | | + |
| | galactose | − | + | + |
| | lyxose | | | + |
| | sucrose | | | − |
| | threose | | | + |
| | trehalose | | + | + |
| | xylose | | | + |
| Other | | | | |
| | salicylic acid | | | + |
| | pyrogallol | | | − |
| | hydroxyquinol | | | |
| | vanillic acid | | | + |
| | gallic acid | | | |
| | beta tocopherol | | | + |
| | galacturonic acid | − | | |
| | lumichrome | | | − |

TABLE 11B

Metabolic analysis of Strain C-treated plants under water-limited conditions. "+" and "−" denote a relative increase or decrease, respectively, when compared to control plants grown in similar conditions (formulation control).

| Metabolic process: | Water-limited Conditions | | |
|---|---|---|---|
| | root | stem | leaf |
| Alkaloid metabolism | | | |
| tryptophan | | + | − |
| phenylalanine | | | − |
| tyrosine | − | | − |
| tryptamine | | | − |
| benzoic acid | | | |
| pipecolic acid | + | | |
| nicotinic acid | − | | − |
| Phenylpropanoid metabolism | | | |
| phenylalanine | | | − |
| shikimic acid | | | − |
| tyrosine | | | |
| quinic acid | − | | − |
| sinapic acid | | | − |
| ferulic acid | | + | − |
| caffeic acid | | | − |

TABLE 11B-continued

Metabolic analysis of Strain C-treated plants under water-limited conditions. "+" and "−" denote a relative increase or decrease, respectively, when compared to control plants grown in similar conditions (formulation control).

| Metabolic process: | Water-limited Conditions | | |
|---|---|---|---|
| | root | stem | leaf |
| Flavonoid/isoflavonoid biosynthesis | | | |
| quinic acid | − | | − |
| shikimic acid | | | − |
| hesperetin | | + | − |
| daidzein | − | | − |
| Lipid metabolism/ fatty alcohols | | | |
| ethanolamine | | + | − |
| ethanolaminephosphate | | | − |
| sphingosine | | − | − |
| glycerol | | + | |
| hexadecanoic acid | + | + | |
| octadecadienoic acid | | | − |
| octadecanoic acid | + | + | − |
| dodecanol | − | | − |
| campesterol | | | − |
| Nitrogen metabolism/ amino acids | | | |
| alanine | − | | − |
| β-alanine | | | − |
| allantoin | − | + | − |
| asparagine | − | | |
| aspartic acid | − | | |
| glutamic acid | − | | − |
| glutamine | − | + | − |
| histidine | − | + | |
| isoleucine | | | − |
| leucine | − | + | − |
| methionine | − | | − |
| phenylalanine | | | − |
| proline | − | | − |
| serine | | | − |
| threonine | | | − |
| tryptophan | | + | − |
| tyrosine | − | | − |
| valine | − | + | − |
| Carbohydrates | | | |
| D-glucopyranose | − | + | |
| galactose | | | − |
| lyxose | | | − |
| threose | | | − |
| trehalose | | | − |
| Other | | | |
| salicylic acid | | + | − |
| pyrogallol | − | | |
| vanillic acid | | + | − |
| gallic acid | | | − |
| beta tocopherol | − | | |
| galacturonic acid | − | | |
| lumichrome | | | + |

Table 12: Community Sequencing

TABLE 12A

The average abundance of bacterial genera, as a proportion of the community, in leaf tissue of water stressed soybean plants grown from seeds treated with Strain B, Strain C, and untreated controls. The average abundance of organisms in the *Eschericia-Shigella* genera are reduced from approximately 21% of the bacterial community of untreated soybean leaves to approximately 13% of the bacterial community in Strain C treated soybean leaves and 16% of the bacterial community in Strain B treated leaves. Treatment with Strain C reduces the abundance of bacteria in the *Eschericia-Shigella* genera on soybean leaves by 37% relative to untreated controls.

| \multicolumn{2}{c}{Mean abundance in leaves of plants grown from seeds treated with Strain B} | | Mean abundance in leaves of plants grown from seeds treated with Strain C | | Mean abundance in leaves of plants grown from seeds treated with formulation control | |
|---|---|---|---|---|---|
| Genus | Mean abundance | Genus | Mean abundance | Genus | Mean abundance |
| Escherichia-Shigella | 0.157 | Escherichia-Shigella | 0.133 | Escherichia-Shigella | 0.213 |
| Bradyrhizobium | 0.104 | Bradyrhizobium | 0.116 | Bradyrhizobium | 0.071 |
| Piscinibacter | 0.043 | Piscinibacter | 0.059 | Cellvibrio | 0.049 |
| Hydrogenophaga | 0.024 | Cellvibrio | 0.030 | Piscinibacter | 0.042 |
| Rhizobium | 0.023 | Hydrogenophaga | 0.028 | Flavobacterium | 0.029 |
| Methylotenera | 0.021 | Methylotenera | 0.026 | Methylotenera | 0.025 |
| Cellvibrio | 0.020 | Flavobacterium | 0.024 | Hydrogenophaga | 0.020 |
| Flavobacterium | 0.019 | Rhizobium | 0.018 | Rhizobium | 0.018 |
| Methylibium | 0.018 | Devosia | 0.014 | Methylibium | 0.013 |
| Pseudomonas | 0.016 | Pseudomonas | 0.013 | Pseudomonas | 0.011 |
| Devosia | 0.012 | Methylibium | 0.013 | Streptomyces | 0.009 |
| Streptomyces | 0.011 | Massilia | 0.011 | Devosia | 0.008 |
| Massilia | 0.010 | Bacillus | 0.010 | Niastella | 0.008 |
| Shinella | 0.008 | Streptomyces | 0.008 | Shinella | 0.007 |
| Bacillus | 0.007 | Acidovorax | 0.008 | Massilia | 0.007 |
| Arthrobacter | 0.007 | Shinella | 0.007 | Acidovorax | 0.007 |
| Acidovorax | 0.006 | Arthrobacter | 0.006 | Ohtaekwangia | 0.007 |
| Pseudolabrys | 0.004 | Dyadobacter | 0.005 | Arthrobacter | 0.006 |
| Ohtaekwangia | 0.004 | Ohtaekwangia | 0.005 | Dyadobacter | 0.005 |
| Dyadobacter | 0.003 | Nocardioides | 0.004 | Pseudorhodoferax | 0.004 |
| | | Niastella | 0.004 | | |

TABLE 12B

The average abundance of bacterial genera, as a proportion of the community, in root tissue of water stressed soybean plants grown from seeds treated with Strain B, Strain C, and untreated controls.

| Mean abundance in roots of plants grown from seeds treated with Strain B | | Mean abundance in roots of plants grown from seeds treated with Strain C | | Mean abundance in roots of plants grown from seeds treated with formulation control | |
|---|---|---|---|---|---|
| Genus | Mean abundance | Genus | Mean abundance | Genus | Mean abundance |
| Bradyrhizobium | 0.067 | Bradyrhizobium | 0.083 | Bradyrhizobium | 0.086 |
| Piscinibacter | 0.054 | Cellvibrio | 0.063 | Cellvibrio | 0.067 |
| Cellvibrio | 0.049 | Hydrogenophaga | 0.060 | Piscinibacter | 0.059 |
| Flavobacterium | 0.047 | Methylotenera | 0.043 | Flavobacterium | 0.051 |
| Methylotenera | 0.044 | Flavobacterium | 0.041 | Methylotenera | 0.038 |
| Hydrogenophaga | 0.043 | Piscinibacter | 0.040 | Hydrogenophaga | 0.037 |
| Pseudomonas | 0.028 | Pseudomonas | 0.025 | Rhizobium | 0.022 |
| Rhizobium | 0.024 | Rhizobium | 0.021 | Methylibium | 0.017 |
| Streptomyces | 0.013 | Streptomyces | 0.016 | Pseudomonas | 0.017 |
| Methylibium | 0.013 | Massilia | 0.016 | Streptomyces | 0.016 |
| Acidovorax | 0.013 | Methylibium | 0.013 | Acidovorax | 0.013 |
| Massilia | 0.012 | Acidovorax | 0.012 | Massilia | 0.012 |
| Devosia | 0.012 | Devosia | 0.011 | Devosia | 0.011 |
| Dyadobacter | 0.012 | Ohtaekwangia | 0.009 | Niastella | 0.011 |
| Asticcacaulis | 0.008 | Shinella | 0.008 | Ohtaekwangia | 0.009 |
| Ohtaekwangia | 0.008 | Dechloromonas | 0.007 | Dyadobacter | 0.009 |
| Shinella | 0.007 | Dyadobacter | 0.007 | Asticcacaulis | 0.008 |
| Arthrobacter | 0.007 | Asticcacaulis | 0.007 | Shinella | 0.008 |
| Niastella | 0.006 | Bacillus | 0.007 | Arthrobacter | 0.007 |
| Pseudorhodoferax | 0.005 | Arthrobacter | 0.006 | Bacillus | 0.006 |

TABLE 12C

The average abundance of fungal genera, as a proportion of the community, in root tissue of water stressed soybean plants grown from seeds treated with Strain B, Strain C, and untreated controls. The average abundance of fungi in the *Rhizophagus* genera are increased from approximately 4.7% of the fungal community of untreated soybean roots and 4.3% of the fungal community in Strain B treated soybean roots to approximately 8.9% of the fungal community of Strain C treated soybean roots. Treatment with Strain C resulted in a 87.7% increase in the abundance of fungi in the *Rhizophagus* genera in soybean roots relative to untreated controls. Fungi of the genus *Glomus* are also increased in the roots of soybeans treated with Strain C and Strain B treatments relative to untreated controls.

| Mean abundance in roots of plants grown from seeds treated with Strain B | | Mean abundance in roots of plants grown from seeds treated with Strain C | | Mean abundance in roots of plants grown from seeds treated with formulation control | |
|---|---|---|---|---|---|
| Genus | Mean abundance | Genus | Mean Genus | Genus | Mean abundance |
| *Claroideoglomus* | 0.133 | *Claroideoglomus* | 0.176 | *Claroideoglomus* | 0.193 |
| *Haematonectria* | 0.061 | *Rhizophagus* | 0.089 | *Podospora* | 0.143 |
| *Podospora* | 0.044 | *Podospora* | 0.079 | *Rhizophagus* | 0.047 |
| *Rhizophagus* | 0.043 | *Funneliformis* | 0.069 | *Haematonectria* | 0.040 |
| *Glomus* | 0.037 | *Glomus* | 0.053 | *Chaetomium* | 0.032 |
| *Funneliformis* | 0.026 | *Haematonectria* | 0.043 | *Glomus* | 0.030 |
| *Fusarium* | 0.017 | *Fusarium* | 0.039 | *Funneliformis* | 0.030 |
| *Chaetomium* | 0.012 | *Olpidium* | 0.024 | *Agrocybe* | 0.027 |
| *Zopfiella* | 0.011 | *Chaetomium* | 0.010 | *Cladosporium* | 0.021 |
| unidentified | 0.008 | *Cladosporium* | 0.010 | *Fusarium* | 0.020 |
| *Conocybe* | 0.006 | *Zopfiella* | 0.009 | *Zopfiella* | 0.020 |
| *Olpidium* | 0.006 | *Ilyonectria* | 0.008 | *Olpidium* | 0.013 |
| *Hypocrea* | 0.006 | unidentified | 0.006 | *Hydnomerulius* | 0.009 |
| *Myrothecium* | 0.005 | *Pseudeurotium* | 0.005 | *Conocybe* | 0.006 |
| *Clonostachys* | 0.005 | unidentified | 0.005 | *Massariosphaeria* | 0.004 |
| *Talaromyces* | 0.004 | *Corollospora* | 0.004 | *Clonostachys* | 0.004 |
| *Cladosporium* | 0.004 | *Curvularia* | 0.004 | *Talaromyces* | 0.003 |
| unidentified | 0.003 | *Penicillium* | 0.004 | *Eremothecium* | 0.003 |
| *Clitopilus* | 0.003 | *Myrothecium* | 0.003 | unidentified | 0.003 |
| *Curvularia* | 0.003 | *Talaromyces* | 0.003 | *Corollospora* | 0.002 |

TABLE 12D

The mean abundance of bacterial families, as a proportion of the community, in leaf tissue of water stressed soybean plants grown from seeds treated with Strain B, Strain C, and untreated controls.

| Mean abundance in leaves of plants grown from seeds treated with Strain B | | Mean abundance in leaves of plants grown from seeds treated with Strain C | | Mean roots in leaves of plants grown from seeds treated with formulation control | |
|---|---|---|---|---|---|
| Family | Mean abundance | Family | Mean abundance | Family | Mean abundance |
| Enterobacteriaceae | 0.157 | Comamonadaceae | 0.139 | Enterobacteriaceae | 0.214 |
| Comamonadaceae | 0.125 | Enterobacteriaceae | 0.135 | Comamonadaceae | 0.112 |
| Bradyrhizobiaceae | 0.107 | Bradyrhizobiaceae | 0.119 | Bradyrhizobiaceae | 0.075 |
| Pseudomonadaceae | 0.037 | Pseudomonadaceae | 0.043 | Pseudomonadaceae | 0.061 |
| Rhizobiaceae | 0.032 | Methylophilaceae | 0.032 | Flavobacteriaceae | 0.030 |
| Methylophilaceae | 0.025 | Rhizobiaceae | 0.026 | Methylophilaceae | 0.029 |
| Flavobacteriaceae | 0.022 | Flavobacteriaceae | 0.024 | Rhizobiaceae | 0.026 |
| Hyphomicrobiaceae | 0.014 | Cytophagaceae | 0.018 | Cytophagaceae | 0.023 |
| Cytophagaceae | 0.013 | Hyphomicrobiaceae | 0.016 | Chitinophagaceae | 0.013 |
| Chitinophagaceae | 0.012 | Oxalobacteraceae | 0.013 | Anaerolineaceae | 0.010 |
| Streptomycetaceae | 0.011 | Bacillaceae | 0.011 | Streptomycetaceae | 0.009 |
| Oxalobacteraceae | 0.010 | Chitinophagaceae | 0.010 | Oxalobacteraceae | 0.008 |
| Planctomycetaceae | 0.009 | Anaerolineaceae | 0.008 | Hyphomicrobiaceae | 0.008 |
| Anaerolineaceae | 0.008 | Streptomycetaceae | 0.008 | Caulobacteraceae | 0.007 |
| Bacillaceae | 0.007 | Rhodospirillaceae | 0.008 | Micrococcaceae | 0.006 |
| Micrococcaceae | 0.007 | Micrococcaceae | 0.006 | Rhodospirillaceae | 0.005 |
| SHA-31 | 0.007 | Caulobacteraceae | 0.005 | SHA-31 | 0.005 |
| Nitrosomonadaceae | 0.006 | Nocardioidaceae | 0.005 | Sphingomonadaceae | 0.004 |
| Xanthobacteraceae | 0.006 | Rhodocyclaceae | 0.005 | Bacillaceae | 0.004 |
| Caulobacteraceae | 0.005 | SHA-31 | 0.004 | Xanthomonadaceae | 0.004 |

TABLE 12E

The mean abundance of bacterial families, as a proportion of the community, in root tissue of water stressed soybean plants grown from seeds treated with Strain B, Strain C, and untreated controls.

| Mean abundance in roots of plants grown from seeds treated with Strain B | | Mean abundance in roots of plants grown from seeds treated with Strain C | | Mean abundance in roots of plants grown from seeds treated with formulation control | |
|---|---|---|---|---|---|
| Family | Mean abundance | Family | Mean abundance | Family | Mean abundance |
| Comamonadaceae | 0.161 | Comamonadaceae | 0.166 | Comamonadaceae | 0.164 |
| Pseudomonadaceae | 0.077 | Pseudomonadaceae | 0.088 | Bradyrhizobiaceae | 0.088 |
| Bradyrhizobiaceae | 0.069 | Bradyrhizobiaceae | 0.084 | Pseudomonadaceae | 0.084 |
| Methylophilaceae | 0.053 | Methylophilaceae | 0.050 | Flavobacteriaceae | 0.052 |
| Flavobacteriaceae | 0.047 | Flavobacteriaceae | 0.041 | Methylophilaceae | 0.045 |
| Cytophagaceae | 0.035 | Rhizobiaceae | 0.029 | Cytophagaceae | 0.037 |
| Rhizobiaceae | 0.030 | Cytophagaceae | 0.029 | Rhizobiaceae | 0.030 |
| Oxalobacteraceae | 0.015 | Oxalobacteraceae | 0.019 | Chitinophagaceae | 0.017 |
| Streptomycetaceae | 0.013 | Streptomycetaceae | 0.016 | Streptomycetaceae | 0.016 |
| Chitinophagaceae | 0.013 | Rhodocyclaceae | 0.015 | Oxalobacteraceae | 0.014 |
| Hyphomicrobiaceae | 0.012 | Hyphomicrobiaceae | 0.011 | Hyphomicrobiaceae | 0.011 |
| Caulobacteraceae | 0.010 | Chitinophagaceae | 0.009 | Caulobacteraceae | 0.010 |
| Micrococcaceae | 0.007 | Caulobacteraceae | 0.008 | Micrococcaceae | 0.007 |
| Rhodocyclaceae | 0.006 | Bacillaceae | 0.007 | Bacillaceae | 0.006 |
| Saprospiraceae | 0.005 | Micrococcaceae | 0.006 | Anaerolineaceae | 0.005 |
| Anaerolineaceae | 0.005 | Opitutaceae | 0.005 | Opitutaceae | 0.005 |
| Bacillaceae | 0.005 | Saprospiraceae | 0.004 | Rhodospirillaceae | 0.004 |
| Rhodospirillaceae | 0.004 | Xanthomonadaceae | 0.004 | Saprospiraceae | 0.004 |
| Unknown_Family | 0.004 | Rhodospirillaceae | 0.003 | Rhodocyclaceae | 0.003 |
| Opitutaceae | 0.003 | Anaerolineaceae | 0.003 | SHA-31 | 0.002 |

TABLE 12E

The mean abundance of fungal families, as a proportion of the community, in root tissue of water stressed soybean plants grown from seeds treated with Strain B, Strain C, and untreated controls.

| Mean abundance in roots of plants grown from seeds treated with Strain B | | Mean abundance in roots of plants grown from seeds treated with Strain C | | Mean abundance in roots of plants grown from seeds treated with formulation control | |
|---|---|---|---|---|---|
| Family | Mean abundance | Family | Mean abundance | Family | Mean abundance |
| Nectriaceae | 0.312 | Nectriaceae | 0.277 | Lasiosphaeriaceae | 0.222 |
| Lasiosphaeriaceae | 0.252 | Glomeraceae | 0.230 | Nectriaceae | 0.215 |
| Glomeraceae | 0.144 | Claroideoglomeraceae | 0.186 | Claroideoglomeraceae | 0.194 |
| Claroideoglomeraceae | 0.137 | Lasiosphaeriaceae | 0.109 | Glomeraceae | 0.115 |
| Chaetomiaceae | 0.014 | Olpidiaceae | 0.024 | Chaetomiaceae | 0.032 |
| Hypocreaceae | 0.012 | Chaetomiaceae | 0.016 | Strophariaceae | 0.027 |
| Incertae sedis | 0.008 | Incertae sedis | 0.013 | Davidiellaceae | 0.021 |
| Bolbitiaceae | 0.006 | Davidiellaceae | 0.010 | Olpidiaceae | 0.013 |
| Olpidiaceae | 0.006 | Trichocomaceae | 0.009 | Paxillaceae | 0.009 |
| Bionectriaceae | 0.005 | Pleosporaceae | 0.006 | Bolbitiaceae | 0.006 |
| Trichocomaceae | 0.004 | Pseudeurotiaceae | 0.005 | Incertae sedis | 0.006 |
| Davidiellaceae | 0.004 | Hypocreaceae | 0.005 | Trichocomaceae | 0.005 |
| unidentified | 0.003 | Halosphaeriaceae | 0.004 | Bionectriaceae | 0.004 |
| Entolomataceae | 0.003 | Incertae sedis | 0.003 | Incertae sedis | 0.004 |
| Pleosporaceae | 0.003 | Paraglomeraceae | 0.002 | Eremotheciaceae | 0.003 |
| Montagnulaceae | 0.003 | Microascaceae | 0.002 | unidentified | 0.003 |
| Pleurotaceae | 0.002 | Eremotheciaceae | 0.002 | Halosphaeriaceae | 0.002 |
| Incertae sedis | 0.002 | Incertae sedis | 0.002 | Incertae sedis | 0.002 |
| Paxillaceae | 0.002 | Montagnulaceae | 0.002 | Microascaceae | 0.002 |
| Paraglomeraceae | 0.002 | Bionectriaceae | 0.002 | Clavicipitaceae | 0.002 |

Table 13: Operational Taxonomic Unit (OTU) Profiles

TABLE 13A

The following OTUs are found in all biological replicates of samples of plants grown from seeds treated with Strain C, but not found in other *Streptomyces* treatments or control samples

| OTU | Tissue | Domain | Phylum | Class | Order | Family | Genus |
|---|---|---|---|---|---|---|---|
| B1.0\|REF97_V4\|101215 | leaf | Bacteria | Acidobacteria | Sva0725 | Sva0725 | | |
| B1.0\|REF97_V4\|125353 | leaf | Bacteria | Bacteroidetes | Sphingobacteriia | Sphingobacteriales | Chitinophagaceae | |
| B1.0\|REF97_V4\|17364 | leaf | Bacteria | Proteobacteria | Alphaproteobacteria | Rhizobiales | Xanthobacteraceae | *Pseudolabrys* |
| B1.0\|REF97_V4\|72181 | leaf | Bacteria | Proteobacteria | Deltaproteobacteria | Myxococcales | | |
| B1.0\|REF97_V4\|8547 | leaf | Bacteria | Bacteroidetes | Cytophagia | Cytophagales | Cytophagaceae | |
| B1.0\|REF99_V4\|1 | leaf | Bacteria | Proteobacteria | Gammaproteobacteria | Enterobacteriales | Enterobacteriaceae | *Klebsiella* |
| B1.0\|REF99_V4\|10660 | leaf | Bacteria | Proteobacteria | Alphaproteobacteria | Rhizobiales | | |
| B1.0\|REF99_V4\|18023 | leaf | Bacteria | Proteobacteria | Alphaproteobacteria | Sphingomonadales | Sphingomonadaceae | *Novosphingobium* |
| B1.0\|REF99_V4\|180779 | leaf | Bacteria | Proteobacteria | Alphaproteobacteria | Rhodospirillales | Rhodospirillaceae | *Dongia* |
| B1.0\|REF99_V4\|217009 | leaf | Bacteria | Acidobacteria | Acidobacteria | Subgroup_6 | | |
| B1.0\|REF99_V4\|2218 | leaf | Bacteria | Actinobacteria | Actinobacteria | Propionibacteriales | Nocardioidaceae | *Nocardioides* |
| B1.0\|REF99_V4\|231393 | leaf | Bacteria | Chloroflexi | Anaerolineae | Anaerolineales | Anaerolineaceae | |
| B1.0\|REF99_V4\|23597 | leaf | Bacteria | Actinobacteria | Thermoleophilia | Solirubrobacterales | TM146 | |
| B1.0\|REF99_V4\|2416 | leaf | Bacteria | Proteobacteria | Betaproteobacteria | Burkholderiales | Comamonadaceae | |
| B1.0\|REF99_V4\|3310 | leaf | Bacteria | Proteobacteria | Alphaproteobacteria | Rhizobiales | Aurantimonadaceae | *Martelella* |
| B1.0\|REF99_V4\|3741 | leaf | Bacteria | Actinobacteria | Actinobacteria | Streptomycetales | Streptomycetaceae | *Streptomyces* |
| B1.0\|REF99_V4\|616 | leaf | Bacteria | Proteobacteria | Gammaproteobacteria | Pseudomonadales | Pseudomonadaceae | *Pseudomonas* |
| B1.0\|REF97_V4\|184062 | root | Bacteria | Proteobacteria | Gammaproteobacteria | Alteromonadales | Alteromonadaceae | |
| B1.0\|REF97_V4\|29448 | root | Bacteria | Proteobacteria | Deltaproteobacteria | Myxococcales | | |
| B1.0\|REF97_V4\|30291 | root | Bacteria | Proteobacteria | Gammaproteobacteria | Xanthomonadales | | |
| B1.0\|REF97_V4\|596 | root | Bacteria | Proteobacteria | Betaproteobacteria | Burkholderiales | Comamonadaceae | *Hydrogenophaga* |
| B1.0\|REF99_V4\|10576 | root | Bacteria | Bacteroidetes | Flavobacteriia | Flavobacteriales | Flavobacteriaceae | |
| B1.0\|REF99_V4\|105970 | root | Bacteria | Verrucomicrobia | Opitutae | Opitutales | Opituticaceae | *Opitutus* |
| B1.0\|REF99_V4\|10645 | root | Bacteria | Proteobacteria | Gammaproteobacteria | Pseudomonadales | Pseudomonadaceae | *Pseudomonas* |
| B1.0\|REF99_V4\|110044 | root | Bacteria | Bacteroidetes | Flavobacteriia | Flavobacteriales | Flavobacteriaceae | *Flavobacterium* |
| B1.0\|REF99_V4\|112628 | root | Bacteria | Proteobacteria | Gammaproteobacteria | Xanthomonadales | Xanthomonadaceae | *Thermomonas* |
| B1.0\|REF99_V4\|145423 | root | Bacteria | Proteobacteria | Betaproteobacteria | Rhodocyclales | Rhodocyclaceae | |
| B1.0\|REF99_V4\|191 | root | Bacteria | Proteobacteria | Alphaproteobacteria | Rhizobiales | Bradyrhizobiaceae | *Bradyrhizobium* |
| B1.0\|REF99_V4\|1915 | root | Bacteria | Actinobacteria | Actinobacteria | Streptomycetales | Streptomycetaceae | *Streptomyces* |
| B1.0\|REF99_V4\|2033 | root | Bacteria | Proteobacteria | Alphaproteobacteria | Rhizobiales | Rhizobiaceae | *Rhizobium* |
| B1.0\|REF99_V4\|2052 | root | Bacteria | Proteobacteria | Gammaproteobacteria | Xanthomonadales | Xanthomonadaceae | *Arenimonas* |
| B1.0\|REF99_V4\|219885 | root | Bacteria | Proteobacteria | Gammaproteobacteria | 34P16 | | |
| B1.0\|REF99_V4\|231107 | root | Bacteria | Proteobacteria | Gammaproteobacteria | Oceanospirillales | Oceanospirillaceae | *Pseudospirillum* |
| B1.0\|REF99_V4\|34780 | root | Bacteria | Firmicutes | Bacilli | Bacillales | Paenibacillaceae | *Paenibacillus* |
| B1.0\|REF99_V4\|42964 | root | Bacteria | Acidobacteria | Acidobacteria | Subgroup_6 | | |
| B1.0\|REF99_V4\|448 | root | Bacteria | Proteobacteria | Betaproteobacteria | Rhodocyclales | Rhodocyclaceae | *Dechloromonas* |
| B1.0\|REF99_V4\|456 | root | Bacteria | Proteobacteria | Betaproteobacteria | Rhodocyclales | Rhodocyclaceae | *Azoarcus* |
| B1.0\|REF99_V4\|5320 | root | Bacteria | Proteobacteria | Gammaproteobacteria | Xanthomonadales | | |
| B1.0\|REF99_V4\|5624 | root | Bacteria | Proteobacteria | Betaproteobacteria | Burkholderiales | Comamonadaceae | |
| B1.0\|REF99_V4\|72181 | root | Bacteria | Proteobacteria | Deltaproteobacteria | Myxococcales | | |
| B1.0\|REF99_V4\|94062 | root | Bacteria | Proteobacteria | Alphaproteobacteria | Sphingomonadales | Sphingomonadaceae | *Sphingopyxis* |
| B1.0\|SYM97_V4\|1256 | root | Bacteria | Proteobacteria | Deltaproteobacteria | Myxococcales | | |
| B1.0\|SYM97_V4\|2433 | root | Bacteria | Proteobacteria | Deltaproteobacteria | | | |
| F1.0\|SYM97_ITS2\|1548 | root | Fungi | Glomeromycota | Glomeromycetes | Glomerales | Glomeraceae | *Rhizophagus* |
| F1.0\|SYM97_ITS2\|1707 | root | Fungi | Glomeromycota | Glomeromycetes | Glomerales | Glomeraceae | *Rhizophagus* |
| F1.0\|SYM97_ITS2\|664 | root | Fungi | Ascomycota | Eurotiomycetes | Eurotiales | Trichocomaceae | *Penicillium* |
| F1.0\|SYM97_ITS2\|715 | root | Fungi | Glomeromycota | Glomeromycetes | Paraglomerales | | |
| F1.0\|SYM97_ITS2\|777 | root | Protista | Cercozoa | | | | |
| F1.0\|UDYN_ITS2\|286 | root | Fungi | Ascomycota | Eurotiomycetes | Eurotiales | Trichocomaceae | *Penicillium* |

TABLE 13B

The following OTUs are found in all biological replicates of samples treated with Strain C and samples treated with Strain B and not found in control (formulation control) samples.

| OTU | Tissue | Domain | Phylum | Class | Order | Family | Genus |
|---|---|---|---|---|---|---|---|
| B1.0\|REF97_V4\|222577 | leaf | Bacteri | Bacteroidetes | Saprospirae | Saprospirales | Saprospiraceae | |
| B1.0\|REF97_V4\|29448 | leaf | Bacteri | Proteobacteria | Deltaproteobacteria | Myxococcales | | |
| B1.0\|REF99_V4\|106421 | leaf | Bacteri | Gemmatimonadetes | Gemmatimonadetes | Gemmatimonadales | Gemmatimonadaceae | |
| B1.0\|REF99_V4\|10651 | leaf | Bacteri | Proteobacteria | Betaproteobacteria | Methylophilales | Methylophilaceae | *Methylotenera* |
| B1.0\|REF99_V4\|112628 | leaf | Bacteri | Proteobacteria | Gammaproteobacteria | Xanthomonadales | Xanthomonadaceae | *Thermomonas* |
| B1.0\|REF99_V4\|309 | leaf | Bacteri | Proteobacteria | Betaproteobacteria | Burkholderiales | Comamonadaceae | *Diaphorobacter* |

TABLE 13B-continued

The following OTUs are found in all biological replicates of samples treated with Strain C
and samples treated with Strain B and not found in control (formulation control) samples.

| OTU | Tissue | Domain | Phylum | Class | Order | Family | Genus |
|---|---|---|---|---|---|---|---|
| B1.0\|REF99_V4\|473 | leaf | Bacteri | Actinobacteria | Actinobacteria | Streptomycetales | Streptomycetaceae | *Streptomyces* |
| B1.0\|REF99_V4\|5981 | leaf | Bacteri | Acidobacteria | Holophagae | Subgroup_10 | ABS-19 | |
| B1.0\|REF97_V4\|137844 | root | Bacteri | Proteobacteria | Gammaproteobacteria | Xanthomonadales | Xanthomonadaceae | |
| B1.0\|REF97_V4\|198225 | root | Bacteri | Bacteroidetes | Cytophagia | Cytophagales | Cytophagaceae | |
| B1.0\|REF99_V4\|1146 | root | Bacteri | Proteobacteria | Betaproteobacteria | Rhodocyclales | Rhodocyclaceae | *Dechloromonas* |
| B1.0\|REF99_V4\|11760 | root | Bacteri | Proteobacteria | Alphaproteobacteria | Sphingomonadales | Sphingomonadaceae | *Sphingomonas* |
| B1.0\|REF99_V4\|20427 | root | Bacteri | Acidobacteria | Acidobacteria | Subgroup_4 | Unknown_Family | *Blastocatella* |
| B1.0\|REF99_V4\|2045 | root | Bacteri | Proteobacteria | Betaproteobacteria | Burkholderiales | Comamonadaceae | *Acidovorax* |
| B1.0\|REF99_V4\|309 | root | Bacteri | Proteobacteria | Betaproteobacteria | Burkholderiales | Comamonadaceae | *Diaphorobacter* |
| B1.0\|REF99_V4\|3570 | root | Bacteri | Proteobacteria | Betaproteobacteria | Burkholderiales | Oxalobacteraceae | *Massilia* |
| B1.0\|REF99_V4\|423 | root | Bacteri | Proteobacteria | Betaproteobacteria | Burkholderiales | Comamonadaceae | *Delftia* |
| B1.0\|REF99_V4\|571 | root | Bacteri | Proteobacteria | Betaproteobacteria | Burkholderiales | Comamonadaceae | *Curvibacter* |
| B1.0\|REF99_V4\|60372 | root | Bacteri | Chloroflexi | Anaerolineae | SBR1031 | A4b | |
| B1.0\|REF99_V4\|616 | root | Bacteri | Proteobacteria | Gammaproteobacteria | Pseudomonadales | Pseudomonadaceae | *Pseudomonas* |
| B1.0\|REF99_V4\|78274 | root | Bacteri | Bacteroidetes | Flavobacteriia | Flavobacteriales | Flavobacteriaceae | *Flavobacterium* |
| B1.0\|REF99_V4\|80223 | root | Bacteri | Chloroflexi | KD4-96 | | | |
| B1.0\|SYM97_V4\|1970 | root | Bacteri | Bacteroidetes | | | | |
| F1.0\|U97_ITS2\|443 | root | Fungi | Ascomycota | Sordariomycetes | Hypocreales | Nectriaceae | *Fusarium* |

TABLE 13C

The following OTUs have significant differences in abundance between Strain C and formulation.

| OTU | tissue | log2 Fold Change | padj | avc_257 | avc_229 | avc_StrepFF | Domain | Phylum |
|---|---|---|---|---|---|---|---|---|
| F1.0\|SYM97_ITS2\|1594 | root | 7.52 | 0.02 | 26974.29 | 0.00 | 0.00 | Fungi | Glomeromycota |
| F1.0\|SYM97_ITS2\|1574 | root | 4.97 | 0.09 | 30543.62 | 0.00 | 621.17 | Fungi | Ascomycota |
| B1.0\|REF99_V4\|2428 | root | -1.63 | 0.05 | 450.23 | 855.30 | 1574.22 | Bacteria | Proteobacteria |
| B1.0\|REF97_V4\|125026 | root | -1.66 | 0.10 | 431.21 | 378.13 | 1762.13 | Bacteria | Actinobacteria |
| B1.0\|REF99_V4\|177253 | root | -1.69 | 0.10 | 484.70 | 441.49 | 2041.68 | Bacteria | Bacteroidetes |
| B1.0\|REF99_V4\|91343 | root | -1.83 | 0.06 | 272.35 | 449.71 | 1271.95 | Bacteria | Proteobacteria |
| B1.0\|REF97_V4\|99883 | root | -1.86 | 0.10 | 375.23 | 1307.65 | 2512.25 | Bacteria | Bacteroidetes |
| B1.0\|SYM97_V4\|1918 | root | -1.88 | 0.08 | 230.61 | 768.19 | 1330.51 | Bacteria | Chloroflexi |
| B1.0\|SYM97_V4\|1711 | root | -2.02 | 0.08 | 193.25 | 914.25 | 1507.13 | Bacteria | Chloroflexi |
| B1.0\|REF97_V4\|76835 | root | -2.26 | 0.05 | 220.76 | 143.46 | 2074.80 | Bacteria | Proteobacteria |
| B1.0\|REF99_V4\|145911 | root | -2.48 | 0.00 | 172.80 | 785.49 | 1630.24 | Bacteria | Firmicutes |
| F1.0\|SYM97_ITS2\|882 | root | -2.67 | 0.09 | 6738.84 | 21099.92 | 46321.34 | Fungi | Ascomycota |
| F1.0\|SYM97_ITS2\|24 | root | -3.19 | 0.09 | 25393.82 | 568795.50 | 227822.37 | Fungi | Ascomycota |
| F1.0\|SYM97_ITS2\|1053 | root | -3.38 | 0.09 | 12333.17 | 1076.03 | 119778.85 | Fungi | Ascomycota |
| F1.0\|UDYN_ITS2\|267 | root | -3.78 | 0.09 | 1145.35 | 10633.31 | 15925.35 | Fungi | Basidiomycota |
| F1.0\|U97_ITS2\|25 | root | -4.12 | 0.09 | 800.58 | 15333.32 | 25670.52 | Fungi | Glomeromycota |
| B1.0\|REF99_V4\|148539 | leaf | -6.02 | 0.10 | 59.41 | 1014.69 | 2038.67 | Bacteria | Bacteroidetes |
| B1.0\|REF97_V4\|76835 | leaf | -9.26 | 0.07 | 0.00 | 0.00 | 5968.98 | Bacteria | Proteobacteria |

| OTU | Class | Order | Family | Genus | Species |
|---|---|---|---|---|---|
| F1.0\|SYM97_ITS2\|1594 | Glomeromycetes | Glomerales | Glomeraceae | Glomus | custos |
| F1.0\|SYM97_ITS2\|1574 | Sordariomycetes | Sordariales | | | |
| B1.0\|SYM97_V4\|2428 | Alphaproteobacteria | DB1-14 | | | |
| B1.0\|REF97_V4\|125026 | Acidimicrobiia | Acidimicrobiales | | | |
| B1.0\|REF99_V4\|177253 | Flavobacteriia | Flavobacteriales | Flavobacteriaceae | Siansivirga | |
| B1.0\|REF99_V4\|91343 | Gammaproteobacteria | Xanthomonadales | Incertae_Sedis | Steroidobacter | |
| B1.0\|REF97_V4\|99883 | Cytophagia | Cytophagales | Cytophagaceae | | |
| B1.0\|SYM97_V4\|1918 | Anaerolineae | | | | |
| B1.0\|SYM97_V4\|1711 | Anaerolineae | | | | |
| B1.0\|REF97_V4\|76835 | Gammaproteobacteria | Pseudomonadales | Moraxellaceae | | |
| B1.0\|REF99_V4\|145911 | Erysipelotrichia | Erysipelotrichales | Erysipelotrichaceae | Asteroleplasma | |
| F1.0\|SYM97_ITS2\|882 | Sordariomycetes | Sordariales | | | |
| F1.0\|SYM97_ITS2\|24 | Sordariomycetes | Sordariales | Lasiosphaeriaceae | | |
| F1.0\|SYM97_ITS2\|1053 | Sordariomycetes | Sordariales | | | |
| F1.0\|UDYN_ITS2\|267 | Agaricomycetes | Agaricales | Bolbitiaceae | Conocybe | apala |
| F1.0\|U97_ITS2\|25 | Glomeromycetes | Glomerales | Claroideoglomeraceae | Claroideoglomus | |

TABLE 13C-continued

The following OTUs have significant differences in abundance between Strain C and formulation.

| | | | | |
|---|---|---|---|---|
| B1.0\|REF99_V4\|148539 | Flavobacteriia | Flavobacteriales | Cryomorphaceae | Fluviicola |
| B1.0\|REF97_V4\|76835 | Gammaproteobacteria | Pseudomonadales | Moraxellaceae | |

Table 14: Field Trial Results

TABLE 14A

Soybean field trial results. No negative impact on soybean plants grown from seeds treated with Strain C was observed during well-watered field trial conditions.

| | Average across 3 locations | | |
|---|---|---|---|
| Treatment | Harvest Yield bu/ac | Weight lb/bu | Moisture % |
| Variety 1_Formulation | 65.23 | 57.46 | 13.02 |
| Variety 1_Strain C | 64.12 | 57.54 | 13.08 |
| Variety 2_Formulation | 64.47 | 57.54 | 14.17 |
| Variety 2_Strain C | 64.32 | 57.51 | 14.18 |

TABLE 14B

Maize field trial results. No negative impact on maize plants grown from seeds treated with Strain C was observed during well-watered field trial conditions. Two varieties of maize demonstrated improvements in yield (as measured by bushels per acre) for plants grown from seeds treated with Strain C, as compared to plants grown from seeds treated with the formulation control only.

| | Average across 3 locations | | | |
|---|---|---|---|---|
| Description | WT lb/bu | % moisture per plot | WT lb/plot | Yield bu/ac |
| Variety1_Formulation | 56.80 | 15.75 | 42.15 | 180.39 |
| Variety1_Strain C | 56.74 | 15.51 | 43.71 | 188.54 |
| Variety2_Formulation | 56.66 | 15.25 | 43.32 | 186.24 |
| Variety2_Strain C | 56.66 | 15.24 | 44.92 | 194.82 |
| Variety3_Formulation | 60.15 | 18.30 | 44.12 | 164.88 |
| Variety3_Strain C | 60.23 | 18.02 | 43.99 | 164.99 |
| Variety4_Formulation | 58.05 | 17.64 | 43.32 | 163.25 |
| Variety4_Strain C | 58.03 | 17.54 | 43.41 | 163.78 |

Table 15: Gene Enrichment Analysis

TABLE 15A

This table shows gene ontology terms which were enriched among genes with significantly increased expression in root tissue of water stressed soybean plants treated with *Streptomyces* Strain C. The column "GO genes in query" shows the number of genes in the query set of differentially expressed genes that were annotated with the corresponding GO accession identifier. The "total genes in query" column lists the total number of genes in the query. The "GO genes in genome" contains the total number of genes in the genome associated with the corresponding GO accession identifier. The column "Total genes in genome" contains the total number of annotated genes in the soybean reference genome. The column "FDR" contains the Benjamini & Yekutieli multiple test corrected p-values.

| GO accession | GO Description | GO genes in query | Total genes in query | GO genes in genome | Total genes in genome | FDR |
|---|---|---|---|---|---|---|
| GO:0016020 | membrane | 62 | 319 | 3518 | 29501 | 0.0025 |
| GO:0016021 | integral to membrane | 28 | 319 | 1419 | 29501 | 0.019 |
| GO:0031224 | intrinsic to membrane | 29 | 319 | 1453 | 29501 | 0.019 |
| GO:0003824 | catalytic activity | 206 | 319 | 13905 | 29501 | 1.40E−07 |
| GO:0016705 | oxidoreductase activity, acting on paired donors, with incorporation or reduction of molecular oxygen | 31 | 319 | 810 | 29501 | 5.50E−07 |
| GO:0042802 | identical protein binding | 12 | 319 | 114 | 29501 | 1.20E−06 |
| GO:0005215 | transporter activity | 40 | 319 | 1340 | 29501 | 1.20E−06 |
| GO:0030246 | carbohydrate binding | 16 | 319 | 239 | 29501 | 1.60E−06 |
| GO:0017171 | serine hydrolase activity | 18 | 319 | 330 | 29501 | 2.80E−06 |
| GO:0008236 | serine-type peptidase activity | 18 | 319 | 330 | 29501 | 2.80E−06 |
| GO:0004252 | serine-type endopeptidase activity | 13 | 319 | 188 | 29501 | 1.50E−05 |
| GO:0009055 | electron carrier activity | 24 | 319 | 702 | 29501 | 5.70E−05 |
| GO:0016491 | oxidoreductase activity | 57 | 319 | 2744 | 29501 | 6.90E−05 |

TABLE 15A-continued

This table shows gene ontology terms which were enriched among genes with significantly increased expression in root tissue of water stressed soybean plants treated with *Streptomyces* Strain C. The column "GO genes in query" shows the number of genes in the query set of differentially expressed genes that were annotated with the corresponding GO accession identifier. The "total genes in query" column lists the total number of genes in the query. The "GO genes in genome" contains the total number of genes in the genome associated with the corresponding GO accession identifier. The column "Total genes in genome" contains the total number of annotated genes in the soybean reference genome. The column "FDR" contains the Benjamini & Yekutieli multiple test corrected p-values.

| GO accession | GO Description | GO genes in query | Total genes in query | GO genes in genome | Total genes in genome | FDR |
|---|---|---|---|---|---|---|
| GO:0020037 | heme binding | 24 | 319 | 728 | 29501 | 8.60E−05 |
| GO:0046906 | tetrapyrrole binding | 24 | 319 | 732 | 29501 | 8.60E−05 |
| GO:0004175 | endopeptidase activity | 19 | 319 | 526 | 29501 | 0.00025 |
| GO:0005506 | iron ion binding | 24 | 319 | 798 | 29501 | 0.0003 |
| GO:0008233 | peptidase activity | 25 | 319 | 871 | 29501 | 0.00039 |
| GO:0070011 | peptidase activity, acting on L-amino acid peptides | 24 | 319 | 834 | 29501 | 0.00053 |
| GO:0022857 | transmembrane transporter activity | 27 | 319 | 1020 | 29501 | 0.00063 |
| GO:0042626 | ATPase activity, coupled to transmembrane movement of substances | 7 | 319 | 120 | 29501 | 0.0097 |
| GO:0043492 | ATPase activity, coupled to movement of substances | 7 | 319 | 120 | 29501 | 0.0097 |
| GO:0015405 | P—P-bond-hydrolysis-driven transmembrane transporter activity | 7 | 319 | 131 | 29501 | 0.014 |
| GO:0015399 | primary active transmembrane transporter activity | 7 | 319 | 131 | 29501 | 0.014 |
| GO:0016820 | hydrolase activity, acting on acid anhydrides, catalyzing transmembrane movement of substances | 7 | 319 | 133 | 29501 | 0.015 |
| GO:0016706 | oxidoreductase activity, acting on paired donors, with incorporation or reduction of molecular oxygen, 2-oxoglutarate as one donor, and incorporation of one atom each of oxygen into both donors | 10 | 319 | 271 | 29501 | 0.017 |
| GO:0016787 | hydrolase activity | 71 | 319 | 4588 | 29501 | 0.018 |
| GO:0016758 | transferase activity, transferring hexosyl groups | 16 | 319 | 615 | 29501 | 0.023 |
| GO:0008762 | UDP-N-acetylmuramate dehydrogenase activity | 5 | 319 | 81 | 29501 | 0.037 |
| GO:0043086 | negative regulation of catalytic activity | 12 | 319 | 108 | 29501 | 0.000 |
| GO:0044092 | negative regulation of molecular function | 12 | 319 | 108 | 29501 | 0.000 |
| GO:0065009 | regulation of molecular function | 12 | 319 | 231 | 29501 | 0.001 |

TABLE 15A-continued

This table shows gene ontology terms which were enriched among genes with significantly increased expression in root tissue of water stressed soybean plants treated with *Streptomyces* Strain C. The column "GO genes in query" shows the number of genes in the query set of differentially expressed genes that were annotated with the corresponding GO accession identifier. The "total genes in query" column lists the total number of genes in the query. The "GO genes in genome" contains the total number of genes in the genome associated with the corresponding GO accession identifier. The column "Total genes in genome" contains the total number of annotated genes in the soybean reference genome. The column "FDR" contains the Benjamini & Yekutieli multiple test corrected p-values.

| GO accession | GO Description | GO genes in query | Total genes in query | GO genes in genome | Total genes in genome | FDR |
|---|---|---|---|---|---|---|
| GO:0050790 | regulation of catalytic activity | 12 | 319 | 227 | 29501 | 0.001 |
| GO:0055114 | oxidation reduction | 49 | 319 | 2408 | 29501 | 0.001 |
| GO:0006810 | transport | 48 | 319 | 2371 | 29501 | 0.001 |
| GO:0051234 | establishment of localization | 48 | 319 | 2371 | 29501 | 0.001 |
| GO:0051179 | localization | 48 | 319 | 2395 | 29501 | 0.001 |
| GO:0006508 | proteolysis | 25 | 319 | 935 | 29501 | 0.002 |
| GO:0008152 | metabolic process | 187 | 319 | 14225 | 29501 | 0.004 |
| GO:0055085 | transmembrane transport | 27 | 319 | 1167 | 29501 | 0.007 |

TABLE 15B

This table shows gene ontology terms which were enriched among genes with significantly increased expression in root tissue of water stressed soybean plants treated with *Streptomyces* Strain B. The column "GO genes in query" shows the number of genes in the query set of differentially expressed genes that were annotated with the corresponding GO accession identifier. The "total genes in query" column lists the total number of genes in the query. The "GO genes in genome" contains the total number of genes in the genome associated with the corresponding GO accession identifier. The column "Total genes in genome" contains the total number of annotated genes in the soybean reference genome. The column "FDR" contains the Benjamini & Yekutieli multiple test corrected p-values.

| GO accession | GO Description | GO genes in query | Total genes in query | GO genes in genome | Total genes in genome | FDR |
|---|---|---|---|---|---|---|
| GO:0003824 | catalytic activity | 51 | 66 | 13905 | 29501 | 9.10E−05 |
| GO:0008236 | serine-type peptidase activity | 6 | 66 | 330 | 29501 | 0.0056 |
| GO:0017171 | serine hydrolase activity | 6 | 66 | 330 | 29501 | 0.0056 |
| GO:0020037 | heme binding | 8 | 66 | 728 | 29501 | 0.0076 |
| GO:0046906 | tetrapyrrole binding | 8 | 66 | 732 | 29501 | 0.0076 |
| GO:0016887 | ATPase activity | 7 | 66 | 581 | 29501 | 0.009 |
| GO:0005506 | iron ion binding | 8 | 66 | 798 | 29501 | 0.0096 |
| GO:0016787 | hydrolase activity | 21 | 66 | 4588 | 29501 | 0.015 |
| GO:0016491 | oxidoreductase activity | 15 | 66 | 2744 | 29501 | 0.016 |
| GO:0009055 | electron carrier activity | 7 | 66 | 702 | 29501 | 0.016 |
| GO:0016462 | pyrophosphatase activity | 10 | 66 | 1440 | 29501 | 0.02 |
| GO:0016818 | hydrolase activity, acting on acid anhydrides, in phosphorus-containing anhydrides | 10 | 66 | 1469 | 29501 | 0.02 |
| GO:0016817 | hydrolase activity, acting on acid anhydrides | 10 | 66 | 1480 | 29501 | 0.02 |
| GO:0008233 | peptidase activity | 7 | 66 | 871 | 29501 | 0.039 |
| GO:0017111 | nucleoside-triphosphatase activity | 9 | 66 | 1412 | 29501 | 0.045 |

TABLE 15C

This table shows gene ontology terms which were enriched among genes with significantly decreased expression in leaf tissue of water stressed soybean plants treated with beneficial *Streptomyces* Strain C. The column "GO genes in query" shows the number of genes in the query set of differentially expressed genes that were annotated with the corresponding GO accession identifier. The "total genes in query" column lists the total number of genes in the query. The "GO genes in genome" contains the total number of genes in the genome associated with the corresponding GO accession identifier. The column "Total genes in genome" contains the total number of annotated genes in the soybean reference genome. The column "FDR" contains the Benjamini & Yekutieli multiple test corrected p-values.

| GO accession | GO Description | GO genes in query | Total genes in query | GO genes in genome | Total genes in genome | FDR |
|---|---|---|---|---|---|---|
| GO:0004866 | endopeptidase inhibitor activity | 9 | 272 | 92 | 29501 | 5.50E−05 |
| GO:0030414 | peptidase inhibitor activity | 9 | 272 | 92 | 29501 | 5.50E−05 |
| GO:0016491 | oxidoreductase activity | 50 | 272 | 2744 | 29501 | 0.00028 |
| GO:0055114 | oxidation reduction | 41 | 272 | 2408 | 29501 | 0.044 |

TABLE 15D

This table shows gene ontology terms which were enriched among genes with significantly increased expression in leaf tissue of water stressed soybean plants treated with beneficial *Streptomyces* Strain C. The column "GO genes in query" shows the number of genes in the query set of differentially expressed genes that were annotated with the corresponding GO accession identifier. The "total genes in query" column lists the total number of genes in the query. The "GO genes in genome" contains the total number of genes in the genome associated with the corresponding GO accession identifier. The column "Total genes in genome" contains the total number of annotated genes in the soybean reference genome. The column "FDR" contains the Benjamini & Yekutieli multiple test corrected p-values.

| GO accession | GO Description | GO genes in query | Total genes in query | GO genes in genome | Total genes in genome | FDR |
|---|---|---|---|---|---|---|
| GO:0009523 | photosystem II | 6 | 255 | 74 | 29501 | 0.0054 |
| GO:0009579 | thylakoid | 7 | 255 | 126 | 29501 | 0.0063 |
| GO:0034357 | photosynthetic membrane | 6 | 255 | 117 | 29501 | 0.014 |
| GO:0009521 | photosystem | 6 | 255 | 113 | 29501 | 0.014 |
| GO:0050660 | FAD binding | 10 | 255 | 237 | 29501 | 0.019 |
| GO:0003824 | catalytic activity | 149 | 255 | 13905 | 29501 | 0.024 |
| GO:0016491 | oxidoreductase activity | 42 | 255 | 2744 | 29501 | 0.024 |
| GO:0016614 | oxidoreductase activity, acting on CH—OH group of donors | 12 | 255 | 437 | 29501 | 0.041 |
| GO:0050662 | coenzyme binding | 15 | 255 | 648 | 29501 | 0.041 |
| GO:0008152 | metabolic process | 151 | 255 | 14225 | 29501 | 0.05 |
| GO:0055114 | oxidation reduction | 38 | 255 | 2408 | 29501 | 0.05 |

REFERENCES

Abarenkov, K., Henrik Nilsson, R., Larsson, K.-H., Alexander, I. J., Eberhardt, U., Erland, S., . . . Koljalg, U. (2010, April). The UNITE database for molecular identification of fungi—recent updates and future perspectives. The New Phytologist. England.

Ainley, W. M., Walker, J. C., Nagao, R. T., and Key, J. L. (1988). Sequence and characterization of two auxin-regulated genes from soybean. J. Biol. Chem. 263, 10658-10666.

Amann et al. (2001) Current Opinion in Biotechnology 12:231-236

Anantharaman, V., Iyer, L. M. and Aravind, L., 2012. Ter-dependent stress response systems: novel pathways related to metal sensing, production of a nucleoside-like metabolite, and DNA-processing. Molecular bioSystems, 8(12), pp. 3142-3165.

Andersson, M. X., Hamberg, M., Kourtchenko, O., Brunnström, A., McPhail, K. L., Gerwick, W. H., Göbel, C., Feussner, I., and Ellerström, M. (2006). Oxylipin profiling of the hypersensitive response in *Arabidopsis thaliana*. Formation of a novel oxo-phytodienoic acid-containing galactolipid, arabidopside E. J. Biol. Chem. 281, 31528-31537.

Angelini, R., Bragaloni, M., Federico, R., Infantino, A., and Porta-Pugua, A. (1993). Involvement of Polyamines, Diamine Oxidase and Peroxidase in Resistance of Chickpea to *Ascochyta rabiei*. J. Plant Physiol. 142, 704-709.

Arnaldos, T. L., Ferrer, M. A., Garcia, A. A. C., and Muñoz, R. (2002). Changes in peroxidase activity and isoperoxidase pattern during strawberry (*Fragaria×ananassa*) callus development. J. Plant Physiol. 159, 429-435.

Bais, H. P., and Ravishankar, G. A. (2002). Role of polyamines in the ontogeny of plants and their biotechnological applications. Plant Cell Tissue Organ Cult. 69, 1-34.

Baker, J., dennSteele, C. V., and Iii, L. D. (1988). Sequence and characterization of 6 Lea proteins and their genes from cotton. Plant Mol. Biol. 11, 277-291.

Baquero, M. R., Bouzon, M., Quintela, J. C., Ayala, J. A. and Moreno, F., 1996. dacD, an *Escherichia coli* gene encoding a novel penicillin-binding protein (PBP6b) with DD-carboxypeptidase activity. Journal of bacteriology, 178 (24), pp. 7106-7111.

Barka et al. 2006, Appl. Environ. Microbiol. 72:7246-7252

Baxter C E, Costa M M, Coen E S. 2007. Diversification and co-option of RAD-like genes in the evolution of floral asymmetry. Plant J. 2007 52(1):105-13.

Begum, A. A., Leibovitch, S., Migner, P., and Zhang, F. 2001. Specific flavonoids induced nod gene expression and pre-activated nod genes of *Rhizobium leguminosarum* increased pea (*Pisum sativum* L.) and lentil (*Lens culinaris* L.) nodulation in controlled growth chamber environments. J. Exp. Bot. 52, (360) 1537-1543.

Binder S. (2010) Branched-Chain Amino Acid Metabolism in *Arabidopsis thaliana*. The *Arabidopsis* Book 8:e0137. doi:10.1199/tab.0137

Birkett, M. A., Hassanali, A., Hoglund, S., Pettersson, J., and Pickett, J. A. (2011). Repellent activity of catmint, *Nepeta cataria*, and iridoid nepetalactone isomers against Afrotropical mosquitoes, ixodid ticks and red poultry mites. Phytochemistry 72, 109-114.

Blanvillain R, Kim J H, Wu S, Lima A, Ow D W. 2008. OXIDATIVE STRESS 3 is a chromatin-associated factor involved in tolerance to heavy metals and oxidative stress. The Plant Journal. 57(4):654-65.

Bolwell, G. P., and Daudi, A. (2009). Reactive Oxygen Species in Plant-Pathogen Interactions. In Reactive Oxygen Species in Plant Signaling, L. A. Rio, and A. Puppo, eds. (Springer Berlin Heidelberg), pp. 113-133.

Borodina, I., Krabben, P. and Nielsen, J., 2005. Genome-scale analysis of *Streptomyces coelicolor* A3 (2) metabolism. Genome research, 15(6), pp. 820-829.

Bourquin, V., Nishikubo, N., Abe, H., Brumer, H., Denman, S., Eklund, M., Christiernin, M., Teeri, T. T., Sundberg, B., and Mellerowicz, E. J. (2002). Xyloglucan Endotransglycosylases Have a Function during the Formation of Secondary Cell Walls of Vascular Tissues. Plant Cell 14, 3073-3088.

Bradley, D. J., Kjellbom, P., and Lamb, C. J. (1992). Elicitor- and wound-induced oxidative cross-linking of a proline-rich plant cell wall protein: a novel, rapid defense response. Cell 70, 21-30.

Briat, J.-F., Ravet, K., Arnaud, N., Duc, C., Boucherez, J., Touraine, B., Cellier, F., and Gaymard, F. (2010). New insights into ferritin synthesis and function highlight a link between iron homeostasis and oxidative stress in plants. Ann. Bot. 105, 811-822.

Brick D J, Brumlik M J, Buckley J T, Cao J-X, Davies P C, Misra S, Tranbarger T J, Upton C A. 1995. New family of lipolytic plant enzymes with members in rice, *arabidopsis* and maize. FEBS Lett. 377 (3): 475-480.

Brisson, L. F., Tenhaken, R., and Lamb, C. (1994). Function of Oxidative Cross-Linking of Cell Wall Structural Proteins in Plant Disease Resistance. Plant Cell 6, 1703-1712.

Brown, M. S., Ye, J., Rawson, R. B. and Goldstein, J. L., 2000. Regulated intramembrane proteolysis: a control mechanism conserved from bacteria to humans. Cell, 100(4), pp. 391-398.

Bruce, R. J., and West, C. A. (1989). Elicitation of Lignin Biosynthesis and Isoperoxidase Activity by Pectic Fragments in Suspension Cultures of Castor Bean. Plant Physiol. 91, 889-897.

Buchanan-Wollaston V. 1997. The molecular biology of leaf senescence. J Exp Bot 48: 181-199

Burd et al. 2000, Can. J. Microbiol. 46:237-245

Caplan, J., Padmanabhan, M., and Dinesh-Kumar, S. P. (2008). Plant NB-LRR Immune Receptors: From Recognition to Transcriptional Reprogramming. Cell Host Microbe 3, 126-135

Carpita, N.C., and Gibeaut, D. M. (1993). Structural models of primary cell walls in flowering plants: consistency of molecular structure with the physical properties of the walls during growth. Plant J. Cell Mol. Biol. 3, 1-30.

Carvalho, A. de O., and Gomes, V. M. (2007). Role of plant lipid transfer proteins in plant cell physiology—A concise review. Peptides 28, 1144-1153.

Ceribelli, M., Dolfini, D., Merico, D., Gatta, R., Vigano, A. M., Pavesi, G., et al. (2008). The histone-like NF-Y is a bifunctional transcription factor. Mol. Cell. Biol. 28, 2047-2058.

Cheong, Y. H., Chang, H., Gupta, R., Wang, X., Zhu, T., Luan, S. 2002. Transcriptional profiling reveals novel interactions between wounding, pathogen, abiotic stress, and hormonal responses in *Arabidopsis*. Plant Physiol. 129, 661-677.

Chepyshko H, Lai C H, Huang L M, Liu J H, Shaw J F. 2012. Multifunctionality and diversity of GDSL esterase/lipase gene family in rice (*Oryza sativa* L. *japonica*) genome: new insights from bioinformatics analysis. BMC Genomics 2012 13:309.

Chichkova N V, Kim S H, Titova E S, Kalkum M, Morozov V S, Rubtsov Y P, Kalinina N O, Taliansky M E, Vartapetian A B. 2004. A plant-caspase-like protease activated during hypersensitive response. Plant Cell. 16:157-171.

Choi et al. 2001, Planta 213:45-50

Christensen, S., Kaplan, F., Huffaker, A., Sims, J., Doehlemann, G., Teal, P., and Schmelz, E. (2015). The maize death acids, 10-oxo-11-phytoenoic acid and derivatives, demonstrate specificity in jasmonate-related signaling and defense. In 57th Annual Maize Genetics Conference, (Pheasant Run, St. Charles, Ill.), Christensen, Shawn A., et al. "The novel monocot-specific 9-lipoxygenase ZmLOX12 is required to mount an effective jasmonate-mediated defense against *fusarium verticillioides* in Maize." Molecular Plant-Microbe Interactions 27.11 (2014): 1263-1276.

Chung, H.-J., and Ferl, R. J. (1999). *Arabidopsis* Alcohol Dehydrogenase Expression in Both Shoots and Roots Is Conditioned by Root Growth Environment. Plant Physiol. 121, 429-436.

Churin, Y., Schilling, S., and Börner, T. (1999). A gene family encoding glutathione peroxidase homologues in *Hordeum vulgare* (barley)1. FEBS Lett. 459, 33-38.

Claus Lehfeldt, Amber M. Shirley, Knut Meyer, Max O. Ruegger, Joanne C. Cusumano, Paul V. Viitanen, Dieter Strack, and Clint Chapple. 2000. Cloning of the SNG1 Gene of *Arabidopsis* Reveals a Role for a Serine Carboxypeptidase-like Protein as an Acyltransferase in Secondary Metabolism. The Plant Cell, Vol. 12, 1295-1306.

Conesa A, Gotz S, Garcia-Gomez J M, Terol J, Talon M, Robles M. 2005. Blast2GO: a universal tool for annota- Cook, Charis M., et al. "Transcriptional changes related to secondary wall formation in xylem of transgenic lines of tobacco altered for lignin or xylan content which show improved saccharification." Phytochemistry 74 (2012): 79-89.

Crespi, M., and Frugier, F. (2008). De Novo Organ Formation from Differentiated Cells: Root Nodule Organogenesis. Sci. Signal. 1, re11-re11.

Crowell, D. N., John, M. E., Russell, D., and Amasino, R. M. (1992). Characterization of a stress-induced, developmentally regulated gene family from soybean. Plant Mol. Biol. 18, 459-466.

D. Xu, X. Duan, B. Wang, B. Hong, THD. Ho and R. Wu. 1996. Expression of a Late Embryogenesis Abundant Protein Gene, HVA1, from Barley Confers Tolerance to Water Deficit and Salt Stress in Transgenic Rice. Plant Physiology. 110(1):249-57.

Daniels et al., (2006). PNAS 103: 14965-14970

Dao, T. T. H., Linthorst, H. J. M., and Verpoorte, R. (2011). Chalcone synthase and its functions in plant resistance. Phytochem. Rev. 10, 397-412.

Dasso, Mary. 1993. RCC1 in the cell cycle: the regulator of chromosome condensation takes on new roles. Trends in Biochemical Sciences. 18(3):96-101.

David M. Chiasson, Patrick C. Loughlin, Danielle Mazurkiewicz, Manijeh Mohammadidehcheshmeh, Elena E. Fedorova, Mamoru Okamoto, Elizabeth McLean, Anthony D. M. Glass, Sally E. Smith, Ton Bisseling, Stephen D. Tyerman, David A. Day, and Brent N. Kaiser. 2014. Soybean SAT1 (Symbiotic Ammonium Transporter 1) encodes a bHLH transcription factor involved in nodule growth and NH4+ transport. Proc Natl Acad Sci USA; 111(13): 4814-4819.

De León, P., Marco, S., Isiegas, C., Marina, A., Carrascosa, J. L. and Mellado, R. P., 1997. *Streptomyces lividans* groES, groEL1 and groEL2 genes. Microbiology, 143 (11), pp. 3563-3571.

Denome, S. A., Elf, P. K., Henderson, T. A., Nelson, D. E. and Young, K. D., 1999. *Escherichia coli* mutants lacking all possible combinations of eight penicillin binding proteins: viability, characteristics, and implications for peptidoglycan synthesis. Journal of bacteriology, 181(13), pp. 3981-3993.

Ding Y, Liu N, Virlouvet L, Riethoven J, Fromm M and Avramova Z. Four distinct types of dehydration stress memory genes in *Arabidopsis thaliana*. 2013. BMC Plant Biology 13: 229.

Dixon, R. A., and Paiva, N. L. (1995). Stress-Induced Phenylpropanoid Metabolism. Plant Cell 7, 1085-1097.

Donà, M., Macovei, A., Faè, M., Carbonera, D., and Balestrazzi, A. (2013). Plant hormone signaling and modulation of DNA repair under stressful conditions. Plant Cell Rep. 32, 1043-1052.

Dri, A. M., Rouviere-Yaniv, J. and Moreau, P. L., 1991. Inhibition of cell division in hupA hupB mutant bacteria lacking HU protein. Journal of bacteriology, 173(9), pp. 2852-2863.

Dunwell J M: Cupins. 1998. A new superfamily of functionally diverse proteins that include germins and plant storage proteins. Biotechnology & Genetic Engineering Reviews. 15: 1-32.

Eberhard et al., (1981). Biochemistry 20 (9): 2444-2449

Eckardt, N. A. (2004). The Role of PHANTASTICA in Leaf Development. Plant Cell 16, 1073-1075. Edgar (2010) Nature methods 10:996-8 el-Basyouni, S. Z., Chen, D., Ibrahim, R. K., Neish, A. C., and Towers, G. H. N. (1964). The biosynthesis of hydroxybenzoic acids in higher plants. Phytochemistry 3, 485-492.

Fiehn et al., (2000) Nature Biotechnol., 18, 1157-1161

Fischer S, Brunk B P, Chen F, Gao X, Harb O S, Iodice J B, Shanmugam D, Roos D S, Stoeckert C J, Jr. 2011. Using OrthoMCL to assign proteins to OrthoMCL-DB groups or to cluster proteomes into new ortholog groups. Curr Protoc Bioinformatics Chapter 6: Unit 6 12 11-19.

Fortin, M. G., Zelechowska, M., and Verma, D. P. S. (1985). Specific targeting of membrane nodulins to the bacteroid-enclosing compartment in soybean nodules. EMBO J. 4, 3041-3046.

Franssen, H. J., Nap, J. P., Gloudemans, T., Stiekema, W., Van Dam, H., Govers, F., Louwerse, J., Van Kammen, A., and Bisseling, T. (1987). Characterization of cDNA for nodulin-75 of soybean: A gene product involved in early stages of root nodule development. Proc. Natl. Acad. Sci. U.S.A 84, 4495-4499.

Friml, J. (2003). Auxin transport—shaping the plant. Curr. Opin. Plant Biol. 6, 7-12.

G Martinez Pastur, D. Z. (2001). CHANGES IN ISOPEROXIDASE PATTERNS DURING THE IN VITRO ROOTING OF NOTHOFAGUS ANTARCTICA. Bulg. J. Plant Physiol. 27, 43-53.

Gabel, C. and Maier, R. J., 1990. Nucleotide sequence of the coxA gene encoding subunit I of cytochrome aa3 of *Bradyrhizobium japonicum*. Nucleic acids research, 18(20), pp. 6143-6143.

Gao, Zhan, et al. "Quantitation of major human cutaneous bacterial and fungal populations." Journal of clinical microbiology 48.10 (2010): 3575-3581.

Gelman, A.; Carlin, J. B.; Stern, H. S. & Dunson, D. B. Bayesian Data Analysis CRC Press, 2013

Gibson, K. E., Kobayashi, H., and Walker, G. 2008. Molecular determinants of a symbiotic chronic infection. Annu. Rev. Genet. 42, 413-41.

Gili Ben-Nissan, David Weiss. 1996. The *petunia* homologue of tomato gast1: transcript accumulation coincides with gibberellin-induced corolla cell elongation. Plant Molec Biol. 32(6):1067-74.

Gilmour et al. (2000) Plant Physiol. 124: 1854-1865

Glover, R. T., Kriakov, J., Garforth, S. J., Baughn, A. D. and Jacobs, W. R., 2007. The two-component regulatory system senX3-regX3 regulates phosphate-dependent gene expression in *Mycobacterium smegmatis*. Journal of bacteriology, 189(15), pp. 5495-5503.

Göbel, C., and Feussner, I. (2009). Methods for the analysis of oxylipins in plants. Phytochemistry 70, 1485-1503.

Guldimann, C., Boor, K. J., Wiedmann, M. and Guariglia-Oropeza, V., 2016. Resilience in the face of uncertainty: sigma B fine-tunes gene expression to support homeostasis in Gram-positive bacteria. Applied and environmental microbiology, pp. AEM-00714.

Guzmán, E. C., Caballero, J. L., and Jiménez-Sánchez, A. (2002). Ribonucleoside diphosphate reductase is a component of the replication hyperstructure in *Escherichia coli*. Mol. Microbiol. 43, 487-495.

Haake et al. (2002) Plant Physiol. 130: 639-648

Haldrup, A., Simpson, D. J., and Scheller, H. V. (2000). Down-regulation of the PSI-F Subunit of Photosystem I (PSI) in *Arabidopsis thaliana* THE PSI-F SUBUNIT IS ESSENTIAL FOR PHOTOAUTOTROPHIC GROWTH AND CONTRIBUTES TO ANTENNA FUNCTION. J. Biol. Chem. 275, 31211-31218.

Hallman, J., et al., (1997) Canadian Journal of Microbiology. 43(10): 895-914

Hamano, Y., Dairi, T., Yamamoto, M., Kuzuyama, T., Itoh, N. and Seto, H., 2002. Growth-phase dependent expression of the mevalonate pathway in a terpenoid antibiotic-producing Streptomyces strain. Bioscience, biotechnology, and biochemistry, 66(4), pp. 808-819.

Hanfrey, C., Sommer, S., Mayer, M. J., Burtin, D., and Michael, A. J. (2001). *Arabidopsis* polyamine biosynthesis: absence of ornithine decarboxylase and the mechanism of arginine decarboxylase activity. Plant J. 27, 551-560.

Hanukoglu L. 2015. Proteopedia: Rossmann fold: A beta-alpha-beta fold at dinucleotide binding sites. Biochem Mol Biol 43 (3): 206-9.

Harig, L., Beinecke, F. A., Oltmanns, J., Muth, J., Müller, O., Rüping, B., Twyman, R. M., Fischer, R., Prüfer, D. and Noll, G. A. 2012. Proteins from the FLOWERING LOCUS T-like subclade of the PEBP family act antagonistically to regulate floral initiation in tobacco. The Plant Journal, 72: 908-921.

Hesse, H., Kreft, O., Maimann, S., Zeh, M., and Hoefgen, R. (2004). Current understanding of the regulation of methionine biosynthesis in plants. J. Exp. Bot. 55, 1799-1808.

Hesse, H., Kreft, O., Maimann, S., Zeh, M., and Hoefgen, R. (2004). Current understanding of the regulation of methionine biosynthesis in plants. J. Exp. Bot. 55, 1799-1808.

Hideki Takahashi, Mami Yamazaki, Noriko Sasakura, Akiko Watanabe, Thomas Leustek, Janice de Almeida Engler, Gilbert Engler, Marc Van Montagu, and Kazuki Saito. 1997. Regulation of sulfur assimilation in higher plants: A sulfate transporter induced in sulfate-starved roots plays a central role in *Arabidopsis thaliana*. Proc Nat Acad Sci. 94(20):11102-07.

Hiroki Miwa, Atsuko Kinoshita, Hiroo Fukuda, Shinichiro Sawa. 2008. Plant meristems: CLAVATA3/ESR-related signaling in the shoot apical meristem and the root apical meristem. J of Plant Res. 122(1):31-39.

Höfer, R., Dong, L., André, F., Ginglinger, J.-F., Lugan, R., Gavira, C., Grec, S., Lang, G., Memelink, J., Van Der Krol, S., et al. (2013). Geraniol hydroxylase and hydroxygeraniol oxidase activities of the CYP76 family of cytochrome P450 enzymes and potential for engineering the early steps of the (seco)iridoid pathway. Metab. Eng. 20, 221-232.

Hua Peng, Sufen Han, Mao Luo, Jian Gao, Xuan Liu, and Maojun Zhao. 2011. Roles of Multidrug Transporters of MFS in Plant Stress Responses. International Journal of Bioscience, Biochemistry and Bioinformatics, Vol. 1, No. 2, July 2011.

Huang da W, Sherman B T, Lempicki R A. 2009. Bioinformatics enrichment tools: paths toward the comprehensive functional analysis of large gene lists. Nucleic Acids Res 37:1-13.

Hui-Wen Wang, Jin-Song Zhang, Jun-Yi Gai, Shou-Yi Chen. 2006. Cloning and comparative analysis of the gene encoding diacylglycerol acyltransferase from wild type and cultivated soybean. Theoretical and Applied Genetics. 112(6):1086-97.

Huttová, J., Mistrik, I., Olle-Simonovicova, M., and Tamás, L. (2006). Cadmium induced changes in cell wall peroxidase isozyme pattern in barley root tips. Plant Soil Environ. 52, 250.

Ishikawa, Fumiyoshi, Suga, Shinobu, Uemura, Tomohiro, Sato, Masa H, Maeshima, Masayoshi. 2005. Novel type aquaporin SIPs are mainly localized to the ER membrane and show cell-specific expression in *Arabidopsis thaliana*. FEBS LETTERS 579: 5814-2

Ishikawa, K., Nakatani, H., Katsuya, Y., and Fukazawa, C. (2007). Kinetic and Structural Analysis of Enzyme Sliding on a Substrate: Multiple Attack in beta-Amylase. Biochemistry (Mosc.) 46, 792-798.

Ito, T., Shiraishi, H., Okada, K., and Shimura, Y. (1994). Two amidophosphoribosyltransferase genes of *Arabidopsis thaliana* expressed in different organs. Plant Mol. Biol. 26, 529-533.

Jami, S. K., Clark, G. B., Turlapati, S. A., Handley, C., Roux, S. J., and Kirti, P. B. (2008). Ectopic expression of an annexin from *Brassica juncea* confers tolerance to abiotic and biotic stress treatments in transgenic tobacco. Plant Physiol. Biochem. 46, 1019-1030.

Joe Ross, Yi Li, Eng-Kiat Lim and Dianna J Bowles. 2001. Higher plant glycosyltransferases. Genome Biol. 2(2): reviews 3004.1-3004.6.

Johnston-Monje, David, and Manish N. Raizada. "Conservation and diversity of seed associated endophytes in *Zea* across boundaries of evolution, ethnography and ecology." PLoS One 6.6 (2011): e20396.

Jones P M, George A M. 2004. The ABC transporter structure and mechanism: perspectives on recent research". Cellular and Molecular Life Sciences 61 (6): 682-99.

Joohyun Kang, Jiyoung Park, Hyunju Choi, Bo Burla, Tobias Kretzschmar, Youngsook Lee, and Enrico Martinoia. 2011. Plant ABC Transporters. *Arabidopsis* Book. 2011; 9: e0153.

José A. Caparrós-Martin, Iva McCarthy-Suárez, Francisco A. Culiáñez-Macià. 2013. HAD hydrolase function unveiled by substrate screening: enzymatic characterization of *Arabidopsis thaliana* subclass I phosphosugar phosphatase AtSgpp. Planta. 237(4):943-54.

Kereszt, A., Mergaert, P., and Kondorosi, E. (2011). Bacteroid Development in Legume Nodules: Evolution of Mutual Benefit or of Sacrificial Victims? Mol. Plant. Microbe Interact. 24, 1300-1309.

Kereszt, A., Mergaert, P., and Kondorosi, E. (2011). Bacteroid Development in Legume Nodules: Evolution of Mutual Benefit or of Sacrificial Victims? Mol. Plant. Microbe Interact. 24, 1300-1309.

Kevin W.-H. Lo, Scott Naisbitt, Jing-Song Fan, Morgan Sheng and Mingjie Zhang. 2001. The 8-kDa Dynein Light Chain Binds to Its Targets via a Conserved (K/R)XTQT Motif. The Journal of Biological Chemistry. 276:14059-66.

Khan, W., Balakrishnan, P., and Smith, D. L. 2008. Nod factor [Nod Bj V (C18:1, MeFuc)] and lumichrome enhance photosynthesis and growth of corn and soybean.

Kidd et al. 2007, Chemosphere 66:1458-1467

Kim, R. Q., Offen, W. A., Davies, G. J. and Stubbs, K. A., 2014. Structural enzymology of *Helicobacter pylori* methylthioadenosine nucleosidase in the futalosine pathway. Acta Crystallographica Section D: Biological Crystallography, 70(1), pp. 177-185.

Klambt, H. D. (1962). Conversion in plants of benzoic acid to salicylic acid and its [beta]d-glucoside. Nature 196, 491.

Konishi, H., Yamane, H., Maeshima, M., and Komatsu, S. (2004). Characterization of fructose-bisphosphate aldolase regulated by gibberellin in roots of rice seedling. Plant Mol. Biol. 56, 839-848.

Kozich, J. J., Westcott, S. L., Baxter, N. T., Highlander, S. K., & Schloss, P. D. (2013). Development of a dual-index sequencing strategy and curation pipeline for analyzing amplicon sequence data on the miseq illumina sequencing platform. Applied and Environmental Microbiology, 79(17), 5112-5120.

Kruschke, J. K. Bayesian Estimation Supersedes the t Test. Journal of Experimental Psychology: General, 2012

Kruschke, John K and Mike Meredith, BEST: Bayesian Estimation Supersedes the t-Test, R package version 0.2.2, http://CRAN.R-project.org/package=BESTKuc, J. (1987). Translocated Signals for Plant Immunization. Ann. N. Y. Acad. Sci. 494, 221-223.

Krusell L1, Krause K, Ott T, Desbrosses G, Krämer U, Sato S, Nakamura Y, Tabata S, James E K, Sandal N, Stougaard J, Kawaguchi M, Miyamoto A, Suganuma N, Udvardi M K. 2005. The sulfate transporter SST1 is crucial for symbiotic nitrogen fixation in Lotus japonicus root nodules. Plant Cell. 2005 17(5):1625-36.

Kuc, J. (1987). Translocated Signals for Plant Immunization. Ann. N. Y. Acad. Sci. 494, 221-223.

Kukavica, B. M., Veljovicć-Jovanovicć, S. D., Menckhoff, L., and Lüthje, S. (2012). Cell wall-bound cationic and anionic class III isoperoxidases of pea root: biochemical characterization and function in root growth. J. Exp. Bot.

Kumar et al. 1995, Environ. Sci. Technol. 29:1232-1238

Lang Minglin, Zhang Yuxiu, Chai Tuanyao. 2005. Identification of genes up-regulated in response to Cd exposure in Brassica juncea L. Gene. 363:151-58.

Laurie S, Halford N G. 2001. The role of protein kinases in the regulation of plant growth and development. Plant Growth Regulation 34: 253-265.

Leah McHale, Xiaoping Tan, Patrice Koehl and Richard W Michel. 2006. Plant NBS-LRR proteins: adaptable guards. Genome Biology 7:212.

Lee, H. I., León, J., and Raskin, I. (1995). Biosynthesis and metabolism of salicylic acid. Proc. Natl. Acad. Sci. 92, 4076-4079.

Legocki, R. P., and Verma, D. P. S. (1980). Identification of "nodule-specific" host proteins (nodulins) involved in the development of Rhizobium-Legume symbiosis. Cell 20, 153-163.

Legocki, R. P., and Verma, D. P. S. (1980). Identification of "nodule-specific" host proteins (nodulins) involved in the development of Rhizobium-Legume symbiosis. Cell 20, 153-163.

Lene Krusella, Katja Krausea, Thomas Otta, Guilhem Desbrossesa, Ute Krämera, Shusei Satob, Yasukazu Nakamurab, Satoshi Tabatab, Euan K. Jamesc, Niels Sandald, Jens Stougaardd, Masayoshi Kawaguchie, Ai Miyamotof, Norio Suganumaf and Michael K. Udvardia. 2005. The Sulfate Transporter SST1 Is Crucial for Symbiotic Nitrogen Fixation in Lotus japonicus Root Nodules. The Plant Cell. 17(5):1625-36.

Li et al., (2004) Mycologia 96: 526-536

Li, C., Ng, C. K.-Y., and Fan, L.-M. (2015). MYB transcription factors, active players in abiotic stress signaling. Environ. Exp. Bot. 114, 80-91.

Lunn, J. E. (2001). Sucrose Metabolism. In eLS, (John Wiley & Sons, Ltd).

Makarova, K. S., Ponomarev, V. A. and Koonin, E. V., 2001. Two C or not two C: recurrent disruption of Zn-ribbons, gene duplication, lineage-specific gene loss, and horizontal gene transfer in evolution of bacterial ribosomal proteins. Genome Biol, 2(9), p. 0033.

Marger M D, Saier M H. A major superfamily of transmembrane facilitators that catalyze uniport, symport and antiport. 1993. Trends in Biochemical Sciences 18 (1): 13-20.

Masaki Hayashi, Sokichi Shiro, Hiroyuki Kanamori, Satomi Mori-Hosokawa, Harumi Sasaki-Yamagata, Takashi Sayama, Miki Nishioka, Masakazu Takahashi, Masao Ishimoto, Yuichi Katayose, Akito Kaga, Kyuya Harada, Hiroshi Kouchi, Yuichi Saeki and Yosuke Umehara. 2014. A Thaumatin-Like Protein, Rj4, Controls Nodule Symbiotic Specificity in Soybean. Plant & Cell Phys. 55(9): 1679-89.

Matamoros, M. A., Dalton, D. A., Ramos, J., Clemente, M. R., Rubio, M. C., and Becana, M. (2003). Biochemistry and Molecular Biology of Antioxidants in the Rhizobia-Legume Symbiosis. Plant Physiol. 133, 499-509.

Matiru, V. N. and Dakora, F. D. 2005. Xylem transport and shoot accumulation of lumichrome, a newly recognized rhizobial signal, alters root respiration, stomatal conductance, leaf transpiration and photosynthetic rates in legumes and cereals. New Phytologist. 165, 847-855.

Maurel C, Boursiac Y, Luu D T, Santoni V, Shahzad Z, Verdoucq L. 2015. Aquaporins in Plants. Physiol Rev. 2015 95(4):1321-58.

McAinsh, M. R. (1990). Abscisic acid-induced elevation of guard cell cytosolic Ca2+ precedes stomatal closure. Nature 343, 186-188.

McClure, P. R. and Israel, D. W. 1979. Transport of nitrogen in the xylem of soybean plants. Plant Physiol. 64, 411-416.

McDonald et al. (2012), ISME journal 6:610-8

McDonald, D., Price, M. N., Goodrich, J., Nawrocki, E. P., DeSantis, T. Z., Probst, A., . . . Hugenholtz, P. (2012). An improved Greengenes taxonomy with explicit ranks for ecological and evolutionary analyses of bacteria and archaea. The ISME Journal, 6(3), 610-8.

McDonald, D., Price, M. N., Goodrich, J., Nawrocki, E. P., DeSantis, T. Z., Probst, A., . . . Hugenholtz, P. (2012). An improved Greengenes taxonomy with explicit ranks for ecological and evolutionary analyses of bacteria and archaea. The ISME Journal, 6(3), 610-8.

Meng Zhang, Jilian Fan, David C. Taylor and John B. Ohlrogge. 2009. DGAT1 and PDAT1 Acyltransferases Have Overlapping Functions in Arabidopsis Triacylglycerol Biosynthesis and Are Essential for Normal Pollen and Seed Development. The Plant Cell. 21(12):3885-3901.

Michel Herzog, Anne-Marie Dorne, Françoise Grellet. 1995. GASA, a gibberellin-regulated gene family from Arabidopsis thaliana related to the tomato GAST1 gene. Plant Molec Biol. 27(4):743-52.

Miller J D, Arteca R N, Pell E J. 1999. Senescence-associated gene expression during ozone-induced leaf senescence in Arabidopsis. Plant Physiol 120:1015-1024.

Ming-Der Shih, Folkert A. Hoekstra, Yue-Ie C. Hsing. 2008. Late Embryogenesis Abundant Proteins. Advances in Botanical Research. 48:211-55.

Mo Lu, Ying-Peng Han, Ji-Guo Gao, Xiang-Jing Wang, and Wen-Bin Li. 2010. Identification and analysis of the germin-like gene family in soybean. BMC Genomics, 11: 620.

Mortvedt 1996, Fertilizer Res. 43:55-61

Motoyuki Ashikari, Hitoshi Sakakibara, Shaoyang Lin, Toshio Yamamoto, Tomonori Takashi, Asuka Nishimura, Enrique R. Angeles, Qian Qian, Hidemi Kitano, Makoto Matsuoka. 2005. Cytokinin Oxidase Regulates Rice Grain Production. Science. 309(5735):741-45.

Moulin, M., Deleu, C., Larher, F., Bouchereau, A. 2006. The lysine-ketoglutarate reductase-saccharopine dehydrogenase is involved in the osmo-induced synthesis of pipecolid acid in rapeseed leaf tissues. Plant Physiol. and Biochem. 44, 474-482.

Mugford Sam T, Xiaoquan Qi, Saleha Bakht, Lionel Hill, Eva Wegel, Richard K. Hughes, Kalliopi Papadopoulou, Rachel Melton, Mark Philo, Frank Sainsbury, George P. Lomonossoff, Abhijeet Deb Roy, Rebecca J. M. Goss, and Anne Osbourn. 2009. A Serine Carboxypeptidase-Like Acyltransferase Is Required for Synthesis of Antimicrobial Compounds and Disease Resistance in Oats. The Plant Cell, Vol. 21: 2473-2484.

Naoya Takeda, Kristina Haage, Shusei Sato, Satoshi Tabata, and Martin Parniske. 2004. Activation of a *Lotus japonicus* Subtilase Gene During Arbuscular Mycorrhiza Is Dependent on the Common Symbiosis Genes and Two cis-Active Promoter Regions. Molecular Plant-Microbe Interactions 24: 662-670

Navarova, H., Bernsdorff, F., Doring, A., and Zeier, J. 2012. Pipecolic acid, an endogenous mediator of defense amplification and priming, is a critical regulator of inducible plant immunity. The Plant Cell. 24, 5123-5141.

Nordberg, J., and Arnér, E. S. J. (2001). Reactive oxygen species, antioxidants, and the mammalian thioredoxin system1. Free Radic. Biol. Med. 31, 1287-1312.

Obanye, A. I. C., Hobbs, G., Gardner, D. C. J. and Oliver, S. G., 1996. Correlation between carbon flux through the pentose phosphate pathway and production of the antibiotic methylenomycin in *Streptomyces coelicolor* A3 (2). Microbiology, 142(1), pp. 133-137.

Omidbakhshfard, M. A., Omranian, N., Ahmadi, F. S., Nikoloski, Z., and Mueller-Roeber, B. (2012). Effect of salt stress on genes encoding translation-associated proteins in *Arabidopsis thaliana*. Plant Signal. Behav. 7, 1095-1102.

Oppenheimer, D. G., Haas, N., Silflow, C. D., and Snustad, D. P. (1988). The beta-tubulin gene family of *Arabidopsis thaliana*: preferential accumulation of the beta1 transcript in roots. Gene 63, 87-102.

Oppenheimer, D. G., Haas, N., Silflow, C. D., and Snustad, D. P. (1988). The β-tubulin gene family of *Arabidopsis thaliana*: preferential accumulation of the β1 transcript in roots. Gene 63, 87-102.

Oppenheimer, D. G., Haas, N., Silflow, C. D., and Snustad, D. P. (1988). The β-tubulin gene family of *Arabidopsis thaliana*: preferential accumulation of the β1 transcript in roots. Gene 63, 87-102.

Osman, S. F. and Fett, W. F. 1982. Isoflavone glucoside stress metabolites of soybean leaves. Phytochem. 22, 1921-1923.

Pearson, Methods Enzymol. 183:63-98 (1990).

Perez-Miranda et al. (2007), J Microbiol Methods 70: 127-131

Peter Buchner, Hideki Takahashi, Malcolm J. Hawkesford. 2004. Plant sulphate transporters: co-ordination of uptake, intracellular and long-distance transport. Journal of Experimental Botany 55: 1765-1773.

Phalip et al., (1994) J Basic Microbiol 34: 277-280

Phillips, D. A., Joseph, C. M., Yang, G., Martinez-Romero, E., Sanborn, J. R., and Volpin, H. 1999. Identification of lumichrome as a *Sinorhizobium* enhancer of alfalfa root respiration and shoot growth. PNAS. 96, (22) 12275-12280.

Plummer, M. et al., JAGS: A program for analysis of Bayesian graphical models using Gibbs sampling Proceedings of the 3rd international workshop on distributed statistical computing, 2003, 124, 125

Pohland B and Owen B (2009). TAS technical bulletin. Biolog. 1, 1-3.

Quadt-Hallmann et al., (1997) Can. J. Microbiol., 43: 577-582

Quast, C., Pruesse, E., Yilmaz, P., Gerken, J., Schweer, T., Glo, F. O., & Yarza, P. (2013). The SILVA ribosomal RNA gene database project: improved data processing and web-based tools. Nucleic Acids Research, 41(November 2012), 590-596.

Quiroga, M., de Forchetti, S. M., Taleisnik, E., and Tigier, H. A. (2001). Tomato root peroxidase isoenzymes: kinetic studies of the coniferyl alcohol peroxidase activity, immunological properties and role in response to salt stress. J. Plant Physiol. 158, 1007-1013.

R Core Team, 2015, A Language and Environment for Statistical Computing, R Foundation for Statistical Computing, Vienna, Austria, 2015, http://www.R-project.org/

Rajkumar et al. 2009, Chemosphere 77:153-160

Ramos, J., Matamoros, M. A., Naya, L., James, E. K., Rouhier, N., Sato, S., Tabata, S., and Becana, M. (2009). The glutathione peroxidase gene family of *Lotus japonicus*: characterization of genomic clones, expression analyses and immunolocalization in legumes. New Phytol. 181, 103-114.

Reinbothe, H. and Mothes, K. 1962. Urea, ureides and guanidine in plants. Annu. Rev. Plant Physiol. 13, 129-149.

Reinhold-Hurek, B., and Hurek, T. (2011). Living inside plants: bacterial endophytes. Curr. Opin. Plant Biol. 14, 435-443.

Richard A. Jorgensen and Ana E. Dorantes-Acosta. 2012. Conserved peptide upstream open reading frames are associated with regulatory genes in angiosperms. Frontiers in Plant Science. 3:1-11.

Rietz Steffen, Friederike E. M. Bernsdorff, and Daguang Cai. 2012. Members of the germin-like protein family in *Brassica napus* are candidates for the initiation of an oxidative burst that impedes pathogenesis of *Sclerotinia sclerotiorum*. J Exp Bot. 63(15): 5507-5519.

Ripodas C, Castaingts M, Clúa J, Blanco F, Zanetti M E. 2015. Annotation, phylogeny and expression analysis of the nuclear factor Y gene families in common bean (*Phaseolus vulgaris*). Front Plant Sci. 14; 5:761

Roessner et al., (2001) Plant Cell, 13, 11-29

Rouhier N. 2010. Plant glutaredoxins: pivotal players in redox biology and iron-sulphur centre assembly. New Phytol. 186(2):365-72.

S. Gazzarrini, L. Lejay, A. Gojon, O. Ninnemann, W. B. Frommer, N. von Wirén. 1999. Plant Cell, 11 (1999), pp. 937-947

S. Pérez-Miranda, Journal of Microbiological Methods, Volume 70, Issue 1, Pages 127-131 (2007)

Sambrook, J., E. F. Fritsch, and T. Maniatis. "Molecular cloning: A laboratory manual. Sambrook 1989." (1989).

Sanssouci, É., Lerat, S., Daigle, F., Grondin, G., Shareck, F. and Beaulieu, C., 2012. Deletion of TerD-domain-encoding genes: effect on *Streptomyces coelicolor* development. Canadian journal of microbiology, 58(10), pp. 1221-1229.

Schmieder and Edwards (2011) Bioinformatics. 2011; 27:863-864

Schmülling Thomas, Tomáš Werner, Michael Riefler, Eva Krupková, Isabel Bartrina y Manns. 2003. Structure and function of cytokinin oxidase/dehydrogenase genes of maize, rice, *Arabidopsis* and other species. J of Plant Res. 116(3):241-52.

Schuler M A1, Berenbaum M R. 2013. Structure and function of cytochrome P450S in insect adaptation to natural and synthetic toxins: insights gained from molecular modeling. J Chem Ecol. 39(9):1232-45.

Schultze, M., and Kondorosi, A. (1998). Regulation of Symbiotic Root Nodule Development. Annu. Rev. Genet. 32, 33-57.

Shah, J., and Klessig, D. (1999). Chapter 23 Salicylic acid: signal perception and transduction. In New Comprehensive Biochemistry, M. A. H. and K. R. L. P. J. J. Hooykaas, ed. (Elsevier), pp. 513-541.

Shinozaki, K., and Yamaguchi-Shinozaki, K. (2000). Molecular responses to dehydration and low temperature: differences and cross-talk between two stress signaling pathways. Curr. Opin. Plant Biol. 3, 217-223.

Smart C M (1994) Gene expression during leaf senescence. New Phytol 126: 419-448

Soares et al. (1999). Revista de Microbiolgia 30(4): 299-303

Stacey, G., Libault, M., Brechenmacher, L., Wan, J., and May, G. D. (2006a). Genetics and functional genomics of legume nodulation. Curr. Opin. Plant Biol. 9, 110-121.

Stacey, G., McAlvin, C. B., Kim, S.-Y., Olivares, J., and Soto, M. J. (2006b). Effects of endogenous salicylic acid on nodulation in the model legumes Lotus japonicus and Medicago truncatula. Plant Physiol. 141, 1473-1481.

Stacey, M. G., Osawa, H., Patel, A., Gassmann, W., and Stacey, G. (2006c). Expression analyses of Arabidopsis oligopeptide transporters during seed germination, vegetative growth and reproduction. Planta 223, 291-305.

Stepanova, E., Wang, M., Severinov, K. and Borukhov, S., 2009. Early transcriptional arrest at Escherichia coli rplN and ompX promoters. Journal of Biological Chemistry, 284(51), pp. 35702-35713.

Strong, F. E., and Kruitwagen, E. (1967). Traumatic Acid: an Accelerator of Abscission in Cotton Explants. Nature 215, 1380-1381.

Subramanian A, Tamayo P, Mootha V K, Mukherjee S, Ebert B L, Gillette M A, Paulovich A, Pomeroy S L, Golub T R, Lander E S, Mesirov J P. 2005. Gene set enrichment analysis: a knowledge-based approach for interpreting genome-wide expression profiles. Proc Natl Acad Sci USA 102:15545-15550.

Sun, X.-L., Yu, Q.-Y., Tang, L.-L., Ji, W., Bai, X., Cai, H., Liu, X.-F., Ding, X.-D., and Zhu, Y.-M. (2013). GsSRK, a G-type lectin S-receptor-like serine/threonine protein kinase, is a positive regulator of plant tolerance to salt stress. J. Plant Physiol. 170, 505-515.

Suto et al., (2002) J Biosci Bioeng. 93:88-90

T. J. Prochaska, T. Donze-Reiner, L. Marchi-Werle, N. A. Palmer, T. E. Hunt, G. Sarath, T. Heng-Moss. 2015. Transcriptional responses of tolerant and susceptible soybeans to soybean aphid (Aphis glycines Matsumura) herbivory. Arthropod-Plant Interactions 9:347-359.

Takahashi, T., Gasch, A., Nishizawa, N., and Chua, N. H. (1995). The DIMINUTO gene of Arabidopsis is involved in regulating cell elongation. Genes Dev. 9, 97-107.

Takeuchi, Y., Yoshikawa, M., Takeba, G., Tanaka, K., Shibata, D., and Horino, O. (1990). Molecular Cloning and Ethylene Induction of mRNA Encoding a Phytoalexin Elicitor-Releasing Factor, beta-1,3-Endoglucanase, in Soybean. Plant Physiol. 93, 673-682.

Tang, L., Zhang, Y. X. and Hutchinson, C. R., 1994. Amino acid catabolism and antibiotic synthesis: valine is a source of precursors for macrolide biosynthesis in Streptomyces ambofaciens and Streptomyces fradiae. Journal of bacteriology, 176(19), pp. 6107-6119.

Thomashow (2001) Plant Physiol. 125: 89-93

Thomma, B. P. H. J., Cammue, B. P. A., and Thevissen, K. (2002). Plant defensins. Planta 216, 193-202.

Tohge, T., Yonekura-Sakakibara, K., Niida, R., Watanabe-Takahashi, A., and Saito, K. (2007). Phytochemical genomics in Arabidopsis thaliana: A case study for functional identification of flavonoid biosynthesis genes. Pure Appl. Chem. 79, 811-823.

Tomoyuki Furukawa, Norihiro Sakaguchi, Hiroaki Shimada. 2006. Two OsGASR genes, rice GAST homologue genes that are abundant in proliferating tissues, show different expression patterns in developing panicles. Genes & Genetic Systems. 81(3):171-80.

Toshitsugu Nakano, Kaoru Suzuki, Tatsuhito Fujimura, and Hideaki Shinshi. 2006. Genome-wide analysis of the ERF gene family in Arabidopsis and rice. Plant Physiol, 140 (2): p. 411-32.

Urao, T., Yamaguchi-Shinozaki, K., Urao, S., and Shinozaki, K. (1993). An Arabidopsis myb homolog is induced by dehydration stress and its gene product binds to the conserved MYB recognition sequence. Plant Cell 5, 1529-1539.

Usadel & Fernie, (2013). Front Plant Sci. 4:48

Van Hoof, P., and Gaspar, T. (1976). Peroxidase and isoperoxidase changes in relation to root initiation of Asparagus cultured in vitro. Sci. Hortic. 4, 27-31.

Velazhahan R, Datta S K, Muthukrishnan S (1999) The PR-5 family: thaumatin-like proteins in plants. In: Datta S K, Muthukrishnan S (eds) Pathogenesis-related proteins in plants. CRC Press, Boca Raton, pp 107-129

Vick, B., and Zimmerman, D. (1987). Oxidative systems for modification of fatty acids: the lipoxygenase pathway. In Lipids: Structure and Function. The Biochemistry of Plants, (New York), pp. 53-90.

Vining et al., (2013) BMC Plant Biol. 13:92

Wang et al., (2007) Applied and environmental microbiology 73:5261-7

Weaver L M, Gan S, Quirino B, Amasino R M. 1998. A comparison of the expression patterns of several senescence-associated genes in response to stress and hormone treatment. Plant Mol Biol 37:455-469.

Weiss, B. and Wang, L., 1994. De novo synthesis of thymidylate via deoxycytidine in dcd (dCTP deaminase) mutants of Escherichia coli. Journal of bacteriology, 176(8), pp. 2194-2199.

Weisshaar, B., and Jenkins, G. I. (1998). Phenylpropanoid biosynthesis and its regulation. Curr. Opin. Plant Biol. 1, 251-257.

Whetten, R. W., and Sederoff, R. R. (1992). Phenylalanine ammonia-lyase from loblolly pine: purification of the enzyme and isolation of complementary DNA clones. Plant Physiol. 98, 380-386.

Xiaoqiang Wang. 2009. Structure, mechanism and engineering of plant natural product glycosyltransferases. FEBS Letters. 583(20):3303-09.

Xuan Y H, Hu Y B, Chen L-Q, Sosso D, Ducat D C, Hou B-H, et al. 2013. Functional role of oligomerization for bacterial and plant SWEET sugar transporter family. Proc Natl Acad Sci USA. 110(39):E3685-94.

Yan Y, Borrego E, and Kolomiets M V (2013). Jasmonate Biosynthesis, Perception and Function in Plant Development and Stress Responses. In Lipid Metabolism, (Intech), pp. 393-442.

Yanagita, T. and Foster, J. W. 1956. A bacterial riboflavin hydrolase. J. Biol. Chem. 221, 593-607.

Yang, X.-D., Li, W.-J., and Liu, J.-Y. (2005). Isolation and characterization of a novel PHGPx gene in Raphanus sativus. Biochim. Biophys. Acta BBA-Gene Struct. Expr. 1728, 199-205.

Yu G, Wang L G, Han Y, He Q Y. 2012. clusterProfiler: an R package for comparing biological themes among gene clusters. OMICS 16:284-287.

SEQUENCE LISTING (4779 sequences)

SEQ ID NO: 1 - DNA, 608 bp, Streptomyces murinus
gcccttcggggtggattagtggcgaacgggtgagtaacacgtgggcaatctgccctgcactctgggacaagccctggaaacggggtctaataccggatatgaccatcttgggcatccttgatggtgtaaagctccggcggtgcaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagctcggggcttaaccccgagtctgcagtcgatacgggctagctagagtgtggtaggggagatcggaattcctggtgtagcggtgaaatgcgcagatatca

SEQ ID NO: 2 - DNA, 574 bp, Streptomyces incertae sedis
gcccttcggggtggattagtggcgaacgggtgagtaacacgtgggcaatctgcccttcactctgggacaagccctggaaacggggtctaataccggataacactctgtcccgcatgggacggggttaaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcgga

SEQ ID NO: 3 - DNA, 622 bp, Streptomyces SMCD2215
tgatatctgcgcatttcaccgctacaccaggaattccgatctcccctaccacactctagcctgcccgtatcgactgcagacccgaggttaagcctcgggctttcacaatcgacgtgacaagccgcctacgagctctttacgcccaataattccggacaacgcttgcgccctacgtattaccgcggctgctggcacgtagttagccggcgcttcttctgcaggtaccgtcacttgcgcttcttccctgctgaaagaggtttacaacccgaaggccgtcatccctcacgcggcgtcgctgcatcaggcttgcgcccattgtgcaatattccccactgctgcctcccgtaggagtctgggccgtgtctcagtcccagtgtggccggtcgccctctcaggccggctacccgtcgtcgccttggtgagccattacctcaccaacaagctgataggccgcgggctcatccttcaccgccggagctttccacgcacatcggatgcccgagcgcgtcgtatccggtattagaccccgtttccagggcttgtcccagagtgaagggcagattgcccacgtgttactcacccgttcgccactaatccaccccgaagggcttcatcgttcgac

SEQ ID NO: 4 - DNA, 1375 bp, Streptomyces SMCD2215
gggttgggccaccggcttcgggtgttaccgactttcgtgacgtgacgggcggtgtgtacaaggcccgggaacgtattcaccgcagcactgctgatctgcgattactagcgactccgacttcatggggtcgagttgcagaccccaatccgaactgagaccggctttttgagattcgctccacctcacggtatcgcagctcattgtaccggccattgtagcacgtgtgcagcccaagacataaggggcatgatgacttgacgtcgtccccaccttcctccgagttgaccccggcggtctcctgtgagtccccatcaccccgaagggcatgctggcaacacagaacaagggttgcgctcgttgcgggacttaacccaacatctcacgacacgagctgacgacagccatgcaccacctgtacaccgaccacaagggggcacccatctctggatgtttccggtgtatgtcaagccttggtaaggttcttcgcgttgcgtcgaattaagccacatgctccgccgcttgtgcgggcccccgtcaattcctttgagttttagccttgcggccgtactccccaggcggggaacttaatgcgttagctgcggcaccgacgacgtggaatgtcgccaacacctagttcccaccgtttacggcgtggactaccagggtatctaatcctgttcgctccccacgctttcgctcctcagcgtcagtaatggcccagagatccgccttcgccaccggtgttcctcctgatatctgcgcatttcaccgctacaccaggaattccgatctcccctaccacactctagcctgcccgtatcgactgcagacccgaggttaagcctcgggctttcacaatcgacgtgacaagccgcctacgagctctttacgcccaataattccggacaacgcttgcgccctacgtattaccgcggctgctggcacgtagttagccggcgcttcttctgcaggtaccgtcacttgcgcttcttccctgctgaaagaggtttacaacccgaaggccgtcatccctcacgcggcgtcgctgcatcaggcttgcgcccattgtgcaatattccccactgctgcctcccgtaggagtctgggccgtgttcagtcccagtgtggccggtcgccctctcaggccggctacccgtcgtcgccttggtgagccattacctcaccaacaagctgataggccgcgggctcatccttcaccgccggagctttccacgcacatcggatgcccgagcgcgtcgtatccggtattagaccccgtttccagggcttgtcccagagtgaagggcagattgcccacgtgttactcacccgttcgccactaatccaccccgaagggcttcatcgttcgactgca

SEQ ID NO: 5 - DNA, 880 bp, Streptomyces incertae sedis
cgctggaccaactccttcgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggcgtacaggtcgtgcatggctgtcgtcagctcgtgtcgtgagatgttgggtaagtcccgcaacgagcgcaaccttgttctggtgctgccagcatgcccttcgggtgatgggacttcaccacggagaccgcggctccactccgacgaggtgggggacgacgtcagtcatcatgccctaatgtctggctg

SEQ ID NO: 6 - DNA, 1160 bp, Streptomyces ginsengisoli
ccgggggcactccactgcgtatgtgtgacgagtagaccgctgcgcttagctgaggtctgatgaaatgtagaacacttaacaaaaatatgcccggatggatatacttttcaacgacagggctgcgattggatgatctcctttgaaacacagaactagtcacggcgacgaatactcaacttcgaccccccccctttctggaggcgcgtcttagtcccctccttgatggagctgccccgtgctcggcggccggagtcggcggtgttttccgctgtacctgagacgctggaccaactccttcgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggcgtacaggtcgtgcatggctgtcgtcagctcgtgtcgtgagatgttgggtaagtcccgcaacgagcgcaaccttgttctggtgctgccagcatgcccttcgggtgatgggacttcaccacggagaccgcggctccactccgacgaggtgggggacgacgtcagtcatcatgccctaatgtctggctg

SEQ ID NO: 7 - DNA, 873 bp, Streptomyces SMCD2215
ccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtct

SEQ ID NO: 8 - DNA, 880 bp, Streptomyces SMCD2215; identical to SEQ ID NO: 5

SEQ ID NO: 9 - DNA, 1382 bp, Streptomyces griseus
cacatgcagtcgaacgatgaagcctttcggggtggattagtggcgaacgggtgagtaacacgtgggcaatctgcccttcactctgggacaagccctggaaacggggtctaataccggataatacttctgcctgcatgggtgggggttgaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgatgccgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaacccct

SEQ ID NO: 10 - DNA, 1160 bp, Streptomyces ginsengisoli; identical to SEQ ID NO: 6

SEQ ID NO: 11 - DNA, 1403 bp, Streptomyces praecox
taccatgcagtcgaacgatgaagcccttcggggtggattagtggcgaacgggtgagtaacacgtgggcaatctgcccttcactctgggacaagccctggaaacggggtctaataccggataacactctgtcccgcatgggacggggttaaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttggggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcga

SEQ ID NO: 12 - DNA, 1859 bp, Streptomyces neyagawaensis
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggatacgacgcgctcgggcatccgatgtgcgtggaaagctccggcggtgaaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagctcgtaggcggtctgtcgcgtcggatgtgaaagcccggggcttaaccccgggtctgcattcgatacgggcagactagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacgccggaaacacccagagatgggtgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggcaggtacaatgagctgcgaagccgtgaggcggagcgaatctcaaaaagcctgtctcagttcggattggggtctgcaactcgaccccatgaagtcggagttgctagtaatcgcagatcagcagtgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttctaaggagcacttctagccgggcttcggcctggttcagaggccagaacatcagcgaatgtctgatgctggtagctcatgggtggaacgttgattattcggcacggtcggtatgggtgagagcgctagtactgcttcggcgtggaacgcgaagctcatcaactgaccgggtcgggcacgctgttgggtgtctgagggtgcgagcgttgctcgcccttcacgatgccgaccccggtgaagatccgcgttgagcgggttgtgacgggtggttggtcgttgtttgagaactgcacagtggacgcgagcatctgtggccaagtttttaagggcgc

SEQ ID NO: 13 - DNA, 1478 bp, Streptomyces albidoflavus
  misc_feature (1220)..(1220): n is a, c, g, or t
acgaacgctggcggcgtgcttaacacatgcaagtcgaacgatgaaccgctttcgggcggggattagtggcgaacgggtgagtaacacgtgggcaatctgccctgcactctgggacaagccctggaaacggggtctaataccggatatgactgtccatcgcatggtggatggtgtaaagctccggcggtgcaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgngaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaagg

SEQ ID NO: 14 - DNA, 1515 bp, Streptomyces albus
agagtttgatcctggctcaggacgaacgctggcggcgtgcttaacacatgcaagtcgaacgatgaaccgctttcgggcggggattagtggcgaacgggtgagtaacacgtgggcaatctgccctgcactctgggacaagccctggaaacggggtctaataccggatatgactgtccatcgcatggtggatggtgtaaagctccggcggtgcaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgtcccgtgttgccagcaggcctttgtggtgctggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacct

SEQ ID NO: 15 - DNA, 1509 bp, Streptomyces aureofaciens
gagtttgatcctggctcaggacgaacgctggcggcgtgcttaacacatgcaagtcgaacgatgaacctccttcgggaggggattagtggcgaacgggtgagtaacacgtgggcaatctgccctgcactctgggacaagccctggaaacggggtctaataccggatactgacccgcttgggcatccaagcggttcgaaagctccggcggtgcaggatgagcccgcggcctatcagcttgttggtgaggtaatggctcaccaaggcgacgacgggtagccggcctgagagggcgacggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaagaacaccggtggcgaaggcggatctctgggccgatactgacgctgaggagcgaaagcgtggggagcgaacaggattagataccctggtagtccacgccgtaaacggtgggcactaggtgtgggcgacattccacgtcgtcggtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactccaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggat

SEQ ID NO: 16 - DNA, 1472 bp, Streptomyces mutabilis
cgctggcggcgtgcttaacacatgcaagtcgaacgatgaaccaccttcgggtggggattagtggcgaacgggtgagtaacacgtgggcaatctgccctgcactctgggacaagccctggaaacggggtctaataccggatactgaccctcgcaggcatctgcgaggttcgaaagctccggcggtgcaggatgagcccgcggcctatcagctagttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaaaccctggagacagggtcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaa

SEQ ID NO: 17 - DNA, 1361 bp, Streptomyces lydicus
gtcgaacgatgaacctccttcgggaggggattagtggcgaacgggtgagtaacacgtgggcaatctgcccttcactctgggacaagccctggaaacgggctctaataccggatacgacacggggtcgcatgacctccgtgtggaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaaaccctggagacagggtcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagcc

SEQ ID NO: 18 - DNA, 100 bp, Streptomyces SMCD2215
tccctctggaatagtgcgtctttgacgtcctggtgagaccagacctgagcggggacagaggggcgcgctggatggggttctgtcctactacggttgcagc

SEQ ID NO: 19 - protein, 472 aa, Escherichia coli str. K-12 substr. MG1655
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGV

SEQ ID NO: 20 - DNA, 20 bp, Artificial sequence
  27f-YM primer
agagtttgatymtggctcag

SEQ ID NO: 21 - DNA, 19 bp, Artificial sequence
  1492R primer
ggttaccttgttacgactt

SEQ ID NO: 22 - DNA, 20 bp, Artificial sequence
  primer
ccctctggaatagtgcgtct

SEQ ID NO: 23 - DNA, 19 bp, Artificial sequence
  primer
ggctgcaaccgtagtagga

SEQ ID NO: 24 - protein, 148 aa, Streptomyces SMCD2215
MTATTDENVPGRFGPSATTEADPRQVGKVRTEYSPAHDGDPDPGEIVWTWVPFEENDGRGKDRPVLVVAREPGGTLLAVQLSSKRHDGDREWVAIGSGPWDRTGRDSWVDIDRVLRLHENGMRREACALDRGRFDLVRRRLAERYGWT

SEQ ID NO: 25 - protein, 320 aa, Streptomyces SMCD2215
MSPFLLTRTLPEDATDAALRTDVLRGLTGTPKTLPPKWFYDAHGSELFEQITELPEYYPTRAEREILIARAAEIAEATGARTLIELGSGSSEKTRYLLDALTDLDTYVPVDVSESALTQAGQALVAERPGLRVHALIADFTASVTLPDTPGPRLIAFLGGTIGNLLPAERAAFYGAIRSLLSPGDALLLGTDLVKDEQVLVRAYDDAAKVTAAFNKNVLTVVNRELDADFDPDAFDHVALWDSRNEWIEMRLRSRTTQTVKIPALDLAVDFAEGEDLRTEISAKFRQDGVRTELAAAGLELTHWWTDREGRFALSSSVAR

SEQ ID NO: 26 - protein, 1006 aa, Streptomyces SMCD2215
MHDDRSLVEARLKRVLDERIRPAVYPESVPLEVAVWHAPGEPVPVAEGLAAEPEPIQVGARWGAPWGTSWFRVTGTVPEDWAGRTVEAILDLGFDENMPGFQCEGLVYRPDGTPVKGLNPRNQWVRIGAPVAGGEEVRLHVEAASNPVILDYHPFLPTQLGDKETAGSEPQYTLARMDLAVLDETVWQLVIDLEVLGELLAELPVDSSRRHDIVRAVEKALDALDLQDVNGTAQEARERLTGVLSAPAVASAHRISAVGHAHIDSAWLWPLRETVRKVARTTANMTALLEDEPDFVFAMSQAQQWAWVKEHRPEVWARVKKAVADGRFVPAGGMWVESDTNMPGSEAMARQFVHGKRFFLDEFGIENDEAWLPDTFGFAAGLPQIIRAAGSTRLLTQKISWSQTNKFPHHTFNWEGIDGTRIFTHFPPVDTYNCSMKGSEIAHAARNFKDKGVARHSLAPTGWGDGGGGTTREMVAKAARLRDLEGSASVVWETPEQFFAKAEAEYPEPPVWVGELYLELHRATLTSQAGTKQGNRRSEHLLREAELWAATAAVRTGFPYPYEELDRIWKTVLLHQFHDILPGSSIAWVHREARATYARLAEELTAIIEAAQRALAGEGSTEFVFNSAPHGRDGVPAGGAGTPAVEGRTVLSAREGGGHVLDNGLLRIEIDARGLVVSAYDIEADRETVAPGRVAGLLQLHPDFPNMWDAWDVDEFYRNTVTDLTDADEVSGGEDGASVRVVRSFGASRVTQVLSLPPGERRLVLDTEVDWHETEKFLKLAFPLDVHAERYASETQFGHFHRPTHSNTSWEAAKFEACNHRFVHVEEPGWGVAIVNDSTYGHDVTRTVRTDGDRGTTTTVRASLLRAPRFPDPETDQGVHRFRHALVPGAGIGDAVREGWRINLPERRVTGAREVAPLVGVDRDGVVITAVKLADDGSGDVIVRFHESHGARTRATLTAGFPLAGATVTDLLERPLADAPAPERDGAGLTLSLRPFELVTLRLARG

SEQ ID NO: 27 - protein, 479 aa, Streptomyces SMCD2215
MSTSAQIGVTGLAVMGRNLARNFARNGYTVALHNRTAARTHALVEEFGNEGDFVTTETAKEFVAALERPRRLVIMVKAGEPTDAVIHEFAPLLEPGDMIIDGGNAHFADTRRRERELREQGIHFVGMGVSGGEEGALNGPSIMPGGPKESYDSLGPMLEKISAKAKDGSPCVTHVGPDGAGHFVKMVHNGIEYADMQLIGEAYQLLRDVAGYSPAQIAEIFRTWNTGRLDSYLIEITAEVLSHVDAATGKPFVDVVVDQAEQKGTGRWTVQIALDLGVPVSGIAEAVFARSLSGHAELREASRGLVGPKATALSEAEAGAFADRVEQALYASKIVSYTQGFHEIAAAREEYGWDIDLGAVSAIWRGGCIIRAAFLDRICAAYDTRADLPSLLSDETFAREIADAQDDWREVLVAATRQGVPTPGFAAALAYYDALRAERLPAALTQGQRDFFGAHTYRRVDQDGAFHTLWGGDRAEVSA

SEQ ID NO: 28 - protein, 772 aa, Streptomyces SMCD2215
MTIKPAAAAARATVYGYPRQGPNRELKKAIEGYWKGRVTADALRATAAELRRANWRQLADAGIHEVPTGDFSYYDHVLDTTVALGAIPDRHRAAVELDALDGYFAMARGTQDTAPLEMTKWFDTNYHYLVPELGPGTVFTADSGKQVTELREALTLGLTARPVLVGPVTYLLLAKPAPGVAADFEPLTLLDRLLPVYAEILADLRAAGAEWVQLDESALVQDRTPAELNATARAYRDLGALTDRPRLLVASYFDRLGDALPVLAKAPVEGLAVDFTESAAGNLQALAAAGGLPGKRLVAGVVSGRNIWVNDLAKSLSTLGTLLGLADRVDVAASCSLLHVPLDAAAERDIEPQILRWLAFARQKTAEVVTLAKGLAQGTDTIAAELAANRADLASRTGSPITHDPAVRSRAAAVTEADVRRSQPYAERAAAQRAHLGLPLLPTTTVGSFPQTGELRTARADLRAGRIDTAEYEERIKAEIQEVISFQEKTGIDVLVHGEPERNDMVQYFAEQLTGYLATQHGWVQSYGTRYVRPPILAGDISRPEPMTVRWTTYAQSLTSRPVKGMLTGPVTMLAWSFVRDDQPLGDTARQVALALRDEVNDLEAAGTSVIQVDEPALRETLPLRAADRPAYLAWATEAFRLSTGGVRPDTQIHTHMCYAEFGDIVQAIDDLDADVISLEAARSHMQVARELAAHGYPREAGPGVYDIHSPRVPSAEEAADLLRTGLRAIPAGRLWVNPDCGLKTRAWPETRASLENLVAAARTVRGELSGS

SEQ ID NO: 29 - protein, 739 aa, Streptomyces SMCD2215
MTDSTIFYTHTDEAPALATYSFLPVVQAYASQAGVTVATRDISLAGRIIAVFPEYLAEDQRIPDALHELGELAKTPEANIIKLPNISASIPQLKAAIAELQSQGYALPNYPDDPKTDEEREIQARYDKIKGSAVNPVLREGNSDRRAPASVKNYAKTHPHRMGAWSADSKTNVATMSQDDFRSTEKSAVISEAGSLRIELVAEDGSTTVLRESVPVLEGEVVDASVMRAAALNEFLAAQVARAKQEGVLFSVHLKATMMKVSDPIIFGHVVRTFFPKTFAKYGSTLAAAGLSPNDGLGGIYKGLEALPEGAEIKASFDAELGEGPALAMVDSDRGITNLHVPSDVIVDASMPAMIRTSGHMWGPDGAEADTLAVLPDSSYAGVYQAVIDDCRANGAYDPSTMGSVPNVGLMAQKAEEYGSHDKTFEIKTAGTVRLVDQNGNAVLEQPVAAGDIFRACQTKDAPIKDWVKLAVTRARATGNPAVFWLDETRAHDAQLIAKVKAYLPEHDTEGLDIRILAPVEATKLSVERIRRGEDTISVTGNVLRDYLTDLFPILELGTSAKMLSVVPLMAGGGLFETGAGGSAPKHVQQLIKENYLRWDSLGEFFALVPAFEQYAATTGNTRAKVLADTLDRATATFLNEDKSPTRRVGGIDNRGSHFFLSLYWAQELAAQTDDADLAKAFAPLAETLAANEQKIVDELLAVQGEPADIGGYYQPDPAKAAAVMRPSATWNGALASLS

SEQ ID NO: 30 - protein, 297 aa, Streptomyces SMCD2215
MTYHLPAGKALGGPYVVDVSPEKAGWGYSSLRVLELPPGGTHSFDTGDSEWIVLPLSGSCTVSSADDFGHETFELTGRDSVFSGVSDFAYVPRDARTTVSSTVGGRFALTGARCTRRLPARYGPASSVPVELRGTGNSSRQVNNFGAAGVFECDKLIAVEVITPGGNWSSFPPHKHDEHRPGEESVLEEIYYFEFAAHEGIPGLGYQRVSPSGNGRGTDVLAEVRGGDVVLIPDGWHGPSMAVPGHHMYYLNVMAGPEPERTWLICDHPDHAWVRDTWPEQPVDPRLPLYTAPETSL

SEQ ID NO: 31 - protein, 191 aa, Streptomyces SMCD2215
MGVSLSKGGNVSLSKEAPGLSAVLVGLGWDVRTTTGADFDLDASALLLDASGKVLSDQHFVFYNNLKSPDGSVEHTGDNLTGEGEGDDESIKVDLAAVPAGVDKIVFPVSIHEADTRGQSFGQVRNAFIRVVNQAGGAELARYDLSEDASSETAMVFGELYRNGAEWKFRAVGQGYASGLAGIASDFGVNV

SEQ ID NO: 32 - protein, 397 aa, Streptomyces SMCD2215
MFDSVRDDLRATLDEIRAAGLHKPERVIGTPQSATVNVTAGGRPGEVLNFCANNYLGLADHPEVVAAAHEALDRWGYGMASVRFICGTQEVHKELEARLSAFLGQEDTILYSSCFDANGGVFETLLGPEDAVISDALNHASIIDGIRLSKARRFRYANRDLADLEQQLKDASGARRRLIVTDGVFSMDGYVAPLAEICDLADRYDAMVMVDDSHAVGFVGPGGRGTPELYGVMDRVDIITGTLGKALGGASGGYVAARSEIVALLRQRSRPYLFSNTLAPVIAAASLKVLDLLESADDLRVRLRENTAQFRRRMVEEGFEILPGDHAIAPVMIGDATVAGRMAELLLERGVYVIGFSYPVVPQGQARIRVQLSAAHSTEDVNRAVEAFVSARAELQG

SEQ ID NO: 33 - protein, 266 aa, Streptomyces SMCD2215
MSELRFVRMGFGAEAVDYQVAWDEQRRVHAARFADEIPDTVLLLEHPPVYTAGRRTADNERPLDGTPVIDVDRGGKITWHGPGQLVGYPIQKLPRPVDVVAHLRRLEDVMIGVCAEFGVETSRVEGRAGVWVLGDPVEERPALGGLSLDFDPRLADEEFDPRLNGPEYAPSNAGQRREDRKICAMGIRVAKGVTMHGFALNVNPDVSNFDKIIPCGIRDAGVTSLAHELGRDVTIAEVLPVVERHLQAVLENADLRPRVIEKTPAA

SEQ ID NO: 34 - protein, 666 aa, Streptomyces SMCD2215
MTATTDGSAGALQPRPASASDTDSTIPVAAGVHDAAVRATRRATDFLLSRQDAEGWWKGDLETNVTMDAEDLLLRQFLGILDESTAHAAALFVRGEQREDGTWASFYGGPGELSTTIEGYVALRLAGDEPDAPHMAKASAWIREQGGIAASRVFTRIWLALFGWWKWEDLPELPPELIYFPKWMPLNIYDFGCWARQTIVPLTIVSAKRPVRPAPFPLDELHRDPSNPNPPKPFAPAASWDGAFQRLDRALHQARKVIPRRLRRAAMNSAARWIIERQENDGCWGGIQPPAVYSVIALYLLGYDLEHPVMREGLASLDRFAVWRDDGARMIEACQSPVWDTCLATIALADAGLPADHPQLVKAADWMLGEEIVRPGDWAVKRPQLPPGGWAFEFHNDNYPDIDDTAEVSLALRRVSHHDPERVEKAIGRAVRWNLGMQSKNGAWGAFDVDNTSPFPNRLPFCDFGEVIDPPSADVTAHVVEMLAVEGLSHDPRTRRGIEWLLAEQEPDGSWFGRWGVNYVYGTGSVVPALTAAGIPGSHPAIRRAVAWLEKVQNDDGGWGEDLRSYKYVKEWSGRGASTASQTAWALMALLAAGERDSKAVERGIEWLAATQREDGSWDEPYFTGTGFPWDFSINYHLYRQVFPLTALGRYVHGEPFAVKSVGKGS

SEQ ID NO: 35 - protein, 197 aa, Streptomyces SMCD2215
MPITPATATHSPSNGTADAILLELVDENGVTIGTAEKLAAHQPPGQLHRAFSVFLFDERGRLLLQQRALGKYHSPGVWSNTCCGHPYPGEAPFAAAARRTYEELGVSPSLLAEAGTVRYNHPDPDSGLVEQEYNHLFVGLVQAPLRPDPEEVGETVFVSPEELAERHAKDTFSSWFMTVLDAARPAVRELTGPSAGW

SEQ ID NO: 36 - protein, 251 aa, Streptomyces SMCD2215
MEPQLLHGVANSVATVVIHHPAKRNAMTAAMWAALPPLLDSLAADPDVRALVLTGEGGTFCAGADISTLRDSPERAQGLAVRAEEALAAFPKPTLAAVRGHCVGGGSQLAAACDLRFAEEGALFGVTPAKLGIVYPASSTRRLVSLVGPAAAKYLLFSGELIDSARALRTGLVDEVLPEGQLAKRVAEFTAILASRSQLTQAAAKEFANGRTDRDTHWSEQARGSGDTAEGVAAFLERRQPRFTWSVPFPG

SEQ ID NO: 37 - protein, 796 aa, Streptomyces SMCD2215
MTTAGSSAVGTIEGRIAEELGVRERQVKAAVELLDGGSTVPFIARYRKEATEMLDDAQLRTLEERLRYLRELEERRAAILDSVREQGKLTDELEAQIRGAETKARLEDIYLPFKPKRRTKAQIAREAGLEPLAEGLLGDPGVEPLAAAAAFVDADKGVPDPQAALDGARAILTERFSEDADLIGELRERMWVRGRLAAKVKDGKEEAGAKFADYFDFAEPFTDLPSHRILAMLRGEKEDVLDLSLEPEEPTDGPSSYESIVASKFGISNQGRPGDKWLQDTVRWAWRTRILVHLGIDLRLRLRTAAEDEAVQVFAANLRDLLLAAPAGTRATLGLDPGFRTGVKVAVIDATGKVVATDVIHPHVPANRWDEAIAKLARLSKEHAVELIAIGNGTASRETDKLAGELIAKHPELQLTKVMVSEAGASVYSASAFASQELPDMDVSLRGAVSIARRLQDPLAELVKIDPKSIGVGQYQHDLSEVKLSRSLDAVVEDCVNGVGVDVNTASAPLLARVSGITSGLAENIVAHRDANGPFTSRTALKGVARLGPKAYEQCAGFLRIRGGDDPLDASSVHPEAYPVVRRMVKTSGQEVASLIGNTAVLRSLQPDQFVDETFGLPTVTDILKELEKPGRDPRPAFKTATFKEGVEKIADLSSGMVLEGVVTNVAAFGAFVDVGVHQDGLVHVSAMSKTFVKDPRDVVKPGDIVKVKVLDVDIPRKRISLTLRLDDEAAAQGRQGGGDGGERRQRGGRPPQQRQRQGGGPRQGGGSRQAPPPANSAMADALRRAGLVDPKNGKR

SEQ ID NO: 38 - protein, 725 aa, Streptomyces SMCD2215
MTESTTIRWEQDDTGVVTLVLDDPDQSANTMNQAFRDSLTVVADRLEAEKDSIRGIILTSAKKTFFAGGDLRDLIRVTPETAQDLFDGGMAIKRNLRRIETLGKPVVAALNGAALGGGYELALACHHRIALDAPGSKIGCPEVTLGLLPGGGGVVRTVRLLGIADALLKVLLQGTQYNPRRALDNGLVDEVAATRDEMLAKARAFIDANPESQQPWDKPGYRIPGGTPANPRFAANLPAFPANLRKQTNGAPYPAPRNILAAAVEGSQVDFETAQVIEARYFVELAAGQTSKNMIQAFFFDLQAVNSGANRPTGIEPRKVRKVAVLGAGMMGAGIAYSCARAGIDVVLKDVSLEAALKGKGYSEKLCAKAVSRGRTTQEKADALLARITPAADPQDVAGCDAVIEAVFENPELKHKVFQEIQHVVEPDALLCSNTSTLPITALAEGVERQADFIGLHFFSPVDKMPLVEIIKGERTGDEALARAFDLVRQINKTPIVVNDSRGFFTSRVIGHFINEGVAMVGEGIEPASVEQAAAQAGYPAKVLSLMDELTLTLPRKIRNESKRAVEEAGGTWPSHPAEAVIDRMVDEFDRPGRSGGAGFYDYDESGKRAGLWPGLREHFTKPGHQIPFKDMQERMLFSEALDTVKLLEEGVLTSVADANIGSILGIGFPGWTGGILQYINGYEGGLPGFVARAHELAERYGERFTPPALLVEKAEKGERFTDAA

SEQ ID NO: 39 - protein, 324 aa, Streptomyces SMCD2215
MTITSPHLGSPAVWTDARLLYALEEVVEKELNRHLKVAKDWMPHEYVPWSDARNFPGLFEDGEAWSKEQSKVTEIGRTALVVNLLTEDNLPSYHHEIASLFGRDGAWGTWVHRWTAEEGRHGIVMRDYLLASRAVDPDKLEQFRMAHMSEGFESDNRHSMLHSVAYVAFQELATRISHRNTGHQSGDPVCDRMLARIATDENLHMVFYRNLLGAAFELAPDLTMQAVRDVVVNFRMPGHSIPGFERAAAQMAIGEVYNLRIHHDDVIQPVLRYLKVLEIDGLGPEGLKAQDELGLFMGGLDAEASKFDEKLAARKARMAARAGA

SEQ ID NO: 40 - protein, 644 aa, Streptomyces SMCD2215
MRRHSAQLTHQPDVLPWLGANFWSRTGGPLMWRNYDPKTVREELRVLGDHGLNMTRSFFYWPDFHPEPHRVDEELCERFEDFLDAHQEAGMGTVPTFIVGHMSGENWDPAWRGGRDLYEDVWMVGRQAWFVQRMARRFKDHPAVTGWLITNEMPGYGRIYQVDPPSSDVVTAWAQAMCNAVRASGATQPVSLGDGAWGIEVTGRDNGFSLRETAEYVDFVGPHVYRSDTDRPRQHYRAAFECELASVTGQPVVLEEFGLSTDTVSAANAGVFYRQTLHNSLLGGATGWIAWNNTDYDDLWDQAPYDHHPFEMHFGITDSLGAPKEPLRELAAFADVLKKVDFAHCARVDADAALVVPAFLERGYPYSRPADRPLIFTSLHQSYVTTRAADLPVGFTREADGLPGTASLYLLPATRQLTTRTRRELARRADAGATVYLSFCSGEHPATRGPWFDDLDGLFGVELQLSYGVAEPIEDDVLEMTFTEDFGALRAGEVLRVPVAGNEDSRAYLPVVPREGRVVAVDAHGRPALIVHETGAGRTVLATYPLEHMAARTPRANPDATHQLYEALAEVAGIRRPVTVADPHVSADVLVHADGRRFVWLVSQSPEPLTVRPVAEGTLHGLEDGEPVMDVTLDAYGVAVLELR

SEQ ID NO: 41 - protein, 429 aa, Streptomyces SMCD2215
MSDNSVVLRYGDGEYTYPVINSTVGDKGFDIGKLRAQTGLVTLDSGYGNTAAYKSSITYLDGEAGILRYRGYPIEQLAERSSFVEVAYLLINGELPTVDELSAFKGEITQHTLLHEDVKNFYKGFPRDAHPMAMLSSVVSALSTFYQDSHNPFDERQRNLSTIRLLAKLPTIAAYAYKKSIGHPFVYPRNDLGYVENFLRMTFSVPAQEFDLDPVVVSALDKLLILHADHEQNCSTSTVRLVGSSQANMFASISAGISALWGPLHGGANQSVLEMLEGIQADGGDVDSFIRKVKNKEDGVRLMGFGHRVYKNFDPRARIIKAAAHDVLSALGKSDELLDIALKLEEHALSDDYFTERKLYPNVDFYTGLIYRAMGFPTEMFTVLFALGRLPGWIAQWHEMIKEPGSRIGRPRQIYTGVVERDFVPVEER

SEQ ID NO: 42 - protein, 129 aa, Streptomyces SMCD2215
MKKAGILNRHLSGALAELGHGDGVLVCDAGMPIPRGPRVVDLAFRAGVPSFAEVLDGLLAELVVEGATAATEIHDANPTTSALLTAHFPRLDLVTHEQLKDLSAGARLVVRTGEAQPYANVLLRCGVFF

SEQ ID NO: 43 - protein, 597 aa, Streptomyces SMCD2215
MPSRRTVLAATAGVTAALALGTPAHASPPDDNKLRSLISRMTLEEKVGQLFVMRVYGHSATDPDQADIDANLKEIGVRTAAELIATYRVGGIIYFTWAHNTRDPHQIADLSNGIQRASLTQPRGLPVLIATDQEHGIVCRVGKPATLFPGAMAMGAGGSRRDARTLGRVSGAELRAMGINQDYSPDADVNINPANPVIGVRSFGADPEAVAGLVAAEVAGYQSASVAATSKHFPGHGDTAVDSHYGFPVITHSRELWEKLDAVPFRAAVRAGIDCIMTAHIQFPALDDSGDPATLSHPILTGILRGELGYDGVVVTDSLGMEGVRTKYGDDRVPVLALKAGVDQLLNPPDLPVAWNAVLKAVQDGELTEARLDESILRILRLKSRLRLFQQPYASDRGVDRTVGTREHLAVADRIAERTTTLLVNDGHLLPLSRHTHRKVLVVGADPASPSGTTGPPTGVLAAALGELGFTATALSTGTAPSGATIAKAVAAAQDADAVVVATYNVTAGNAQQALVQQLLATGRPVVAVAVRNPYDVAQLPSVRASLATYSWTDVELRAAARVIAGRVAPRGRLPVPVQRADDPAQELYPIGYGLSY

SEQ ID NO: 44 - protein, 322 aa, Streptomyces SMCD2215
MSSNETPRGPVDSSRVPRYAGPATFARLPRLDEVGSADVAVVGVPFDSGVSYRPGARFGGNAIREASRLLRPYNPAQDASPFALAQVADGGDIAVNPFNINEAVDTIEAAADQLLGTGARLMTLGGDHTIALPLLRSVAKKHGPVALLHFDAHLDTWDTYFGAEYTHGTPFRRAVEEGILDTSALSHVGTRGPLYGKQDLTDDEKMGFGIVTSADVMRRGVDEIADQLRQRVGDRPLYISIDIDCLDPAHAPGTGTPEAGGMTSRELLEILRGLASCNLVSADVVEVAPAYDHAEITSVAASHTAYELTTIMSRQIAEARAK

SEQ ID NO: 45 - protein, 645 aa, Streptomyces SMCD2215
MFDTVLVANRGEIAVRVIRTLRSLGVRSVAVFSDADADARHVREADTAVRIGPAPAAESYLSVERLLQAAARTGAQAVHPGYGFLAENAGFARACADAGLVFIGPPADAISLMGDKIRAKETVKAAGVPVVPGGRDPELAAAARELGAPVLLKPSAGGGGKGMRLVRDLAVLDEEIAAARREARASFGDDTLLVERWVDRPRHIEIQVMADGHGHVVHLGERECSLQRRHQKLVEEAPSVLLDEATRAAMGEAAVQAARSCGYRGAGTVEFIVPGGDPSSYYFMEMNTRLQVEHPVTELVTGLDLVEWQLRVAAGEPLTFTQDDVRLTGHAVEARICAETVSVKEGARGFLPSGGAVLRLREPEGDGVRTDSGLSEGTEVGSLYDPMLSKVIAYGPDRETALRKLRAALAGTVTLGVPTNAGFLRRLLAHPAVVAGELDTGLVEREVDGLVPTDVPDEVYEAAAAVRQEALRPRAEGWQDPFSVPSGWRMGGPSKPLAFDLRVPGFEPVEHVARGAHTVTGDEVTVTLDGVRHTFHRAADWLGRDGDAWQVRDHDPVAASLTGAGRAGADSLTAPMPGTVTVVKVAVGDEVSAGQSLLVVEAMKMEHVISAPHAGTVAELDVAPGTTVAMDQVLAVIAPHEEAEK

SEQ ID NO: 46 - protein, 325 aa, Streptomyces SMCD2215
MTVQQLPMAVGAEGLPARVRIHEVGARDGLQNEKGTVPTQVKAEFIHRLAEAGLTRIEATSFVHPKWVPQLADAEQLFPLVAGLPVELPVLVPNRRGLDRALALGARRVAVFASATESFAKANLNRTVEESLAVFDPVVRHAKDEGAHVRGYVSMCFGDPWEGPVPLPQVVRVCKALTDMGCDELSLGDTIGVATPGHVRRLLSLLNEAGVATDVIGVHFHDTYGQALANTYAALEHGVTTVDASAGGLGGCPFAKSATGNLATEDLVWMLRGLGIDTGVDLGRLVATSAWMAEQLGRPSPSRTVSALSHKDSEADQAAEAPEEQ

SEQ ID NO: 47 - protein, 645 aa, Streptomyces SMCD2215
MNDRAGHRRVRRLAIGTAVVLALAGMNGPWLYRFGTEKYHEYQINRPEYKADNGHWDIIQFPPKYRQDTIHAALLRTGKVLLVAGSGNNQDNFDKKKFDSRIWDPVKGTIKKVPTPADLFCTGHTQLANGNLLIAGGTKRYEKLKGDVTKAGGLMVVHNENPDKPITLPAGTVFTGKENGKSFVSKDPVLVPRAKKVFDKATGRFLRNDPGLGRIYVEAKKRGTKYETGTQDNYRIQGLTGSDARNTYGIAQKLALDKKDFQGIRNAYEFDPVAEKYIKVDPMNEARWYPTLTTLSDGKILSVSGLDDIGQLVPGKNEIFDPKTKKWTYTGKIRQFPTYPALFLMQNGKIFYSGSNAGYGPDNVGRTPGIWDVDTNKFTKLPGLSDADKMETSGTVLLPPAQNEKFMVIGGGGVGESKLSSNRTRLIDLKDKNPKFTDGPKLEKGTRYPQSSILPDDTVLVSGGSEDYRGRGDSNIHQARIYHPDTNSFEKVADPLVGRNYHSGSILLPDGRVMFFGSDSLYADKANTKPGKFEQRIEIYTPPYLYRDSRPSLSGGPQTIARGGTGTFTSPQASAIKKARLIRPSASTHVTDVDQRSIALDFKTSGNKITVTVPKNKNLVQSGWYMLFVDDDQGTPSKAQWVKVP

SEQ ID NO: 48 - protein, 341 aa, Streptomyces SMCD2215
MYGMRGAGMSASAAVLGVALLVAGCSSGGDGDGDKNGDAGAKITQQPKESDPFWVNPDGSAARQVAAYEKSGKDGDAEQIRKIAEQPTGEWIGPENPEAEAKGFTEAADKAGRTALLVLYNIPHRDCGQYSQGGAADGDAYRGWIDGVAAGIGDRAATVILEPDAILHLVDGCTPDEFHEERYDLLKGAVTKLKSLKNTKVYLDAGNAGWGRPDQIYQPLQWAGIAQADGFAVNVSNFYSTKDSVAYGKELSAKVGGKHFVIDTSRNGNGPYKGGDEDERWCNPPGRALGDTPTTRTADPLVDAYLWVKRPGESDGTCKGGPKAGAWWASYALKLAKASTP

SEQ ID NO: 49 - protein, 357 aa, Streptomyces SMCD2215
MTRTPLRVGLVGYGLAGSVFHAPLIAATEGLALDTVVTSNPERQKQALAEFPDVRVAATPEELFGRAAELDLVVVASPNRTHVPLATAALKAGLPVVVDKPIAGTAAEARELAALAEDRGLLLSVFQNRRWDNDFLTLQGLLAKGELGDVWRFESRFERWRPQTKGGWRESGDPAEIGGLLYDLGSHVVDQALVLFGPAAQVYAESDIRRPGAEADDDTFIAITHASGVRSHLYVSATTAQLGPRFRVLGSKAGYVKYGLDPQEADLREGRRPGTAADWGTEAEESWGRVGSGESPATGGGRPEPTLPGDYPAYYAAVARALTDGGANPVTAHEAAAALDVLEAARRSARDNVAVTL

SEQ ID NO: 50 - protein, 293 aa, Streptomyces SMCD2215
MTDQLRLMAVHAHPDDESSKGAATMAKYVSEGVDVLVVTCTGGERGSILNPKLQGDKYIEEHIHEVRKKEMDEAREILGVRQEWLGFVDSGLPEGDPLPPLPGGCFALEDVDKAAGELVKQIRTFRPQVITTYDENGGYPHPDHIMTHKISMVAFEGAADAEKYPEAEFGPAYQPQKLYYNQGFNRQRTEALHHALLDRGLESPYEDWLKRWSESERVERTLTTHIPCAEFFEIRDKALIAHATQIDPDGGWFRVPMEIQKEVWPTEEYELAKSLVDTSLPEDDLFAGIRDNA

SEQ ID NO: 51 - protein, 166 aa, Streptomyces SMCD2215
MTQTSENVTWLTQEAYNQLKAELEYLSGPARTEIASKIAAAREEGDLRENGGYHAAKEEQGKQELRVRQLTQLLENAKVGEAPASADGAVAPGMVVTIAFDGDEDDTLTFLLASREYASTDIETYSPQSPLGSGVTGHKVGEDAEYELPNGKKASVKILKAEPYNG

SEQ ID NO: 52 - protein, 384 aa, Streptomyces SMCD2215
MSDRHISQHFETLAIHAGNTADPLTGAVVPPIYQVSTYKQDGVGGLRGGYEYSRSANPTRTALEENLAALEGGRRGLAFASGLAAEDCLLRTLLSPGDHVVIPNDAYGGTFRLFAKVVARWGVEWSVADTSDPSAVRAALTPRTKAVWVETPSNPLLGITDIAALAQVARDAGARLVVDNTFATPYLQQPLALGADVVVHSLTKYMGGHSDVVGGALVVADEALGEELAFHQNAMGAVAGPFDSWLVLRGTKTLSVRMDRHSENATRVADMLTRHARVTSVLYPGLPEHPGHEVAAKQMRAFGGMVSFRVAGGEEAAVEVCNRAKVFTLGESLGGVESLIEHPGRMTHASAAGSALEVPADLVRLSVGIENVDDLLQDLQQALG

SEQ ID NO: 53 - protein, 372 aa, Streptomyces SMCD2215
MEFIWVVMAALMVGFVLLPFLRRRRGMIEQVPAGHPDAADPANYGFAREEELDVRMPGPDQDLLDVLDLVQRTQDYRAASQLLAGTEAEGEVRWQRVQAFAGAASLELQQRPGGVSETPGGQWLRVWRAEQPKDAGGAAVHAEFLVQQAWRTSTPGTDEFRIIMEEARSACGDAALLAPGDPVPYIVELSVARGLAYPRAEFEQLWLKILDRAPAHMGAHLAALHYWCEKWHGSRELAMSFAEAAAARAPEGSLLAAMPLFAVFEHLPEVNLVSGFYQSEVVTKAIHGALHAVHSARPDDPMLAHVRHLLVFFLVRAERWSEAMNQLIHIDGHVGALPWTLSPDPAAEFAVYRALAVAGYEANGGSPATLPH

SEQ ID NO: 54 - protein, 514 aa, Streptomyces SMCD2215
MDMHTVVVGTSGVTASDVLAVARDGARVELSAQAVEALAAARAIVDALAAKPEPVYGVSTGFGALATRHISPELRAQLQRNIVRSHAAGLGPRVEREVVRALMFLRLKTVCSGHTGVRPEVAQTMADVLNAGITPVVHEYGSLGCSGDLAPLSHCALTLMGEGEAEGPDGTVRPAGELLAEHGIAPVELREKEGLALLNGTDGMLGMLIMALADLDRLYKSADITAALSLEALLGTDKVLAPELHAIRPHPGQGASAANMLAVLKGSELTGHHQDDAPRVQDAYSVRCAPQVAGAGRDTMAHARTVAERELASAVDNPVVLPDGRVESNGNFHGAPVAYVLDFLAIAAADLASIAERRTDRLLDKNRSHGLPPFLADDAGVDSGLMIAQYTQAALVSEMKRLAVPASADSIPSSAMQEDHVSMGWSAARKLRTAVDNLARVVAVELYAASRAIELREGLIPAPASQAAIAAARAAGVQGPGPDRYLAPDLAAADAFVRDGRLVAAVESVTGPLQ

SEQ ID NO: 55 - protein, 269 aa, Streptomyces SMCD2215
MSEERFGEFVAVRRHGDEDAGQVAELVLDRSKAMNAVSTGMAQSIAGACAALGADRDVRVVVVTSTHERAFCVGADLKERNSFSDADLVRQRPVARAAYTGVLELPVPTIAAVHGFALGGGFELALSCDLIVADRTAVVGLPEVSVGVIPGGGGTQLLPRRVGVARAAELIFTARRLKAAEARELGLVDELVEEGRDRDEALALAARIAANSPVGLRAAKRALRLGHGLDLRAGLEVEDAAWRSVAFSGDRAEGVAAFNEKRTPRWPGQ

SEQ ID NO: 56 - protein, 590 aa, Streptomyces SMCD2215
MRKVLIANRGEIAVRVARACRDAGIASVAVYADPDRDALHVRTADEAFALGGDTPATSYLDIEKVLGAAREAGADAIHPGYGFLSENAEFAQAVLDAGLIWIGPPPQAIRDLGDKVAARHIAQRAGAPLVAGTPDPVSGADEVVAFAREHGLPIAIKAAFGGGGRGLKVARTLEEVPELYESAVREAVAAFGRGECFVERYLDKPRHVETQCLADTHGNVVVVSTRDCSLQRRHQKLVEEAPAPFLSEAQVAELYASSKAILKEAGYVGAGTVEFLVGADGTISFLEVNTRLQVEHPVTEEVAGLDLVREMFRIADGEELGYGDPELRGHSFEFRINGEDPGRGFLPAPGTVTAFAPPSGPGVRLDAGVESGSVIGPAWDSLLAKLIVTGATREQALQRAARALAEFQVEGMATAIPFHRAVVTDPAFAPELTGSSEPFTVHTRWIETEFVNDIKPFTAPADAESDEEPGRETVVVEVGGKRLEVSLPSSLGMSLARTGLAAGARPKRRAARKSGPVASGDTLASPMQGTIVKVAVEEGQEVKEGDLIVVLEAMKMEQPLNAHKSGTIKGLSAEIGASLTSGAAICEIKD

SEQ ID NO: 57 - protein, 482 aa, Streptomyces SMCD2215
MGYVTRIVIIGGGPGGYEAALVAAQLGAEVTVVDCDGLGGASVLTDCVPSKTLIATAEVMTTFDSSYEELGIIVADDTPPLEQAARVVGVDLGKVNRRVKRLALAQSHDITASVTRAGARVMRGRGRLEGMQALDGSRKVVVAAADGTEETLTADAVLIATGGHPREVPDALPDGERILNWTQVYDLDELPEELIVVGSGVTGAEFAGAYQALGSKVTLVSSRDRVLPGEDPDAAAVLEDVFRRRGMNVMARSRAAAAKRVGDRVEVTLSDGRVITGSHCLMAVGAIPNSQGMGLEEAGVRVRESGHIWTDKVSRTTAPGVYAAGDVTGVFALASVAAMQGRIAMYHFLGDAVAPLDLKTVSSNVFTDPEIATVGYSQADVDGGKIDARVVKLPLLRNPRAKMQGIRDGFVKLFCRPGTGIVVGGVVVAPRASELIHPISIAVDNNLTVEQIANAFTVYPSLSGSIAEVARQLHNRKTGAGL

SEQ ID NO: 58 - protein, 289 aa, Streptomyces SMCD2215
MCSVIYARRPKPATLVRVNASLLPDDIQGDPHADAAAARLRELTGAETHDVALVMGSGWAPAVDALGAPDAEFQVTELPGFPPPAVEGHGGKIRSYRSGDKRALVFLGRTHYYEGRGVAAVAHGVRTAVAAGCKTIVLTNGCGGLREGMRPGQPVLISDHINLTAASPIVGANFVDLTDLYSPRLRALCKEIDPTLEEGVYAQFPGPHYETPAEIRMARVIGADLVGMSTVLEAIAAREAGAEVLGISLVTNLAAGMTGEPLNHEEVLQAGRDSATRMGSLLAQVLGRL

SEQ ID NO: 59 - protein, 543 aa, Streptomyces SMCD2215
MHDELFARAQAWLAEDPDPDTREELAALVEARDVTELADRFDGTLQFGTAGLRGELGAGPNRMNRAVVIRAAAGLAAYLKNNGRAGGLVVIGYDARHKSADFARDTAAVMTGAGLRAAVLPRPLPTPVLAYAIRHLGAVAGVEVTASHNPPRDNGYKVYLGDGSQIVPPADAEIAAEIDAIAALADVPRPEEGWDTLGEDVLDAYLARTDAVLAPGSPRTARTVYTAMHGVGRDTLLAAFARAGFPEPVLVAEQAEPDPDFPTVAFPNPEEPGAMDLAFATARKADPDLIVANDPDADRCAVAVRDGGEWRMLRGDEVGALLAAHLVRRGARGTFAESIVSSSLLGRIAEKAGLPYEETLTGFKWIARVEGLRYGYEEALGYCVDPDGVRDKDGITAALLITELASGLKEEGRTLLDLLDDLAVEHGLHATDQLSVRVEDLSLIAAAMRRLREQPPTQLAGLAITKAEDLTEGTDRLPPTDGLRYTLDGARVVVRPSGTEPKLKCYLEVVVPVTAHTALPAARTTARDRLAAIKRDLSNAAGI

SEQ ID NO: 60 - protein, 385 aa, Streptomyces SMCD2215
MTSQTKSNTPTPEQIRRAPKVLLHDHLDGGLRPGTIVELAQEQGYSRLPETDPGKLGIWFREAADSGSLERYLETFSHTVGVMQTRDALVRVARECAEDLAEDGVVYAEVRYAPEQHLEGGLSLEEVVEAVNEGFREGERLARESGHRIRVGALLTAMRHAARSLEIAELANRYRDLGVVGFDIAGAEAGYPPTRHLDAFEYLKRENNHFTIHAGEAFGLPSIWQALQWCGADRLGHGVRIIDDIQVRPDGTVKLGRLASYVRDKRIPLELCPSSNLQTGAASSYSEHPIGLLRRLHFRATVNTDNRLMSGTGMSREFEHLVEAFGYSLDDMQWFSVNAMKSAFIPFDERLAMINDVIKPGYAELKSEWLFQQTASTSDSAPQES

SEQ ID NO: 61 - protein, 340 aa, Streptomyces SMCD2215
MSDGTTATTTADLDVRLEKHRVELTGYCYRMLGSSFEAEDAVQDTMVRAWRSYEKFEGRSSLRSWLYRIATNVCLDMLTAGNKRARPMDLSESTPLAQAALSPRPDNTWLEPMPDARVLPTVEDPAEAAVAKESVRLAFMAALQQLPAKQRAVLILREVLAWKASEVAELLDTSVASVNSALQRARATLAERDEKAAHAAVSDPLDEEQQKLLERYVAAFEGYDMTALTALLHEDAVMTMPPFDLWLTGHDDITGFMTTLGSACEGSRLVPVQVNGLPGFAQYKPDPDKGGHSPWAVQVLEISDGRLTGFHFFLDTQRWFPLFGLPLHLDAESDQVQEGA

SEQ ID NO: 62 - protein, 160 aa, Streptomyces SMCD2215
MATTETTASGIGPVEGASVYNVDNPAPLIEAPRKRTKKTPRSTRGNFEMAAWLFMRLSGVVLVVLVIGHLLIQLVLDGGVSKIGFAFVAGRWASPFWQVWDLLMLWLAMLHGANGLRTVINDYAERANTRLWLKGLLYTATVFTILLGTLVIFTFDPNIR

SEQ ID NO: 63 - protein, 259 aa, Streptomyces SMCD2215
MATPVLEKEGAAGQPEPGFADSPYITVTFRVRRFNPEVSAEATWEDFQLEIDPKERVLDGLHKIKWDVDGTLTFRRSCAHGICGSDAMRINGKNRLACKTLIKDINPEKPITVEPIKGLTVLKDLVVDMEPFFQAYRDVMPFLITKETNEPTRERFQTAEDRERFDDTTKCILCAACTSSCPVFWNDGQYFGPAAIVNAHRFIFDSRDEAGEQRLEILNDRDGVWRCRTTFNCTDACPRGIEVTKAIQEVKRALITRRF

SEQ ID NO: 64 - protein, 196 aa, Streptomyces SMCD2215
MAAQTEQSDTAREQTKAEQDVDQVRQRAVRDQQRLDSGAVTSPKDLENLQREIASLARRQSDLEDVVLEVMERVESVQERVAELTERVSSVQSKVDDATARRDAAVEQIDGEVATVTKEREVIAGTIPADLLKLYDKLREQQGGIGAAKLYQRTCQGCRQELAITDINEIRAAAPDTVVRCENCRRILVRTAESGL

SEQ ID NO: 65 - protein, 165 aa, Streptomyces SMCD2215
MTTDEDTEYAAEQPARMRWASHAPEVYKAMARLDTAAKQGLDPRLVELVRLRASAINHCAFCLDMHTKDALAAGENIQRIVQLNAWEESKHFYTEKELAAIELTEAVTVLTDGFVPDEVYEKAAKHFEEAELAQLIATIAVINAWNRFGVTTRAVPGHYQPGDFK

SEQ ID NO: 66 - protein, 329 aa, Streptomyces SMCD2215
MTRTPVNVTVTGAAGQIGYALLFRIASGQLLGADVPVKLRLLEITPALKAAEGTAMELDDCAFPLLQGIDITDDPNVAFDGTNVGLLVGARPRTKGMERGDLLEANGGIFKPQGKAINDHAADDVKVLVVGNPANTNALIAQAAAPDVPAERFTAMTRLDHNRALTQLAKKTGSTVADIKRLTIWGNHSATQYPDIFHATIAGKNAAETVNDEKWLAEEFIPTVAKRGAAIIEARGASSAASAANAAIDHVYSWVNGTADGDWVSMGIPSDGSYGVPEGLISSFPVTTKDGAYEIVQGLEINEFSRARIDASVKELEEEREAVRALGLI

SEQ ID NO: 67 - protein, 284 aa, Streptomyces SMCD2215
MTAQILDGKATAAAIKSDLTARVAALKEKGVTPGLGTILVGNDPGSQKYVAGKHRDCAQVGIASIQRELPDTATQEEIEAVVRELNEDPACTGYIVQLPLPKGIDENRILELMDPDKDADGLHPMNLGRLVLNEPAPLPCTPNGVLTLLRRYGVEIKGAEVVVVGRGVTIGRPMPLLLTRRSENATVTQCHTGTRDLSSHLKRADIIVAAAGSAHLVRPEDVKPGAAVLDVGVSRSADGKIVGDVHPGVAEVAGWISPNPGGVGPMTRAQLLVNVVEAAERSAG

SEQ ID NO: 68 - protein, 209 aa, Streptomyces SMCD2215
MAAKPVVKRLVVLVSGSGTNLQALLDEIAAVGAEAYGAEIVAVGADREGIEGLARAERAGLATFVCRVKDFGSREEWDAALAEAVAAHEPDLVVSAGFMKIVGKEFLARFGGRFVNTHPALLPSFPGAHGVRDALAYGARVTGCTVHFVDDGVDTGPIIAQDVVEVRNEDDESALHERIKEVERRLLVDVVGRLARNGYRIEGRKVVIQ

SEQ ID NO: 69 - protein, 239 aa, Streptomyces SMCD2215
MSDPTEANEPAEPTGASTGERHVRVVLVDDHRMFRTGVQAEIGRTDETGVEVVGEAADVDQAVTVITATRPEVVLLDVHLPGGGGVEVLRRCAALMADAEEPVRFLALSVSDAAEDVIGVIRGGARGYVTKTITGTDLVNSIFRVQEGDAVFSPRLAGFVLDAFASTDAPPVDEDLDRLTQREREVLRLIARGYAYKEIAKQLFISVKTVESHVSAVLRKLQLSNRHELTRWATARRLV

SEQ ID NO: 70 - protein, 374 aa, Streptomyces SMCD2215
MTEIEIGRGKRGRRAYAFDDIAVVPSRRTRDPKEVSIAWQIDAYRFELPFLAAPMDSVVSPATAIRIGELGGLGVLNLEGLWTRYEDPQPLLDEIAQLPAESANRRLQEIYTAPIKEELIGRRIKEVRDSGVVTAAALSPQRTAQFSKAVVDAGVDIFVIRGTTVSAEHVSGSHEPLNLKQFIYELDVPVIVGGCATYTAALHLMRTGAAGVLVGFGGGAAHTTRNVLGIQVPMATAVADVAAARRDYMDESGGRYVHVIADGGVGWSGDLPKAIACGADAVMMGSPLARATDAPGRGHHWGMEAVNEELPRGKKVDLGTVGTIEEVLTGPSHIPDGSMNFFGALRRAMATTGYSELKEFQRVEVTVADSQHKR

SEQ ID NO: 71 - protein, 541 aa, Streptomyces SMCD2215
MAKILKFDEDARRALERGVNKLADTVKVTIGPKGRNVVIDKKFGAPTITNDGVTIAREVEVEDPYENLGAQLVKEVATKTNDIAGDGTTTATVLAQALVREGLRNVAAGASPALLKKGIDAAVAAVSEELLASARPIDEKSDIAAVAALSAQDQQVGELIAEAMDKVGKDGVITVEESNTFGLELDFTEGMAFDKGYLSPYFVTDQERMEAVLEDPYILINQGKIGSIADLLPLLEKVIQAGSSKPLLIIAEDVEGEALSTLVVNKIRGTFNAVAVKAPGFGDRRKAMLQDMATLTGATVISEEVGLKLDQVGLDVLGSARRITVTKDDTTIVDGAGNSADVQGRIAQIKAEIENTDSDWDREKLQERLAKLAGGVCVIKVGAATEVELKEKKHRLEDAISATRAAVEEGIVSGGGSALVHAVKVLADNLGKTGDEATGVAVVRRAAVEPLRWIAENAGLEGYVITSKVAELDKGQGFNAATGEYGDLVKAGVIDPVKVTRSALENAASIASLLLTTETLVVEKKEEEEPAAAGAGHGHAH

SEQ ID NO: 72 - protein, 102 aa, Streptomyces SMCD2215
MTTASSKVAIKPLEDRIVVQPLDAEQTTASGLVIPDTAKEKPQEGVVLAVGPGRFENGERLPLDVNTGDIVLYSKYGGTEVKYNGEEYLVLSARDVLAIVEK

SEQ ID NO: 73 - protein, 173 aa, Streptomyces SMCD2215
MAETTVETPVEGEEIVDIESYTTESDVPVEGEYTSESLASRFGDPQPAAGLGRRKNAIARVRIVPGSGKWKINGRTLEDYFPNKVHQQEVNEPFKVLELEGRYDVIARISGGGVSGQAGALRLGVARALNEADVDNNRGPLKKAGFLKRDDRAVERKKAGLKKARKAPQYSKR

SEQ ID NO: 74 - protein, 147 aa, Streptomyces SMCD2215
MRTYSPKPGDVTRQWHVIDAQDVVLGRLATTAASLLRGKHKPIYAPHVDTGDFVIIINADKVHLSGNKRTQKMAYRHSGYPGGLRSVRYDELLSKNPEKAIEKAVKGMLPKNTLGRQMLTKLKVYSGDQHPHAAQQPVPFEITQVAQ

SEQ ID NO: 75 - protein, 284 aa, Streptomyces SMCD2215
MSDEVEPGYVRVRLDLSYDGSEFSGWAKQAGGRRTVQGEIEDALRTVTRSRETYELTVAGRTDAGVHARGQVAHVDLPEPVWREHHEKLLKRLAGRLPRDVRVWALREAPSGFNARFSAVWRRYAYRVTDNPGGVDPLLRGHVLWHDWPLDVDAMNEAAERLLGEHDFAAYCKKREGATTIRTLQRLSLVRGDDGIITATVRADAFCHNMVRSLIGALLFVGDGHRGPDWPGKVLAAGVRDSAVHVVRPHGLTLEEVGYPADELLAARSKEARNKRSLPGAGCC

SEQ ID NO: 76 - protein, 81 aa, Streptomyces SMCD2215
  misc_feature (16)..(19): Xaa can be any naturally occurring amino acid
MRPRDAMASAGKTLVXXXXSEADLLDIRNFGAKSIDEVKAKLAGMGLALKDSPPGFDPTAAADAFGADDDADAGFVETEQY

SEQ ID NO: 77 - protein, 134 aa, Streptomyces SMCD2215
MPPKGRQGAAKKVRRKEKKNVAHGHAHIKSTFNNTIVSITDPSGNVISWASAGHVGFKGSRKSTPFAAQMAAESAARRAQEHGMRKVDVFVKGPGSGRETAIRSLQATGLEVGSIQDVTPTPHNGCRPPKRRRV

SEQ ID NO: 78 - protein, 126 aa, Streptomyces SMCD2215
MARVSGVDIPREKRVEVALTYVFGIGRTLAQQTLAETGVDPNTRVRDLSEEQLVAIREYVDNNIKTEGDLRREIQADIRRKVEIGCYQGLRHRRGLPVRGQRTSTNARTRKGPRRAIAGKKKPGKK

SEQ ID NO: 79 - protein, 278 aa, Streptomyces SMCD2215
MVQIKSPEQIAKMREAGLVVAAIHAATREAAVPGASTKDLDQVARKVLAEHNAKPNFLGYGGFPATICTSVNEVVVHGIPSDEVVLKDGDIISIDCGAIIDGWHGDAAYTAFVGSGHAPELIELSRVTEESMWAGIAAMKQGNRLVDVSRAIETYIRRQPKPGGGKYGIIEDYGGHGIGTEMHMDPHLLNYVDRRRGKGPKLVPGFCLAIEPMVSLGTPKTEVLSDDWTVITTDGTWSSHWEHSIALTEQGPLVLTAPDGGRAKLAELGITAAPDPLG

SEQ ID NO: 80 - protein, 201 aa, Streptomyces SMCD2215
MAGPQRRGSGAGGGERRDRKGRDGGAAAAEKTAYVERVVAINRVAKVVKGGRRFSFTALVVVGDGDGTVGVGYGKAKEVPAAIAKGVEEAKKHFFKVPRIQGTIPHPIQGEKAAGVVLLKPASPGTGVIAGGPVRAVLECAGIHDILSKSLGSDNAINIVHATVAALKGLQRPEEVAARRGLPLEDVAPAALLRARAGAGA

SEQ ID NO: 81 - protein, 132 aa, Streptomyces SMCD2215
MTMTDPIADMLTRLRNANSAYHDSVTMPASKIKSHIAEILQQEGFITGWKVEDAEVGKNLVLELKFGPNRERSIAGIKRISKPGLRVYAKSTNLPKVLGGLGVAIISTSHGLLTDKQAGKKGVGGEVLAYVW

SEQ ID NO: 82 - protein, 95 aa, Streptomyces SMCD2215
MSESNVTEETKAARGFRKTREGLVVSDKMDKTVVVAVEDRVKHALYGKVIRRTNKLKAHDEQNAAGVGDRVLLAETRPLSATKRWRVVEILEKAK

SEQ ID NO: 83 - protein, 139 aa, Streptomyces SMCD2215
MLIPRRVKHRKQHHPKRSGAAKGGTQVAFGEYGIQALTPAYVTNRQIEAARIAMTRHIKRGGKVWINIYPDRPLTKKPAETRMGSGKGSPEWWIANVKPGRVMFELSYPNEKIAREALTRAAHKLPMKCRIVKREAGEA

SEQ ID NO: 84 - protein, 279 aa, Streptomyces SMCD2215
MGQKVNPHGFRLGVTTDFKSRWYADKLYKDYVKEDVAIRRMMTSGMERAGISKVEIERTRDRVRVDIHTARPGIVIGRRGAEADRIRGDLEKLTGKQVQLNILEVKNPETDAQLVAQAVAEQLSSRVSFRRAMRKSMQSAMKAGAKGIKIQCGGRLGGAEMSRSEFYREGRVPLHTLRANVDYGFFEAKTTFGRIGVKVWIYKGDVKNIAEVRAENAAARAGNRPARGGADRPARGGRGGERRGRKPQQAAGAEAPKAEAPAAAAPAEAPSSSTGGTEA

SEQ ID NO: 85 - protein, 115 aa, Streptomyces SMCD2215
MEARAQARYIRVTPMKARRVVDLIRGMDATEAQAVLRFAPQAASVPVGKVLDSAIANAAHNYDHTDADSLFISEAYVDEGPTLKRFRPRAQGRAYRIRKRTSHITVVVSSKEGTR

SEQ ID NO: 86 - protein, 93 aa, Streptomyces SMCD2215
MPRSLKKGPFVDDHLIKKVEVQNEAGTKNVIKTWSRRSMIVPAMLGHTIAVHNGKTHIPVFVTESMVGHKLGEFSPTRTFRGHVKDDRKSKRR

SEQ ID NO: 87 - protein, 278 aa, Streptomyces SMCD2215
MGIRKYKPTTPGRRGSSVADFVEVTRSTPEKSLVRPLHSKGGRNNSGRVTVRHQGGGHKRAYRVIDFRRHDKDGVPAKVAHIEYDPNRTARIALLHYADGEKRYILAPRGLNQGDRIENGPGADIKPGNNLALRNIPVGTTIHSVELRPGGGAKFARSAGASVQLLAKEGSMAHLRMPSGEIRLVDQRCRATVGEVGNAEQSNINWGKAGRKRWLGVRPTVRGVAMNPVDHPHGGGEGKTSGGRHPVSPWGQKEGRTRSPKKASNKYIVRRRKTNKKR

SEQ ID NO: 88 - protein, 218 aa, Streptomyces SMCD2215
MSTVDILSPAGDKAGSVELPAEIFDVEKVSIPLIHQVVVAQLAAARQGTHKTKTRGEVRGGGKKPYRQKGTGRARQGSTRAPQFAGGGVVHGPQPRDYSQRTPKKMKAAALRHALTDRARHNRIHVVSGVVEGETPSTKAAKGLFGKISERKNLLLVVERADEAAWLSARNLPQVHILEPGQLNTYDVLVSDDVVFTQAAFESFVSGPKANDTEGSEA

SEQ ID NO: 89 - protein, 102 aa, Streptomyces SMCD2215
MAGQKIRIRLKAYDHEVIDSSAKKIVETVTRTGASVAGPVPLPTEKNVYCVIKSPHKYKDSREHFEMRTHKRLIDILDPTPKTVDSLMRLDLPAGVDIEIKL

SEQ ID NO: 90 - protein, 708 aa, Streptomyces SMCD2215
MATTSLDLARVRNIGIMAHIDAGKTTTTERILFYTGVSYKIGEVHDGAATMDWMEQEQERGITITSAATTCHWPLEDNDYTINIIDTPGHVDFTVEVERSLRVLDGAVTVFDGVAGVEPQSETVWRQADRYGVPRICFVNKLDRTGAEFHRCVDMISDRLGAQPLVMQLPIGAEADFKGVVDLVRMKALVWSAEAAKGEMYDVVDIPATHTEAAEEWRGKLVEAVAENDEEIMELYLEGQEPTEEQLYAAIRRITIASGKSSDTTVTPVFCGTAFKNKGVQPLLDAVVRYLPTPLDVEAIEGHDVKDPEVVVKRKPSDDEPLSALAFKIMSDPHLGKLTFVRVYSGRLESGTAVLNSVKGKKERIGKIYRMHANKREEIDSVGAGDIIAVMGLKQTTTGETLSDDKNPVILESMDFPAPVIQVAIEPKSKGDQEKLGVAIQRLAEEDPSFQVHSDEETGQTIIGGMGELHLEVLVDRMRREFKVEANVGKPQVAYRETIRKAVERVDYTHKKQTGGTGQFAKVQIAIEPIEGGDASYEFVNKVTGGRIPKEYIPSVDAGAQEAMQFGILAGYEMTGVRVTLIDGGYHEVDSSELAFKIAGSQAFKEAARKASPVLLEPMMAVEVTTPEDYMGEVIGDINSRRGQIQAMEERAGARVVKGLVPLSEMFGYVGDLRSKTSGRASYSMQFDSYAEVPRNVAEEIIAKAKGE

SEQ ID NO: 91 - protein, 156 aa, Streptomyces SMCD2215
MPRKGPAPKRPVIIDPVYGSPLVTSLINKVLLNGKRSTAERIVYGAMEGLREKTGNDPIITLKRALENIKPTLEVKSRRVGGATYQVPIEVKPGRANTLALRWLVGYSRARREKTMTERLLNELLDASNGLGAAVKKREDTHKMAESNKAFAHYRW

SEQ ID NO: 92 - protein, 123 aa, Streptomyces SMCD2215
MPTIQQLVRKGRQDKVEKNKTPALEGSPQRRGVCTRVFTTTPKKPNSALRKVARVRLTSGIEVTAYIPGEGHNLQEHSIVLVRGGRVKDLPGVRYKIIRGSLDTQGVKNRKQARSRYGAKKEK

SEQ ID NO: 93 - protein, 1299 aa, Streptomyces SMCD2215
MLDVNFFDELRIGLATADDIRQWSHGEVKKPETINYRTLKPEKDGLFCEKIFGPTRDWECYCGKYKRVRFKGIICERCGVEVTRAKVRRERMGHIELAAPVTHIWYFKGVPSRLGYLLDLAPKDLEKVIYFAAYMITYVDEERRTRDLPSLEAHVSVERQQVENRRDADLEARAKKLETDLAELEAEGAKADVRRKVREGAEREMKQLRDRAQREIDRLDEVWTRFKNLKVQDLEGDELLYRELRDRFGTYFDGSMGAAALQKRLESFDLEEEAEKLREIIRTGKGQKKTRALKRLKVVSAFLQTSNSPKGMVLDCVPVIPPDLRPMVQLDGGRFATSDLNDLYRRVINRNNRLKRLLDLGAPEIIVNNEKRMLQEAVDALFDNGRRGRPVTGPGNRPLKSLSDMLKGKQGRFRQNLLGKRVDYSARSVIVVGPQLKLHQCGLPKAMALELFKPFVMKRLVDLNHAQNIKSAKRMVERGRTVVYDVLEEVIAEHPVLLNRAPTLHRLGIQAFEPQLVEGKAIQIHPLVCTAFNADFDGDQMAVHLPLSAEAQAEARILMLSSNNILKPADGRPVTMPTQDMVLGLFFLTTDGEMRNVKGEDRSFASVAEAIMAFDAGDLSLQSKVDIRFPVGTIPPRGWTPPAQEEGEPEWQQGDTFRLKTTLGRALFNELLPEDYPFVDYEVGKKQLSEIVNDLAERYPKVIVAATLDNLKAAGFFWATRSGVTVAISDVVVPEAKKEIVKGYEAQDEKVQKQYERGLITKDERTQELIAIWTKATNEVAEAMNDNFPKTNPIFMMVNSGARGNMMQMRQIAGMRGLVSNAKNETIPRPIKASFREGLSVLEYFISTHGARKGLADTALRTADSGYLTRRLVDVSQDVIIREEDCGTDRGLRLKIADRGADGVLRKADDVETSVYARCLAEDIVVDGKVLAPAGVDLGDVLIDQLVANGIEEVKTRSILTCESQVGTCAMCYGRSLATGKLVDIGEAVGIIAAQSIGEPGTQLTMRTFHTGGVAGDDITQGLPRVVELFEARTPKGVAPISEASGRIRIEETEKTKKIVVTPDDGSDETAFPISKRARLLVSEGEHVEVGQKLTVGATNPHDVLRILGQRAVQVHLVGEVQKVYNSQGVSIHDKHIEIIIRQMLRRVTIIESGDAELLPGELVERSKFETENRRVVQEGGHPASGRPQLMGITKASLATESWLSAASFQETTRVLTDAAINAKSDSLIGLKENVIIGKLIPAGTGLSRYRNIRVEPTEEAKAAMYSAVGYDDIDYSPFGTGSGQAVPLEDYDYGPYNQ

SEQ ID NO: 94 - protein, 1161 aa, Streptomyces SMCD2215
MAASRNASTANTNNGASTAPLRISFAKIKEPLEVPNLLALQTESFDWLLGNTAWQSRVEEALESGQDVPTKSGLEEIFEEISPIEDFSGSMSLTFRDHRFEPPKNSIDECKERDFTYAAPLFVTAEFTNNETGEIKSQTVFMGDFPLMTNKGTFVINGTERVVVSQLVRSPGVYFDSSIDKTSDKDIFSAKIIPSRGAWLEMEIDKRDMVGVRIDRKRKQSVTVLLKALGWTTEQILEEFGEYESMRATLEKDHTQGQDDALLDIYRKLRPGEPPTREAAQTLLENLYFNPKRYDLAKVGRYKVNKKLGADAPLDAGILTVEDIISTIKYLVKLHAGEIETTADNGQTIVVETDDIDHFGNRRLRSVGELIQNQVRTGLARMERVVRERMTTQDVEAITPQTLINIRPVVASIKEFFGTSQLSQFMDQNNPLSGLTHKRRLSALGPGGLSRERAGFEVRDVHPSHYGRMCPIETPEGPNIGLIGSLASYGRVNAFGFVETPYRKVVDGQVTDEVDYLTADEEDRFVIAQANATLTDDLRFAENRVLVRRRGGEVDYVAGDDVDYMDVSPRQMVSVATAMIPFLEHDDANRALMGANMMRQAVPLIKSEAPLVGTGMEYRSAVDAGDVVKAEKAGVVQEVSADYITTANDDGTYITYRLAKFARSNQGTSVNQKVIVSEGDRLVEGQVLADGPATQEGEMALGKNLLVAFMPWEGHNYEDAIILSQRLVQDDVLSSIHIEEHEVDARDTKLGPEEITRDIPNVSEEVLADLDERGIIRIGAEVIAGDILVGKVTPKGETELTPEERLLRAIFGEKAREVRDTSLKVPHGETGKVIGVRVFDREEGDELPPGVNQLVRVYVAQKRKITDGDKLAGRHGNKGVISKILPIEDMPFLEDGTPVDIILNPLGVPSRMNPGQVLEIHLGWLASRGWDVSGLSEEWAQRLQAIGADQVDPGTNVATPVFDGAREDELAGLLQHTIPNRDGERMVLPSGKARLFDGRSGEPFPEPISVGYMYILKLHHLVDDKLHARSTGPYSMITQQPLGGKAQFGGQRFGEMEVWALEAYGAAYALQELLTIKSDDVTGRVKVYEAIVKGENIPEPGIPESFKVLIKEMQSLCLNVEVLSSDGMSIEMRDTDEDVFRAAEELGIDLSRREPSSVEEV

SEQ ID NO: 95 - protein, 176 aa, Streptomyces SMCD2215
MARPDKAAAVAELTEQFRSSNAAVLTEYRGLTVAQLKTLRRSLGENAQYAVVKNTLTKIAANEAGISTLDDLFNGPTAVAFVTGDPVESAKGLRDFAKDNPNLVIKGGVLDGKAMSADEIKKLADLESREVLLAKLAGAMKGKQTQAAQVFQALPSKLVRTVDALRAKQDEQGGAE

SEQ ID NO: 96 - protein, 144 aa, Streptomyces SMCD2215
MPPKKKKVTGLIKLQIQAGAANPAPPVGPALGQHGVNIMEFCKAYNAATESQRGWVIPVEITVYEDRSFTFITKTPPAAKMILKAAGVEKGSGEPHKTKVAKITQAQVREIATTKMADLNANDLDAAAKIIAGTARSMGVTVEG

SEQ ID NO: 97 - protein, 411 aa, Streptomyces SMCD2215
MGPMSAATPPTERRVSARVGAISESATLAVDAKAKALKAAGRPVIGFGAGEPDFPTPDYIVQAAIEACSNPKYHRYTPAGGLPELKAAIAAKTLRDSGYEPDVSQILVTNGGKQAIYEAFAAILDPGDEVIVPAPYWTTYPESIRLAGGVPVEVVADETTGYRVSVEQLEAARTEKTKVVLFVSPSNPTGAVYTEAETEAIGRWAVEHGLWVLTDEIYEHLVYGDAVSVSLPALLPELRDKCIVVNGVAKTYAMTGWRVGWVIGPKDVVKAATNLQSHATSNVSNVAQVAAQAAVSGDLEAVAKMREAFDRRRKTIVRMLNEIDGVLCPEPEGAFYAYPSVKALLGKEIRGKRPQDTVELAALILEEAEVAVVPGEAFGTPGYLRLSYALGDEDLVEGVSRIQKLLAEARD

SEQ ID NO: 98 - protein, 218 aa, Streptomyces SMCD2215
MRIVIAGGHGQIALRLERLLAARGDEVAGIIRHAEQGDDLREAGAEPVLLDLESSSVEEVAAHLAGADAAVFAAGAGPGSTVARKDTVDKGAAILFADAAIRAGVRRHVVVSSMGADPAHQGDEIFDAYLRAKGEADAYVRSQDALDATILRPGMLTNDAGTGLVRLEAHTGRGPVPRDDVAAVLAELVESPATAGLTLELVSGSAPVSVAVKSVAGN

SEQ ID NO: 99 - protein, 130 aa, Streptomyces SMCD2215
MKTILNVIWLVLSGFWLFLGYMAAGLLLCITIIGIPFGVAAFRIGVYALWPFGYTTVERRDAGAPSCIGNVLWLILAGWWLAIAHIVTGIALCITIIGIPFGIANFKLIPVSLLPLGREIVRTDEPFATR

SEQ ID NO: 100 - protein, 322 aa, Streptomyces SMCD2215
MTDALDVTLRLLIVFVVFLTFPLIVGQTEHKVMAHMQGRLGPMYAGGFHGWAQLVADGVKFAQKEDVVPAGADRRVFQLAPAVALLPYLVVLLAIPIGPGEGAVGQVLDAGVFFVLAVMGVGVLGSLMAGWASANKFSLLGGLRTAAQLLAYELPMLLTAASVAMAAGTVSLPGILDAFQWWWLPWQIVGAIVFFVAGLAELQRPPFDMPVADSEIIFGAYTEYTGLRFALFLLAEYAGIIVLCGLTTVLFLGGWHGPWGSDGLGWVWTLLKTAVLAFLVIWLRVTYPRLREDQLQKLSWTLLVPLSLAQIALTGIVKVVIS

SEQ ID NO: 101 - protein, 318 aa, Streptomyces SMCD2215
MKFSVSGRTAATGLVAAAVSTVMLLTGGSLAGAAPAPAQAAAPDIPVANVKAHLAQLQSIATANGGNRAHGKAGYKASLDYVKGKLDAAGFTTTVQTFTSSGATGYNLIADWPGGDTDHVVMSGSHLDSVSAGPGINDNGSGSAAVLETALAVSRAGYQPAKHLRFAWWGAEELGMVGSRNYVNGLSTANRSKISDYLNFDMIASPNPGYFVYDDDPTIEKTFKDYFTGLNITTEPETEGDGRSDHAPFKSAGIPVGGLFSGADYIKTAAQKAAWGGTSGKAFDPCYHRSCDTSTNIDDTALDRNSDAIAHAVWELSS

SEQ ID NO: 102 - protein, 406 aa, Streptomyces SMCD2215
MPPFDVPEGDPFGPHNLPYGVFSLAGSTRPAERRVGVRLGDHVLDAGGAAMALGSPYASLLAHPSLNPLLAAGRTAWSDVRRALTGWVTVPAHQEAIAPFLHPLSSVTLHLPFEVADYVDFYASEHHARNVGQIFRPDAADSLTPNWKHLPIGYHGRAGTVVVSDTDVVRPSGQRKAPADAAPVFGPSVRLDIEAEVGFVVGVPSRQGTPVPLGDFRDHVFGLCLLNDWSARDIQAWEYVPLGPFLGKSFATSVSAWITPLDALEEARVAPPERTHELLPYLDDSQDEPGGYDLRITVALNGHVISEPPFSGMYWTAAQQLAHMTVNGASLRTGDLYASGTVSGPELSQRGSLLELTWNGRDPLELPDGKRAFLEDGDVVTLSAWAPGPGGVRVGLGEVRGRIVGR

SEQ ID NO: 103 - protein, 834 aa, Streptomyces SMCD2215
MTVTTNAPSGGGEAAVPPEDLVSLTIDGAEISVPKGTLVIRAAEQLGIEIPRFCDHPLLDPVGACRQCIVEVEGQRKPMASCTITCTDGMVVKTHLTSPVAEKAQHGVMELLLINHPLDCPVCDKGGECPLQNQAMSHGQAESRFEGKKRTYEKPVPISTQVLLDRERCVLCARCTRFSNQVAGDPMIELVERGALQQVGTGEGDPFESYFSGNTIQICPVGALTSAAYRFRSRPFDLVSSPSVCEHCSGGCATRTDHRRGKVMRRLAANDPEVNEEWICDKGRFAFRYAQQRDRLEQPLVRNAEGELEPASWPEALQIAAQGLLASRGRTGVLTGGRLTVEDAYAYSKFARVALDTNDIDFRARVHTSEEADFLAARVAGRGRDLDGTGVTYTLLEKAPAVLLVGIEAEEEAPGVFLRLRKAWRKRGQKVFSLATHSTRGLEKAGGTLLPAAPGTETEWLDALAGGVGLDGDGSKAAEGLRTEGAVIVVGERLAAVAGGLTAAVRAATATGARLAWIPRRAGERGALEVGALPSLLPGGRPATDPRAREEVAAVWGLAELPHRYGRDTGQILEAAVSGELQALLVAGVEVADLPDPARAREALHEAGFVVSLELRPGEVSELADVVLPVAAVAEKAGTFLNWEGRVRFFEAALKPDQMVHPLAPTDARVLQMLADAMDVHLGLPDLRTVRAEIDRLGPWDGPRATEPLESAGVLPRPAAGEAVLSGHRLLLDQGVLQEGDEALAGTRHAAHARVSAATAAEAGVKDGDLLAVTGPAGTVELPLRITEMPDRVVWLPLNSAGRGVASDTGALPGALVRIGPATLVGEAPKEVEA

SEQ ID NO: 104 - protein, 282 aa, Streptomyces SMCD2215
MDNSRTRPRVGHIQFLNCLPLYWGLARTGTLLDFELTKDTPDKLNEKLVQGDLDIGPITLVEFLKHADDLVAFPDIAVGCDGPVMSCVIVSQVPLDQLDGARVALGSTSRTSVRLAQLLLAERYGVQPDYYTCPPDLSLMMQEADAGVLIGDAALRANLLDGPRYGLQVHDLGAMWKEWTGLPFVFAVWAARRDYLEREPEITRKVHEAFLASRNLSLEEVGKVAEQAARWEAFDEKVLEQYFTTLDFRFGAPQLNAVAEFARRVGPTTGFPANVKVDLLQP

SEQ ID NO: 105 - protein, 387 aa, Streptomyces SMCD2215
MDVGLKRELEEKVRAGVRLTREDGIALYESDDLAWLGGLAHEVRTRKNGDVVHFNVNRHLNMTNVCTASCAYCSFQRKPGEKDAYTMRIEEAVKLAKAMEGENLTELHIVNGLHPNLPWRYYPRSLRELKAALPDVSLKAFTATEIHHFETISGLSASEILDELIDAGLESLTGGGAEIFDWEVRQHIVDHRTHWEDWSRIHRLAHEKGLKTPCTMLYGHIEEPRHRVDHVLRLRELQDETGGFQVFIPLRYQHDFVDMKDGKVRNRLQARTQMATGAEALKTFAVSRLLFDNVPHVKVFWVMHGVQTAQLALQHGADDMDGSVVEYKITHDADNYGTPNKLTREDLLDLIRDAGFRPVERNTRYEILREYDGPDPARRESPQPMRV

SEQ ID NO: 106 - protein, 151 aa, Streptomyces SMCD2215
MDAVDRQLIQALRENGRASYAELGRLVGLSGPSVTDRINRLEAAGVITGYRATVDAASLGLGVTALVGISLSDATDHEDVAQRLKDLSEIEDCWFIAGDDSYMLKVRAANVDGLEKIIRRLSGTKGVSRTRTTIILSTKWENRVGELPEEV

SEQ ID NO: 107 - protein, 593 aa, Streptomyces SMCD2215
MRPYRLPQARKKDVPIVAQSTETTDWVSRFADEVIEESERRAPGKPVVVASGLSPSGPIHLGNLREVMTPHLVADEIRRRGHQVRHLISWDDYDRYRKVPAGVAGVDETWAEHIGKPLTSVPAPKGSAHPNWAEHFKAAMTESLAALGVEFDGISQTAQYTTGVYREQILHAIAHRAEIDAILDQYRTKKAPAKKQQQKPLDEAELEAAEGSGAASEDDGSSGSAGYFPYKPYCGNCEKDLTTVTAYDDDTTELTYACTACGFAETVRLSEFNRGKLVWKVDWPMRWAYEGVVFEPSGVDHSSPGSSFQVGGQIVGIFGGKQPIGPMYAFVGISGMAKMSSSRGGVPTPADALKIMEPQLLRWLYARRRPNQSFKIAFDQEIQRLYDEWDKLDAKVADGSALPGDVAAHTRAVGTAAGELPKTPRPLPYRTLASVADITAGHEDQALRILSELDPANPLGSLDEARPRYDKAEAWINTQVPADQRTIVRDEPDAELLKSLDEDGRQSLRLLLDGLADNWSLDGLTHLVYGVPKVQAGFPADATPKELPPEIKTAQRSFFALLYHLLVGRDTGPRLPTLLLAVGQERVRALLGE

SEQ ID NO: 108 - protein, 588 aa, Streptomyces SMCD2215
MASVTSLSDSVQQQLASALSATLPEAAGADPLLRRSDRADFQANGILALAKKAKANPRELAAQVVGNIATGDVIKDIEVSGPGFLNVTLADRAIIDNLAARYADGERLGVPLKQNAGITVVDYAQPNVAKEMHVGHLRSAVIGDALRGMLDFTGEKTIGRHHIGDWGTQFGMLIQYLFENPGELAPAADVDGEQAMSNLNRVYKASRAVFDADEEFKERARKRVVALQSGDKETLELWQQFVDESKVYFNSVFEKLDMRIRDEEIVGESAYNDMMAETARLLEESGVAVRSEGALVVFFDEIRGKDDQPVPLIVQKADGGFGYAASDLSAIRNRVFELHATTLLYVVDVRQSLHFKMVFETARRAGWLGDDVTAHNMGYGTVLGADGKPFKTREGETVRLEDLLDEAVERATAVVREKAEKVGLSEAEIVENGRYVGIGAVKYADLSTSPNRDYKFDLDQMVSLNGDTSVYLQYAYARIRSIFGKAGDRAPLAHPELELAPAERALALHLDAFGETVFEASAEYAPHKVAAYLYQLASLYTTFYDQCPVVKPAPAQEVAENRLFLCDVTARTLHKGMALLGIRTPERL

SEQ ID NO: 109 - protein, 568 aa, Streptomyces SMCD2215
MSPTTLPTGLEHGHVTFLGAGPGDPGLLTLRAVEALANADVLVAEHDVLDVVRKHARQGVAEVHTDGGPSADSHPGTGTPQLAVVDGSSTTAGVPAVRDAAHLVMEAARGGRRVVRAVAGDPGLDTYAAEEMLACAGAGVPFEVVPGVAAAVGVPAYAGVPLRDAEGADVRFVDARTASDRCWTEVGASDGTVVVSTTLDSVGAAAGELVSAGRKPDTPMTVTIAGTTTRQRTWTATLGTIAQTLKQAKVLPSPEGGRPVIAVVGDRSAPAQRDQLSWFESKPLFGWKVLVPRTKEQAASLSDQLRSYGAVPHEVPTIAVEPPRTPQQMERAVKGLVTGRYEWIAFTSVNAVKAVREKFEEYGLDARAFAGIKVAAVGEQTANALIAFGVKPDLVPSGEQSAAGLLEDWPPYDPVFDPIDRVFLPRADIATETLVAGLIELGWEVDDVTAYRTVRASPPPAETREAIKGGGFDAVLFTSSSTVRNLVGIAGKPHNVTVIACIGPATAKTAEEHGLRVDVMAPEPSVHKLAEALADFGLRRRAAALEAGDAVTRPSERRPGARRRRTTT

SEQ ID NO: 110 - protein, 214 aa, Streptomyces SMCD2215
MRYDLVIFDNDGVLVDSEPISNRLLAGYLTELGHPTSYEESLQDYMGAAMHRVHDLIEERTGERLPADFDDVFHARVFAAFERELEPVAGAVGLLEKLAADGVPYCVASSGSHERIRVGHRKTGLDRLFDDGRIFSSQDVGRGKPAPDLFLYAAERMGAVPERCVVVEDSPLGVQAAVAAGMDVYGFTAMTPAERLVGATRLFSDLGELADLLV

SEQ ID NO: 111 - protein, 157 aa, Streptomyces SMCD2215
MEARMSLFENPIAGKLFKHINTAGKVVSDSTLPAATAELVKLRASQINGCGFCTDMHTKDALAAGEDPQRLLMVAAWREAKVFTEAERAALELAEQGTRIADAAGGVTDEAWANAAKHFDEEQLAALVAVIALINMYNRFNVITQQPAGDYQPGMFG

SEQ ID NO: 112 - protein, 330 aa, Streptomyces SMCD2215
MREFAYQKAGDVSGAVALLDADPEARFLAGGTNLVDLMKSGVERPTRLVDVRELPLDRVESTPDGGLRIGATVTNSDLAVHPEVRRRYPMLAQALLAGASGQLRNMATVGGNLLQRTRCGYFTDLSKPCNKRTPGSGCPAIRGEHHNHAVLGASAYCVAVHPSDMAVALAALDAVVHFETVDGPDALPIGWFFLPVDETPHRETALPPGALITHVSLPPAPVAARSRYRKVRERASYAFAIGSIAAALDVRDGLVHDVRLAYGAVASRPWRARAAERVLAGASADAETFAAAADAELAAARPLAHNEYKVTLMRNLTVAVLSELAEEAGR

SEQ ID NO: 113 - protein, 708 aa, Streptomyces SMCD2215
MTTTTVTAAPVRAVGRDHVRVEGRDKVTGAARYAGEVPFAGLAHGWLVLSTVARGRIEDVVTGPVLEMPGVLAVLHHGNAPHVETDFIGMLGTKPDPTCAVFQNDQVPHLGWPVALVVAETSEQAREAAESLVVHYDEQPHEVEFSSEDPDACHVDGRVPAVTDKGDLEAELAASAVVLDAEYTTPEEHHNPMEPHAAMARWDDGRLELVDSNQSTTMVVGELAKLFSLDPASIRVRSEHVGGGFGSKGVRAHQVAAVMAASVLQRPVRVVLTRRQMFTLAGHRSPTIQRVRLGADADGRLRALDHRSLSRTSTVYDFVEPSATVARAMYDADAHHTENRVVRRDVPSPTWMRAPGEAPGSFALEAALDELAEKCGVDPIELRLRNEPDKGPVSGLPFAARNLRACFEEGARRFGWDRRDPRPGVRRDGRWLLGSGTAGASFQAAALPSTATIAAEADDTFTVRIAAADIGTGARTALTLVAADALDTPPERIRVRIGDSAFGPASIAGGSSGTRSWSWAVTAAASELRERLVPGMEIPAQGITVRSDTTAAITALAQKERHSYGAQFAEVAVDPATGEVRVRRMLGIFAAGRIVNPLTAKGQFTGGMIWGLSMALHEEAARDAYFGGQVGADLAGYHVATHADVPHIEADWVDDHDPEDPVGIKGIGEVGIVGAAAAVANAVWHATGVRHRSLPIRPDRILTAGNGA

SEQ ID NO: 114 - protein, 505 aa, Streptomyces SMCD2215
MTEISPATTTDSGAPVESDEHSLTVGPGGPILLQDAYLIEQMAQFNRERIPERQPHAKGSGAFGHFEVTHDVSAYTKAAVFQPGTRTDLVARFSTVAGERGSPDTWRDPRGFAVKFYTSEGNYDMVGNNTPVFFVKDPMKFQHFIRSQKRRADNNLRDHDMQWDFWTLSPESAHQVTWLMGDRGIPRTWRHMNGYTSHTYMWINAAGERFWVKYHFKTDQGIECFTQHEADQMAAADTDYHTRDLFEHIRDGDFPSWTLKVQVMPYEDAAHYRFNPFDLTKVWPHGDYPLIPVGRMTLDRNPTDNHAQIEQAAFQPNNLVPGIGPSPDRMLLARLFSYADAHRHRIGGNYQQLPVNAPVVDVHTYSKDGAMAYRNTTDPVYAPNSKGGPAADSARYTPPSWEADGAITRAAYVSHPEDDDWGQPGTLVREIMDDAARDRLVDNVVGHLLNGVTEPVLKRAFEYWSNIDKTIGDRIAQGVRAKAGEKDPKAAEQANPARSSMQDKA

SEQ ID NO: 115 - protein, 305 aa, Streptomyces SMCD2215
MFSLVRSRARTAALALSAVAALITGATATTGAAAATAPAKQGPTSVAYVEVNNNSMLNVGKYTLASDGDNVFDVAVIFAANINYDTATKSAYLYFNDNVQRVLDNAATQIRPLQQKGIKVVLSVLGNHQGAGFANFPSQQAASAFAGQLSDAVAKYGLDGIDFDDEYAEYGNNGTGQPNDSSFVQLVTALRANMPDKIISLYNIGPSASRLSYGGVDISSKFDYAWNPYYGTWQVPGIALPKSKLSPAAVEIGGTSQSTVADLARRTVSEGYGVYLTYNLDGADRSADVSAFTKELYGSAAVYTP

SEQ ID NO: 116 - protein, 617 aa, Streptomyces SMCD2215
MPELRSRTVTHGRNMAGARALMRASGVPGADIGRKPVIAVANSFTEFVPGHTHLQPVGRIVSEAIIAAGGIPREFNTIAVDDGIAMGHGGMLYSLPSRDLIADSVEYMVEAHCADALVCISNCDKITPGMLNAALRLNIPTVFVSGGPMESGRATLVDGTVRTLDLVDAMSDAVNDKISDADMLRIEENACPTCGSCSGMFTANSMNCLTEAIGLSLPGNGSVLATHTARKQLYVDAARTVMDITKRYYEQDDETVLPRSIASISAFENAMALDIAMGGSTNTILHLLAAAQEADVPFGLEEIDAVSRRVPCLAKVAPNVAKNRTYYMEDVHRAGGIPALLGELHRAGLLNEDVHAVHSPSLADWLKTWDVRGGSPSQEAVELWHAAPGCVRSAEAFSQSERWEALDEDTAEGCIRSVEHAYSKDGGLAVLKGNLAVDGCVVKTAGVDESIWTFEGPAVVCESQEEAVQKILTQQVKEGDVVVIRYEGPKGGPGMQEMLYPTSYLKGRGLGKACALVTDGRFSGGTSGLSIGHASPEAASGGTIALVEDGDRIRIDIPNRQIELLVDDAELSRREAALGGVHAPKNRERKVSAALRAYAAMATSADKGAVRDVSKLG

SEQ ID NO: 117 - protein, 841 aa, Streptomyces SMCD2215
MFERFTDRARRVVVLAQEEARMLNHNYIGTEHILLGLIHEGEGVAAKALESLGISLEAVRQQVEEIIGQGQQAPSGHIPFTPRAKKVLELSLREALQLGHNYIGTEHILLGLIREGEGVAAQVLVKLGADLNRVRQQVIQLLSGYQGKETAAAGGPAEGTPSTSLVLDQFGRNLTQAARESKLDPVIGREKEIERVMQVLSRRTKNNPVLIGEPGVGKTAVVEGLAQAIVKGEVPETLKDKHLYTLDLGALVAGSRYRGDFEERLKKVLKEIRTRGDIILFIDELHTLVGAGAAEGAIDAASILKPMLARGELQTIGATTLDEYRKHLEKDAALERRFQPIQVAEPSLPHTIEILKGLRDRYEAHHRVSITDEALVQAATLADRYISDRFLPDKAIDLIDEAGSRMRIRRMTAPPDLREFDEKIAGVRRDKESAIDSQDFEKAASLRDKEKQLLAAKAKREKEWKAGDMDVVAEVDGELIAEVLATATGIPVFKLTEEESSRLLRMEDELHKRVIGQVDAVKALSKAIRRTRAGLKDPKRPGGSFIFAGPSGVGKTELSKALAEFLFGDEDALISLDMSEFSEKHTVSRLFGSPPGYVGYEEGGQLTEKVRRKPFSVVLFDEVEKAHPDIFNSLLQILEDGRLTDSQGRVVDFKNTVIIMTTNLGTRDISKGFNLGFAASGDKKSNYERMKNKVSDELKQHFRPEFLNRVDDVVVFPQLTQEDILKIVDLMIGKVDERLKDRDMGIELSQSAKELLSKKGYDPVLGARPLRRTIQREVEDSLSEKILFGELRPGHIVVVDTEGEGEAQTFTFRGEEKSALPDVPPIEQAAGGAGPNLSKEA

SEQ ID NO: 118 - protein, 191 aa, Streptomyces SMCD2215
MGVTLAKGGNVSLSKAAPNLTQVMVGLGWDARSTTGAPFDLDASALLCTGGRVMGDEWFVFYNQLKSPDGSVEHTGDNLTGEGEGDDESILVDLVKVPAQCDKIVFPVSIHMADERGQTFGQVSNAFIRVVNQADGQELARYDLSEDASTETAMIFGELYRYQGEWKFRAVGQGYASGLRGIALDFGVNVS

SEQ ID NO: 119 - protein, 191 aa, Streptomyces SMCD2215
MGVSLSKGGNVSLTKEAPGLTAVIVGLGWDVRTTTGTDFDLDASALLLNSSGKVASDANFVFFNNLKSPDGSVEHTGDNITGEGEGDDEQIKINLAAVPADVEKIVFPVSIYDAENRQQSFGQVRNAFIRVVNQAGEAEIARYDLSEDASTETAMVFGELYRNGAEWKFRAIGQGYASGLRGIAQDFGVNV

SEQ ID NO: 120 - protein, 119 aa, Streptomyces SMCD2215
MDRVALRGLKARGHHGVFPKEREEGQTFIVDLVLGLDTRPAAADDDLAKTVHYGIVAEEVVAVVKGEPVNLVETLAERIAQVCLKHEGVEEVEVCVHKPDAPITVPFDDVTVTIIRSRV

SEQ ID NO: 121 - protein, 679 aa, Streptomyces SMCD2215
MDVKRYFRGPVMWIVLAVLAVVVLMQVVGSSGGYKTVDTGQVVAAINDNKVEQAKLTTGDEQTVKVQLKDGVKVEGSSKIQASYIGDQGVTIANTLQTKYQDKQIPDGYTVSPSKQNPFLGILLSLLPFVLIVVVFLFLMNQMQGGGSRVMNFGKSKAKLITKDTPKTTFSDVAGCDEAVEELHEIKEFLQEPAKFQAVGAKIPKGVLLYGRPGTGKTLLARAVAGEAGVPFYSISGSDFVEMFVGVGASRVRDLFEQAKANAPAIVFVDEIDAVGRHRGAGLGGGHDEREQTLNQLLVEMDGFDVKGGVILIAATNRPDILDPALLRPGRFDRQIAVDPPDLQGRLEILKVHQKGKPVAPDVDLSAVARRTPGFTGADLSNVLNEAALLTARSDKKLIDNSMLDEAIDRVVAGPQKRTRIMSDKEKKITAYHEGGHALVAAASPNSDPVHKITILSRGRALGYTMVLPDEDKYSTTRNEMLDQLAYMLGGRAAEELVFHDPTTGAANDIEKATTTARAMVTQYGMTERLGAIKFGGDNTEPFLGREMAHQRDYSEEVAALVDEEVKKLIENAHNEAWEILVENRDVLDNLVLQLLERETLGKEEIAEIFAPIVKRPPRPAWTGSSRRTPSTRPPVLSPKELALTNGANGAAPAITTAKATASESAPVTEPAPEERPEN

SEQ ID NO: 122 - protein, 186 aa, Streptomyces SMCD2215
MRVDAKDMGTDLKEVLITKEEIDAKLLDLAAKIDAEYAGKDLLIVGVLKGAVMVMADLARALSTPVTMDWMAVSSYGAGTQSSGVVRILKDLDTDIKGKHVLIVEDIIDSGLTLSWLLSNLGSREPESLKVCTLLRKPDAAKVAIDVEWVGFDIANEFVVGYGLDYAEKYRNLPFVGTLAPHVYGG

SEQ ID NO: 123 - protein, 347 aa, Streptomyces SMCD2215
MGPHPAVAAIRLAVRHVLHDILNEHQTASKAYGRFEQVSHERRSSPLVLVACSGGADSMALASALAFEAPKLGIRAGGITVDHGLQQGSDLRAEEVAQRLRELGLDPVDSVAVTVGRDGGPEAAARDARYAALDAAAVRHGATAVLLGHTRDDQAETVLLGLARGSGIRSLSGMAAVSGADGRYRRPFLRLDRQTARKACMVQSLPVWDDPHNADPAYTRSRLRHEGLPALEKALGKGVVEALARTAQLSRDDADALDSWASQAETSVRDAAGRLECAKLYALPPAVRRRILRRAAIEAGAPAGSLFARHIEEVDRLITGWRGQGVINLPGKVVAQRQGGRLVIRQG

SEQ ID NO: 124 - protein, 486 aa, Streptomyces SMCD2215
MSSYFSDLAQQYIDGEWRPGTGSWDIIDFNPYDGEKLASITIATVDEVDEAYQAAARAQKQWADTNPYARRAVFEKALRLIEEREQEITEVIIAELGGTRLKAAFELHLAKEFLRESIQWALRPEGKILPSPVDGKENRLYRVPVGVVGVISPFNFPFLLSVKSVAPALALGNAVVLKPHQNTPVTGGTLVAKIFEDAGLPGGLLNVVVTDIAEIGDAFIEHPIPKVISFTGSDKVGRHVATVCASHFKRSVLELGGNSAIVVLDDADIDYAVDAAVFSRYVHQGQVCMAANRVLVDRSIADEFTEKFVAKVRTLKAGDPRDPQTVIGPVINSQQADALSATVEQAIAEGATALVHGTTTDNLVEPSVLTGVPADSALLRQEVFGPVAFLIPFDGEEEAVRLVNETPYGLSGAVHTGDIERGVSFAKRIDTGMFHVNDGTVHDEPLVPFGGEKSSGVGRLNGESTVECFTTLKWISVQHGRSGFPF

SEQ ID NO: 125 - protein, 915 aa, Streptomyces SMCD2215
MASGSDRNPIIIGGLPSQVPDFDPEETQEWLDSLDAAVDQRGRERARYLMLRLIERAREKRVAVPEMRSTDYVNTIATKDEPFFPGNEEIERKVLNATRWNAAVMVSRAQRPGIGVGGHIATFASSASLYDVGFNHFFRGKDEGDGGDQVFFQGHASPGIYARAYLLDRLSAEQLDGFRQEKSKSPNGLSSYPHPRSMPDFWEFPTVSMGLGPIGAIYQARMNRYMHARGIADTSKSHVWAFLGDGEMDEPESLGQLSIAAREGLDNLTFVVNCNLQRLDGPVRGNGKIIQELESVFRGAGWNVIKLIWDRSWDPLLAQDRDGLLVNRMNTTPDGQFQTYATESGAYIREHFFGDDQRLRAMVEGMTDHQILMLGRGGHDHRKIYAAYKAALEHKGQPTVILAKTIKGWTLGPNFEGRNATHQMKKLTVDDLKGFRDRLHLPITDKELEDGAPPYYHPGRDSEEIQYMHDRRKGCGGYVPTRVVRSKPLDLPDDKAYATVKKGSGQQSIATTMAFVRLLKDLMRDKEFGKRFVLIAPDEYRTFGMDSFFPSAKIYNPLGQQYESVDRELLLAYKESPTGQMLHDGISEAGCTASLIAAGSAYATHGEPLIPVYVFYSMFGFQRTGDQFWQMADQLARGFVLGATAGRTTLTGEGLQHADGQSQLLASTNPACVAYDPAYSYEIAYIVQDGLRRMYGASEEHPHGEDVFFYLTVYNEPIQHPAEPANVDVEGIVRGLHRIGEGTSGTIPAQVIASGVAVPWAVEAQKILAEDWNVKADVWSATSWNELRREAVEVERHNLLHPEEEQRVPYVTRKLSGAEGPVVAVSDWMRSVPDQIARWVPGTYQSLGADGFGFADTRGAARRFFHIDAQSIVVAVLTELAREGKVDRSVLKQAIDRYQLLDVSAADPGAAGGDA

SEQ ID NO: 126 - protein, 941 aa, Streptomyces SMCD2215
MSPTSETAHGGRRLVIVESPAKAKTIKGYLGPGYIVEASVGHIRDLPNGAAEVPEKYTGEVRRLGVDVEHDFQPIYVVNADKRAQVKKLKDLLRDSDELFLATDEDREGEAIAWHLLEVLKPKVPVKRMVFHEITKDAIREAVANPRDLNKRMVDAQETRRILDRLYGYEVSPVLWKKVMPRLSAGRVQSVATRLVVERERERIAFRSAEYWDLTGTFATGRAGDSSDPSSLIARLQTVDGRRVAQGRDFDSVGQLKGANTLHLDEANARALVAALENTRFAVRSVESKPYRRSPYAPFRTTTLQQEASRKLGFGAKATMQVAQKLYENGYITYMRTDSTTLSDTAVSAARAQVTQLYGADYLPDRPRTYAGKVKNAQEAHEAIRPSGDRFRTPAETGLTGDQFKLYELIWKRTVASQMKDATGNSVTVKIGGTAADGRDVEFSASGKTITFHGFLKAYVEGADDPNAELDDRERRLPQVAEGDALTAEEITADGHSTKPPARYTEASLVKELEEREIGRPSTYASIIGTILDRGYVFKKGTALVPSFLSFAVVNLLEKHFGRLVDYDFTAKMEDDLDRIARGEAQSVPWLKRFYFGEGTDNGNAAEAGNGDGDHLGGLKELVTDLGAIDAREVSSFPVGSGIVLRVGRYGPYIERGEKDSENHQRADVPEDLAPDELSVELAEELLAKPSGDFELGADPETGRQIIARDGRYGPYVTEVLPEGTPKTGKNAVKPRTASLFKSMSLDTVTLEDALKLMSLPRVVGVDAEGQEITAQNGRYGPYLKKGTDSRSLQSEEQLFTITLEEALEIYSQPKQRGRAAAKPPLKELGTDPVSEKPVVVKDGRFGPYVTDGETNATLRSGDSVEEITPERGFELLAEKRAKGPAKKTAKRATAKKAPAKKTAAKKTAAKKTTTAKKTTAKKTAATAAKKATAAKSASDD

SEQ ID NO: 127 - protein, 113 aa, Streptomyces SMCD2215
MDLSLSTRTVGDRTVVEVGGEIDVYTAPKLREQLVELVNDGSFHLVVDMEGVDFLDSTGLGVLVGGLKRVRAHEGSLRLVCNQERILKIFRITGLTKVFPIHTSVEEAVAATD

SEQ ID NO: 128 - protein, 651 aa, Streptomyces SMCD2215
MSNESLANLLKEERRFAPPADLAENANVTAEAYEQAKADRLGFWAEQARRLTWAKEPTETLDWSNPPFARWFKDGELNVAYNCVDRHVEAGHGDRVAIHFEGEPGDSRAITYAELKDEVSKAANALLELGVQKGDRVAVYMPMIPETAIAMLACARIGAAHSVVFGGFSADALATRIEDADAKVVITSDGGYRRGKPSALKPAVDEAVARVDNVSHVLVVRRTGQEVAWNDERDVWWHEIVDRQSAEHTPQAFDAEHPLFILYTSGTTGKPKGILHTSGGYLTQTAYTHHAVFDLKPETDVYWCTADVGWVTGHSYIVYGPLANGATQVMYEGTPDTPHQGRFWEIVQKYGVTILYTAPTAIRTFMKWGDDIPAKFDLSSLRVLGSVGEPINPEAWIWYRKNIGADRTPVVDTWWQTETGAMMISPLPGVTAAKPGSAQTPLPGISATVVDDEANEVPNGGGGYLVLTEPWPSMLRTIWGDDQRFIDTYWSRFEGKYFAGDGAKKDDDGDIWLLGRVDDVMLVSGHNISTTEVESALVSHPSVAEAAVVGATDETTGQAIVAFVILRGTAAETEDLVGELRNHVGTTLGPIAKPKRILPVAELPKTRSGKIMRRLLRDVAENRQLGDVTTLTDSTVMDLIQDKLPSAASED

SEQ ID NO: 129 - protein, 539 aa, Streptomyces SMCD2215
MTSQTAIESTGPGDNAPAAPSSAPPASGLRGHPWFTLITVAVGVMMVALDGTIVAIANPAIQKDLKASFADVQWITNGYFLALAVSLITAGKLGDRFGHRQTFLIGVTGFAAASGAIGLSNSIAVVVTFRVFQGLFGALLMPAALGLLRATFPAEKLNMAIGIWGMVIGASTAGGPILGGVLVEHVNWQSVFFINVPVGVVALVLGLLILRDHRAENAPRSFDLLGIALLSAAMFCLVWALIKAPAWGWGDGKTWAFIGASVVGFALFSFWETKVAEPLIPLGLFRSIPLSAGVVLMVLMAIAFLGGLFFVTFYLQNVHGMSPIDAGLHLLPLTGMMIVASPIAGVMITKLGPRIPLAGGMAATAIAMYGMSTLKVDTSSAVMSVWFALLGLGLAPVMVGATEVIVGNAPMELSGVAGGLQQAAMQIGGSLGTAVLGAVMASKVDGDLAGNWKDAGLPPLTPAQLHQASEAVQVGVAPVAKGTPEPIAAKIAGVAHDTFISGMSLASLVACGVAVVAVFVALLTKRGANAEAGAGAAHI

SEQ ID NO: 130 - protein, 224 aa, Streptomyces SMCD2215
MDDVLRRNPLFAALDDEQAAELRASMSEVTLARGDSLFHEGDPGDRLYVVTEGKVKLHRTSPDGRENMLAVVGPSELIGELSLFDPGPRTATGTALTEVKLLGLGHGDLQPWLSARPEVAGALLRAVARRLRKTNDAMSDLVFSDVPGRVARALLDLSRRFGVQSEEGIHVVHDLTQEELAQLVGASRETVNKALADFAQRGWLRLEARAVILLDVERLAKRSR

SEQ ID NO: 131 - protein, 427 aa, Streptomyces SMCD2215
MPALVLLGAQWGDEGKGKATDLLGGSVDYVVRYQGGNNAGHTVVVGDQKYALHLLPSGILSPGCTPVIGNGVVVDPSVLFSELNGLNERGVDTSKLLISGNAHIITPYNVTVDKVTERFLGKRKIGTTGRGIGPTYADKINRVGIRVQDLYDESILTQKVEAALDVKNQMLTKLYNRRAIAVDQVVEELLGYADRLQPYVADTVLVLNQALEQDKVVLFEGGQGTLLDIDHGTYPFVTSSNPTAGGACTGAGVGPTKISRVIGILKAYTTRVGSGPFPTELFDEDGEALRRIGGERGVTTGRDRRCGWFDAVIARYATRVNGLTDFFLTKLDVLTGWEQIPVCVAYEIDGKRVEELPYSQTDFHHAKPIYETLPGWSEDITKAKSFSDLPKNAQAYVKALEEMSGAPISAIGVGPGRDETIEVNSFL

SEQ ID NO: 132 - protein, 406 aa, Streptomyces SMCD2215
MGAVSDLAFDPWDPAFVADPYPAYAELRAAGRVHYFEPTNQWLVPHHADVSALLRDRRLGRTYLHRFTHEDFGRTAPPPEHEPFHTLNDHGMLDLEPPDHTRIRRLVSKAFTPRTVEQLRPYVTRLAGELVDRLVESGGGDLLTDVAEPLPVAVIAEMLGIPEADRAPLRPWSADICGMYELNPPEETARRAVRASVEFSEYLRELIAERRKQPGEDLISGLIAAYEEGDRLTEQEMISTCVLLLNAGHEATVNATVNGWYALFRNPDQLAALRADHSLIPSAVEELMRYDTPLQLFERWVLDEIEIDGTTVPRGAEIAMLFGAANHDPEVFREPGRLDLTRRDNPHISFSAGIHYCIGAPLARIELAASMTALLEKAPGLRLAAEPKRKPNFVIRGLEGLTVDVR

SEQ ID NO: 133 - protein, 405 aa, Streptomyces SMCD2215
MSDITQPLDITQPLAVRAAKADAADELAGVRAQFVLDDVVYLDGNSLGALPVAVPGRVDDVVRRQWGELRIRSWDESGWWTAPERIGDRIAPLVGAAPGQIVVGDSTSVNVFKAVVGAVRLAGEGRDEIVVDATTFPTDGYIAESAARMTGRTLRPVTPSEVPGVLSARTAAVLLNHVDYRTGRLHDLPALTAAIHAAGAVAVWDLCHSAGALPVGLDEHGVDLAVGCTYKYLNGGPGSPAYLYVRRDLQDRFDSPLPGWNSHAQPFGMRSGYEPAAGALRGRVGTPDILSMLALEAALEVWDGVTVEAVRAKSLALTDFFLECVREYVPEGRVESLTPAAHAQRGSQVALRCQDAGDVMKRLIERGVVGDFRHPDVLRFGFTPLYVGFGDVERAARVLAETLAG

SEQ ID NO: 134 - protein, 340 aa, Streptomyces SMCD2215
MPIATPEVYNEMLDRAKAGKFAYPAINVTSSQTLHAALRGFAEAESDGIVQISTGGAEFLGGQYSKEMVTGAVALAEYAHIVAEKYPVTVALHTDHCPKDKLDGYVRPLLAVSEERVKAGRNPLFQSHMWDGSAETLADNLAIAQELLERTRAARIILEVEITPTGGEEDGVSHEINDSLYTTVDDAIRTAEALGLGEKGRYLLAASFGNVHGVYKPGNVVLRPELLKELNEGVGAKFGKQSPFDFVFHGGSGSTEQEIRTALENGVVKMNIDTDTQYAFTRPVADHMLKNYDGVLKVDGEVGSKKTYDPRTWGKLAEASMAARVTEACGNLRSTGTRIK

SEQ ID NO: 135 - protein, 615 aa, Streptomyces SMCD2215
MARAVGIDLGTTNSVVSVLEGGEPTVITNAEGARTTPSVVAFAKNGEVLVGEVAKRQAVTNVDRTIRSVKRHMGTDWKMELDGKPFNPQQISAFILQKLKRDAEAYLGEKVTDAVITVPAYFNDSERQATKEAGEIAGLNVLRIVNEPTAAALAYGLDKDDQTILVFDLGGGTFDVSLLEIGDGVVEVKATNGDNHLGGDDWDQRVVDYLVQQFKSGHGVDLAKDKMALQRLREAAEKAKIELSSSTETSINLPYITASAEGPLHLDEKLTRAQFQQLTADLLERCKTPFHNVIKDAGIQLSEIDHVVLVGGSTRMPAVAELVKELTGGKDANKGVNPDEVVAIGAALQAGVLKGEVKDVLLLDVTPLSLGIETKGGIMTKLIERNTTIPTKRSEIFTTAEDNQPSVQIQVYQGEREIAAYNKKLGMFELTGLPPAPRGVPQIEVAFDIDANGIMHVTAKDLGTGKEQKMTVTGGSSLPKDEVDRMRQEAEKYAEEDHARREAAESRNQGEQLVYQTEKFLKDNEDKVPGDIKTEVEASVEELKAALKGEDTAEIRTATEKVAAVSQKLGQAMYADAQAQQAAAGGESAGAEAPKADDDVVDAEIVDDERKDGAA

SEQ ID NO: 136 - protein, 191 aa, Streptomyces SMCD2215
MLLSDKDIRAEIDAGRVVIDPYDESMVQPSSVDVRLDRYFRVFENHKYPHIDPSVEQVDLTRLVQPEGDEPFILHPGEFVLASTYEVITLPVDLASRLEGKSSLGRLGLVTHSTAGFIDPGFSGHVTLELSNLATLPIKLWPGMKIGQLCLFRLSSPSEFPYGSERYGSRYQGQRGPTASRSYLNFHRTQV

SEQ ID NO: 137 - protein, 423 aa, Streptomyces SMCD2215
MSPTNRTVVVTGIGATTPLGGDAASTWEGLVAGKSGVRPIEHEWAAEQAVRIAAPVAVEPSEVIPRPQARRLDRSAQFALIAAKEAWADAGFTDKAGEDEKIDPDRLGAVIASGIGGVTTLLDQYDVLKEKGVRRVSPHTVPMLMPNGPSANVGLLVGARAGVHTPVSACASGAEAIGYGIEMIRTGRADVVVAGGTEAAIHPLPIAAFGNMMAMSKNNENPEGASRPYDVDRDGFVLGEGAGVIVLESAEHAAARGARVYAEAVGQGISADAHDIVQPEPEGRGISHALQNLMERTDLDPAEIVHVNAHATSTPAGDVAELKALRKVFGDDAGHMAVSATKSMTGHLLGGAGGVESVATILALYHRVAPPTINVENLDPEAEAAADIVRGEARKLPVEGRIAALNDSFGFGGHNVVLAFRTV

SEQ ID NO: 138 - protein, 276 aa, Streptomyces SMCD2215
MGTVTTDDGTTIFYKDWGPRDGRPIVFHHGWPLSADDWDNQMLFFLAHGYRVIAHDRRGHGRSDQSPTGHDMDTYSADVMALTDALDLHDAVHIGHSTGGGEVARYVARAKPGRVAKAVLVGAVPPVMVKSDTNPGGLPIETFDGFREALAANRAQFYIEVPSGPFYGFNRPGAQVSQGLIDNWWRQGMMGAANAHYECIKAFSETDFTEDLQQIDVPVLVAHGTDDQIVPYDDSAPLTAQHLKNGTLKSYEGLPHGMLATHPEILNPDILAFLQS

SEQ ID NO: 139 - protein, 587 aa, Streptomyces SMCD2215
MHRYRSHTCGQLRSSDVGSDVRLSGWLHNRRDLGGILFIDLRDHYGITQLVARPGTAAYEALDKVTKESTVRVDGKVVSRGAENINPELPTGEIEVEVSEVELLGAAAPLPFTINTEDGVNEERRLEYRFLDLRRERMHKNILLRTSVISAIRHKMTALGFNEMATPILSATSPEGARDFVVPSRLNPGKFYALPQAPQQFKQLLMISGFDRYFQIAPCFRDEDARADRSPGEFYQLDIEMSFVEQEDVFQPVERLMTELFEEFGNGRHVTSPFPRIPFREAMLKYGSDKPDLRAQLELVDITDVFEGSEFKAFAGKHVRALPVPAVQDQPRKFFDQLGDYAVSLGAKGLAWVRVAEDGSLTGPIAKFLTEENVAELTKRLSLAAGHAVFFGAGEFDEVSKIMGAVRVEAAKRAGHFEEGVFRFCWIVDFPMYEKDEETGAIDFSHNPFSMPQGGLEALETQDPLDILGWQYDIVCNGVELSSGAIRNHEPDIMLKAFEIAGYDRETVEDKFAGMLRAFRFGAPPHGGIAPGVDRIVMLLADEPNIRETIAFPLNGNAQDLMMGAPTELEEARLRELHLSVRKPQPK

SEQ ID NO: 140 - protein, 447 aa, Streptomyces SMCD2215
MSAPHRFDRGHTDDLMSFLAASPSPYHAVASAAERLEKAGFRQVSETDAWDMEPAADAADAGVAVSAAGSGGRYVLRGGAIVAWYVPEGAAPHTPFRIVGAHTDSPNLRVKPQPDTGAHGWRQVAVEIYGGPLLNSWLDRDLGLSGRLTLRDGSTRLVNVDRPLMRVPQLAIHLDRSVSADGLKLDKQRHILPIWGLGNDVREGDLIAFLEEEAGLGAGQVTGWDLMTHSVEAPAHLGRDKELVAGPRMDNLLSVHAGVAALTAVAGSSDLSCIPVLAAFDHEENGSQSDTGADGPLLGSVLERSVFARGGSFEDRARAFAGTVCLSSDTGHAVHPNYAERHDPTHHPRVNGGPILKVNVNNRYATDGSGRAVFAAACEKANVPFQSFVSNNSMPCGTTIGPITAARHGIKTVDIGVAILSMHSARELCGADDPHLLANALVAFLQG

SEQ ID NO: 141 - protein, 295 aa, Streptomyces SMCD2215
MTGRRLRRAAAVSVTAGAVLATGALAAVPAQAASAPSIVAKGGYVMNNSNAKTLYTKAADTKRSTGSTTKIMTAKVVLAQSHLNLDSKVTIQKAYSDYVVSHNASQAHLIVGDKVTVRQLLYGLMLPSGCDAAYALADKFGSGSTRAKRVSNFIGKMNTAAKSLGLTHTHFDSFDGIGNGSNYSTPRDLTKIASSAMKNSTFRTLVKTKKYTAKTITKTGSTRTMAAWTNTNGLLSSYSGTIGVKTGSGPEAKYCLVFAATRGGKTVIGTVLASSSIAQRESDAKKLMSYGFTKI

SEQ ID NO: 142 - protein, 475 aa, Streptomyces SMCD2215
MTTMTEASVREFKMPDVGEGLTEAEILKWYVQPGDTVTDGQVVCEVETAKAAVELPIPYDGVVRDLHFPEGATVDVGTSIIAVDVSGGAAAPEAPAEPAAPAAAPAAPAEESKPQGSGRQPVLVGYGVAESSTKRRPRKGADTEAAQASTAIQTELNGHGPAPVAEPVATTTGQRPLAKPPVRKLAKDLGVDLATVVPSGPDGIITREDVHAALAPAPAPEAPVAAPAAPVSAPAPVAAYDAARETRIPIKGVRRATAQAMVGSAFTAPHVTEFVTVDVTRTMKLVEELKQDKEFAGLRVNPLLLIAKALLVALKRNPEINASWDEAAQEIVVKHYVNLGIAAATPRGLIVPNIKDAHAKTLPQLAESLGELVSTAREGKTSPGAMQGGTVTITNVGVFGVDTGTPILNPGESAILAVGAIKLQPWVHKGKVKPRQVTTLALSFDHRLVDGELGSKVLADVAAILEQPKRLISWA

SEQ ID NO: 143 - protein, 330 aa, Streptomyces SMCD2215
MAEAVTVRTMALAKAVNESLRRALETDPKVLVMGEDVGKLGGVFRVTDGLQKDFGESRVIDTPLAESGIVGTAIGLALRGYRPVVEIQFDGFVFPAYDQIVTQLAKMHARSLGKVKLPVVVRIPYGGGIGAVEHHSESPEALFAHVAGLKVVSPSNASDAYWMMQQAIQSDDPVIFFEPKRRYWDKAEVNTEAIPGPLHKAQIVRPGTDLTLAAYGPMVKLCREVADAAAEEGKSLEVLDLRSVSPLDFDSIQASVERTGRLVVVHEAPVFFGSGAEIAARITERCFYHLEAPVLRVGGYHAPYPPARLEEEYLPGLDRVLDAVDRALAY

SEQ ID NO: 144 - protein, 179 aa, Streptomyces SMCD2215
MEMPRNDRSPENPQILVVGQDGMAIGGGTDEDSREIPVTEQVEQPAKVMRIGSMIKQLLEEVRVAPLDEASRARLKEIHRSSVKELEDGLAPELVEELERLSLPFTDDGTPSDAELRIAQAQLVGWLEGLFHGIQTTLFAQQMAARAQLEQMRRALPPGVAPDGTEDRQAGGRSGGPYL

SEQ ID NO: 145 - protein, 196 aa, Streptomyces SMCD2215
MTTAKRDTYTPETLLSVAVQVFIERGYDGTSMEHLSRAAGISKSSIYHHVAGKEELLRRAVSRALDGLFGILDEEHARVGRAAERLEYVVRRMVEVLIGELPYVTLLLRVRGNTGTERWALERRRDFDHRVAELLKAAAADGDVRADVEVRLATRLVFGMINSIVEWYRPDGRGMDEREVADAVVRLVFGGLRKEG

SEQ ID NO: 146 - protein, 177 aa, Streptomyces SMCD2215
MAEQLYATLKTNNGDIEVRLLPNHAPKTVRNFVELAQGEREWINPSTGEKSTDKLYDGTVFHRVISGFMIQGGDPLGNGTGGPGYQFEDEFHPDLSFNRPYLLAMANAGPGTNGSQFFITLAPTTWLNRKHTIFGEVTDTASQKVVDAIATTKTNPRTDRPVTDVVIESVVVETREG

SEQ ID NO: 147 - protein, 864 aa, Streptomyces SMCD2215
MADENTPAPSDEGGVIAQRLEPVGLETEMQRSYLDYAMSVIVSRALPDVRDGLKPVHRRVLYAMYDGGYRPERGFYKCARVVGDVMGSYHPHGDSSIYDALVRLAQPWSMRMPLVDSNGNFGSPGNDPAAAMRYTECKMAPLSMEMVRDIDEETVDFMDNYDGRSQEPTVLPARFPNLLINGSAGIAVGMATNIPPHNLREVASGAQWYLENPDASHEELLDALIERIKGPDFPTGALVVGRKGIEEAYRTGRGSITMRAVVEVEEIQNRQCLVVTELPYQTNPDNLAQKIADLVKDGKIGGIADVRDETSSRTGQRLVIVLKRDAVAKVVLNNLYKHTDLQTNFGANMLALVDGVPRTLSLDAFIRHWVAHQIEVIVRRTRFRLRKAEERAHILRGLLKALDAIDEVIALIRRSETVEIARGGLMDLLEIDEIQANAILEMQLRRLAALERQKIVQEHDELQAKITEYNAILSSEARQRGIVSEELAAIVEKYGDDRKTMLVPFDGDMSIEDLIAEEDIVVTVSRGGYVKRTKTDDYRAQKRGGKGVRGTKLKEDDIVDHFFVSTTHHWLLFFTNKGRVYRAKAYELPDAGRDARGQHVANLLAFQPDESIAEILAIRDYEAAPYLVLATKGGLVKKTSLKDYDSPRSGGVIAINLRETADGSDDELIGAELVSADDDLLLISKKAQSIRFTATDESLRPMGRATSGVKGMSFREGDELLSMNVVRPGTFVFTATDGGYAKRTAVDEYRIQGRGGLGIKAAKIVEDRGSLVGALVVEEADEILAITLSGGVIRTRVSEVRETGRDTMGVQLINLGKRDAVVGIARNAEAGREAEEVDGADAVDETAEGAATTGTDEGEAPSAE

SEQ ID NO: 148 - protein, 712 aa, Streptomyces SMCD2215
MPQPLRQPSGGGTPRAWLVLCQKGRFVADSGNPNENIPSTDAGENGAVTSSNGEVTASYDASAITVLEGLDAVRKRPGMYIGSTGERGLHHLVYEVVDNSVDEALAGHADTIDVTILADGGVRVVDNGRGIPVGIVASEGKPALEVVLTVLHAGGKFGGGGYAVSGGLHGVGVSVVNALSAKVAVEVKTDGHRWTQDYKMGVPTAPLAQHEATDVTGTAVTFWADPDIFETTEYSFETLSRRFQEMAFLNKGLTIKLTDERESAKATTGADEAGADEKAEVKAVTYHYEGGIVDFVKYLNSRKGDVVHNTVIDLEAEDKDKSLSLEVAMQWNSGYSEGVYSFANIIHTHEGGTHEEGFRAALTSLINKYARDKKLLREKDDNLTGDDIREGLTAIISVKLSEPQFEGQTKTKLGNTEAKTFVQKAVYEHLNDWLDRNPVEAADIIRKGIQAATARVAARKARDLTRRKGLLETASLPGKLSDCQSNDPTKCEIFIVEGDSAGGSAKSGRNPQYQAILPIRGKILNVEKARIDKILQNQEIQALISAFGTGVHEDFDIEKLRYHKIILMADADVDGQHISTLLLTFLFRFMRPLVEAGHVFLSRPPLYKLKWGRDEVEYAYSDRERDALVELGRQRGKRIKEDTIQRFKGLGEMNAEELRITTMDQEHRVLGQVTLDDAAQADDLFSVLMGEDVEARRQFIQRNAKDVRFLDI

SEQ ID NO: 149 - protein, 291 aa, Streptomyces SMCD2215
MELGLVGLGKMGGNMRERIRRAGHTVIGYDRNPDLADVHSLDELVGKLSGPRVVWVMVPAGAPTQSTIDELADLLEPGDVVVDGGNSRWTDDEKHAEELAAKGIGFVDCGVSGGVWGLENGYALMYGGDAENVARVQPVFDALKPEGTFGAVHAGKAGAGHFAKMVHNGIEYAMMQAYAEGWELLEKVDSVTDVREVFRSWQEGTVIRSWLLDLAVNALDEDEHLDRLKGFAQDSGEGRWTVEAAIDNAVPLPAITASLFARFSSRQEDSPQMKMIAALRNQFGGHAVEKK

SEQ ID NO: 150 - protein, 415 aa, Streptomyces SMCD2215
MPCVRLFPGVLPFTGTGDTETDDGARQGEKRRQQQEAATVKIRVERDVLAEAVAWAARSLPARPPAPVLAGLLLKAEDGALSLSSFDYEVSARVSVETEVEEEGTVLVSGRLLADICRALPNRPVEISTDGVRATVVCGSSRFTLHTLPVEEYPALPQMPNATGTVPGEVFASAASQVAIAAGRDDTLPVLTGVRIEIEGDTVTLASTDRYRFAVREFLWKPENPEASAVALVPAKTLLDTAKALTSGDSVILALSGSGAGEGLIGFEGAGRRTTTRLLEGDLPKYRTLFPTEFNSVAVIETAPFVEAVKRVALVAERNTPVRLSFEQGVLILEAGSSDDAQAVERVDAQLEGDDISIAFNPTFLLDGLSAIDSPVAQLSFTTSTKPALLSGKPALDAEADEAYKYLIMPVRLSG

SEQ ID NO: 151 - protein, 322 aa, Streptomyces SMCD2215
MSDVRNVIIIGSGPAGYTAALYTARASLKPLVFEGAVTAGGALMNTTDVENFPGFRDGIMGPELMDNMRAQAERFGAELVPDDIVSVDLTGEIKTVTDTAGTVHRAKAVIVTTGSQHRKLGLPNEDALSGRGVSWCATCDGFFFKDQDIAVIGGGDTAMEEATFLSRFAKSVTIVHRRDTLRASKAMQDRAFADPKIKFVWDSEVAEIQGDPKLSGLKLRNIKTGELSDLAVTGLFIAIGHDPRTELFKGQLDLDEEGYLKVDAPSTRTNVTGVFAAGDVVDHTYRQAITAAGTGCSSALDAERFLAALADEEQAEPEKTSV

SEQ ID NO: 152 - protein, 360 aa, Streptomyces SMCD2215
MGSVRVAIVGVGNCAASLVQGVEYYKDADPASRVPGLMHVQFGDYHVRDVEFVAAFDVDAKKVGLDLADAIGASENNTIKICDVPNAGVTVQRGHTLDGLGKYYRETIEESAEAPVDVVQVLKDKQVDVLVCYLPVGSENAAKFYAQCAIDAKVAFVNALPVFIAGTKEWADKFTEAGVPIVGDDIKSQVGATITHRVMAKLFEDRGVVLDRTMQLNVGGNMDFKNMLERERLESKKISKTQAVTSQIRDRELGEGNVHIGPSDWVAWLDDRKWAYVRLEGRAFGDVPLNLEYKLEVWDSPNSAGVIIDALRAAKIAKDRGIAGPILSASSYFMKSPPVQYFDDEARENVEKFIRGEVER

SEQ ID NO: 153 - protein, 96 aa, Streptomyces SMCD2215
MRHYEVMVILDPDLEERAVSPLIENFLSVVREGNGKVEKVDTWGRRRLSYEIKKKPEGIYSVIDLQAEPAVVKELDRQMNLNESVLRTKVLRPETH

SEQ ID NO: 154 - protein, 78 aa, Streptomyces SMCD2215
MAKPPVRKPKKKVCAFCKDKVTYVDYKDTNMLRKFISDRGKIRARRVTGNCTQHQRDVATAVKNSREMALLPYTSTAR

SEQ ID NO: 155 - protein, 475 aa, Streptomyces SMCD2215
MTTPQEELLPGTRRALLHRIAVAQAEGRAPSLAATVVRGGRAVWHGARTSVDGHGPDENVQYRIGSITKTFTAVLVLRLRDEGVLDLGDPLEKHLPGTGAGEATIVDLLAHSGGLAAESPAPWWERTPGTLRPELADVLGEQPFLHPVGRRFHYSNPGYTLLGALVEKLRGAPWEDVLRREVLESLGLDRTSAQPRAPHAGGWAVHPWADVLLPEPAEDLGRMAPAGQLWSTTGDLARFAVFLTQGDDRVLSAASVREMREPAAPSEAADVMDGGAYGLGLQIQLRDGRLLVGHSGSLPGFLANLTIDVEEDVAAVVLANCTSGPALSSVGADLVRIVAEAEPRIPDPWRPLPEIDASEMELAGPWYWGTQAFVLRISADDGLSLGPLSGSGRRSRFRANGDGTWTGLEGYYAGELLRPVRRPDGTVSHLDLGSFVFTRQPYEEGAPVPGGVDPDGWRGIAQTPTPGEPPVSRET

SEQ ID NO: 156 - protein, 383 aa, Streptomyces SMCD2215
MSDSAEGRPSVDGDGTRAVRAGLPEAVKNEPTLPGPVFAAHFHLPGEVGGPYKYGRDENPTWTLLERAIGELEAPGQEDVETFVFASGMAAISSVLFSQLRAGDAVVLPSDGYQALPLVRAQLEAYGIEVRTAPTGQDAQLDVLDGARLLWLETPSNPGLDVCDVRRLAEAAHARGALVAVDNTLATPLGQRPLDLGADFAVASGTKQLTGHGDVLLGYVVGRDAEAMAAVRRWRKIVGAIPGPMEAWLAHRSIATLQLRVDRQCATALTLAEALRTRPEVTGLRYPGLPDDPSHKIASQQMRRYGCVVSFTLPTRARADRFLDALRLVDNATSFGGVRSTAERRGRWGGDAVPEGFIRFSVGAEDPEDLVADVLRALEESAR

SEQ ID NO: 157 - protein, 385 aa, Streptomyces SMCD2215
MRITGISTHVVGTPWRNLTYVQVHTDEGITGVGETRMLGHTDALIGYLHEAEANHILGSDPFAVEDLVRRMKYGDFGRAGEIVMSGIAVIETACWDIKGKALGVPVWQLLGGRVTDRVKAYANGWYTTERTPEAYHKAAQGVMERGYKALKIDPFGTGHFELDHEQTLYAVSLIEAVRDAIGPEAELMLEMHGRFSPATAVRLAHELAPFKPAWLEEPVPPENLKALQKVAAKVDMPIATGERIHDRIEFRELFENQAVDIIQPDVGHIGGIWETRKLAATAETHYMLVAPHNVGGSVLTAASLQVGFTSPNFKILEHFNDFADAEIKKVVKGAPQVVDGYFHLSDAPGLGVELDVDAAAEFPQQQARFDLWADGWEQRKPKDTK

SEQ ID NO: 158 - protein, 594 aa, Streptomyces SMCD2215
MTNKDARTPASSQGEQPQEAGKSIGWHKAYVAGSRPDLQVPVRQVHLTNGQSVTLYDTSGPYTDPLTDTDVRRGLAPLRENWIIARGDTEEYAGRPVRPEDDGIKHTSPRGGLRNLDAVFPGRPRQPRRGRAGQAVTQLAYARRGEVTPEMEFVALRENVSPEVVREEIAAGRAVLPANVNHPEIEPMIIGKRFLVKVNANIGNSAVTSSIEEEVEKMTWATRWGADTVMDLSTGRNIHTTREWVLRNSPVPIGTVPLYQALEKVDGRAEELTWEIYKDTVVEQAEQGVDYMTVHAGVRLPFVPLTANRKTGIVSRGGSIMAAWCLAHHKESFLYENFEELCEILAAYDVTYSLGDGLRPGSIADANDEAQFAELRTLGELNRIARRLNVQTMIEGPGHVPMHKIKENIDLQQEICDEAPFYTLGPLTTDVAPAYDHITSGIGAAMIAWWGTAMLCYVTPKEHLGLPNRDDVKTGVITYKIAAHAADLAKGHPGAQEWDDALSDARFEFRWEDQFNLALDPDTAREFHDETLPAEPAKTAHFCSMCGPKFCSMKISQDIRREHGGTRDEIEEGMAQKSKEFAASGNRVYLPLAD

SEQ ID NO: 159 - protein, 358 aa, Streptomyces SMCD2215
MTQGAGQGPETERTATLRDFRVPAYVHETGPYGQSTHPGDVVPPDEAIHPDGYTPTERDLPVINRGDTVQVPVAPEPLAAPHETDGTGALYVVGDVHGYLDELVSALQAQGLVDAAGQWCAGTSRLWFLGDFTDRGPDGIGVIDLVMRLSAEAAAAGGYCKALMGNHELLLLGAKRFGDTPVNSGAGTATFQAAWLLNGGQKTDMDRLQDHHLQWMARLDAVEEVDGYLLVHSDTTAYLDYGDSIEAVNDTVRETLTRNDADECWDLFRKFTKRFSFRDEGGADAVRSLLNTYGGTRIVHGHSPIPYLLGEVGSEEGEDSTGPVVEGPHVYADGLAIAMDGGVTMAGKLLVQQLPLDI

SEQ ID NO: 160 - protein, 359 aa, Streptomyces SMCD2215
MSETSPKLRAELEGIPTYKPGKPAAAGGPAAYKLSSNENPYPPLPGVMETVTAAIASFNRYPDMACTGLMSELSDRFGVPLTHLATGTGSVGVAQQLIQATAGPGDEVIYAWRSFEAYPIITQISGATSVQVPLTPGDVHDLDAMADAITDRTRLIFVCNPNNPTGTTVRRAELERFLDRVPGDVLVVLDEAYREFIRDPEVPDGVELYRERPNVCVLRTFSKAYGLAGLRVGFAIAHEPVAAALRKTAVPFGVSQLAQEAAIASLRAEDELLGRVGSLVCERNRVVDTLRSQGWTVPETQANFVWLRLGERTVPFAQACEQHGVVVRPFAGEGVRVTVGENEANDIFLKVTEAFRKEF

SEQ ID NO: 161 - protein, 301 aa, Streptomyces SMCD2215
MSLRLSTVILPYRRWHEGGRAAWERAEQLGFHTAYTYDHLSWRVPFRDGPWFGAVPTLTAAAAVTERLRLGTLVTSPNFRHPVTLAKELISLDDISGGRVTLGIGAGGTGFDATALGQEPWAPRERANRFAEFVPLLDRLLTQDSVSYEGDFYSAHEARNIPGCVQRPRLPFAVAATGPRGLALAARHGQAWVTTGDPKLYENGTSEQSVQAIRAQAEKLADACAEIGRDASAMDKILLTGFTPDRARPLDSLDAFVDFAGRHRELGFTEIVIHWPVPETVFAAEEKVFEQIAMDAPAQLS

SEQ ID NO: 162 - protein, 310 aa, Streptomyces SMCD2215
MPASYAYLGPEGTFTEAALRTLPEAATRELIPYVSVQSALDAVRVGEAEAAFVPIENSVEGGITTTLDELVAGAPLMIYREVLLSITFALLVRPGTKLSDIKTVSAHPAAQPQVRNWLRNNLPDAHWESAASNADAARLVQEGQYDAAFAGEFAAALYGLEALETGIHDAENAQTRFVLVGRPARPAAPTGADKTSVVLWQRDDHPGGLRDLLGEFATRGINLMLLQSRPTGAGIGNYCFCIDAEGHISDRRVAEALMGLKRICLEVRYLGSYPRADIGVDDVSAPRRGTSDQEFVSAADWVARCQDGRF

SEQ ID NO: 163 - protein, 485 aa, Streptomyces SMCD2215
MADELTPATPEESEEPIKQRKNGLYPGVSDELAENMKSGWADTELHDLEPIAQAAETAARRAALSARFPGERLVIPAGGLKTRSNDTEYAFRASVEYAYLTGNQTEDGVLVLEPTATGHDATIYLLPRSDRDNGEFWLSGQGELWVGRRHSLTEAEKLYGIPASDVRELPDALREATGPVRVVRGYDAAIEAALTDKVTGERDEELRVFLSEARLVKDEFEIGELQKAVDSTVRGFEDVVKVLDKAEATSERYIEGTFFLRARVEGNDVGYGTIAAAGPHACTLHWVRNDGPVRSGDLLLLDAGVETHTYYTADVTRTLPVNGRFGEIQKKIYDAVYDAQEAGIAAVKPGAKYRDFHDAAQRVLAERLVEWGLVEGPVERVLELGLQRRWTLHGTGHMLGLDVHDCAAARVESYVDGTLEPGMCLTVEPGLYFQADDLTVPEEYRGIGVRIEDDILVTEDGNRNLSAGLPRRSDEVESWMASLKG

SEQ ID NO: 164 - protein, 291 aa, Streptomyces SMCD2215
MAEAVEVREFWRRLGVPGLVDVHTHFMPERVLRKVWEYFDALGPLTGGVEWPISYREGEGERVARLREFGVRAFTAMLYPHKPGMAQWLNGWAVDFAGRTPGCLHTSTLFPEPGVEAYVREAVEAGARVFKAHVQVGAYDPASELLDPAWGLLAEAGIPVVIHCGSGPAPGKHTGPEPIARVLARHPRLRLVIAHMGMPEYEDFLDLAERYGEVRLDTTMAFTDFSERIAPFPRRALPRLAGLGERILLGSDFPNIPYPYVHQLHALEALGLGEEWLRAVCHDNGARLFGV

SEQ ID NO: 165 - protein, 752 aa, Streptomyces SMCD2215
MSRTPLDTVEHAAATPDVELPWAELGLKKDEYERILEILGRRPTGAELAMYSVMWSEHCSYKSSKVHLRQFGEKAPQSDALLVGIGENAGVVDVGQGYAVTFKVESHNHPSYVEPYQGAATGVGGIVRDIIAMGARPVAVVDPLRFGAADHPDTKRVLPGVVAGIGGYGNCLGLPNIGGEVVFDACYQGNPLVNAGAIGVMRHEDIHLAKASGSGNKVILYGARTGGDGIGGASILASETFDDAKPSKRPAVQVGDPFQEKLLIECTLEAFKEKLVVGIQDLGAAGLSCATSELASNGSGGMRVTLDDVPLRDSTLSPEEILMSESQERMCAVVEPEKVDRFLEICDKWDVIATVIGEVTDGDRLEIYWHGGKIVDVDPRTVAHEGPVYERPLARPDWQDALQADDANKLARPASSEELRAQVLQLVGSPNQASKKWITSQYDHFVQGNTVLAQPEDSGMIRIDEESGLGVAIATDGNGRYAKLDPYAGAQLALAEAYRNVATTGAKPLAVSDCLNFGSPEDPAVMWQFAEAIRGLADGCQQLGTPVTGGNVSLYNQTGEAAIHPTPVVAVLGVIDDVTRRTPVAFQEEGQLLYLLGDTREEFSGSAWSQVVHDHLGGLPPKVDLERERLLGEILISASRDGMIDSAHDLSDGGLIQAVVESALLGGKGARLVVPDGLDAFTLLFSESAGRAVVAVPRSEEVRFNDMCGARGLPVTRIGVVDGDTVELQGEFELSLQELREAHEGTIEALLA

SEQ ID NO: 166 - protein, 356 aa, Streptomyces SMCD2215
MSETTGASYAAAGVDIEAGDRAVELMKEWVKKTQRPEVLGGLGGFAGLFDASALKRYERPLLASATDGVGTKVDIARQLGVYDSIGHDLVAMVMDDIVVCGAEPLFMTDYICVGKVHPERVAAIVKGIAEGCVLAGCALVGGETAEHPGLLGADDFDVAGAGTGVVEADRLLGPDRIRTGDTVIAMAASGLHSNGYSLVRHVLLNQGGLSLDARIEEFGRTLGEELLEPTKIYSLDCLALTGTTEVHAFSHITGGGLAANLARVIPDDLHAIVDRSTWTPAPVFDLVGRTGQVEGLELEKTLNMGVGMIAIVPQESTDVALATLADRGVEAWVAGEITDRGEHTTGAALVGTYAQQ

SEQ ID NO: 167 - protein, 561 aa, Streptomyces SMCD2215
MSHPHPELGPPQPLPEGGLRVTPLGGLGEIGRNMTVFEYGGRLLIVDCGVLFPEEEQPGIDLILPDFSSIRDRLDDIDGIVLTHGHEDHIGGVPYLLREKPDIPLIGSKLTLALIEAKLQEHRIRPYTLQVAEGHRERVGPFDCEFVAVNHSIPDALAVAIRTPAGMAVHTGDFKMDQLPLDHRLTDLHAFARLSEEGIDLLLADSTNAEVPGFVPPERDISNVLRQVFAGARKRIIVASFASHVHRIQQILDAAHEYGRRVAFVGRSMVRNMGIARDLGYLKVPPGLVVDVKTLDDLPDSEVVLVCTGSQGEPMAALSRMANRDHQIRIVDGDTVILASSLIPGNENAVYRVINGLTRWGANVIHKGNAKVHVSGHASAGELLYFYNICRPKNLMPVHGEWRHLRANAELGALTGVPHDRIVIAEDGVVVDLIEGKAKISGKVQAGYVYVDGLSVGDVGEPALKDRKILGDEGIISVFVVMDSSTGKITGGPHVQARGSGIEDSAFAEVMPKIIEVLERSAQDGVVEPHQLQQLIRRTLGKWVSDTYRRRPMILPVVVEV

SEQ ID NO: 168 - protein, 244 aa, Streptomyces SMCD2215
MTSGDAPKPYMRSDVTVELVKSSASDADVLFAARVSTLGEQSLEELQKDPERSKGLINYLMRDRHGSPFEHNSMTFFISAPIFVFREFMRHRVGWSYNEESGRYRELEPVFYVPGESRKLVQEGRPGKYVFVEGTPAQHASVTSVLSEAYEQAYTAYQKLLAEGVAREVARAALPVGLFSSMYATCNARSLMHFLGLRTQHELAKVPSFPQREIEMVGEKMEEEWARLMPLTHAAFNANGRVAP

SEQ ID NO: 169 - protein, 250 aa, Streptomyces SMCD2215
MSKLRVAVLGAKGRIGSEAVRAVEATEDMELVAALGRGDDLETLAVTGAQVAVELTTPNSVMGNLEYCLGHGIHAVVGTTGWTEERLAQLREWLAASPETGVLIAPNFSIGAVLNMKFAQLAAPWFESVEVIELHHPKKVDAPSGTATRTAQLIAEARRQSNAEPAPDATETALDGARGADVDGVPVHSVRLRGLLAHQEVLLGAEGETLTIRHDSLHHSSFMPGILLGARRVVTNPGLTFGLEHFLGLS

SEQ ID NO: 170 - protein, 739 aa, Streptomyces SMCD2215
MENETHYAEAVIDNGSFGTRTIRFETGRLAKQAAGSAVAYLDDDTMVLSATTASKNPKDQLDFFPLTVDVEERMYAAGKIPGSFFRREGRPSEDAILTCRLIDRPLRPSFKKGLRNEIQVVETIMALNPDHLYDVVAINAASASTQLAGLPFSGPIGGTRVALINGQWVAFPTHTELEDAVFDMVVAGRVLEDGDVAIMMVEAEATDKTIQLVKGGAEAPTEEVVAAGLEAAKPFIKVLCKAQSDLAAKAAKPTGEFPIFLDYQDDVLEALTAAVRPELAQALTIAGKQEREAELDRVKGLAAEKLLPEFEGREKEISAAYRSLTKSLVRERVIKEKKRIDGRGVTDIRTLAAEVEAIPRVHGSALFERGETQILGVTTLNMLRMEQQLDTLSPVTRKRYMHNYNFPPYSTGETGRVGSPKRREIGHGALAERALVPVLPTREEFPYAIRQVSEALGSNGSTSMGSVCASTMSLLNAGVPLKAPVAGIAMGLISQEIEGETHYVTLTDILGAEDAFGDMDFKVAGTKEFVTALQLDTKLDGIPASVLAAALKQARDARLHILDVMMEAIDTPDEMSPNAPRIITVKIPVDKIGEVIGPKGKMINQIQEDTGADITIEDDGTIYIGAAQGSQAEAARATINGIANPTMPEVGERYLGTVVKTTTFGAFVSLLPGKDGLLHISQIRKLAGGKRVENVEDVLGVGQKVQVEIAEIDSRGKLSLIPVIEGEENDADKKDDGDK

SEQ ID NO: 171 - protein, 95 aa, Streptomyces SMCD2215
MSLDAATKKQIIDEFGQKEGDTGSPEVQVAMLSRRISDLTEHLKTHKHDHHSRRGLLILVGQRRRLLQYLAKKDIQRFRALVDRLGIRRGAAGAK

SEQ ID NO: 172 - protein, 332 aa, Streptomyces SMCD2215
MDIDMSALRGLVREKEISFDLLVEAIESALLIAYHRTEGSRRHARVELNRESGHVTVWAKEDPDDLDEGQEAREFDDTPSGFGRIAATTAKQVILQRLRDAEDDATLGEYAGREGDIVTGVVQQGRDPKNVLVDIGRLEAILPVQEQVPGETYPHGLRLRSYVVRVAKGVRGPSVTLSRTHPNLVKKLFALEVPEIADGSVEIAAIAREAGHRTKIAVRSTRSGLNAKGACIGPMGGRVRNVMGELNGEKIDIVDWSDDPAEMVANALSPARVSKVEVVDLAARSARVTVPDYQLSLAIGKEGQNARLAARLTGWRIDIRPDTEQAPEQRGE

SEQ ID NO: 173 - protein, 567 aa, Streptomyces SMCD2215
MANAPVQRMSQLMAKTLRDDPADAEVLSHKLLVRAGYVRRTAAGIWSWLPLGKKVLGNIERIVREEMDAIGAQEVLLPALLPREPYDATGRWDEYGPELFRLKDRKGGDYLLGPTHEEIFTLLVKDQASSYKDLPVILYQIQHKYRDEARPRAGILRGREFLMKDSYSFDTEDEGLAKSYALHRQAYQRIFERLGLDYRICAATAGAMGGSKSEEFLAPAEAGEDTFADCPNCDFAANTEAISYELQPVDGSGAGPVEELDTPDTPTIESLATLLGVQASETLKNLLVKVDGEIVAIGVPGDREVDLGKVEAHFAPSIVEMVTEADFAGRPDLVRGYVGPQGLGEKVKYIADPRVAPGTTWITGANKPGVHAKNVQAGRDFEVAEYVDVVVVQDGDPCPKCGTGLKLDRAIEIGHIFQLGRKYADALKLDVLGQNGKPVRVTMGSYGIGVSRAVAALAEQTADEQGLCWPAEVAPADVHVVAAGKALQTELALDVSEKLRSAGLRVLVDDRAGVSPGVKFTDSELIGVPKILVAGRRAADGVLELKDRRTGEREELTVDEAIARLTA

SEQ ID NO: 174 - protein, 238 aa, Streptomyces SMCD2215
MATHTPGRRIGMALIAPTLALGATVGLASAPASAAVWSSCDQWGNTTLNGYTLYNNIWGSGAGSQCIWANSGTNWGVNANHPNTGGIKSYPNAKKVINKSITSLGSLSSSYNVSVPSSGAYNTSYDIWDTGYQYEIMLWMNKTGAVGPLGTSQGNLILGGHTWTVYKGNNGSNDVFSFVRTSNSSSGTVNVLPILKWIKDTKGWFGNVTIGDLQFGFEITSSSGGLDFTVNSESVSSS

SEQ ID NO: 175 - protein, 257 aa, Streptomyces SMCD2215
MGRLVPAVTRALDILELFLDGDGTLSAPDIVRKLQLPRTTVHELVTTLAARSYIVQVPGQPGRYRLGVRPYQLGSRYAEQLDLAAEGQQVARSVAETCDETVHVAILEGTDVIYIAKVDSTHAVRMVSAAGRRLPAHCTSVGKMLLASLPEPELTSRIPDDAELVAMTPNSITDPAALREVLAEIRQNGIAVESRESNPDVSCVAAPVRDRAGQVVAALSISVPMIRWSDERRAELEQLAAKGAVELSERLGHRSVA

SEQ ID NO: 176 - protein, 354 aa, Streptomyces SMCD2215
MTEHLDASAAPLRDLHGFIAGLPKAELHVHHVGSASPRIVAELASRHPDSKVPTDPEALVDYFTFTDFAHFIDVYLSVVDLIRTPEDVRLLTYEIARDLARQQVRYAELTITPWSSTRRNIDERAFMDAIEDARKAAEAEFGTVLRWCFDIPGEAGLEAAEETTRLATDDRLRPEGLVSFGLGGPEIGVPRPQFKPYFDRAIAAGLRSVPHAGETTGPETVWDALTDLRAERIGHGTSSFKDAKLLAHLAEHRIPLEVCPTSNIATRAVRTLDEHPIKEFVQAGVVITVNSDDPPMFGTDLNNEYAVAARLLNLHEQGLAELAKTAVDVSFLDEPGKARIRQEIDTYTASWLAP

SEQ ID NO: 177 - protein, 482 aa, Streptomyces SMCD2215
MSTEPRGLRTLRNYVAGEFRDAADGRTTEVVNPATGEAYATAPLSGQADVDAAMAAAAAAFPAWRDTTPAERQKALLKIADAFEERAEELIAAEVENTGKPIGLTRSEEIPPMVDQIRFFAGAARMLEGRSAGEYMEGLTSIVRREPIGVCAQVAPWNYPMMMAVWKFAPALAAGNTVVLKPSDTTPASTVLIAEIIGSIVPKGVFNVVCGDRDTGRLMVEHPTPAMASITGSVRAGMSVAESASKDLKRVHLELGGKAPVVVFEDTDIAKAVEDISVAGFFNAGQDCTAATRVLVQEGIHDEFVAALAKAAAETKTGQPDDEDVLYGPLNNPNQLKQVSGFIERLPAHAKVEAGGHRVGDKGYFYAPTVVSGLKQDDEIIQKEVFGPVITVQSFTDEDQAVEWANGVEYALASSVWTKNHGRAMRMSKKLDFGCVWINTHIPLVAEMPHGGFKKSGYGKDLSAYGFDDYTRIKHVMTSLDA

SEQ ID NO: 178 - protein, 460 aa, Streptomyces SMCD2215
MGNPITVSPKDLSKTAYDHLWMHFTRMSSYENSPVPTIVRGEGTYIYDDKGKRYLDGLAGLFVVQAGHGRTELAETAFKQAQELAFFPVWSYAHPKAVELAERLADYAPGDLNKVFFTTGGGEAVETAWKLAKQYFKLTGKPTKYKVISRAVAYHGTPQGALSITGLPALKAPFEPLVPGAHKVPNTNIYRAPLFGDDPEAFGRWAADQIEQQILFEGPDTVAAVFLEPVQNAGGCFPPPPGYFQRVREICDQYDVLLVSDEVICAFGRLGTMFACDKFDYVPDMITCAKGMTSGYSPIGACIISDRLAEPFYKGENTFLHGYTFGGHPVSAAVGLANLDLFERENLTQHVLDNEGAFLQTLQKLHDLPIVGDVRGNGFFYGIELVKDKNTKESFNDEETERVLYGFLSKALYDNGLYCRADDRGDPVVQLAPPLISDQSTFDEIEQILRATLTEAWTKL

SEQ ID NO: 179 - protein, 185 aa, Streptomyces SMCD2215
MIEETLLEAEEKMEKAVVVAKEDFAAIRTGRAHPAMFNKIVADYYGAPTPINQLASFSVPEPRMAVVTPFDKSALRNIEQAIRDSDLGVNPSNDGNIIRVVFPELTEERRRDYIKVAKGKAEDARVSIRSVRRKAKDAIDKLIKDGETGEDEGRRAEKELDDTTHKYVAQVDELLKHKEAELLEV

SEQ ID NO: 180 - protein, 278 aa, Streptomyces SMCD2215
MANYTAADVKKLRELTGAGMMDCKKALDEADGNVEKAVEALRIKGQKGVAKREGRSAENGAVVSIIADDNSSGVLVELKCETDFVAKGDKFQAVATAIAEHVAKTAPADLEALLASEIEAGKTVQAFVDEANANLGEKIVLDRFAQYGDGFVTAYMHRTMPDLPPQIGVLVEFDKPNAEVAKGVAQHIAAFAPKYLSKEDVPAEVVESERRVAEETTRAEGKPEAALPKIVEGRLNGFFKDATLLGQPYALDNKKSVQKVLDEAGVTLKRFTRIKVGI

SEQ ID NO: 181 - protein, 315 aa, Streptomyces SMCD2215
MAVVTMRELLESGVHFGHQTRRWNPKMKRFIFTERNGIYIIDLLQSLSYIDRAYEFVKETVAHGGTVMFVGTKKQAQEAIAEQATRVGMPYVNQRWLGGMLTNFSTVYKRLQRLKELEQIDFEDVAASGLTKKELLVLSREKAKLEKTLGGIREMSKVPSAVWVVDTKKEHIAVGEARKLNIPVVAILDTNCDPDEVDYKIPGNDDAIRSVTLLTRVIADAVAEGLIARSGVATEGKGEKAAGEPLAEWERDLLEGEKKADSDQAAEKPAEAAAEKPVETPAAEAEAPATEAPATEAPAAEAPAAEAPAADAEQA

SEQ ID NO: 182 - protein, 102 aa, Streptomyces SMCD2215
MSAEDLEKYETEMELKLYREYRDVVGLFKYVIETERRFYLTNDYEMQVHSVQGEVFFEVSMADAWVWDMYRPARFVKQVRVLTFKDVNIEELNKSDLELPSG

SEQ ID NO: 183 - protein, 313 aa, Streptomyces SMCD2215
MDAAVPAADSAVTSGNDSGATEGTEPGGRGRAEREGAGGTPPKAGKQRSFWKELPILIGIALVLALLIKTFLVQAFSIPSDSMQNTLQEGDRVLVDKLTPWFGSEPERGEVVVFHDPDNWLAGEPTASPNALQKVLSWIGLMPSAEEKDLIKRVIGVGGDTVSCKGTGPLTVNGKALNDSSVVFAGNTPCSVDDQGGQFTVKVPKGYIWVMGDHRQNSRDSRYNQSDKHNGMVPVNKVVGRAIVIAWPITRWDTLPVPDTFDQPGLDKQSSASAAMTAAPNALALAATVPVVVWRRRRIAPVDTRRGGPAEGV

SEQ ID NO: 184 - protein, 139 aa, Streptomyces SMCD2215
MAVKIKLKRLGKIRSPHYRIVVADSRTRRDGRAIEEIGLYHPVQNPSRIEVDADRVAYWLSVGAQPTEPVLAILKKTGDWQKYKGEPAPAPLLQPAEKAARPSFEALGGDDEGKGEAITQKKKAEKKDEASAESASTEA

SEQ ID NO: 185 - protein, 517 aa, Streptomyces SMCD2215
MFDTLSDRLSATFKNLRGKGRLSEADIDATAREIRIALLEADVALPVVRSFIKNVKERALGAEVSRALNPAQQVLKIVNEELVTILGGETRRLRFAKQPPTVIMLAGLQGAGKTTLAGKLGHWLKEQGHSPLLVAADLQRPNAVNQLSVVADRAGVAVYAPEPGNGVGDPVKVAKDSIGFAKSKVHDIVIVDTAGRLGIDQELMQQAADIRDAVSPDEILFVVDAMIGQDAVTTAEAFRDGVGFDGVVLSKLDGDARGGAALSIRQVTGKPIMFASNGEKLDDFDAFHPDRMASRILDMGDLLTLIEQAEKTFSQEEAQKMASKLASKKGQDFTLDDFLAQMEQVRKMGSISKLLGMLPGMGQIKDQINNLDERDVDRTAAIIKSMTPGERQEPTIINGSRRARIAKGSGVEVSAVKNLVERFFEARKMMSRMAQGGGMPGMPGVPGMGGGPGRTKKQPKKAKGKQRSGNPMKRKQQEQEEAERRAAAAQGGNAFGVPGQQPPQDFELPDEFKKFMG

SEQ ID NO: 186 - protein, 473 aa, Streptomyces SMCD2215
MTSTEQAPKSGAGSAHPEHLGRVVFIAAAAAMGGFLFGYDSSVINGAVEAIRSRYDIGSAALAQVIAVALIGCAIGAATAGRIADRIGRIRCMQISAVLFTISAVGSALPFALWDLAFWRIVGGFAIGMASVIGPAYIAEVAPPAYRGRLGSFQQAAIVVGIAVSQLVNWGLLNAAGGDQRGTLLGLEAWQVMLGVMVIPAVVYGLLSFAIPESPRFLISVGRRERAREILNQVEGGGAERLDARVGEIEHAMRSEEKSSFKDLLGGGFFFKPIVWVGIGLSVFQQFVGINVAFYYSSTLWQSVGVDPSDSFFYSFTTSIINIVGTVIAMVFVDRIGRKPLALIGSVGMVVGLALEAWAFSYHLVDGKLPAAQGWTALIAAHIFVLFFALSWGVVVWVMLGEMFPNKIRAAALGVAASAQWIANWAITASFPSLSDWNLSATYVIYTAFAALSIPFVLKFVKETKGKALEEMG

SEQ ID NO: 187 - protein, 216 aa, Streptomyces SMCD2215
MASNARLDHRNPLVFDTHELGRRPGALQRLSRTIDAPKDLGLVGVVGVPEGAPVELDLRLESVMEGVLVTGTARAQAEGECVRCLEPLRLDVEAEFQEMFSYPDADDRGRPKAEPADDAEEDEDRLFIEDGLFDLEPVLRDAVVLALPMQPVCQDDCPGLCSECGARLADDPDHHHDAVDIRWAALQGLAGSLEDGEKDEMSGADAEAGVDEKQEK

SEQ ID NO: 188 - protein, 159 aa, Streptomyces SMCD2215
MRRAVCPGSFDPITNGHLDIISRASRLYDEVYVAVMINKAKKGLFEIDERIELIREVTAEYENVRIEAFHGLLVDYCKQRDIPAIVKGLRAVSDFDYELQMAQMNNGLSGVETLFVPTNPTYSFLSSSLVKEVATWGGDVAHLVPPVVLEALNKRLRKD

SEQ ID NO: 189 - protein, 215 aa, Streptomyces SMCD2215
MNKAQLVEAIADKVGGRQQAAEAVDAVLDAIVRATVAGDRVSVTGFGSFEKVDRPARYARNPQTGERVRVKKTSVPRFRAGQGFKDLVSGSKKLPRGGEVAVKKAPKGSLSGGASATVKKAAAKKTTAKKATAKKTTAKKTTARKTTGAAKTSAAKKTTAKKATGAAKTSAAKKTTAKKATAKKAPAKKATAKKAPAKKSTARTTTAKKATARKR

SEQ ID NO: 190 - protein, 494 aa, Streptomyces SMCD2215
MASAPVRVRFCPSPTGNPHVGLVRTALFNWAFARHHQGTLVFRIEDTDAARDSEESYNQLLDSMRWLGFDWDEGPEVGGPHAPYRQSQRMDIYADVANRLLEAGHAYRCYCSQEELDTRREAARAAGRPSGYDGHCRDLSAGQVAEYEAQGRTPIVRFRMPDEAITFTDLVRGELTFTPENVPDYGIVRANGAPLYTLVNPVDDALMEITHVLRGEDLLSSTPRQIALYKALIELGVAKEIPQFGHLPYVMGEGNKKLSKRDPQSSLNLYRERGFLPEGLLNYLSLLGWSLSADQDIFSVEEMVAAFDVADVNPNPARFDLKKCEAINGDHIRLLDVKDFTERCRPWLQAPFAPWAPEAFDESRWQAIAPHAQTRLKVLSEITDNVDFLFLAEPVFDEPSWTKAMKEGSDALLRTAREKLESADWTSAESLKEAVLAAGEAHGLKLGKAQAPVRVAVTGRTVGLPLFESLQVLGKERTLARVDAALTRLGTAGS

SEQ ID NO: 191 - protein, 261 aa, Streptomyces SMCD2215
MRIARFSIDGNVAFGAVEGDKPDELVLDIIKGIPFADFELSGTKVPLSKVRLLPPVLPNKVVAFGRNYAEHARELGHEVPDAPFAFFKPSTSVIGPGDEIGYPSFTEDLHHEAELAVVIGRMCREVPRERVADVIFGYTCANDITARDVQKREKQWARAKGFDNSCPLGPWVETDLDLATAGDLTVQLTVNGEQRQLGRTSEMIHPIEDLIVNITEAMTLLPGDVILTGTPAGVGPLTVGDEVAVTIEGIGTLTNKVVKRG

SEQ ID NO: 192 - protein, 140 aa, Streptomyces SMCD2215
MSQMSQAAQNLNWLITNFVDNTPGVSHTVVVSADGLLLAMSEGFPRDRADQLAAVASGLTSLTAGASRIFEGGNVAQTVVEMERGFLFLMSVSDGSSLAVLAHPECDIGLVGYEMALLVDRAGAVLTPDLRAELQGSLLH

SEQ ID NO: 193 - protein, 140 aa, Streptomyces SMCD2215
MSPMSQAAQNLNWLITNFVDNTPGVSHTVVVSADGLLLAMSEGFPRDRADQLAAVASGLTSLTAGASRIFEGGSVNQTVVEMERGFLFIMSVSDGSSLAVLAHPEADIGLIGYEMALLVDRAGSVLTPDLRAELQGSLLN

SEQ ID NO: 194 - protein, 362 aa, Streptomyces SMCD2215
MTTPTIELKPSASPLAAAERAAILENPGFGRHFTDHMVTIKWTEGRGWHDGQLVPYAPLSIDPATMVLHYAQEIFEGLKAYRQPDGTVATFRPEMNARRFQRSAHRLGMPELPVETFIEACDVLVQQDKDWVPAHGGEESLYLRPFMIATEVGLGVRPAGEYLFLVIASPAGAYFPGGVRPVSIWLSEDRVRAVPGGMGDAKTGGNYAASLLAQAEAAAKGCDQVCYLDAVEHKWVEELGGMNLYFVYGDKIITPTLTGSILEGVTRDSLLTVARDLGYESEEGRVSIDQWQRDAENGTLTEVFACGTAAVITPVGTVKRANAEWQQSGGEPGKVTVTLREALLNIQRGTAKDDHGWMHPLG

SEQ ID NO: 195 - protein, 350 aa, Streptomyces SMCD2215
MSASSRSIDLAVIPGDGIGQEVVAEGLKVLSAVLPQDVKLETKEYDFGARRYHATGETLTDADLDALKRHDAILLGAIGDPSVPSGVLERGFLLKLRFAFDHHVNLRPSKLLPGVATPLAGEPSIDFVVVREGTEGPYTGNGGTIRKGTEHEVATEVSVNTAYGVERVVRDAFARAQARPRKKLALIHKNNVLAFAGHLWTNVFNKVAAEFPDVTTEYMHVDAATIYLVTQPERFDVIVTDNLFGDIITDLAAAVSGGIGVAASGNINPSREFPSMFEPVHGSAPDIAGQGKADPTATVLSVALLLRHLGHEAEAARIDEAVSADLAERTGKPARSTSEIGDALAVRVAG

SEQ ID NO: 196 - protein, 543 aa, Streptomyces SMCD2215
MDAVTQVPTPVNEPVHGYAPGSPERARLEAKLKELAENPVDLPMTIGGEKRLGGGEPFQVVQPHNHKSVIGTGRHATQQDARDAIDAALAAAPAWRAMSFDDRAAIILRAAELLSGPWRETIAASTMLGQSKTAQQAEIDSPCELIDFWRFNVHYARGILAEQPPANSPGVWNRMDHRPLEGFVYAITPFNFSAIAANLPTAPALMGNVVVWKPSPTQTHAAVLLMQLLEEAGLPKGVINLVTGDGIEVSKVALEHRDLAGIHFTGSTKTFQYLWKTVGNNIEKYRTYPRLVGETGGKDFLVAHPSADRAVLKTALTRGAFEYQGQKCSATSRAYIPASIWNSGFKEEFAAEVDHLTMGDVTDLSNFLGAVIDERAFAKNKAAIDRAKSDPSCTIVAGGSYDDSVGWFVRPTVVECDDPDNEVFRTEYFGPFLAVHVYEDDRYEEMLTQMESVSDYALTGSVIAGDRAAAAYTMEKLRYAAGNFYINDKSTGAVVGQQPFGGGRASGTNDKAGAPQNLLRWTLTRAIKETLVPPTDYAYPHMG

SEQ ID NO: 197 - protein, 308 aa, Streptomyces SMCD2215
MLGPVILAASRSDRMRRLISAAPVTKQVVDRFIPGEAVDDIVPIIKDLTGKGLELTMDVVGEDITTPEQSHAARDAYLALIDRLAVLDLGEQVEMSVKLSMFGQALDGGHDLALANVRQVVVAAAAIGTTVTLDAEDHTTLDSMFAIHEELRKDFPQTGCVIQAYLFRTEADARRLAAAGSRVRLVKGAYKEPAEVAYQNKHEIDKAYVRILKILMDGEGYPMVGSHDPRLISIAQELAHRAGRKPDEYEFQMLYGIRGDEHLRLAAEGHRMRVYTAYGTDWYGYFMRRLAEKPANLRFFLRSMISKG

SEQ ID NO: 198 - protein, 529 aa, Streptomyces SMCD2215
MSSKPVVLIAEELSPATVDALGPDFEIRHCNGADRAELLPAIADVDAILIRSATKVDAEAIAAAKKLKVVARAGVGLDNVDVSASTKAGVMVVNAPTSNIVTAAELACGLLIATARHIPQANAALKNGEWKRSKYTGVELAEKTLGVVGLGRIGALVAQRMSAFGMKVVAYDPYIQPARAAQMGVKVLSLDELLEVSDFITVHLPKTPETLGLIGEEALRKVKPSVRIVNAARGGIVDEEALYSALKEGRVAGAGLDVYAKEPCTDSPLFEFDQVVSTPHLGASTDEAQEKAGIAVARSVRLALAGELVPDAVNVQGGVIAEDVKPGLPLAERLGRIFTALAGEVAVRLDVEVYGEITQHDVKVLELSALKGVFEDVVDETVSYVNAPLFAQERGVEVRLTTSSEATDHRNVVTVRGTLTDGQEVSVSGTLAGPKHLQKIVAVGEYDVDLALTEHMVVLRYEDRPGVVGTVGRVFGEAGINIAGMQVARSAVGGEALAVLTVDDTVAAGVLAEVAEEIGATFARSVNLV

SEQ ID NO: 199 - protein, 174 aa, Streptomyces SMCD2215
MSKHTLSVLVENTPGILARIAALFSRRGFNIDSLAVGVTEHPDISRITIVVGVEDLPLEQVTKQLNKLVNVLKIVELEPGQAVQRELVLVKVRADNETRSQIVEIVQLFRAKTVDVSPEAVTIEATGSSEKLSAMLKMLEPYGIKELVQSGTIAIGRGARSITDRSLRALDRSA

SEQ ID NO: 200 - protein, 419 aa, Streptomyces SMCD2215
MSENAEDTVVTTPAKSEGATLTKDAAPGETLLKVTGLQKHFPIKKGLLQRQVGAVHAVDGIDFEVRSGETLGVVGESGCGKSTMGRLITRLLEPTAGTVEFEGKDITHLGVAGMRPLRRDVQMIFQDPYSSLNPRHTIGTIVGAPFRLQGVTPEGGIKQEVQRLLSVVGLNPEHYNRYPHEFSGGQRQRIGIARALALKPKLVVADEPVSALDVSIQAQVVNLLDDLQQELGLTYVIIAHDLSVVRHVSDRIAVMYLGKIVELADRESLYRAPMHPYTKALMSAVPIPDPRRKSAKSERILLKGDVPSPISPPSGCRFHTRCWKATEICKTTEPKLVELRPGQQVACHHPENFEDQAPQDTVLLTVAKEAAELVADEVLAESAETSAAVAAEVAENADSEVAESDSGADEEAGQESTDK

SEQ ID NO: 201 - protein, 365 aa, Streptomyces SMCD2215
MTELSKTGAAVGEPTSASPAPTAFLEVRDLKVHFPTDDGLVKSVDGLSFKLEKGKTLGIVGESGSGKSVTSLGIMGLHTAGQYGKRKAQISGEIWLDGTELLTSNPDDVRKLRGRQMSMIFQDPLSALHPYYTIGQQIVEAYRIHHNVDKKTAKRRAIEMLDRVGIPQPDKRVDSYAHEFSGGMRQRAMIAMSLVNNPELLIADEPTTALDVTVQAQILDLIRDLQKEFGSAVIIITHDLGVVAELADDILVMYGGRCVERGPAEKVFYEPRHPYTWGLLGSMPRLDREQQDRLIPVKGSPPSLINVPSGCAFNPRCPYADVPKDNLTRTVRPELTEVGSQHWAACHMTQEQRERIWTEEIAPKL

SEQ ID NO: 202 - protein, 372 aa, Streptomyces SMCD2215
MSSTPLRRTALDALHRSLGATMTDFAGWDMPLRYGSERDEHLAVRTRAGLFDLSHMGEITVTGPQAAALLNHALVGNIASVGVGRARYTMICRADGGILDDLIVYRLAETEYMVVANASNAQVVLDALTERAAGFDAEVRDDRDAYALIAVQGPESPGILKSLTDADLDGLKYYAGLPGTVAGVPALIARTGYTGEDGFELFVKPEHAVELWQALTAAGEGVGLVPCGLSCRDTLRLEAGMPLYGHELSTSLTPFDAGLGRVVKFEKEGDFVGRAALAEAAARAEQNPPRVLVGLVAEGRRVPRAGYPVVAGGAVIGEVTSGAPSPTLGKPIAMAYVDAAHAAPGTPGVGVDIRGSHEPYEVVALPFYKRQK

SEQ ID NO: 203 - protein, 422 aa, Streptomyces SMCD2215
MTALNTSLHELDPEIAAAVDAELVRQQSTLEMIASENFAPLAVMEAQGSVLTNKYAEGYPGRRYYGGCEHVDVAEQIAIDRLKELFGAAYANVQPHSGASANQAALFALAQPGDTILGLDLAHGGHLTHGMRLNFSGKQFNVVAYHVDAATGLVDMAELERLAKEHRPKVIIAGWSAYPRELDFAAFRRIADEVGAYLWVDMAHFAGLVAAGLHANPVPHADVVTSTTHKTLGGPRGGIILARSTDFAKKLNSSVFPGFQGGPLEHVIAAKAVSFKVAASEEFRERQRRTVEGARILAERLTADDVRAAGVNVLSGGTDVHLILVDLRASELDGQQAEDRLHEVGITVNRNAVPDDPRPPMVTSGLRIGTPALATRGFGAEDFAEVADVIAEALKPSYDAEALKARVRALADKHPLYPGLNK

SEQ ID NO: 204 - protein, 255 aa, Streptomyces SMCD2215
MTVNLEVAEGVGTIRLDRPPMNALDVATQDRLKELAEEATRREDVRAVIVYGGEKVFAAGADIKEMQNMDHAAMVLRSRALQDSFTAVARIPKPVVAAITGYALGGGCELALCADYRIAAENAKLGQPEILLGLIPGAGGTQRLSRLVGPSKAKDLIFTGRMVKADEALTLGLVDRVVPAEEVYTAAHAWAARLAQGPAIALRAAKESIDTGLETDIETGLAVERNWFAGLFATEDRERGMRSFVEEGPGKAKFL

SEQ ID NO: 205 - protein, 401 aa, Streptomyces SMCD2215
MSPSRVLVLNSGSSSVKYQLLDMRDSSRLAAGLVERIGEETSRLRHTPLARGGETREWNAPVADHEAALKAVSQELARDGLGLDSPELAAIGHRVVHGGKRFTEPTVVDEAVLAEIERLIPVAPLHNPANLTGIRTAQALRPDLPQVAVFDTAFHTTMPESAARYAIDVRTADEHRIRRYGFHGTSHAYVSRATAKLLGRAPEEVNVIVLHLGNGASASAVRGGRCVDTSMGLTPLEGLVMGTRSGDADPAVIFHLARVGGMSIDEIDTLLNKKSGLVGLCGDNDMREIRRRIDEGDAQAQLAFDIYIHRLKKYIGAYCAVLGTVDAIAFTAGVGENAAPVREAAVAGLEILGLAVDGALNAVRSDEPRLISPEDARVKIAVVPTDEELEIATQTFALVEG

SEQ ID NO: 206 - protein, 475 aa, Streptomyces SMCD2215
MRRSKIVCTLGPAVDSHEMLVSMIEAGMNVARFNFSHGSHAEHQGRYDRVRAASKETGRAIGVLADLQGPKIRLETFAEGPVELERGDEFVITTEDVQGDKSVCGTTYKGLPGDVDRGDQILINDGNVELKVLDVEGPRVKTIVIEGGVVSDHKGINLPGAAVNVPALSEKDVEDLRFALRMGCDMVALSFVRDAKDVDDVHKVMDEEGRRVPVIAKVEKPQAVQNMEGVVMAFDAVMVARGDLAVEYPLEKVPMVQKRLIELCRRNAKPVIVATQMMESMITNSRPTRAEASDVANAILDGADAVMLSAESSVGAYPVETVKTMSKIVTAAEEELLSKGLQPLVPGKKPRTQGGSVARAACEIADFLGGRGLVAFTQSGDTARRLSRYRAQQPIIAFTTDENTRNQLTLSWGVESHVVPFVNTTDEMVDMVDQEIAKINRFNPGEIVIITAGSPPGVPGTTNMLRVHHIGGGSN

SEQ ID NO: 207 - protein, 326 aa, Streptomyces SMCD2215
MQPRNMSMSGVVDLAAVKAAQEAKAKAEQARAEAARQGGGPGAVSPADLVIDVDEAGFENDVLQRSTEVPVVIDFWAEWCEPCKQLSPVLERLAVEYNGRFLLAKVDVDANQMLMQQFGIQGIPAVFAVVAGQALPLFQGAAGEAQIRQTLDQLVQVAEQRFGLTGLTVDPDAEPGGGPAAAETAPAGPYDALLEAAVRALDSGDLAGAVQAYKNVLSEDPGHPEAKLGLSQAELLQRVQGLDPQQVRRDAADRPGDAQAQIAAADLDLVGGHVEDAFGRLIDTIRRTAGDERDTVRVRLLELFEVVGTDDPRVASSRRALARALF

SEQ ID NO: 208 - protein, 158 aa, Streptomyces SMCD2215
METETATRWLTDAEQCAWRTHLEVNRLLTYQLERDLQPFGLTMNDYEILVNLSESEDVRMRMSDLASATLQSKSRLSHQITRMENANLVRRENCESDRRGLYAVLTEHGMETMKKVAPHHVASVRRHFMDLLSPEALAELDKALKPIAQHLRGHRGRP

SEQ ID NO: 209 - protein, 399 aa, Streptomyces SMCD2215
MSSGTNTSVIVAGARTPMGRLLGSLKSFSGADLGGFAIKAALDRAGIGGDQVQYVIMGQVLQAGAGQIPARQAAVKGGIPMSVPALTVNKVCLSGLDAIALADQLIRAGEFDVIVAGGQESMTNAPHLLPKSREGFKYGAIEMLDAMAYDGLTDPWENIPMGESTEKHNTRLGIGRAEQDEIAALSHQRAAAAQKNGVFEAEITPVEIPQRKGEPVVFSKDEGIRGDTTAESLGKLRPAFTKDGTITAGTASQISDGAAAVVVMSKAKAQELGLEWIAEIGAHGNVAGPDNSLQSQPSNAILHALKKEGLEVSDLDLVEINEAFAAVAVQSMKDLGISTEKVNVNGGAIALGHPIGMSGARLVLHLALELKRRGGGVGAAALCGGGGQGDALIVRVTKA

SEQ ID NO: 210 - protein, 146 aa, Streptomyces SMCD2215
MLTRIDHIGIACFDLDKTVEFYRATYGFEVFHSEVNEEQGVREAMLKINDTSDGGASYLQLLEPTRPDSTVAKWLDKNGEGVHHIAFGTADVDADAASVKEKGVRVLYEEPRRGSMGSRITFLHPKDCHGVLTELVTSAPVESPEH

SEQ ID NO: 211 - protein, 478 aa, Streptomyces SMCD2215
MTTTVETAVATGRVARVIGPVVDVEFPVDAMPEIYNALHVEVADPANAGEKKTLTLEVAQHLGDGLVRTISMQPTDGLVRQATVTDTGKGISVPVGDFTKGKVFNTLGEVLNSDEAYDGERWTIHRKAPAFDQLESKTEMFETGLKVVDLLTPYVRGGKIGLFGGAGVGKTVLIQEMIMRVANLHEGVSVFAGVGERTREGNDLIAEMEESGVLDKTALVFGQMDEPPGTRLRVALAGLTMAEYFRDVQKQDVLFFIDNIFRFTQAGSEVSTLLGRMPSAVGYQPNLADEMGQLQERITSTRGHSITSMQAIYVPADDLTDPAPATTFAHLDATTVLSRPISEKGIYPAVDPLDSTSRILDPRYIAQDHYDAAMRVKTILQKYKDLQDIIAILGIDELGEEDKLVVHRARRVERFLSQNTHAAKQFTGVDGSDVPLDESIAAFNAICDGDYDHFPEQAFFMCGGLEDLKANAKELGVS

SEQ ID NO: 212 - protein, 530 aa, Streptomyces SMCD2215
MAELTIRPEEIRDALENFVQSYKPDAASREEVGTVTLAGDGIAKVEGLPSAMANELLKFEDGTLGLALNLEEREIGAVVLGEFSGIEEGQPVQRTGEVLSVAVGEGYLGRVVDPLGNPIDGLGEIETSGRRALELQAPTVMQRKSVHEPMETGYKAVDAMTPIGRGQRQLIIGDRQTGKTALAVDTIINQRDNWRTGDPSKQVRCIYVAIGQKGSTIASVRGSLEEAGALEYTTIVAAPASDPAGFKYLAPYTGSAIGQQWMYEGKHVLIIFDDLSKQADAYRAVSLLLRRPPGREAYPGDVFYLHSRLLERCAKLSDEMGAGSMTGLPIVETKANDVSAFIPTNVISITDGQCFLESDLFNAGQRPALNVGISVSRVGGSAQHKAIRQVSGRLRVDLAQFRELEAFAAFGSDLDAASKAQLERGQRMVELLKQPQYQPMATEDQVISIWAGTTGKMDDVPVGDIRRFEKELLEFLHRKEQGLMTSIKEGGKMSDDTLQAMADAVAEFKKQFETADGKLLGEDAPAAAAK

SEQ ID NO: 213 - protein, 271 aa, Streptomyces SMCD2215
MNGASREAHAAARERLEALTDSSSVDAGQLAEQLAAVTEFLDREVGLRRVLTDPVQSGEARAELATRLLTGHVDGPALDLVTGMVRARWSRSRDLVDSVEELAASADLTKAQQNSTLDDVEDELFRFGRIVQSSTALRAALTDRAATTEAKGELLHSLLGGRANPVTERLVVRLVTRPRGRSLEAGLEAMSRLAAARRDRAVAVVTSAVPLTDAQKQRLGAALAKLYGRQMHLNLDVDPTVLGGISVRVGEEVIDGTITERLAEASRRLAG

SEQ ID NO: 214 - protein, 352 aa, Streptomyces SMCD2215
MTHQWRGIIEEYRDRLPVSDTTPVVTLREGGTPLVPAQVLSERTGCEVHLKVEGANPTGSFKDRGMTMAITRAKEEGAKAVICASTGNTSASAAAYAVRAGMVSAVLVPQGKIALGKMGQALVHGAKILQVDGNFDDCLTLARSLSDNYPVALVNSVNPVRIEGQKTAAFEIVDMLGDAPDIHVLPVGNAGNITAYWKGYREYAADGPATRTPRMWGFQASGSAPIVRGEIVKDPSTIATAIRIGNPASWQYALAARDESGGFIDEVTDREILRAYRLLAAQEGVFVEPASAASVAGLLKAAEQGKVDPGQRIVCTVTGNGLKDPDWAVAGAPQPVTVPVDAVAAAERLGLA

SEQ ID NO: 215 - protein, 463 aa, Streptomyces SMCD2215
MSRSAHPAGPRHADVLPEGHYSAPPADLNVLDPKVWAQTVSRDADGVATVGGMDVKSIAEQYGTPAYVLDEADFRARARAWRGAFGGDADVFYAGKAFLSRAVVRWLHEEGLNLDVCSGGELATALSAGMPADRIAFHGNNKSVEEIRRAIGEGVGRIVLDSFQEIVRVAHIARELGTRQRVQIRITVGVEAHTHEFIATAHEDQKFGIPLAGGQAAEAVRRALQLDSLELIGIHSHIGSQIFDMSGFEVAAHRVVGLLKDVRDEHGVELPEIDLGGGLGIAYTSDDDPREPHEIAKALTEIVTRECEAAKLRTPRISVEPGRAIVGPTAFTLYEVGTIKPLDGLRTYVSVDGGMSDNIRTALYDAEYSVALVSRTSDAEPMLARIVGKHCESGDIVVKDAFLPSDLAPGDLVAVPATGAYCRSMASNYNHVLRPPVIAVHDGEARVIVRRETEEDLLRLDVG

SEQ ID NO: 216 - protein, 417 aa, Streptomyces SMCD2215
MRKILVVGAGQSGLQLALGLQSHGYEVTLMSNRTADEIRSGRVMSTQCMFHTALQHERDLQLNFWESQAPKIEGLGVSVAAPGSWGEGPAARAIDWVGRLDGYAQSVDQRVKMAGWMETFAQRGGQLVIHGAAVSDLDYFSRTYDLVMVSAGKGELVSMFGRDASRSPYSEPQRALAVAYVHGLGPRPEHPEFDAVRCNLVPGVGELFVMPTFTTSGRADILFWEGIPGGPLDVFNGVKDPAEHLSLTLELMEKFTPWEYARATKVELTDAGGTLSGRYAPTVRNPIGRLPGGGLVLGVADVVVANDPITGQGSNSASKCAAAYLASILEHGDRPFDEAWMQATFDRYWGTAQHVTKWTNAMLAPPPEHILNLIGAAGQLQPVADRFANAFNDPADFENFFYEPEKTEAYLASVAGS

SEQ ID NO: 217 - protein, 1265 aa, Streptomyces SMCD2215
MSPQSPSNSSLSTDTDQAGKNPAAAFGPNEWLVDEIYQQYLQDPNSVDRAWWDFFADYKPGAAAAPAPAGTAAAGAAGTTSPAAPAQAAPAPAAPAPAPAAAKPAAAAPAPAQPAAAAKAPAPAPAKPAAKPAAKAEPATEPAAGPELVTLRGPAAAVAKNMNASLELPTATSVRAVPVKLLFDNRIVINNHLKRARGGKISFTHLIGYAMVQAIKAMPSMNYSFAEKDGKPTLVKPDHVNLGLAIDLVKPNGDRQLVVAAIKKAETLNFFEFWQAYEDIVRRARDGKLTMDDFSGVTVSLTNPGGLGTVHSVPRLMPGQSVILGVGSMDYPAEFQGTSQDTLNKLGISKVMTLTSTYDHRVIQGAASGEFLRQVANLLLGENGFYDEIFEALRIPYEPVRWLRDIDASHDDDVTKAARVFELIHSYRVRGHVMADTDPLEYRQRKHPDLDITEHGLTLWDLEREFAVGGFSGKSLMKLRDILGVLRDSYCRTIGIEFMHIQDPKQRKWIQDRVERPHSKPEREEQLRILRRLNAAEAFETFLQTKYVGQKRFSLEGGESVIPLLDAVLDSAAESRLDEVVIGMAHRGRLNVLANIVGKSYAQIFREFEGNLDPKSMHGSGDVKYHLGAEGTFTGLDGEQIKVSLAANPSHLETVDPVIEGIVRAKQDIINKGGTDFTVLPVALHGDAAFAGQGVVAETLNMSQLRGYRTGGTVHIVINNQVGFTAAPESSRSSMYATDVARMIEAPIFHVNGDDPEAVVRVARLAFEFRQAFNKDVVIDLICYRRRGHNESDNPAFTQPLMYDLIDKKRSVRKLYTESLIGRGDITLEEAEQALQDYQGQLEKVFTEVREATSQPGTAPVSDPQAEFPVPVTTAISAEVVKRIAESQVNIPDHFHVHPRLLPQLQRRAAMVEDGTIDWGMGETLAIGSLLLENTPVRLSGQDSRRGTFGQRHAVLIDRETGEDLTPLQYLSDDQARYNVYDSLLSEYAVMGFEYGYSLARPDALVMWEAQFGDFVNGAQSVVDEYISAAEQKWGQTSGVTLLLPHGYEGQGPDHSSARVERFLQLCAQNNMTVAMPTLPSNYFHLLRWQVHNPHHKPLVVFTPKSMLRLKAAASKTEEFTSGQFRPVIGDSSVDPAAVKKVVFVAGKLYYDLEAERTKRGATDIAIVRVERLYPLPGAEIQAEIAKYPNVEKYLWAQEEPANQGAWPFIALNLIDHLDLAVGADVPHGERLRRISRPHSSSPAVGSAKRHQAEQEQLVREVFEA

SEQ ID NO: 218 - protein, 261 aa, Streptomyces SMCD2215
MEVVIVPDARSGGELIAEATAQLLRRRPAALLGVATGSTPLPIYEALAAKVRSGAVDTSRARIAQLDEYVGLPAEHPESYRSVLRREVLEPLGIGMDAFMGPDGTAEDVQGACEAYDRALAEAGGVDLQLLGIGTDGHIGFNEPCSSLASRTRIKTLTEQTRIDNARFFDGDIEQVPHHVITQGIGTILEARHLVLLATGEGKADAVAATVEGPVAAVCPASALQLHPHATVVVDDAAASKLKLADYFRHTYANKPEWQGI

SEQ ID NO: 219 - protein, 337 aa, Streptomyces SMCD2215
MTTRNQNLLDPGFELTLRPMRYPDFYERYRDAIKNTWTVEEVDLHSDVADLAKLTPEEQHLIGRLVAFFATGDSIVANNLVLTLYKHINSPEARLYLSRQLFEEAVHVQFYLTLLDTYLPDPEDRTAAFAAVENIPSIREKAGFCFTWMDSVDHLDRLESKADRRRFLLNLICFAACIEGLFFYGAFAYVYWFRSRGLLHGLATGTNWVFRDETMHMSFAFDVVDTVRKEEPELFDDQLQQEVTDMLREAVEAELQFARDLCGDGLPGMNTDSMRQYLECVADQRLTRLGFAPVYGSENPFSFMELQGVQELTNFFERRPSAYQVAVEGTVDLDEDF

SEQ ID NO: 220 - protein, 216 aa, Streptomyces SMCD2215
MAQQDTDQQHVGVLPVDDEGFVIDTQETEEREAAWRERGTSRPITVVGNPVLHKECKDVTEFGPELEQLVADMFASQRTAEGVGLAANQIGVDLKVFVYDCGDDEGARHVGVVCNPKLVDLPAERRRLDDSNEGCLSVPTAYAPLARPDYAEVTGQDEKGNPIKVRGTGYFARCLQHETDHLYGYLYIDRLSKRERKDALRQMAENEPRYPVVAND

SEQ ID NO: 221 - protein, 282 aa, Streptomyces SMCD2215
MGSTICPSRSSSADLDWTVLTAAKTTPIRGAAGTGRRLSSDSGGSGFGPARNLEEVGPVTGTDAGTDNGQAEQPEGQGISAESTSQRSARFERDALEFLDQMYSAALRMTRNPADAEDLVQETYAKAYASFHQFREGTNLKAWLYRILTNTFINSYRKKQREPQRSAAEEIEDWQLARAESHMSTGLRSAESQALDHLPDSDVKAALQAIPEEFRIAVYLADVEGFAYKEIADIMGTPIGTVMSRLHRGRRQLRGMLEDYARERGLVPAGAGESNEAKGSGS

SEQ ID NO: 222 - protein, 988 aa, Streptomyces SMCD2215
MAFQMPDRGGGPTGPRIRVGRPSRRVRTLLMTLGVLAVLGMAFTMFAGFWTDWLWYRSVKYSSVFTTTLWTKIGLFFVFGLLMALAVGFNIWLAHRLRPPLSAMSMEQQSLDRYRMGIAPYKTWLLLGITALVGLIAGASASSQWRTWLMWVNGVPFHQKDPQFHLDVSFYAFDLPWYRFLLGFGFAAAILSLIAAALTHYLYGGLRITSPGARATASATGHLSVLLGFFVALKAVAYWLDRYGLAVKSSDFKATDNWTGLRYVDANAYLPAKTILFCIAVICALLFFATLWRRTWQLPVIGFGLMVLSAILIGGLYPAIVQKFQVQPNEQAKEAPYVQKNLKATREAYGIDGAKVSDYSGTSKTKDKSTLRDDVDPTASIRILDPNIVSPTFQQLQQIRNYYAFPTNLDVDRYSKDGKDQDTVIGLRELNLNGIPKNNWINDHFRYTHGYGVVAAKGTAADANGQPVFTEYDLPSRGALGSYEQQVYYGEKTTTYSIVGGPQKEIDYSDDSGEKTTSYKGKSGVNLANPINRAAYAVAFNEPQILYSGAIGKGSRILYNRTPKERVEAVAPWLTIDGDAYPAVVNHRIQWIVDAYTTTNGYPYASRTTLGDTTADSLTATNNSRAVVAQQNQVNYIRNSVKATVDAYTGEVKLYQWDTKDPVLKTWMKAFPHTVKPRSAISPDLMAHLRYPQDLFKVQRELLTRYHVTNPTTFLSGSEVWQVPSDPTNKSGNAVPPYYLSMKMPDQSSQAFSLTTTFTPNGRDNLSAFMTIDAEAGSSDYGKIRILKLPTSTTVDGPKQVQSQFNSEQDIAESIKLLKGGDSDIEYGNLLTVPLDGGLLYVEPVYVRGGGLKYPLLRKVLVSYGDKTAFEDTLDEALNKVFGAESSTKPPADQGTTKPPTSTNPTVQDALNDAQKAFDAGQEALKKNDWQAYGEAQKDLEAALKRAEAAQSKADKTAGSGGSGKPGGKASSSPSKQPSSSPSTKPSG

SEQ ID NO: 223 - protein, 562 aa, Streptomyces SMCD2215
MAREFQRGHKAKISDLTAGTDLYVGVQISGPGLTFDISCFGLDADERLSDDRYFVFFNQPKSPEESIQLLGEQAGDTQSFRVTLDRIPAQIQKLSFTATLDGAGQMSQIAPGYLRIVAGGEEVARYAFDGSEFTTERAVMLGDFYLKDVWRFAAVGQGFDGGLEALLKNFGGEVMEEEQPAAPAPQQPQQTGATPGFAPPAFAAPAAPAPAPAPAPAPAPQGFAPPPGQTPPPAPAPAPAPNVHAAPTVIAPMTPPGGAPVPPPGPVPVPYGQPPQQQSYGGPGAPTAPPPPGYGQPQAPQAPTPPPGYGQPTPPPGYGQQPPMGQVPAQQGYGVPQGAPQGGAGVAAALQQFKETPTGQRWTQQNKKLVRVDLGIGGHPVLARQGSMVLYQGKVDFSYKGAGFAGRIVGNATGQEMQLMRCTGQGQVFLAENSTHLHPIELQGDAICVSAENVLAFDEGLQYEVRRIEGHGIPGGALFTMQFQGTGTIVVKTHGTPVVLPVTPTTFADCNAVVAWSAAAQVIVSSQVRMRRNAYPGDTGESVNLQFRAAPGNFVVVQPYEV

SEQ ID NO: 224 - protein, 75 aa, Streptomyces SMCD2215
MEVKIGVQHAPREIVLESGQSAEEVERVVADALAGKTQLLTLVDEHGRKVLVPADRLAYVELGEPAPRKVGFGAL

SEQ ID NO: 225 - protein, 285 aa, Streptomyces SMCD2215
MRIDLHAHSTASDGTDTPAELVRNAAAAGLDVVALTDHDTTRGYAEAIAALPEGLTLVTGAELSCRIGGISMHLLAYLFDPEEPALLAERELVRDDRVPRAQGMVAKLNALGVPVTWEQVRRIAGEGSVGRPHVATALVELGVVASVNDAFTQDWLADGGRAYVEKHETDPFEAIRLVKAAGGVTVFAHPAAAKRGRTVPESAIAEMATAGLDGIEVDHMDHDEDTRARLRGLAKDLGLLTTGSSDYHGSRKTCVLGEYVTDPEVYGEITRRATGAFPVPGTGGA

SEQ ID NO: 226 - protein, 377 aa, Streptomyces SMCD2215
MASEDAVREALATVNDPEINRPITELGMVKSVDIGADGTVAVTVYLTVSGCPMRETITQRVTDAVSAVEGVTRVDVTLDVMSDEQRKELATALRGGQTEREVPFAKPGSLTRVYAVASGKGGVGKSSVTVNLAAAMAADGLKVGVVDADIYGHSVPRMLGADGRPTQVENMIMPPSANGVKVISIGMFTPGNAPVVWRGPMLHRALQQFLADVYWGDLDVLLLDLPPGTGDIAISVAQLVPNAEILVVTTPQQAAAEVAERAGSIAVQTHQKIVGVVENMSGLPCPHCGEMVDVFGTGGGQSVADGLTRTTGTTVPVLGSIPIDVRLREGGDEGKPVVLSDPDSPAGAALRGIAGKLGGRQRGLSGLSLGITPKNKF

SEQ ID NO: 227 - protein, 267 aa, Streptomyces SMCD2215
MADTVLYEVSDGLATITLNRPEAMNALNVATKVALREAVSSAAGDDAVRAVLLTAAGDRAFCVGQDLKEHIGLLMQDRETGSGQTMSTVKEHYNPIVRAIAGMPKPVVAGVNGVAAGAGFGFALAADYRVVADTAAFNTSFAGVALTADSGISWTLPRVVGPGRATDLLLFPRSIKAQEAYDLGIASRLVPAGELRAEAEKVARALAEGPTVAYAAIKEAVAHGLSHSLSETLDKEDELQTRAGSSEDHAIAVQAFVNKEKPKYLGR

SEQ ID NO: 228 - protein, 193 aa, Streptomyces SMCD2215
MSDGTAIAGPDGGLRCPWALSTEDYVAYHDEEWGRPVHGDDALFERLSLEAFQSGLSWITILRRRPGFRAAFAEFRIAKVAAFTDEDRERLLLDAGIIRNRAKIDATLANARVLAEWAPGELDELIWSHAPAPGRPAPKALGDVPAVTPESTALSKALKKRGLRFVGPTTAYALMQACGLVDDHLEACVARRS

SEQ ID NO: 229 - protein, 359 aa, Streptomyces SMCD2215
MADTPLDLTLDAAELTARLVDFPSESGTEKPLADAIEAALRALPHLRVERLGNNVVARTELGRPERVILAGHIDTVPIADNVPSRLDEDGVLWGCGTCDMKSGVAVQLRIAATVVAPNRDLTFVFYDNEEVAAELNGLKHVAEARPDWLRGDFAVLLEPSDGEVEGGCQGTLRVLLRTTGERAHSARSWMGSNAIHAAAPILARLAAYEPRCPVIDGLEYREGLNAVGITGGVAGNVIPDECVVTVNFRYAPDRTEEEALAHVREVFADCQVAEFVVDDHSGAALPGLSHPAAAAFIEAVGGTPQPKYGWTDVSRFSSLGIPAVNYGPGNPHLAHKRDERVETAKILAAEERLRSWLTR

SEQ ID NO: 230 - protein, 363 aa, Streptomyces SMCD2215
MSAVSDRLPTFPWDKLEPYKKTAAAHPDGIVDLSVGTPVDPVPELVQKALIDAADSPGYPTVWGTPALRDAIAGWVERRLGAREVTHKHVLPVVGSKELVAWLPTQLGLGPGDRVAYPRLAYPTYEVGARLARAEYEAYDDPTELDPEGLKLLWLNSPSNPTGEVLPKQELTRIVAWAREHGVLVFSDECYLELGWEADPVSVLHPDVNGGSYEGIVAVHSLSKRSNLAGYRAAFLAGDPAVLGPLLEIRKHGGMMTPAPTQAAVVAALSDDGHVREQRERYAARRTALRAALERHGFRIEHSEASLYLWATRDESCWDTVAHLAGLGILVAPGDFYGPAGDRFVRVALTATDERVRAAVERL

SEQ ID NO: 231 - protein, 324 aa, Streptomyces SMCD2215
MLLEVRDLQVEFRTRDGIAKAVNGVSYSVDAGETLAVLGESGSGKSVTAQAVMGILDIPPGKITGGEILFRGQDLLKFKEDERRKVRGAEMAMIFQDALSSLNPVLSVGDQLGEMFLVHRGMSKKDARAKAVELMDRVRIPAAKERVKDYPHQFSGGMRQRIMIAMALALEPALIIADEPTTALDVTVQAQVMDLLAELQREYNMGLILITHDLGVVADVADKIAVMYAGRIVESAPVHDIYKAPAHPYTRGLLESIPRLDQKGQELYAIKGLPPNLMNIPPGCAFNPRCPMAQDVCRTDVPPLFEVDEVRRSACHFWRECLHG

SEQ ID NO: 232 - protein, 415 aa, Streptomyces SMCD2215
MTSVVSGGRYPRGMALNTSAQTPLPVGEVSRLIGGWIDRLGAVWVEGQITQLSRRPGAGVVFLTLRDPSHDISISVTCYRQVFDAVADVVSEGARVVVHAKPEWYAPRGQLSLRATEIRPVGIGELLARLEQLKKSLAAEGLFAPERKKALPFLPQLIGLVCGRASAAERDVLENARHRWPAVRFEVRNVAVQGVHAVPQVVQAVKELDELGEVDVIIVARGGGSVEDLLPFSDEQLVRAVAECRTPVVSAIGHEPDNPLLDHVADLRASTPTDAAKKVVPDVGEEYERVRLLRDRARRCVEALVEREERGLAHALARPSIEDPHRMIDERADHVASLTDRSRRTLRHLLDRADSELTHTHARVVALSPAATLKRGYAVLQKEDGHAVRDPAEVTAQETLRARVPEGEFSVRVDA

SEQ ID NO: 233 - protein, 554 aa, Streptomyces SMCD2215
MPEFAYTDLLPMGEDTTTYRLVTSEGVSTFEADGRTFLKVEPEALRKLAEEAIHDIQHYLRPAHLSQLRRIIDDPEASANDKFVALDLLKNANIAAAGVLPMCQDTGTAIVMGKRGQNVLTRGGDEEALSRGIYDAYHNLNLRYSQMAPLTMWEEKNTGSNLPAQIELYATDGGAYKFLFMAKGGGSANKSFLYQETKAVLNEGSMMKFLEEKIRSLGTAACPPYHLAIVVGGTSAEYALKTAKYASAHYLDEIPAEGSELGHGFRDKELEQKVFELTQKIGIGAQFGGKYFCHDVRVVRLPRHGASCPVAIAVSCSADRQALAKITPEGVFLEQLETDPARFLPETTDEHLDESDVVRIDLNQPMDAILAELTKYPVKTRLSLTGPLVVARDIAHAKIKERLDAGEEMPQYLKDHPVYYAGPAKTPEGYASGSFGPTTAGRMDSYVEQFQAAGGSKVMLAKGNRSKQVTDACDAHGGFYLGSIGGPAARLAQDCIKKVEVVEYEELGMEAVWKIEVEDFPAFIVVDDKGNDFFQDPAPQPTFTTIPVRGPGLA

SEQ ID NO: 234 - protein, 466 aa, Streptomyces SMCD2215
MCAGDHERVEWMERTNPEETGERRLMEHAHPAAPGNRTVPAAAARAMTTFSAADEEKQRGVRRMKLTATGLLLFVALVYVLAKWADNSGAGAWAGYVAAASEAGMVGALADWFAVTALFRHPLGLPIPHTAIIPTKKDQLGISLGEFVGENFLSRDVVRQRLRAVGIGSRLGAWLAEPEHADRVTAELSAALRGALTVLRDSDVQAVVGEAITRRADAQEIAPGIGKMLEKVVADGGHNRVVDLIVTRAHDWLVWHDTEIMDAVQGGAPGWTPRFVDRKVGERVYRELLRFVTEMRDMPTHPARGALDRFLTDFASDLQSDTDTRARVERLKGEVLGRGEVQDLIASAWTAVRSMIVSAAEDERSELRLRVRASLLSLGSRMAVDPKVQSKVDGWVESAAVYVVSTYRKEITSLITDTVASWDAEHTTRKIEAHIGRDLQFIRINGTVVGSLAGLLIYVVTRVLGA

SEQ ID NO: 235 - protein, 112 aa, Streptomyces SMCD2215
MAHTSDTPDTRTPAQIEADIKSRRAVLAETLDEIGVRVHPKTIVGDARAKIASNVDHTLGRAYVGVNKVVSDVKGKFVDEDGSPRLERIVPVAVVAVGLVGLLALGTRRRKS

SEQ ID NO: 236 - protein, 200 aa, Streptomyces SMCD2215
MTRLILATRNAGKITELRAILADAGLSHELVGAEAYPDIPDVKETGVTFAENALLKAHALAQATGLPAVADDSGLCVDVLGGAPGIFSARWAGRHGDDQANLDLLLAQLSDITDEHRGAHFACAAALALPDGTERVVEGQLRGTLRHTPEGTGGFGYDPILQPDGDTRTCAELTPAEKNAISHRGEAFRALVPVVRELLG

SEQ ID NO: 237 - protein, 245 aa, Streptomyces SMCD2215
MSRIDGRTPDQLRPVTIERGWSKHAEGSVLVSFGDTKVLCTASVTEGVPRWRKGSGEGWVTAEYAMLPRATNTRGDRESVKGRIGGRTHEISRLIGRSLRAVVDYKALGENTIVLDCDVLQADGGTRTAAITGAYVALADAIAWAQGRKLIKAGRQPLTGTVSAVSVGIVGQVPLLDLCYEEDVRAETDMNVVCTGDGRFVEVQGTAEAEPFARDELNSLLDLAVSGCTELAVLQRKALDTVLEK

SEQ ID NO: 238 - protein, 381 aa, Streptomyces SMCD2215
MTQTTDHTPDTARQADPFPVKGMDAVVFAVGNAKQAAHYYSSAFGMRLVAYSGPENGSRETASYVLENGSARFVFTSVIKPATTWGHFLAQHVAEHGDGVVDLAIEVPDARAAYAYAVEHGARSLAEPYEMKDEHGTVVLAAIATYGETRHTLVDRSGYDGPYLPGFVAAAPIVQPPAHRTFQAVDHCVGNVELGRMNEWVGFYNKVMGFTNMKEFVGDDIATEYSALMSKVVADGTLKVKFPINEPAVAKKKSQIDEYLEFYGGAGVQHIALNTNDIVQTVRTMSAAGVEFLNTPDSYYDTLGEWAGETRVPVDTLRELKILVDRDEDGYLLQIFTKPVQDRPTVFFELIERHGSMGFGKGNFKALFEAIEREQEKRGNL

SEQ ID NO: 239 - protein, 470 aa, Streptomyces SMCD2215
MATAPSVSYSITVRLEVPASGTAVSQITTAVESHGGSVTGLDVTASGHEKLRIDVTIAASSTAHADEIVQQLRGIEGVTLGKVSDRTFLMHLGGKIEMQSKHPIRNRDDLSMVYTPGVARVCMAIAENPEDARRLTIKRNSVAVVTDGSAVLGLGNIGPKAALPVMEGKAALFKRFAGIDAWPICLDTQDSDAIVEIVKAIAPGFAGINLEDISAPRCFEIEARLREALDIPVFHDDQHGTAIVVLAALTNALRVTGKAIENIRVVMSGAGAAGTAILKLLLAAGVKNAVVADIHGVVHAGRDDLREAPADSPLRWIADNTNPEGLAGTLKEAVRGADVFIGVSAPNVLDGEDVAAMADGAIVFALANPDPEVDPAIARQTAAVVATGRSDFPNQINNVLVFPGVFRGLLDAQSRTVNTDMMLAAATALADVVTEDELNPNYIIPSVFNDKVAGAVAGAVRDAAKAVAGS

SEQ ID NO: 240 - protein, 691 aa, Streptomyces SMCD2215
MSTQTPDSFEWTELDRRAVDTARILAADAVQKVGNGHPGTAMSLAPAAYTIFQKAMRHDPADPEWTGRDRFVLSPGHTSLTLYTQLYLAGYEVTLDDLKAFRAHGSKTPGHPEYGHTAGVETTTGPLGQGVANAVGMAMAARYERGLFDPEAPEGTSPFDHTVWAIVSDGDLEEGVSSEASSMAGHQRLGNLVFLYDDNHISIEGDTATAFSEDVLGRYEAYGWHVQRVEPALGGDIDVPALYAALKAAQAETSRPSIIAMRTIIAWPAPNAQNTEAAHGSALGDDEIAATKRILGFDPERSFQVDADVLAHAQQALDRGAEAHAAWDKQLDKWRGANPERAELFDRIVAGRLPEGWESALPVFEEGTSVATRAASGKVLQALGPVLPELWGGSADLAGSNNTTIDKTSSFLPEGNALPGADPYGRTVHFGIREFSMAAEMNGIALHGNTRIYGGTFLVFSDYMRNAVRMSALMQLPVTYVWTHDSIGLGEDGPTHQPVEHLAALRAIPGLNVVRPADANETAIAWAEILRRHSTKPAPHGLALTRQGVPAYAPNPDAAKGGYVLKESSTPTPDVILIATGSEVQLAVAAREQLEAEGVGTRVVSMPSVEWFEEQPREYRESVLPPSVRARVAVEAGIGLTWYRFTGDAGRIVSLEHFGASADAKTLFAEFGFTPENVAAAARESLTAARG

SEQ ID NO: 241 - protein, 390 aa, Streptomyces SMCD2215
MIKVTEATATAGALERLSDEGVSIWLDDLSRSRIESGNLAALVEKSNVVGVTTNPSIFQAAIGSGEGYEEQLADLAVRGVTVDEAVRMTTTADVRAAADILRPVYDRTGGRDGRVSIEVDPRLAHNTVATVAEAKQLAWLVDRPNVMIKIPATKAGLPAITEVIGLGISVNVTLIFSLERYREVMAAYLAGLEKAAAKGLDLSVIHSVASFFVSRVDAEIDKRLTVLGTDEALALKGRAALANARLAYEAYEEVFGSVDGSTRAASARWTALAAAQANPQRPLWASTGVKDPAYKDTLYVDELVAPGTVNTMPQATLEATADHGGITGDTVTGGYGEARADLAAVEALGISYDEVVQQLEDEGVAKFESAWQDLLNAVTKSLDSKGVETK

SEQ ID NO: 242 - protein, 412 aa, Streptomyces SMCD2215
  misc_feature (9)..(11): Xaa can be any naturally occurring amino acid
  misc_feature (163)..(163): Xaa can be any naturally occurring amino acid
MCTPSSTRXXXNVVNIGIGGSDLGPAMAYEALRTFAARELTFRFVSNVDGADLHEATRDLDPAETLFIVASKTFTTIETITNATAARSWLLAGLGGEEKAVARHFVALSTNAGKVTEFGIDPDNMFEFWDWVGGRYSYDSAIGLSLMIAIGPDRFREMLDGFXIVDEHFKNAPAEANAPLILGLLGIWYGNFFGAETHAVLPYSHYLSKFTAYLQQLDMESNGKSVDRDGQVVGWETGPVVWGTPGTNGQHAYYQLIHQGTRLIPADLIGFARPADELSDELKAQHDLLMANLFAQGQALAFGKTAEEVRAEGVPEEQVPHRTFLGNHPTTTILARELTPSVLGQLIALYEHKVFVQGAVWNIDSFDQWGVELGKVLAKRVEPALTEGTEVPGLDPSTRALVAAYRELKEVN

SEQ ID NO: 243 - protein, 151 aa, Streptomyces SMCD2215
MALWDRIRESASTMQTQLVAKKNDLKSGAFRDASMAMCALVAAADGTIDPAERQRVAQLISTNEVLQNFPADDLRRRFEENLNKLTADFAFGKVSVLQEIAKAKKKPAEARAVIQIGIVIGGADGDFDKTEQAIVREACFTLDLPPHEFDL

SEQ ID NO: 244 - protein, 346 aa, Streptomyces SMCD2215
MSRTSHTDPELTHRLTRRGMLGVAAGATAAALLGTATPATAAPATAAGTSAHGRGRPLLPPGRLGVQLYSLRDKVASLGFAPVFAELEKYGYDEIEFAGYTQGTGPITLAQLKRLARNHGLNPIGSHVGYFSSDPNAYTFAQNLTQVLDDAEALGLKHIGTASGPNRYGNTVDAWKRAAEEFNTYGAAAKKRGMKFYQHNHSDEFAFATDDPKVRLYDVLLAETDPGLVYLEMDIFWAYAGQFRFSKRPDGSPAPFEPLDYVLKQPHRYPLFHVKDGVSDPDNEFGYRMVDVGDGDIDYQRFISAVTRLRGERLAHHWQTEHDQPTESFTFARRSSAYLHSLREKC

SEQ ID NO: 245 - protein, 144 aa, Streptomyces SMCD2215
MTVVPAQQSGGGGGSSGLYDVLELVLDRGLVIDAFIRVSLVGIEILKIDVRVVVASVDTYLRFAEACNRLDLESGSNKSPGLPEIVGEVTESGARGKSKGALSGAAETISDAFKQSREEGREKETESRPRARKSTASRRKEEQE

SEQ ID NO: 246 - protein, 594 aa, Streptomyces SMCD2215
MSRRVPRSRAARGPALAVALCAALTAPLAVTAPAASAGQYSVTALKFTVEAGGRTCAVDADLYRPAGVDPTHPAPAVVATNGFGGSKSDGSTDAIGKAFAERGYVSLIYSGLGFGKSGCLISLDDPGIDGTAAARLIDFLGGKRAADDGTRADFVTLDGPGDPRVGMIGGSYGGAIQLATAAVDHRVDALVPLITWNDLAYSLDPNNASSAVPGAFKWQWSNGFYLIGEGQPLTAPNLDPSRINSLACLHFVTKACETMRLLNSGSYRSAPTAAMLAYAHSVSPRSYLSRVKAPTLLIQGQADTLFNLNEATATYNTLKAQGTTTKMIWQSWGHSGGMTDPASGELNLTQGNLETSYVGRRILAWFDRYLHRRSTDTGPAFAYYRDWITDTARTYATSAQLPSLTRTLYLSGDGKLVDDRDKVARGSRTYTNHLIPTSHSENMLAGIAGLPDPAPYDTAGTYLGWTGAPLARATDVVGSPRATLRVVSPAAARVQRSGDAADRLVLFAKLYDIAPDGSRTLVHRLIAPVRVPDVTKSFTVTLPGIVHRFEKGHRLRFVIAASDDAYTGNRGIKPVTVVSAPGDTGLLKLPVLGD

SEQ ID NO: 247 - protein, 447 aa, Streptomyces SMCD2215
MTVKDILDAIQSPDSTPDDFAALPLPESYRAITVHKDETEMFAGIETRDKDPRKSLHLDEVALPELGPGEALVAVMASSVNYNSVWTSIFEPMSTFGFLERYGRLSELTRRHDLPYHIIGSDLAGVVLRTGPGVNAWNPGDEVVAHCLSVELESSDGHNDTMLDPEQRIWGFETNFGGLAEVALVKSNQLMPKPGHLSWEEAAAPGLVNSTAYRQLVSRNGAGMKQGDNVLIWGASGGLGSYATQFALAGGANPICVVSSPQKAEICRAMGAEAIIDRNAEGYKFWKDEHNQDPKEWKRFGKRIRELTGGEDVDIVFEHPGRETFGASVYVTRKGGTIVTCASTSGYNHEYDNRYLWMSLKRIIGSHFANYREAWEANRLVAKGKIHPTLSKVYSLEETGQAAYDVHRNLHQGKVGVLCLAPEEGLGVRDEEMRARHIDAINRFRNI

SEQ ID NO: 248 - protein, 469 aa, Streptomyces SMCD2215
MLDAVVVGAGPNGLTAAVELARRGFSVAVFEARDTVGGGARTEELTLPGFRHDPCSAAHPLGINSPAFRALPLERYGLEWLHPRLPMAHPFTDGTAAVLSRSVAETAASFGPRDAGAYRRLVEPFLPKWDTLVRDFMSLPGTALPRDPVTLARFGLVGLPPSAWLTRRFHDEPAKTLFAGLVAHVMAPLTGLATGAIGLVFALAAHARGWPVARGGSQSISDALTAYLKDLGGLVHTDYEVKRLDDLPPARAYVFDTSPTALARIAGLGNYYEGYRYGPGIFKIDYALDGPVPWTAEEARGAGTVQIGADSAEIGTALHEASRAGRAPERPFMITVQPGVVDPSRAPDGKHVFWAYGHVPSGWTGDLTDAMERQLERFAPGFRDRVIARATAGPPEIAARNHNYIGGDIASGAVSGLQVLLRPKLTLSPYSTPHPAVFLCSSATPPGPGVHGMSGHNAAKAVWRRLRQT

SEQ ID NO: 249 - protein, 609 aa, Streptomyces SMCD2215
MPFTTRPTLQGTFGMVSSTHWLASQSAMAVLEDRGNAYDAAVAGAFVLHVVEPHLNGPAGEVPILLAPADGEVRVLCGQGVAPAGATVAHYRSLGLDLVPGTGPLAAAVPGAFDAWMVLLRDHGTKPLADLLKYAVGYAEHGHAPVENVGATVETVRELFETEWTSSADVYLPGGKAPRPGELLCNPALAATWKRLLAEVAGAGDRVAQIEAAREVWRSGFIAEALVRQAQRPTMDTSGERHSGTLTAADLAGWSATYEAPATYDWNGWTVCKAGPWSQGPAFLQQLALLPPELPAYGSADYVHLLIEGCKLAMADREAWYGDAAAVPLSDLLSPHYNAARRHLVGAKASYDLRPGGPGGRTPRLSAHAHTVVGDEPGFSPMGVGEPTVAKPTVSPVPGEPPVAADGTTRGDTCHLDVVDRWGNMVAATPSGGWLQSNPVVPELGFPLGTRLQMTWLEEGLPNALTPGRRPRTTLTPSIALRDGVPVMAFGTPGGDQQDQWQLHFFLAVALRAQVRGGLDLQGAIDAPNWHNDSFPGSFYPRGMRPGSVTVESRMDPEVVEELRRRGHDVTVGDAWSEGRLCAVARDPETGVLSAAANPRGMQGYAVGR

SEQ ID NO: 250 - protein, 467 aa, Streptomyces SMCD2215
MSSRTVIRGGLVITASDEIHADVLIEDGRIAALAASGTPAAEAFTAESVIDATGKYVIPGGVDGHTHMEMPFGGTYASDTFETGTRAAAWGGTTTIVDFAIQTVGQSLREGLDAWHAKAEGNCAIDYGFHMIVSDVRQETLKEMDLLVQEGVTSFKQFMAYPGVFYSDDGQILRAMQRAAENGGLIMMHAENGIAIDVLVEQALARGETDPRYHGEVRKALLEAEATHRAIRLAQVAGAPLYVVHVSAIEAVAELARARDEGLPVFGETCPQYLFLSTDNLAEPDFEGAKYVCSTPLRPKEHQAALWRGLRTNDLQVVSTDHCPFCFVGQKELGRGDFSKIPNGMPGVENRMDLLHQAVVEGHISRRRWIEIACATPARMFGMYPKKGTIAPGADADVVVYDPQAEQVISAETHHMNVDYSAYEGRRTTGRVETVLSRGEVVINEREYTGRAGHGVYTPRSTCQYLN

SEQ ID NO: 251 - protein, 427 aa, Streptomyces SMCD2215
MSDLYARHRSVLPDWLALYYEDPLEITHGEGRHVWDADGNKYLDFFGGILTTMTAHALPEVTKAMTEQAGRILHSSTLYLNRPMVELAERIAQLSGIPDARVFFTTSGTEANDTALLLATAYRRSNTLLAMRNSYHGRSFSAVGITGNRGWSPTSLSPLQTLYVHGGVRTRGPYASLGDEEFIAACVEDLKDLLGHTRAPAALIAEPIQGVGGFTSPPDGLYAAFREVLAERGILWIADEVQTGWGRTGDHFWGWQAHGQNGPPDLLTFAKGIGNGSSIGGVVARAEIMNCLDSNSISTFGGTQITMAAGLANLAYLLEHDLQGNARRVGGLLIERLRAVAAQVPHVREVRGRGLMVGVELVKPGTDEADPDAASAVLEATRAEGLLIGKGGGHNTSALRIAPPLSLTVAEAEEGAAILERALRSLS

SEQ ID NO: 252 - protein, 604 aa, Streptomyces SMCD2215
MRRPVARKLSVLAVSAAVVSVGAAAPPSAPASSTPTKVPVAVGYGGAVSSVDADASAAGIEVLKKGGNAVDAAVATAAALGVTEPYSSGIGGGGFFVYYDAKSRTVHTIDGRETAPLSADSNLFVEHGKPLSFADAVSSGLSVGTPGSPATWQTALDQWGSRRLGTVLEPAERIARHGFTVDDTFRSQTASNETRFRYFPDTAKLFLPGGRLPEVGSTFKNPELARTYQELAKKGVGAIYHGDLGRDIVRTVNKPPVDPSSGWNARPGKLSQKDLAVYRAKLQAPTKTSYRGLGVYSIAPSSSGGTTVGEALNIMEKTDLSKASEAQYLHHYIEASRIAFADRGRWVGDPAFEDVPTKDLLSQRFADSRACLIKDDAVLTSPLAPGDPRHPAPCASGGTAAPTTYEGQNTTHLTVADKWGNVVSYTLTIEQTGGSAMTVPGRGFLLNNELTDFSFTPANPAVHDPNLPGPGKRPRSSISPTIVLDRHNKPVVALGSPGGATIITTVLQTLTEFLDRGLPLVDAIAAPRVSQRNAATTEMEPALYNDTSPSGLRAQLEGIGHSFTLNPEIGAATGVQRLPGGKWLAAAETVRRGGGSAQVVEPAP

SEQ ID NO: 253 - protein, 254 aa, Streptomyces SMCD2215
MPKPEVDPTVSLELSVDRSSPVPLYFQLSQQLEAAIEHGALTPGSLLGNEIELAARLGLSRPTVRQAIQSLVDKGLLVRRRGVGTQVVHSQVKRPLELSSLYDDLEAAGQRPATKVLVNTVVAATAEVAAALNVAEGSDVHRVERLRLAHGEPMAYLCNFIPPGLLDLDTEQLEATGLYRMMRSAGITLHSARQTIGARAATAAEAERLAEPEGAPLLTMQRVTFDDTGRAVEYGTHTYRPSRYSFEFQLLVRP

SEQ ID NO: 254 - protein, 371 aa, Streptomyces SMCD2215
MTAIPSFTGDANPYGGGDPYADYRTADFPFTQYANLADRQLGASVIAANDEFFAQRENLLVPEPAAFDPEHFGHKGKIMDGWETRRRRGAGADHPWPTADDHDWALVRLGAPGVIRGIVVDTAHFRGNYPQAVSVEATSVPGSPSPEELLGDDVKWTTLVPRTPVGGHAANGFAVSVEQRFTHLRVNQHPDGGIARLRVYGEVVPDPTWLATLGTFDVAALENGARVEDASNLFYSPATNTIQPGRSRKMDDGWETRRRRDRGNDWIRYRLAAQSRIRAIEIDTAYLKGNSAGWASVSVKDGESGEWHEILPRTRLQPDTNHRFVLPAEAVGTHARVDIFPDGGISRLRLYGSLTETGASALVARHQELGG

SEQ ID NO: 255 - protein, 446 aa, Streptomyces SMCD2215
MSDVELVLRSTRVITPEGTRAASVAVAGGTIAAVLPYEADVPASARLEDLGDDVLLPGLVDTHVHVNDPGRTEWEGFWTATRAAAAGGITTLVDMPLNSLPPTTTVDHLRTKQEVAADKAHIDVGFWGGALPDNTKDLRPLHEAGVFGFKAFLSPSGVDEFPHLDQDRLARSLAEISSFGGLLIVHAEDPHHLAAAPQHGGPKYADFLASRPRDAEDTAIAQLIAQAKRFDARVHILHLSSSDALPLIAQAKAEGVRLTVETCPHYLTLTAEEVPDGASEFKCCPPIREAANQDLLWRALADGTVDCVVTDHSPSTADLKTDDFATAWGGISGLQLSLAAVWTEARKRGHGLEDVVRWMSSRTAALVGLDARKGAIAAGRDADFAVLAPDETFTVDPAALHHRNRVTAYAGKTLHGVVRSTWLRGERIAADGEFGEPRGRLLTRNP

SEQ ID NO: 256 - protein, 541 aa, Streptomyces SMCD2215
MSAPAPSPLAIVDAEPLPRQAEVLTEAALAFVAELHRRFTPRRDELLARRAQRRTEIARTSTLDFLPETADVRADDSWRVAPCPEALNDRRVEITGPTDRKMTINALNSGAKVWLADFEDASAPTWENVVTGQANLIDAYTRSIDFTDPASGKSYALRPDEELATVVTRPRGWHLNERHLVDADGIQVPGALVDFGLYFFHNAKRLLEMGKGPYFYLPKTESHLEARLWNEVFVFAQDYVGIPQGTIRATVLIETITAAYEMEEILYELRDHASGLNAGRWDYLFSIVKNFRDGGAKFVLPDRNAVTMTAPFMRAYTELLVRTCHKRGAHAIGGMAAFIPSRRDAEVNKVAFEKVRADKDREANDGFDGSWVAHPDLVPIAMESFDKVLGDRPNQKDRLREDVHVEAADLIAIDSLEAKPTYAGLVNAVQVGTRYIEAWLRGMGAVAIFNLMEDAATAEISRSQIWQWINAGVEFENGEKATPALARKVAAEELANIRAEIGEEAFAAGHWQQAHDLLLTVALDEDYADFLTLPAYEQLRG

SEQ ID NO: 257 - protein, 411 aa, Streptomyces SMCD2215
MCALLATLAAGLAFPAAARAGEPTGGATPKVDLVLDVSGSMRARDIDGGSRMAAAKQAFNEVLDATPEDVQLGIRTLGANYPGDDRRTGCKDTAQLYPVSTLDRTDAKAAVATLSPTGWTPIGPALLKAADDLGTGAGSKRIVLISDGEDTCAPLDPCEVAREIAAKGIGMTIDTLGLVPNTKLRKQLSCIAEATGGTYTSVEHTDELTDRVNQLVDRAADPVVTPVATEGAGQCTDAPTLKSGLYTDREEFGQQRWYKVDVPPGQELRASVSVAADRSVNPDYGVLLRAVTVHGREIVRGEAAGDGRTDVVSTGLRYPKAESDDEDAPAEVVCLQVTNSFSAASGVKTTPGLPVELTVDVVGGPSQADDVASFGLGRGWWLLGVVVLAGFLAGLVWGWVSRWRVAVWRTN

SEQ ID NO: 258 - protein, 133 aa, Streptomyces SMCD2215
MSTGTTASVSTHILDTSVGRPAAGVAVHLAARTGREADWQALGGSATDADGRCKDLPALPEGTTHVRLDFDTETYFAKKQAAAQQDAPALRDSENGRPVFFPEVTIAFAVVPGEHYHVPLLLNPFGYSVYRGS

SEQ ID NO: 259 - protein, 794 aa, Streptomyces SMCD2215
MTADEAPTRITQGSQAQGGIGESTLRPDGTLKVTGEFAYSSDMWHEDMLWGQILRSTVAHAEIVSIDTGEALATPGVHAVMTYDDLPTEVRHYGLEIRDTPVLAHGKVRHHGEPVALVAADHPETARRAAAKIKVEYRELPLITDEASATAPDAVLVHENRHDHHAGHVPHPNIVHRQPIVRGDATAAAQRADVIVTGDYTFGMQDQAFLGPESGLAVPEEDGGVHLYIATQWLHSDLRQMAPVLGLPEDKVRMTLSGVGGAFGGREDLSMQIHACLLALRTGRPVKIVYNRFESFFGHVHRHPATLHYEHGATRDGKLTHMKCRIVLDGGAYASASPAVVGNAASLSAGPYVIDDVDIEALALYTNNPPCGAMRGFGAVQACFAYEAQMDKLARELGLDPVEFRQLNAMEQGTLMPTGQPVDSPAPVAELLRRVKAMPMPPERQWESSEGADVRQLPGGLSNTTHGEDVVRGVGYAVGIKNVGFSEGFDDYSTARVRMEVVGGEPVATVHTAMAEVGQGGVTVHAQIARTELGVAQVTIRPADTQVGSAGSTSASRQTYVTGGAVKNACELVRERVLEIGRRKFGSYHPAWATAELRLEGGKVVTDGGEVLADLVDVLEGEAVEVEQEWRHRPTEPFDLRTGQGNGHVQYSFAAHRAVVEVDTALGLVKVIELACAQDVGKALNPLSVLGQIQGGTVQGLGMAVMEEIVVDPATAKVNNPSFTDYLIPTILDTPTIPVDVLELADDHAPYGLRGVGEAPTLSSTPAVLAAIRDATGLELNRTPVRPEHLTGTV

SEQ ID NO: 260 - protein, 164 aa, Streptomyces SMCD2215
MRVNVTVNGRPQQADDVWEGESLLYVLRERLGLPGSKNACEQGECGSCTVRLDGVPVCSCLVAAGQAEGREVVTVEGLAQLAGRRTEDGELAPVQQAFIDAGAVQCGFCTPGLLVAADEMLERNPNPSDEDIREALSGNLCRCTGYEKIMDAVRLAAARQQEAV

SEQ ID NO: 261 - protein, 296 aa, Streptomyces SMCD2215
MDFLRPASWQEALAAKAEHPAAVPIAGGTDVMVEINFDHRRPEHLLDLTRIADLYEWEVGERSVRLGASVPYTKIMENLRAELPGLALASHTVASPQIRNRGGVGGNLGTASPAGDAHPALLAAGAEVEVESVRGSRRIPIDAFFTGVKRNALAADELIKWVHIEKADGPQQFSKVGTRNAMVIAVCAFGLALHPATRTVRTGIGSAAPTPVRAGAAEEFLNAALDEGGFWDNGRIVPPSVVKQFAQLCSGACNPIDDVRGTAAYRRHAVGVMARRTLTWTWESYRGARRLTEGAA

SEQ ID NO: 262 - protein, 1781 aa, Streptomyces SMCD2215
MIPRARRVAAVTVVALAAALIQPLAAQAAAPPAPPSDAKLAAAPARHDDTREQFYFVMPDRFANGDTGNDEGGLTGSRMSTGYDPTDKGFYQGGDLKGLTQKLDYIKGLGTTAIWMAPIFKNRPVQGTGANASAGYHGYWITDFTQVDPHFGTNKDLATLISKAHAKGMKVFFDVITNHTADVVDYQEKSYDYLSKGAFPYLTKDGRPFDDADYADGTKQFPSVGTGSFPRTPTVTAADKKAKVPAWLNDPTMYHNRGDSTFAGESGTYGDFGGLDDLWTERPEVVSGMEKIYERWVRDFGIDGFRIDTVKNVDMDFWTQWATALDKYAAAHGRRNFFMFGEVYSADTSVTSPYVTQGRLDATLDFPFQDAARSYASQGGSAQKLASLFGDDYKYTTDKANAYEQVTFLGNHDMGRIGYFLDQDNPKATDAELLKKDELANELMFLSRGNPVVYYGDEQGFTGSGGDKDARQTMFASKVADYLDDDEIGTDRTHASDAYDPKAPLYRQISALGTLRRANPALTDGVQTERYAADGPGIYAFSRTDARTGQEYVVALNNAGETRTATFATGSAGMQFRGIYGTSDDVTSGADKKVTVSVPAQSAVVLKAAGRLAKPATKPTITLKAPDAGSTGTVELSAGVDGGGLNRVVFAAQVGNGKWRTLGSADHAPYKVTQTIGQDVPPGTALRYKAVVVDTAGRTASATAASTTGTPPAEEPPTASTRDYAVVHYKRSDGDYGGWQLTSGDTKAEFSGRDAYGAFAWVKVPAGAGEITYGIEKDGAADGPQRSIDLGRTGEVWVEQGKDGSTETKPDGAYPPQDTTKAVIHYHRADGNYDGWGLHVWTGAANPTDWTSPLKPVKIDSYGAVFEVPLTDGATSLSYIIHKGDEKDLSADQSLDLKASGHEVWLLNGQEKYLLPQPAGSAAALDLTTSKAVWIDRDTVAWNGSDGAASTQLLYSHDGSIAVKDGALTSDDERWLRLEKTTLTDAQKAKFPYLKDYTAFSVDPRDRDRVREALDGQIVASQRAANGAVLAATGVQIAGVLDDVYADATKTDLGPTFHQGRPTLSVWAPTAQSVSLELDGSLKPMKRDDTTGVWSVTGPTSWKNKPYRYVVKVWAPSVRKVVTNKVTDPYSVALTANSERSLVVDLDDNSLAPGGWSTLTKPKAVPLKDAQIQELHVRDFSVADKTVPAKDQGTYLAFTDKDSDGSKHLRELAKSGTSYVHLLPAFDIATIPEKKADQARPDCDLASYPADSDKQQECVAKTAAKDAYNWGYDPFHYTVPEGSYATDPDGTARTVQFRKMVKSLNEDGLRVVMDVVYNHTAAAGQADTSVLDKVVPGYYQRLLADGSVANSTCCANTATENAMMGKLVVDSVVTWAKEYKVDGFRFDLMGHQPKANILAVRRALDALTPAKDGVDGKKIIMYGEGWNFGEVADDARFVQATQKNMAGTGIATFSDRARDAVRGGSPFDEDPGVQGFASGLYTDPNSSSANGTSAEQKARLLHYQDLIKVGLTGNLAQYRFTDTGGKDVTGAEVDYNGQPAGYADAPGDAVAYTDAHDNESLFDALTYKLPKDTSAADRARMQVLAMATATLSQGPSLSQAGSDLLRSKSLDRNSFDSGDWFNAVHWNCADGNGFGRGLPMATDNESKWPYAKPLLTSVKVGCPQIEGASAAYQDLLRIRSTEKAFSLGTAAQVQSELSFPLSGKDETPGVITMRLGDLVVVFNATPDKQEQHVTSLSGTGYRLHPVQAAGTDAVVKSSSYDRASGTFSVPGRTVAVFTRTS

SEQ ID NO: 263 - protein, 538 aa, Streptomyces SMCD2215
MSTRTPDPKTVLLRRGEVHSPADPFATAMVVERGQVAWVGSEGAADAFADGVDEVVDLDGALVTPAFTDAHVHTTSTGLALTGLDLSDAPSLEAALARVRDFATARPRDKVLLGHGWDASRWPGGRPPTRAELDEATGGRPLYLSRIDVHSAVVTTALLDLAPGIGNGVGDGPLTTDAHHAVRAAAFAAVTPAQRAEAQRTALAHAASLGIGSVHECAGPDISSEDDFTDLLRLAAEEPAPRVVGYWAEAGEEGVAKARGLGAVGAAGDLFVDGALGSHTACLHMPYADRDHTGTAYLDAAAVAAHVIACTEAGLQAGFHAIGDAAVTTVVEGVRAAADKIGPARVRAARHRVEHAEMLTPETVAGFAELGLTASVQPAFDALWGGEDGMYAQRLGAERARTLNPFAALLRAGVPLAFGSDSPVTPFDPWGTVRAAAFHRTPEQRVSVRAAFTAHTRGGWRAIGRDDAGVLVPGAPADYAVWRTDELVVQAPDDRVARWSTDPRSGTPGLPDLTPGRELPVCLRTVVGGRTVFVGPGE

SEQ ID NO: 264 - protein, 460 aa, Streptomyces SMCD2215
MARRTLSALSATVALTAAALVMTPTAAQASPPGTKDVTAVLFEWNFASVAKECTNTLGPAGYGYVQVSPPAEHIQGSQWWTSYQPVSYKIAGRLGDRAAFQNMVSTCHAAGVKVVVDTVINHMSAGSGTGTGGSSYTKYDYPGLYSVYDFDDCTAQVSNYQDRWNVQHCELVGLADLDTGEEYVRKTIAGYMNDLLSLGVDGFRIDAAKHIDAADLANIKSRLTNPNAYWKQEVIYGAGEAVQPTEYTGNGDVQEFRYAYDLKRVFNDENLAYLKNFGEGWGYMSNSVAGVFVDNHDTERNGSTLNYKDGANYTLANVFMLAYPYGAPDINSGYEWSDADAGPPNGGQVNACWQDGWKCQHAWPEIKSMVAFRNATRGQSVTNWWDDGADAIAFGRGSKGFVAINHESGSLTRTYQTSLPAGAYCDVQKNTQVTVDSSGQLNATLAANTALAIYAGKSSC

SEQ ID NO: 265 - protein, 161 aa, Streptomyces SMCD2215
MSGKGAPELSVRNVGDLRVAVIAAQWHEKVMDGLVDGALRALHDLGIDEPTLLRVPGSWELPVVAKALAGRGYDAIVALGVVIRGGTPHFDYVCQGVTQGLTQVCVDTGVPVGFGLLTCDNEEQALDRAGLPGSNEDKGHEAVTAAVATAATLRSVSEPWH

SEQ ID NO: 266 - protein, 480 aa, Streptomyces SMCD2215
MRFLNDIQPAYDLTYDDVFMVPSRSAVGSRLGVDLSSPDGTGTTIPLVVANMTAIAGRRMAETMARRGGLVVIPQDIPIEVVTEVVGWVKSRHLVLDTPIVLSPHQTVADALALLPKRAHNAGVVVDEDGRPVGVVTDTDLTGVDRFTQLEVVMSRDLLLLDADIDPREAFNRLDAANRRYAPAVNADGRLAGILTRKGALRATLYTPAVDADGKLRIAAAVGINGDVAGKAKQLLDAGVDTLVIDTAHGHQESMIGAIKLVRALDPQVPIVAGNIVAAEGVRDLIEAGADIIKVGVGPGAMCTTRMMTGVGRPQFSAVLECAAEAKKYGKHVWADGGVRHPRDVAMALAAGASNVMIGSWFAGTYESPGDLQQDANGRLYKESFGMASARAVRNRTSEESAYDRARKALFEEGISTSRMFLDPARPGVEDLIDSIIAGVRSSCTYAGANSLEEFAERAVVGIQSAAGYAEGQPLHASWS

SEQ ID NO: 267 - protein, 310 aa, Streptomyces SMCD2215
MKLVFAGTPEVAVPALDALISSGRHEVAAVVTRPDAPAGRGRRLVASPVAQRAQDAGIEVLKPLRPKEPEFLERLREIGPDCCPVVAYGALLPRVALDIPAHGWVNLHFSLLPAWRGAAPVQHSIMAGDELTGASTFLIEEGLDSGPVYGTVTETIRPTDTSGDLLTRLAFAGAGLLAATMDGIEDGTLKALPQPAEGITMAPKITVEDARVDWATPALRVDRVVRGCTPAPGAWTTFRGERLKLIQVTPVPDRTDLGPAQLAVGKNSVHAGTGSYAVELLWVQAQGKKPMRAADWARGARITDGETLGE

SEQ ID NO: 268 - protein, 281 aa, Streptomyces SMCD2215
MTVLEPFGTRLRHAMDERGPLCVGIDPHASLLAEWGLNDDVAGLERFSRTVVEAVADRVAVLKPQSAFFERFGSRGIAVLEKTVEQARAAGALVVMDAKRGDIGSTMTAYAETFLHKDSPLLSDALTVSPYLGYGSLSPAVALARESGTGLFVLALTSNPEGGEVQHAVRADGRSVGATMLAHLAAENAGEQPLGSFGAVVGATLGDLSTYDLDINGPLLAPGIGAQGATAADLPGVFGAAVRNVVPNVSRGVLRHGPDAGALRSAADRFAEEIRVAVAAV

SEQ ID NO: 269 - protein, 368 aa, Streptomyces SMCD2215
MYKLFFRLVFRRMDPEQAHYLAFRWIRLAVRLPVLRTFVAAALAPRHKELRTEAFGLRMHGPFGLAAGFDKNAVAIDGMSMLGFDHVEIGTVTGQAQPGNPKKRLFRLVKDRALINRMGFNNEGSLAVAARLASREPVFRTVVGVNIGKTKVVPEDEAAADYVKSTERLAPYADYLVVNVSSPNTPGLRNLQATEALRPLLSAVREAADRTVTGRRVPLLVKIAPDLADEDVDAVADLAVELGLDGIIATNTTIAREGLGLTSEPSLVKEAGGLSGAPLKARSLEVLRRLYARVGDRITLVGVGGIENAEDAWQRILAGATLVQGYSAFIYEGPFWARAVHKGLAARLRTSPYATLADAVGADTRKSA

SEQ ID NO: 270 - protein, 428 aa, Streptomyces SMCD2215
MSKILIRGAKVLGGEVQDVLIDGATIAEVGSGLSADGAEVVEAAGKVLLPGLVDLHTHLREPGREDSETVLTGTRAAASGGYTSVFAMANTFPVADTAGVVEQVYRLGQEHGYCDVQPIGAVTVGLAGRKLAELGAMHESAAGVTVFSDDGKCVDDAVIMRRALEYVKAFGGVVAQHAQEPRLTEGAQMNEGVVSAELGLGGWPSVAEESIIARDVLLAEHVGSRVHICHLSTAGSVEIVRWAKSRGIDVTAEVTPHHLLLTDELVRTYNPVYKVNPPLRTERDVLALREALADGTIDIVATDHAPHPHEDKDCEWAAAAMGMVGLETALSVVQETMVDTGLLTWAGVAERMSVKPAEIGQAKGHGRPVSAGEPANLTLVDTAYRGSVDPAGFASRSRNTPYEGRELPGRVTHTWLRGKATLVDGKLT

SEQ ID NO: 271 - protein, 312 aa, Streptomyces SMCD2215
  misc_feature (249)..(253): Xaa can be any naturally occurring amino acid
MTATRRAAVLGSPIAHSLSPQLHTAGYRALGLAGWSYDRFDIDEAALPGFLAKLGPEWAGLSLTMPLKRAVIPLLDEISDTAASVEAVNTVVFEADGRRVGDNTDIPGLVAALHERGVEKAESAAILGAGATASSALAALARICTGEVTVYVRSERRADEMRQWGERLGVQVRPADWSDAARAFEAPLVISTTPAGGTDALTERLPAQVGTLFDVLYEPWPTPLAAAWQSRGGQVLGGLDLLVHQAVFXXXXXWPLSGSAPARQPRVRLPDREQRCPADVGGSEVAGRGRAPGRAVAVREDVRTQAVPGREH

SEQ ID NO: 272 - protein, 890 aa, Streptomyces SMCD2215
MESAEIRRRWLSFFEERGHTVVPSASLIADDPTLLLVPAGMVPFKPYFLGEVKPPFDRATSVQKCVRTPDIEEVGKTTRHGTFFQMCGNFSFGDYFKEGAITYAWELLTSPQDKGGYGLEPEKLWITVYKDDDEAERIWHEVVGVPKERIQRLGMKDNYWSMGVPGPCGPCSEINYDRGPEFGAEGGPAVNDERYVEIWNLVFMQYERGEGIGKDNFEILGELPSKNIDTGLGLERLAMILQGVQNMYEIDTSMAVIKKATELTGVHYGDAHASDVSLRVVTDHMRTSVMLIGDGVTPGNEGRGYVLRRIMRRAIRNMRLLGATGPVVLDLIDTVIAMMGQQYPELVTDRERIEKVAVAEENAFLKTLKAGTNILDTAVSETKAAGASVLPGDKAFLLHDTWGFPIDLTLEMAAEQGLSVDEDGFRRLMKEQRERAKADAQAKKTGHAGAGAYREIADRTGATDFIGYSETEGESTIVGILVDGASSPAATEGDEVEIVLDRTPFYAEGGGQIGDTGRIKVESGAVIEIRDCQKPVPGVYVHKGVVQVGEVTVGAKAHAAIDGRRRKAIARAHSATHLTHQALRDALGPTAAQAGSENQPGRFRFDFGSPSAVPTAVMSDVEQKINEVLARDLDVRADVMGIDEAKKQGAIAEFGEKYGERVRVVTIGDFSKELCGGTHVHNTAQLGLVKLLGESSIGSGVRRIEALVGVDAYSFLAREHTVVNQLTELLKGRPEELPEKVSSMLGKLKDAEKEIEKFRAEKVLQAAAGLAESAKDIRGVAVVTGRVPDGTTADDLRKLVLDVRGRIQGGRAAVVALFTVNNGKPLTVIATNDAARERGLKAGDLVRTAAKTLGGGGGGKPDVAQGGGQNPAAIGEAVDAVERLVTDTAK

SEQ ID NO: 273 - protein, 204 aa, Streptomyces SMCD2215
MANQPRPKVKKSRALGIALTPKAVKYFEARPYPPGEHGRGRKQNSDYKVRLLEKQRLRAQYDVSERQLVRAYERASKVQGKTGEALIIELERRLDALVLRSGIARTIYQARQMVVHGHIEVNGQKVDKPSFRVKPDDVVMVRERSREKTLFSIAREGGFAPEGETPRYLQVNLKALAFRLDREPNRKEIPVICDEQLVVEYYAR

SEQ ID NO: 274 - protein, 384 aa, Streptomyces SMCD2215
MSKIGSIGARLHRGEVGYDFVGNRKIWYGISILITITAILGLAVRGLNMGIEFQGGAVFTTPKHVSASVTSAEGYAEDASGHDAIVQKLGDGSLRIQIAGIDTDKSDAIKEQLAKELKVDSESINADLVGPSWGDQIANKAWEGLGIFMVLVVIYLAIAFEWRMALAALVALIHDITITTGIYALVGFEVTPGTVIGLLTILGYSLYDTVVVFDSLKEQTKDITRQTRWTFSDVANRSINGTLVRSINTTVVALLPVAGLLFIGGGFLGAGMLNDISLSLFVGLAAGAYSSIFIATPLVADLKEREPQMQALRKRVLAKRAQAAAQGTQVEPETADEAYDEPEDAAPAVVGPRNQPGTRSGQSTARNQPSSRNRGRGRPSGKRR

SEQ ID NO: 275 - protein, 303 aa, Streptomyces SMCD2215
MSSTLSENQAPETGTARVKRGMAEQLKGGVIMDVVTPEQAKIAEDAGAVAVMALERVPADIRKDGGVARMSDPDMIDGIIGAVSIPVMAKSRIGHFVEAQVLQSLGVDYIDESEVLTPADEVNHSDKWAFTTPFVCGATNLGEALRRIAEGAAMIRSKGEAGTGNVVEAVRHLRQIKNEIARLRGYDNHELYAAAKELRAPYELVKEVAELGKLPVVLFSAGGVATPADAALMRQLGAEGVFVGSGIFKSGDPAKRAAAIVKATTFYDDPKIIADASRNLGEAMVGINIDTLPETERYAERGW

SEQ ID NO: 276 - protein, 225 aa, Streptomyces SMCD2215
MLNKYARAFFTRVLTPFAAFLIRRGVSPDAVTLIGTAGVMAGALVFYPMGEFFWGTVVITLFVFSDLVDGNMARQLGRSSRWGAFLDSTLDRVADGAIFGGFALWYAAGGDDIVLCAVSIFCLASGQVVSYTKARGESIGLPVAVNGLVERAERLVISLVAAGFAGLHKFGVPGIQYLLPVALWIVAVGSLITLIQRVVTVRRESAEAEAAARPENASRGSEAAK

SEQ ID NO: 277 - protein, 559 aa, Streptomyces SMCD2215
MSQQHSAIAPAGHPAEAERGDWWRDAVIYQVYPRSFADSDGDGMGDLEGVRSRLPYLRDLGVDAVWLSPFYASPQADAGYDVADYRAVDPMFGNLLDADALIRDARELGLRIIVDLVPNHSSDQHEWFKRALREGPGSPSRERYHFRPGQGVRGELPPNDWESIFGGPAWTRVTEPDGTPGEWYLHLFAPEQPDFNWEHPAVGDEFRSILRFWLDMGVDGFRIDVAHGLVKAAGLPDLGSHEQLKLLGNDVMPFFDQDGVHEIYRQWRLVLDEYAGERIFVAEAWTPTVERTANYVRPDELHQAFNFQYLSTAWDAHELREVIDRTLESMRPVGAPATWVLSNHDVTRHATRFANPPGLGTQIRLAGDRELGLRRARAASLLMLALPGSAYVYQGEELGLPDVVDLPDEVRQDPAYFRGAGQDGFRDGCRVPIPWTREGSSYGFGSGGSWLPQPAGWGELSVEAQQGVPGSTLELYRSALAVRREQPDLGAGDAVEWLRAPEGVLAFRRGEFVCVANTSGESVTTPSYGRILLTSGDVTEADGGTKVPADTTVWFTTRR

SEQ ID NO: 278 - protein, 658 aa, Streptomyces SMCD2215
MSDVRVIIQRDSEREERVVTTGTTAAELFAGERSIVAARVGGDLKDLAYVPAEGEVVEPVEITSEDGLNILRHSTAHVMAQAVQQLFPEAKLGIGPPVKDGFYYDFDVEKPFTPEDLKAIEKKMQEIQKRGQKFSRRVVTDEAAREELSDEPYKLELIGLKGSASHDDGADVEVGSGELTIYDNLDAKTGELCWKDLCRGPHLPSTRNIPAFKLMRNAAAYWRGSEKNPMLQRIYGTAWPSKDELKAHLDFLAEAEKRDHRKLGSELDLFSIPEQIGSGLAVFHPKGGIVRRVMEDYSRRRHEEEGYEFVYTPHATKGKLFETSGHLDWYADGMYPPMQLDEGVDYYLKPMNCPMHNLIFDARGRSYRELPLRLFEFGTVYRYEKSGVVHGLTRARGFTQDDAHIYCTREQMSDELDKTLTFVLGLLRDYGLTDFYLELSTKDPEKFVGSDEVWEEATETLRQVAEKQGLPLVPDPGGAAFYGPKISVQTKDAIGRTWQMSTIQLDFNLPERFDLEYTGPDGSKQRPVMIHRALFGSIERFFAVLLEHYAGAFPAWLAPVQAVGIPIGDAHVEYLEKFAAAAKKQGLRVEVDSSSDRMQKKIRNAQKQKVPFMVIAGDEDMSNGSVSFRYRDGSQENGIPVDEAIAKIVKVVEERSQV

SEQ ID NO: 279 - protein, 273 aa, Streptomyces SMCD2215
MKIWLDGGLQDTESACVSVFDHGLTVGDGIFETVKAVQGRPFALTRHLDRLTRSARGLGLPDPDLDEVRRACAAVLEANPMPYGRLRITYTGGHGPLGSDRGEHGPTLVVALGEATRRPDSTVVITVPWTRNERGALTGLKTTSYAENVVALARAHQHGASEALFANTVGQLCEGTGSNVFVVLDGEIHTPPVASGCLAGITRALVVEWTGAKETDLPLDVLERADEVFLTSSLRDIQAVHRVDGRELPGTPGPVTAKAVRVFDERSAADLDP

SEQ ID NO: 280 - protein, 385 aa, Streptomyces SMCD2215
MGTQDEQRDGTGRRALLGAAVLGAGGAVLGLSGTARAAEAHHGGGLRSLPKPTIIGHRGTAGYRPEHTFGSYELALDLGADVVEAGDLCPTKDGHLVCRHEPEIGGTTDVADHPEFAGRKTTKVLDGVPTTGWFTEDFTLAELKTLRAIERIPANRPHNTLYNGRWEIPTFEEVLKWQDEQTRRRGKQVWFYPETKHPTYFRKLGLGVEERVAKLLRKHGKDRRNSPVIVQSFEPTSIQKLNTLIDNPLVVLLSTADSRPYDFVATGDPRTVADLITPKGLREIAGYAQGIGPTLDLVITKNADGSLGERTTLVADAHKVGLVLHPYTMRNENPFLPLEFRKGSDADGYGDAFGAFATYFATGIDGVFTDNADTALLARADFVNG

SEQ ID NO: 281 - protein, 477 aa, Streptomyces SMCD2215
MSSNSGDVRLWGGRFADGPAEALAKLSASVHFDWRLAPYDIAGSRAHARVLHTAGLLTEDELTRMLAGLDRLEADVASGAFVGTVADEDVHTALERGLLERLGPELGGKLRAGRSRNDQVATLFRMYLRDHARIIGGLIADLQDALVGLAEAHPDTAMPGRTHLQHAQPVLFAHHVLAHVQSLSRDAERLRQWDERTAVSPYGSGALAGSSLGLDPEAVARDLGFEHGSAANSIDGTASRDFVAEFAFITAMIGVNLSRIAEEVIIWNTKEFSFVTLHDAFSTGSSIMPQKKNPDIAELARGKSGRLIGNLTGLLATLKALPLAYNRDLQEDKEPVFDSCDQLEVLLPAFTGMMATLTVNRERMEELAPAGFSLATDIAEWLVKQGVPFRVAHEVAGECVKAAEAEGKELADLTDEQFAKISAHLTPEVRSVLNVPGALASRDGRGGTAPSAVAIQLAEVKANVAAQHAWAAAKKKG

SEQ ID NO: 282 - protein, 485 aa, Streptomyces SMCD2215
MGIVAGLDSAPDFTRIVVCDADSGAVLRQGYAAHPVEGGEGGGRPSDVDPQAWLLSLGEAAGGGLLEGVQAIGVSAQANAVVPLDSQGNTVRPAMVGGDKRAQVAAADLIDALGGREAWAQAVGCVPQAALPVTKLRWLAKNEPDAALRTAILMQAHDWLVWQLLGRPVRRTTDRGGASGTGYWSAATGNYRTDLVELALGHQAMLPEVIGPSDPAGTTPEGLLISAGTGETMAAAFGLGIGLGDAVVSLGASGSVMAVHREALVDSSGMITSLADATGLHLPVVTTLNAVRTLRGTAELLGLPDLESLSDLALKSTPGSHGLVLLPYLEGERTPNLPHTAGTLAGLRRESMKAEHLARAAFEGMLCGLADALDVLRGRGVEVRRVFLLGAAAELPAVQAAAPMLFGAQIVVPQPADYAAIGAARQAAWARGASQGTLDPRNPPAWQGAAAAQVLSPGDELAVGQAVRQQYVSVRDQTHPGAFRP

SEQ ID NO: 283 - protein, 342 aa, Streptomyces SMCD2215
MAVRAAVAGASGYAGGELLRLLLAHPETEIGALTGNSNAGQRLGALQPHLLPLADRVLEETTPGALAGHDVVFLALPHGQSAAVAEQLGPDVLVVDMGADFRLKDAADWERFYGSPHAGTWPYGLPELPGARTALTGSRRIAVPGCYPTAVSLALFPAYAAGLARNEAVIVAASGTSGAGKAPKPHLLGSEVMGSMSPYGVGGGHRHTPEIIQNLSAAAGERVTVSFTPTLAPMPRGILATCSASAVEGVTAESVRAAYEKAFADEPFVHLLPEGQWPATASVYGSNAVQVQVAYDEAAGRIIAISAIDNLTKGTAGGAVQSMNLALGLDETTGLTTIGVAP

SEQ ID NO: 284 - protein, 407 aa, Streptomyces SMCD2215
MGRLSRRTFALAALATLAAAPDASAVPRGRHASGEMRGMWVATVGNRDWPSRPGLSAAQQHAELVGHLDLAVRDRLNAVMFQVRPTADALWPSPYEPWSEYLTGTQGRDPGWNPLRTAVAEAHARGLELHAWFNPYRVALHTDLTRLAASHPARRHPDWVVPYGGKLYYNPGLPEVRAFVQEAMLDAVRKYPVDAVHFDDYFYPYPVAGQTFDDDEAYDRYGSGFADRAAWRRDNIDRLVREMAVRIKLTRPGTRFGISPFGVWRNAATDPLGSDTTAGVQTYDDLHADTRKWVRENWIDYIAPQIYWNIGFAAADYAKLLPWWAQVARGSGTRLYVGEALYKAGDPAQPAAWQDPAELSRHLTLAKKYPQARGHIFFAATDVAADRIGAMARVVADHYRQPARPPR

SEQ ID NO: 285 - protein, 837 aa, Streptomyces SMCD2215
MRVPLSWLREYVDLPATETGRDVQEKLVSAGLEVETVEHLGADLKGPLVVGQVLTIEELEGFKKPIRFCTVNVGQANGTGEPQEIVCGARNFAVGDKVVVVLPGATLPGGFSISARKTYGKVSHGMICSSDELGMGDDGSKGIVVLPPETEVGKDAIELLELVDEVLDIAVTANRGDCLSIRGVARETAIAYGLPLRDPALLDVPGPNAFGYPVKVADPTGCDRFTARTVTGLSPEARSPIWLQRRLQKVGMRPISLAVDVTNYVMMELGQPLHAYDRSLVQGTIGVRRAEAGEKLVTLDGVQRTLDTEDLVITDERGPIGLAGVMGGANTEIADHEDVDHATSDVVIEAAHFNAVSVARTARRHKLSSEASRRFERGVDPQAAAAAAQRTVDLLVLLAGGSAEAGVTEVVAPSAPHTIAVPADHPDKVAGVDYGRETVVRRLQEIGCDVYGQDELIVTVPSWRPDLLEINDLAEEVIRLEGYENLPSTLPKPPSGRGLTHRQRLHRRIGRALAGAGYVEAPNYPFIGEQVFDQLLLEADDPARRVVKLTNPLNDEEPALRTSLLPGLFGALRRNDGRGAHDLALFETGLVFLPRAEQRVAAALPVDRRPTDEEIAGLDAALPEQPRHAAVVLAGAREQAGWWGKGRPADWADAIEAARVVAREAGAELIVRGGQYGPWHPGRTAELVVVVDGAEKVVGHAGELHPRVIKALSLPERTCAMEIDLDVLEAVGDDTPQAPSISTFPVATQDVALVVDKSVPHADVEGALREGAGELLEGIRLFDVYENDDQLGAGRKSLAYALRFRAGDRTLTVEEASAARDAAVALAGERTGAVLRG

SEQ ID NO: 286 - protein, 373 aa, Streptomyces SMCD2215
MSAPNKSYDPVEVEALKPEAIERMRDEALAAFAAADSLDALQEAKVAHTGGTSPLALANREIGALPPHAKADAGKRVGQARGAVNKALAARQAELEAERDARVLVEEAVDVTLPHDRVPAGARHPLTTLSERIEDVFVAMGYEVAEGPEIEAEWFNFDALNIGPDHPARGEADTFFVQGPDGGTESGAVLRTHTSPVQIRSLLDRELPVYVICPGRVYRTDELDATHTPVFHQVELLAVDEGLTMADLKGTLDHMVQSLFGEGMKTRLRPNFFPFTEPSAEMDMVCYVCRGESVGNPDRPCRTCSSEGWIELGGCGMVNPRVLTACGVDPEKYSGFAFGFGIERMLMFRHNVEDMRDMVEGDVRFTRPFGMEI

SEQ ID NO: 287 - protein, 127 aa, Streptomyces SMCD2215
MARVKRAVNAHKKRRAILEQASGYRGQRSRLYRKAKEQVTHSLVYNYNDRKKRKGDFRQLWIQRINAAARANGITYNRFIQGLKAANVEVDRKILAELAVNDATAFAALVEVAQKALPADVNAPKAA

SEQ ID NO: 288 - protein, 260 aa, Streptomyces SMCD2215
MTDTPVCRRLVGRTAVITGAGSGIGLATARRLASEGAHVVCGDVDEARGKAAAEEVGGLFVKVDVTDAEQVEALFKTAFDTYGSVDIAFNNAGISPPDDDSILETGLEAWKRVQEVNLTSVYLCCKAAIPYMRRQGKGSIINTASFVARMGAATSQISYTASKGGVLAMSRELGVQFAREGIRVNALCPGPVNTPLLQELFAKDPERAARRLVHIPVGRFAEADEIAAAVAFLASDDASFVNATDFLVDGGIAGAYVTPL

SEQ ID NO: 289 - protein, 421 aa, Streptomyces SMCD2215
MVDADQTFVIVGGGLAGAKAAETLRAEGFSGRVILICDERDHPYERPPLSKGYLLGKEERDTVFVHEPAWYAQNDIELHLGETVDAIDRSAKTVRFGGDGTLVRYDKLLLATGAEPRRLDIPGTDLAGVHHLRRIAHAERLKGVLSALGRDNGHIVIAGAGWIGLEVAAAAREYGAEVTVVEPEQTPLHAVLGPELGSLFADLHREHGVRFHFGARLTEIVGQDGMVLAARTDDGEEHPAHDVLAAIGAAPRIGLAEAAGLEIAAREHGGGVVVDERLRTSDPDIHAAGDVVSFPHALFGTRLRVEHWANALNGGPAAARAMLGQDVTYDRVPYFFSDQYDLGMEYNGWAPPGTYDEVVIRGDAGKRAFIAFWVKDGRVLAGMNVNVWDVKDPVQKLIRAKTQVNTEALADPHVPLESLVP

SEQ ID NO: 290 - protein, 301 aa, Streptomyces SMCD2215
MLLDTASLYFRAYFGVPESVKAPDGTPVNAVRGLLEFIDRLVKDHRPDLLVACMDADWRPQWRVDLIPSYKAHRVAEERAAGPDEEEVPDTLSPQVPVIEAVLDALGIARVGVEPYEADDVIGTFTARAKGPVDIVTGDRDLYQLVDDARGVRVLYPLKGVGTLQLTDEAWLREKYGVDGRGYADLALLRGDPSDGLPGVPGIGEKTAAKLLAEFGDLAGIMAAVEDPKAKLTPSQRKRLDESRPYVAVAPKVVKVADDVPLPDVDTALPHAPRDPAALEELAARWGLGGSLQRLLTTLGA

SEQ ID NO: 291 - protein, 437 aa, Streptomyces SMCD2215
MEGIAGIEPQAYENHVPPPGYDASAVERWVTEPDKRPGRTAFQRDRARVLHSAALRRLAGKTQVVTPGARNQAWDASPRTRLTHSLECAQVGRELGAALGCDPDLVEAACLSHDLGHPPFGHNGEQALNEFAEDCGGFEGNAQSLRLLTRIEPKRFTDGGSRSVGLNLTRAALDAATKYPWPRGEHPTDPGSRKFGVYEDDRPVFDWVRKEAPGARTTFEAQVMDWADDVAYSVHDVEDGLHAGHIDPNCLHAEPERQSVFAVAVGRYVPAATDPAELAAALDRLQDQEWWPHGYDGSAIAQARLKDATSQLIGRFCLAAEAATRARHGSGRLTRYGAELVVPREARLECAVLKAVADRYVMQRAEQERLRADQRIVVAELAEALTARAPDGLDPQFRALFEQAGDDRARKRVIVDQIGSLTDASARSLHARLTGHP

SEQ ID NO: 292 - protein, 123 aa, Streptomyces SMCD2215
MSIDKPEIDFPGGEPPADLEIKDIWEGDGAVAQAGQTVTVHYVGVAFSTGEEFDASWNRGTPFRFPLGGGRVIKGWDLGVQGMKVGGRRQLTIPAHLAYGNQSPTPAIQPGETLIFVVDLVAV

SEQ ID NO: 293 - protein, 300 aa, Streptomyces SMCD2215
MSEPTGAARRRGPFKVGDQVQLTDPKGRHYTFTLEAGKNFHTHKGSFPHDELIGAPEGSVVRTTGNVAYLALRPLLPDYVLSMPRGAAVVYPKDAGQILAFADIFPGARVVEAGVGSGSLSSFLLRAIGDQGMLHSYERREDFAEIARQNVERYFGDPHPAWQLTVGDLQDNLSDTDVDRVILDMLAPWECLEAVSKALVPGGILCCYVATTTQLARTVESIREIGCFNEPTSWETMIRNWHVEGLAVRPDHRMIGHTGFLLTARRLADGVEPPMRRRRPAKGAYGEDYSGPNADGGSGR

SEQ ID NO: 294 - protein, 223 aa, Streptomyces SMCD2215
MAIRVLLVDDQPLLRTGFRMILEAEQDIAVVGEAGDGLQALDQVRALQPDVVLMDIRMPRMDGVEATRQITGPGRDGPAKVLVLTTFDLDEYVVEALRAGASGFLLKDAPANELVQAIRVVAGGEAMLAPSITRRLLDKYATHLPSGDEPVPDTLHTLTDREVEVLKLVARGLSNAEIAADLFVSETTVKTHVGHVLTKLGLRDRVQAAVYAYESGLVRPGAQ

SEQ ID NO: 295 - protein, 409 aa, Streptomyces SMCD2215
MHAWPASEVPALPGQGRDLRIHDTATGGVVPLDPGPVARIYVCGITPYDATHMGHAATYNAFDLVERVWLDTKRQVQYVQNVTDVDDPLLERAQRDGVDWVALAEQETALFREDMTALRMLPPQHYIGAVEAIPGIVPLVERLREAGAAYELEGDIYFSVESDPHFGKVSHLDAAAMRLLSAERGGDPDRPGKKNPLDPMLWMTARKGEPSWDGGSLGPGRPGWHIECVAIALDHLGMGFDVQGGGSDLAFPHHEMGASHAQVLTGEFPMAKAYVHAGMVALDGEKMSKSKGNLVFVSQLRRDGVDPAAIRLALHAHHYRSDWEWTDQVLADAVARLGRWRAAVSRPDGPPAEALVEEVREALANDLDAPAALAAVDRWVARQDAEGGTDTGAPGVVSRAVDALLGVAL

SEQ ID NO: 296 - protein, 441 aa, Streptomyces SMCD2215
MSEADTARGVTGEDEVVDLCRELIQIDTSNYGDHSGPGERKAAEYVAGKLAEVGLEPQIFESHPGRASTVARIEGEDPSRPALLIHGHLDVVPANADDWTHHPFSGEVADGCVWGRGAVDMKDMDAMTLAVVRDRLRSGRRPPRDIVLAFLADEEAGGTYGAKHLVTEHPALFEGVTEAISEVGGFSFTVSEQRRLYLIQTAEKGMHWMKLKVAGTAGHGSMIHRDNAITELSEAVARLGRHKFPVRVTKTTRAFLDELGDALGTELDPEDMEGTLARLGGIAKLIGATLSNTANPTQLGAGYKVNVIPGEATAHVDGRFLPGFEEEFLADLDKILGPKVQREDVHADKAVETTFDGALVEAMQSALVAEDPAAKAIPYMLSGGTDAKSFDDLGIRGFGFAPLKLPPELDFAGMFHGVDERVPVDGLKFGVRVLDRFIDAS

SEQ ID NO: 297 - protein, 233 aa, Streptomyces SMCD2215
MSTPGRGLHGRVLDSLGPAITAGEYPPGSVLRTDELAQHFEVSRSVMREAVRVLESMHLVQSRRRVGVTVQPKSAWNVYDPQVIRWRLAGADRPHQLRSLTVLRSAIEPVAAGLAARHATAEQCAELTECALGMVANSRGHQLEAYLVHDMAFHRVILAASGNEMFARLGDVVAEVLAGRTHHEVMFEDPDPAAVTLHVQVAEAVRAGDAARAEELTRQITVGALQELDILAP

SEQ ID NO: 298 - protein, 404 aa, Streptomyces SMCD2215
MDFAFDARTEELRAQLLAFMDEYVYPAEAVAEEQRAALASPWDTPAVVEELKAEARRQGLWNLFLPDAEHGAGLTNLQYAPLAEITGRSPHLAPTATNCAAPDTGNMEVLAQFADERQKKQWLEPLLAGEIRSAFAMTEPEVASSDATNITTHIERDGDEYVITGRKWYISGAMNPDCKIFIVMGKTDPDGADIRRQQSMVLVPRDTPGVTVKRAMQVFGYEDHSHGGHAEVVFDHARVPVSNLIGEEGGGFAIAQARLGPGRIHHCMRLIGMAERAIELMCRRAVSRNAFGKALAQQGVVQNWIADARVAVEQLRLLVLKTAWMMDTVGNRGAHTEIQAIKIATPRTVVNILDRAIQLHGAGGVSQDFPLAELYAGARTLMLADGPDEVHQRSLARRELKKYL

SEQ ID NO: 299 - protein, 441 aa, Streptomyces SMCD2215
MSGEARKTAEGLTYLSGFGNEHSSEAVPGALPEGRNSPQRAPLGLYAEQLSGTAFTEPRARNRRSWLYRIRPSAAHPPFTRADNGAIRTAPFTESVPDPNRLRWNPLPEPPAGTDFLAGLWTLGGNGDATQRTGMAVHLYSADSSMERVFSDADGELLIVPERGGLLLHTEFGLLHAEPGHVALVPRGVRFRVELLDASARGYVCENYGAPFQLPDLGPIGANGLANARDFRAPVAAYEDVEGPVEVVNKFCGNLWRATYDHSPLDVVAWHGNHLPYVYDLRRFNVIGTISYDHPDPSIFTVLTSPSDTPGLAGVDFVVFAPRWLVGEDTFRPPYFHRNVMSEYMGLVEGAYDAKTAGKGGFVPGGGSLHNMMSAHGPDRETFERASAAELKPQKVDDGLAFMFETRWPVTLTAHAAQAEHLQRRYDDVWQGLERHFRPLH

SEQ ID NO: 300 - protein, 268 aa, Streptomyces SMCD2215
MRRSRIAVFVSSILLAAGAALTGASAAQASPDAAATGYVALGDSYSSGVGSGSYISSSGDCKRSTKAYPYLWAAAHSPSTFDFTACSGARTGDVLSGQLGPLSAATGLVSISIGGNDAGFSDVMTTCVLQSDSSCLSRIDTARAYVSSTLPGQLDSVYSAISAKAPNAHVVVIGYPRFYKLATTCVGLSDTKRKAINDAADQLDTAIAKAAAAHGFSFGDVRATFTGHEICSGSSWLHSVDWLNIGESYHPTAAGQSGGYLPVLTSAA

SEQ ID NO: 301 - protein, 178 aa, Streptomyces SMCD2215
MSANSADSSNSADSANSAEGAARLEVVLVKAGRTKIRYEAELLGDDGTRVVVRAPWAGEGVRDFGFVRFEKGDVFTEYYWRDRWYSVKEVRDTAGVLKGWYCDITRPAVRSGGELVAEDLDLDLWRSADGRDVRRLDEDEFAASGLTRTDPRAAAAALAALNELETLAREGGFDDLLG

SEQ ID NO: 302 - protein, 122 aa, Streptomyces SMCD2215
MAVRAVRGAVQLERDEAGHMDEQVGALLTAILERNALTADDLISVWFTATPDLHSDFPAAAARKLGAGFADVPLICAQELDIEGAMPRVVRVLAHIESDRPRSDIAHVYLGAAAALRKDIAQ

SEQ ID NO: 303 - protein, 374 aa, Streptomyces SMCD2215
MIDVKVGIPREVKNNEFRVAITPAGVHELVRNGHQVVIEQGAGAGSSIPDEEYVAAGAKILGTADEVWATADLLLKVKEPIAEEYHRLRKDQTLFTYLHLAASKECTDALVESGTTAIAYETVELPNRALPLLAPMSEVAGRLAPQVGAYHLMRFNGGRGVLPGGVPGTQPAKAVVIGGGVSGWNATQIAVGMGFHVTLLDRDINKLREADKVFGTKVRAIMSNSFELEKAVLDADLVIGAVLIPGAKAPKLVTNELVSRMKPGSVLVDIAIDQGGCFEDSRPTTHAEPTFKVHNSVFYCVANMPGAVPNTSTYALTNATLPYIVELANKGWVEALRRDPALAKGLNTHDGKVVYREVADAHGLEHVELESLLG

SEQ ID NO: 304 - protein, 208 aa, Streptomyces SMCD2215
MTIKDSPEEWEIRATETPFVGNKTSVRTDDVVMPDGHVARRDYQVHPGSVAVLALDGEGRVVVIRQYRHPVRHKLWEIPAGLLDVPGENPLHAAQRELYEEAHVKAEDWRVLTDVYTTPGGCDEAVRVFLARDLSEADGDRFEVEHEEADMELARVPLEELVRGVLAGELHNNCLVVGVLSLVAAEHGDGLDALRPAEAPWPARPFES

SEQ ID NO: 305 - protein, 553 aa, Streptomyces SMCD2215
MAKVQVADTAMERRQSAGGGRVVVEWLTTTDHKRIGTLYLTTSFVFFLVGGAFALVMRAELARPGMQFLSNEQFNQAFTAHGTIMLLVFATPLFAGFANWIMPLQIGAPDVAFPRLNMFAYWLYLLGSLIVLSGFLTPDGSAHWGWTGYAPLSSALHSPGVGGDLWVMGLALSGFGTILGSVNFITTIICMRAPGMTMFRMPVFTWNVLLTAVLVLIAFPTLAAALLALEADRKFGAHVFDAANGGPLLWQHLFWFFGHPEVYIIALPFFGIVTEILPVFSRKPVFGYMGLVGATIAIAGLSVTVWAHHMFVTGGVLLPFFAFMSFLIAVPTGVKFFNWIGTMWKGSLSFETPMLWALGFLVTFLFGGLTGVLLASPPLDFHVSDSYFVVAHFHYTVFGTVVFAMFAGFYFWWPKFTGKMLDERIGKIHFWTLFVGFHCTFLVQHWLGAEGMPRRYADYLAADGFTALNTVSTIGSFLLGASMLPFLYNVWKTAHYAPRVADDDPWGYGRSLEWATSCPPPRHNFLSLPTIRSESPAFDLRHPEVRALEHSGR

SEQ ID NO: 306 - protein, 178 aa, Streptomyces SMCD2215
  misc_feature (173)..(176): Xaa can be any naturally occurring amino acid
MSRLTVLPFGNVDGMSRSTEGGTVSEARTRLLNTATRIFYAEGIHSVGIDRIVAEAKVTRATLYRHFASKEDLVLAYLAQADQAIRGQVAAAQASSPSPDDQVRAVAKSITDGIQSTGFRGCAFLNAAAEYSDPAHPIHQAVLAHRQWFLDTVTGLMAQTDDGVADAAGRHFXXXXRS

SEQ ID NO: 307 - protein, 408 aa, Streptomyces SMCD2215
MSAAPQVTDILSPEFAADPYPAYAVMREKEPLIWHEATQSYIISRYEDVERVFKDKKSEFTTDNYNWQLEPVHGKTILQLSGREHAVRRALVAPAFRGSDLQEKFLPVIERNSRELIDAFRHTGSADIVHDYATRFPVNVIADMLGLDKADHARFHGWYTAVIAFLGNLSGDAEVTAAGERTRVEFAEYMIPIIRERRGNLGEDLLSTLCAAEVDGVRMSDEDIKAFCSLLLAAGGETTDKAIASILANLLMHPEQLAAVREDRSLIPAAFAETLRFTPPVHMIMRQSATEVEVTGGTIPAEATVTCLIGAANRDEQRFHDPDRFDIFRDDLTTTSAFSAAADHLAFALGRHFCVGALLAKAEVETGVNQLLDAMPDLRLADGFDPVEQGVFTRGPQSLPVRFTPSTV

SEQ ID NO: 308 - protein, 476 aa, Streptomyces SMCD2215
MPEEPIKLRKNGFYPGVSHELAENMRSGWAKPEARDVTPITQVAETAARRADLSHRFPGEWLVVPAGRLKTRSNDMAYAFRAATEYAYLTGDQSAGGVLVLAPNATGHRATLHLLPRSDRESGEFWLDEQGELWVGPRHSLAEAEQMYGMPTADVRDLPDTLRENTGPVRIVRGHDTQLEAAVADRTTARRDEELLVFLSEARLVKDAFEIGELQKAVDSTVRGFEDVVKNLDKAQVTSERYVEGTFFLRARVEGNDVGYGSTCAAGSHTSTLHWARNDGPVVPGDLLLLDAGVETHTLYTADVTRTLPISGRYSAVQRKIYDAVYEAQEAGIAAVRPGAGFRDFHYAAQLVLARKLVEWGVLEGPAERVVELGLQRRWTLHGTGHMLGMDVHDCAAARVASHVAGTLVPGMVFTVEPGLYFQPDDLTVPEEYRGIGVRIEDDILVTENGCRILSAALPRRSDEVETWMASLKARN

SEQ ID NO: 309 - protein, 307 aa, Streptomyces SMCD2215
MDLRIFTEPQQGASYDTLLAVAKATEDLGFDAFFRSDHYLRMGSGDGLPGPTDAWVTLAGLARETKRIRLGTLMTAATFRLPGVLAIQVAQVDQMSGGRVELGLGAGWFEEEHKAYGIPFPKEKFGRLEEQLEIVTGLWSTKLGESFDFHGTFYDLTDSPALPKPAQDRIPVLIGGHGATRTPRLAARFADEFNMPFAGVEDSERQFARVRAAAEEAGRGADDLVLSNALVVCVGKDDKEVARRAAAIGREPDELRANGLAGTPSEVVDKIGRYAEIGSRRLYLQVLDLSDLDHLELISSHVQSQLS

SEQ ID NO: 310 - protein, 407 aa, Streptomyces SMCD2215
MGFHVDSEAGRLRRVILHRPDLELKRLTPSNKDALLFDDVLWVRRARAEHDGFADVLRDRGVAVHLFGDLLTEALQVPEARTLVLDRVFDEKEYGVLATDHLRAAFETLPAPELAEALVGGMTKREFLDAHLEPTSVRFHVMDLDDFLLAPLPNHLFTRDTSAWIYDGVCVNAMRWPARQRETVHFEAIYRHHPLFRDETFRVWSEGQADYPSTIEGGDVLVIGNGAVLIGMSERTTPQAVEMLAHKLFEAGSATTIVALDMPKRRAFMHLDTVMTMVDGDTFTQYAGLGMLRSYTIEPGAGDKELKVTDHPPEHMHRAIAAALGLSGIRVLTATQDVHAAEREQWDDGCNVLAVEPGVVVAYERNSTTNTHLRKQGIEVIEIPGSELGRGRGGPRCMSCPVEREAV

SEQ ID NO: 311 - protein, 335 aa, Streptomyces SMCD2215
MASVPTALAGRHFLKELDFTQEEFLALIELAAELKAAKKAGTETRHLSGKNIALVFEKTSTRTRCAFEVAAADQGASTTYLDPSGSQIGHKESVKDTARVLGRMYDAIEYRGHGQGVVEELAAHAGVPVYNGLTDEWHPTQMLADVLTMTEHTDKPLTATAFAYLGDARYNMGNSYLVTGALLGMDVRIVAPRLLWPDETIVEVAQRLAAASGARITLTEDVKEGVRGADFIATDVWVSMGEPKEVWDERIALLGPYAVTMDVLRATGNPDVRFLHCLPAFHDLGTDVGREIHQRHGLTELEVTDEVFESEYSVVFDEAENRMHTIKAVLVATLG

SEQ ID NO: 312 - protein, 270 aa, Streptomyces SMCD2215
MINVSDQHAPRSLIVTLYGAYGRFAEGPVPVAELIRLLAAVGVDAPSVRSSVSRLKRRGLLLPARTAQGAAGYELSPDARQLLDDGDRRIYASAPPDDEGWVLAVFSVPESERQKRHVLRSRLAGLGFGTATPGVWIAPARLYEETRHTLQRLRLDPYVDLFRGEHLGFAATREAVARWWDLAAIAKEHEAFLDRHGPVLQGWEHRPHTPPEEAYRDYLLALDSWRHLPYADPGLPARLLPDDWPGVRSAAVFRGLHARLRDTGAEFVGV

SEQ ID NO: 313 - protein, 905 aa, Streptomyces SMCD2215
MSANSFDARSTLQVGDESYEIFRLDKVEGSARLPYSLKVLLENLLRTEDGANITADHIRALGGWDSQAQPSQEIQFTPARVIMQDFTGVPCVVDLATMREAVKELGGDADKINPLAPAELVIDHSVIADKFGTNDAFKQNVELEYGRNRERYQFLRWGQTAFDEFKVVPPGTGIVHQVNIEKLARVVMVRDGKAYPDTLVGTDSHTTMVNGLGVLGWGVGGIEAEAAMLGQPVSMLIPRVVGFKLTGELKPGTTATDLVLTITEMLRKHGVVGKFVEFYGEGVGATSLANRATIGNMSPEFGSTAAIFPIDDETINYMRLTGRSEQQLALVEAYAKAQGLWLDPKAEPDFSEKLELDLSTVVPSIAGPKRPQDRIVLANAAEQFKQDVRNYVDSVDEAGQESFPASDAPAIAPNGAPSNPVTVTAPDGSTYEIDHGAVTVAAITSCTNTSNPYVMVAAALVAKKAVEKGLTRKPWVKTTLAPGSKVVTDYFDKAGLTPYLDKVGFNLVGYGCTTCIGNSGPLPEEVSKAVNDHDLAVTSVLSGNRNFEGRINPDVKMNYLASPPLVVAYAIAGSMKVDITRDALGTDQDGNPVYLKDIWPSEAEVNDVVANAIGEDMFNKSYADVFAGDAQWQALPIPTGNTFEWDAESTYVRKPPYFEGMQPEPAPVSDISGARVLAKLGDSVTTDHISPAGAIKADTPAGQYLTEHGVQRRDFNSYGSRRGNHEVMIRGTFANIRLRNQIAPGTEGGYTRDFTQADAPVSFIYDASRNYIEQGIPLVVLAGKEYGSGSSRDWAAKGTALLGVKAVIAESYERIHRSNLIGMGVLPLQFPEGASAASLGLTGEETFSFTGVEELNNGTTPGTVKVTTDTGVEFDAVVRIDTPGEADYYRNGGIMQYVLRSLIRK

SEQ ID NO: 314 - protein, 1267 aa, Streptomyces SMCD2215
MGHRTRHRWGPAVVLTAAFALAVGTQGAATALPAKAPAADRSFASSFEAGDPAPDWLNTVDTRPDGTKRASGVDGGYSSGIPGNVNDHVTDVRASGENTGGGEVKENLVDGESATKWLTFEATGWAEFDLDKPLKITNYALTSANDFAERDPKDWTLQGSTDGKDWKTLDSRSGESFGERFQTKKYDLAEPAEYQHFRLDITRNNGAADILQLADLQLSTGDSDNPVPQDMLSLVDHGPSGSPTAKAAAGFTGKKALRYAGRHTADGRAYSYNKIFDVNVAVGRDTQLSYRIFPQMADKVLDYDATNVSVDLAFTDGTYLSDLDAVDQHGFGLTPQAQGAAKILYVNQWNNVTSRIGSVAAGKTVDRILVAYDSPKGPAKFRGWLDDIALKSVAPEKPKAHLSDYVLTTRGTNSSGSFSRGNNFPATATPHGFNFWTPVTNSSSLSWLYDYARANNDDNLPTIQSFSASHEPSPWMGDRQTFQLMPSVASGTPDTGREARELAFRHENETARPYYYGVRFENGLKAEMAPTDHAASLRFTYPGDDASVVFDNVTEQAGLTLDKDNGIVTGYSDVKSGLSTGATRLFVYGVFDKKVTDASSSGVKGYMRFDAGSDHTVTLRLATSLISVDQAKDNLRQEIPDGRSFDAVKKQAQHTWDKLLGKVEVQGATPDQLTTLYSSLYRLYLYPNSGFEKVGSKYQYASPFSPMPNPDTPTHTGAKIVDGKVYVNNGFWDTYRTTWPAYSFLTPSQAGEMVDGFVQQYKDGGWTSRWSSPGYADLMTGTSSDVAFADAYVKGVKFDAKSAYDAAVKNATVVPPSSGVGRKGMTTSPFLGYTSTDTGEGFSWAMEGYVNDYGIAEMGKALYKKTGEKRYKEESDYFLNRAQDYVNLFDSKAGFFQGKDAKGNWRLDSAKYDPKVWGYDYTETDGWGYAFTAPQDSRGLANLYGGQKALGDKLDEYFSTPETASPDNVGSYGGVIHEMTEARDVRMGQYGHSNQVAHHVNYMYDAAGEPWKAQKNVREVLSRLYTGSEIGQGYHGDEDNGEQSAWYLFSSLGFYPLVMGSGEYAIGSPLFKKATVHLENGHDLVVRAPKNSTKNVYVQGLKVNGRTWSKTSLPDSLLKKGGVLDFDMGSKPSKWGSGKDAAPVSITKDDKVPTPRADVLKGDGALFDNTSATDATVTSVDLPVSGAVKGLQYTLTSSGDHTKAPTGWTLQGSDDGTTWKTLDKRSGESFRWDKQTRAFSVKSPGTYGKYRLVLDGEAVVSEIELLA

SEQ ID NO: 315 - protein, 484 aa, Streptomyces SMCD2215
MGSTSAENNGTTGVGRRDLIKRSAALGLISVPTMSFLSACASGGGDDNGDKAKAGKKTAKNPLGVNDTAGMEFVLFDGGFGKEYAQDAVKIYEKNFPKVKVKFSATQKIQSTLQPRFNQGTPPDLIDNSGAEQMDMGVLVGKKQLSDLTPLLDAASYDDPNKKVRDTLRPGIVEMGQFDGDPVWIMYYAYTIYGVWYSQKALDSLDAEYPKTWDEMLAVCEKAKKKGMAGWTYAGKYPYYIPFSLYPMIGKVGGREVLDAIDNLEPNAWKHPAVKACFEAYYELYKKGYILKGTPGLDHIQSQTAWAKGKALFIPNGSWVENESANVIPKDFNLAVSAPSGIDSSDKLPFGTIWASGGEPFIVPAKAKNPEGGMEQLRIMLSEASSKNFTTKVKSLTAFNGGTTGITLTPGLKSGVAALDLAKDNVLNPRIQDWYVQLQKEQIGVGGLGEMMAGRATPAETIKKIQGFADAAAKDSSIKHYKHQ

SEQ ID NO: 316 - protein, 430 aa, Streptomyces SMCD2215
MSIDKTSTPPGDHVVENPEAATGAATVVDPRLLVREQGFAGYLSEFKRKMKAGDLGSIPVVIGLAIIWIIFQSLNSNFLTANNLSDISIAMVGTGMIAVGIVFVLLLGEIDLSVGSVSGVAGASFAVLNINHGMNEALAFVLAILTGTVAGAIHGFFFAKIGVPAFAVTLAGLLFWNGFMLQILGSNGTINLNSDGMVAKLTTYYFTDVAAAYALAIVVTALYFVTSFLGNRRREAAGVPSRPLSEIILRTVLLGVLSIAVAVVYNQYKGLPLAVVIFIGVLLITDFVLRRTPYGRKIFALGGSVEASRRAGINVEMIRISVFAISGTFAAIGGLFIASKIASANQGAGAGDLLMNAIAAAVIGGTSLFGGRGRTWNALLGVLVIVSIQYGLALEGIASPVQYMITGGVLLATVVIDAVTRKTQKTAGRA

SEQ ID NO: 317 - protein, 384 aa, Streptomyces SMCD2215
MRRPHVRIAPRGPGTSALRRRARLARVSANQSPANQTRTPSAATYDSAFLKACRREPVPYTPVWFMRQAGRSLPEYRKVREGVPMLEALRRPELIAEITLQPVRRHGVDAAIFFSDIVVPLKAVGIDLDIKPGVGPVVENPIRTRADLARLRDLTPEDVSYVTEAIGRLTSELGATPLIGFAGAPFTLASYLIEGGPSRTYENAKAMMYGDPELWADLLDRLSDITIAFLKVQIEAGASAVQLFDSWAGALAPADYRRSVLPASAKVFEAVAGYGVPRIHFGVGTGELLGLMGEAGADVVGVDWRVPLDEAARRVGPGKALQGNFDPTVLFAPKEAVEAKAREVLDSAADLEGHVFNLGHGVMPSTDPDALTRLAEYVHEQSAR

SEQ ID NO: 318 - protein, 243 aa, Streptomyces SMCD2215
MSDDVPTTEATRIPNKGKLAKDLNEVIRYTLWSVFKLKDALPEDRTGYADEVQELFDQLAAKDVTIRGTYDLSGLRADADLMIWWHAETSEQLQEAYNLFRRTKLGRALEPVWSNMALHRPAEFNRAHIPAFLADETPRNYISVYPFVRSYEWYLLPDEDRRRMLADHGKMARGFPDVRANTVASFSLGDYEWILAFEADELHRIVDLMRHLRASEARRHVRTEIPFYTGRRKSVAELVEGWV

SEQ ID NO: 319 - protein, 375 aa, Streptomyces SMCD2215
MTGSTRVPFTADDYRSRMDRAARAAADAGLDGLLVAPGPDLVWLTGYAPTAVTERLTLLVLAQGRAPVLVVPTLEAPDAAQAPGAPALNLRDWTDGKDPYAATAALLSGAGRFGISDNAWAMHLLGLQRALPGTSYDSLTEVLPMLRAVKDAAELELMAAAGAAADQAFEEIRKVPFAGRRESEVGADLADLLRQFGHSQVDFTIVASGPNGANPHHEVGDRVIEFGDMVVLDFGGLRDGYGSDTSRTVHVGEPTEEERRVHDLVREAQEAGFRAVRPGAACQEVDRAARAVIAEAGYGEYFIHRTGHGIGVTTHEPPYMIEGERQPLMPGMCFSVEPGVYLPGRFGVRIEDIVTVTEDGGRRLNDTTREMVIVD

SEQ ID NO: 320 - protein, 709 aa, Streptomyces SMCD2215
MQVWPGEAYPLGATYDGAGTNFAVFTEAADRVELCLLHDDGSETAVELRESDAFVRHAYVPGIMPGQRYGFRVHGPYAPEHGLRCNSAKLLLDPYARAISGSVRWGEEVYGYHFDAPEERNDLDSAPHTMTSVVVNPYFDWGDDRRPRRGYHETVIYEAHVKGLTMQHPGLPEELRGTYAALAHPVIIEHLVELGVTTLELMPVHQFVNDHRLVDMGLNNYWGYNTIGFFAPHNAYASWGDRGQQVLEFKSAIKALHEAGIEVILDVVYNHTAEGNHLGPTLSFKGIDNAQYYRLADDPRYYMDTTGTGNSLLMRSPHVLQLIMDSLRYWVTDMHVDGFRFDLAATLARQFHEVDRLSSFFDLVQQDPVVSQVKLIAEPWDVGEGGYQVGNFPPLWTEWNGKYRDTVRDMWRGEQRALAEFASRLTGSSDLYQDDGRRPLASINFVTCHDGFTLHDLVAYNDKHNEANGEENRDGESHNRSWNCGAEGETEDSDVLRLRARQMRNFVATLMLSQGVPMISHGDELARSQGGNNNAYCQDNEISWVKWLDPDATEETTESALLDFTRAMVWLRKDHPVFRRRRFFHGRPVEGTHDELSDIAWFTPEGNEMNQQDWDTAPASALTVFLNGNAISEPGVRGERIADDSFLLMFNASPEPLEFVVPVNHGRQWQVVVDTARSNGLPPEGEPKVDAGDRLTLMDRSLTVLQRPV

SEQ ID NO: 321 - protein, 371 aa, Streptomyces SMCD2215
MPANRSRSKFLRRGTAVLAALPLLALAACGYGSHSDDTDTAKVAAGSKKIDGLDSVKIGYFGNLTHATALVGREQGLFQKELGATKADYAIFNAGPSEIEALNSGSIDIGWLGPSPAINGYTKSNGKSLKIIGGSASGGVKLVVNPKKIKSLKDVKGKNIATPQLGNTQDVAFLNWVAEQGWKVDAQSGKGDVTVVRTDNKITPDAFKAGSIDGAWVPEPTASKLVAEGGRTILDESTLWPDKKFVITNIIVRQAFLKEHPKAVEAVLKASVEANKWINANSDKAKTAANKQLGIDSGKELPANVLDPAWKSIRFTDDPLAATLNTEAAHAVKAGLLQKPNLKGIYDLTVLNKILKAAGEDPVDAAGLGTS

SEQ ID NO: 322 - protein, 481 aa, Streptomyces SMCD2215
MQANENAPRLRTHDRHGRRIDEVDFHPAWHRLLGKGVSAGLTAAWNRPGGHVRRAAAFVVWTQVDAGNLCPLSMTHAAVPALRTDPELAAEWEPRLTSVIYDRELRPAPLKPGALFGMGMTEKQGGSDVRANATTARPLAEDGTYELTGHKWFCSAPMSDGFLVLARAPGGLTCFLVPRVLEDGTRNVFLLQRLKDKLGNRSNASAEVEFDGTWARRVGEEGRGVRTIIGMVAATRLDCVLGSAGLMRQAVAQAVHHCAHREAFGAKLTDQPLMRNVLADLALESEAATTLALRLAAACDDGGEQERALLRIAVPAAKYWVTKRCPPVAVEAAECLGGNGYVEESGLPRLVRESPLNSIWEGAGNVQALDVLRVLQREPQALNAYLQEVGRARGADHRLDAAIKNLLTELADLDGIETRARRLTERFALVLQGSLLVRFAPPQVADAFCGSRLGGDGGSAFGTLPHTLDLASIVERARPPV

SEQ ID NO: 323 - protein, 88 aa, Streptomyces SMCD2215
MRIRVRRTGGFAGIERHAEVDTSGRPDAGEWHALAEQAVTGGHSTPPVGVPDGFSYEITVDGRTFYAADPRLTEEQRTLISRVLKEGA

SEQ ID NO: 324 - protein, 374 aa, Streptomyces SMCD2215
MAGTDREKALEAALAQIERQFGKGAVMRMGERPNEPIEVIPTGSTALDVALGVGGIPRGRVVEVYGPESSGKTTLTLHAVANAQRAGGQVAFVDAEHALDPEYARKLGVDVDNLILSQPDNGEQALEIVDMLVRSGALDLIVIDSVAALVPRAEIEGEMGDSHVGLQARLMSQALRKITSALNQSKTTAIFINQLREKIGVMFGSPETTTGGRALKFYASVRMDIRRIETLKDGTDAVGNRTRVKVVKNKVAPPFKQAEFDILYGQGISREGGLIDMGVEHGFVRKAGAWYTYEGDQLGQGKENARNFLKDNPDLANEIEKKIKEKLGVGVQPEKPAAEPGADAAVSAAPDDAAKTVPAPAAKGAKAKAPAAKS

SEQ ID NO: 325 - protein, 510 aa, Streptomyces SMCD2215
MSASTSRTLPPEIAESVSVMALIERGKAEGQIAGDDVRRAFEADQIPATQWKNVLRSLNQILEEEGVTLMVSAAEPKRTRKSVAAKSPAKRTATKTVAAKTATARKATATAAPEAPPAADVPVEDDAPKAAAKKAVAAKKPAAAKKTAAKKTAAKKTSAKKDDAEAVEEETVEETPKGDEPEGAESAGFVLSDEDEDDAPAQQVAAAGATADPVKDYLKQIGKVPLLNAEQEVELAKRIEAGLFAEDKLANADKLAPKLKRELEIIAEDGRRAKNHLLEANLRLVVSLAKRYTGRGMLFLDLIQEGNLGLIRAVEKFDYTKGYKFSTYATWWIRQAITRAMADQARTIRIPVHMVEVINKLARVQRQMLQDLGREPTPEELAKELDMTPEKVIEVQKYGREPISLHTPLGEDGDSEFGDLIEDSEAVVPADAVSFTLLQEQLHSVLDTLSEREAGVVSMRFGLTDGQPKTLDEIGKVYGVTRERIRQIESKTMSKLRHPSRSQVLRDYLD

SEQ ID NO: 326 - protein, 707 aa, Streptomyces SMCD2215
MTAETSVPSTALLAGADRDGSNYTARHLLVLEGLEAVRKRPGMYIGSTDSRGLMHCLWEIIDNSVDEALGGYCDHIDVILHDDGSVDVRDNGRGIPVDVEPKTGLSGVEVVMTKLHAGGKFGGGSYAASGGLHGVGASVVNALSARLDVEVDRGGHTHAISFRRGVPGAFATSGPDAKFEAGSGLRKTKKIPKTRSGTRVRYWADRQIFLKDAKLSLETLHQRARQTAFLVPGLTIVVRDELGLGEGGSKGEESFRFDGGISEFCEYLASDKPVCDVLRLSGQGTFRETVPVLDEHGQMTPTQVTRELDVDVAMRWGTGYDTTLRSFVNIIATPKGGTHVAGFETAVTSTINEVLRAKKLLRVAEDDVVKDDALEGLTAVVTVRLAEPQFEGQTKEVLGTSAARRIVNTVVAKELKAFLTSTKRDAAAQARVVMEKAVAAARTRIAARQHKDAQRRKTALESSSLPAKLADCRSDDVDRSELFIVEGDSALGTAKLARNSEFQALLPIRGKILNVQKSSVTDMLKNAECGAIIQVIGAGSGRTFDIDAARYGKIIMMTDADVDGSHIRTLLLTLFHRYMRPMVEAGRVFAAVPPLHRIEIVQPKKGQDKYVYTYSDRELRDKLLEFESKGIRYKDSIQRYKGLGEMDADQLAETTMDPRHRTLRRINLSDLDSAETVFDLLMGNDVAPRKEFISSSAATLDRSRIDA

SEQ ID NO: 327 - protein, 283 aa, Streptomyces SMCD2215
MNAIISASELASDLAGQHPPVLLDVRWQLSAAKAAGEPPFDGRAAYAAGHIPGAVYIDLDTELAGTAGERGRHPLPDLEVFGAAMRRAGVSAGRPVVAYDGGQGWAAARTWWLLRWTGHPDVRVLDGGLAAWEGALQTSVPTPAEGDFEPVPGAAGLLDADAAAALARTGVLLDARAGERYRGEVEPIDRVGGHIPGALSAPTNENVGSDGRFLPAERLAERFKALGAGGGSQVGVYCGSGVSGAHEVLALAVAGIEADLYVGSWSEWSSDPTRPVATGPDPR

SEQ ID NO: 328 - protein, 154 aa, Streptomyces SMCD2215
MQLSTTPYEERLTAPRSWWLISFLVGVSFALILLPFGTLPMLGGLVGGTAVAAVMASSYGSVRIRVVGGSLIAGEAKIPVTALGETEVLDAEEARAWRTHKADTRAFLLLRAYIPRALRVVVTDPEDPTPYLYLSTREPERLAEALKAAREAAA

SEQ ID NO: 329 - protein, 260 aa, Streptomyces SMCD2215
MAFKKLLASLGAGGASVETVLTEVNVVPGGVVQGEVRIQGGSVNQEIEGLSVGLQAKVEVESGDEEYKQNIEFTKVRLGGAFELQAGAVHAVPFGLEIPWETPITMIDGQALRGMNIGVTTELSIARAIDSGDLDPINVHPLPAQKAILDAFIQLGFRFKNADMERGHIRNTRQRLPFYQEIEFYPPSQYRGLNQVELSFVADEHAMDVVLEMDKKPGLFSEGSDTFRSFQVGQHDFQGTDWAAYLNQWLSEVGSKRNWF

SEQ ID NO: 330 - protein, 179 aa, Streptomyces SMCD2215
MTELKRRPLPHDFHPPVPAFTVTSEDVQEGATLKDAQVFAAGNTSPQLRWEGFPAGTKSFAVTCYDPDAPTGSGFWHWTVFDIPASVTELPAGAGSGKFEGLPEGAVQVRNDYGTKEFGGAAPPPGDGPHRYVFTVYAVDQEKLGPDSDATPAVVGFNLRFHTLARAQLIGEYEVPAEG

SEQ ID NO: 331 - protein, 541 aa, Streptomyces SMCD2215
MSPVQTTLLAAGEASEHRPLIITLFSIFVAATLVITVWAGRQTKNAADFYAGGRQFTAFQNGLAVSGDYMSAASFLGIAGAIALAGYDGFLYSIGFLVAWLVALLLVAEPLRNSGRYTMGDVLAYRMRQRPVRTAAGTSTIVVSIFYLLAQMAGAGVLVSLLLGITSDGGKIGIVALVGVLMIVYVTIGGMKGTTWVQMVKAVLLIVGAILLTFLVLLKFDFNISDLLGSAADNSGKGSAFLEPGLKYGLTSTSKLDFISLGIALVLGTAGLPHILIRFYTVPTAKAARKSVNWAIGLIGAFYLMTLALGFGAAALIKPDEIIASNKAGNTAAPLLALHLGGVDSDWGAILLASISAVAFATILAVVAGLTLASSSSFAHDIYANVIKKGRASEKDEVRAARLATVGIGAVSILLGALARDLNVAGLVALAFAVAASANLPTILYSLFWKRFTTSGALWSIYGGLITAVGLVLFSPVVSGKESSMFPDVDFHWFPLENPGIISIPVGFLLGVVGTYLSKEEPDAGKYAELEVRSLTGTGAH

SEQ ID NO: 332 - protein, 267 aa, Streptomyces SMCD2215
MATPAKDLGPVLDKDGVRLTVDDAIATVTLTNPAKRNAQSPAMWRTLAEAGRVLPGSVRVVVLRAEGQSFSAGLDRRMFTPEGIEGEPTFIDLARSSDGELDASIAGFQDGFTWWRRSDLVSIAAVQGHAIGAGFQLALACDLRVVADDVQFAMRETSLGLVPDLTGTHPLVALVGQARALEICVTGRFVTAEEAVSTGLANLAVPADQLDGAVKDLASAILAAPRDAVIETKALIRGAQGRSYDDQRAAERAAQARRLRDLAGLGE

SEQ ID NO: 333 - protein, 668 aa, Streptomyces SMCD2215
MSTPYPFTAVVGQEDLRLALLLNAVSPAIGGVLVRGEKGTAKSTAVRALSTLMPELDVVAGCRFSCDPDAPDPACPDGPHEPGAFETRPARMVELPVGASEDRLVGALDIERALAEGVKAFEPGLLADAHRGILYVDEVNLLHDHLVDLLLDAAAMGASYVEREGVSVRHAARFLLVGTMNPEEGELRPQLLDRFGLTVEVAASREPDQRVEVVRRRLAYDDDPAGFAARWADEETAVRQRIVAARELLPSVRLGDGALRQIAATCAAFEVDGMRADIVMARTATALAAWAGRTDVLAEDVRQAALLALPHRRRRNPFDAPGLDEDKLDETLEEFAEPEDDDDPDPDGGPGGGGGGGGQPEPDAGPQDGDAGARPEAGEDGEPRASGAGEQSPVRAAEPFRTKVLSVPGIGEGAAGRRSRARTEHGRTTGARRPQGALTKLHLAATVQAAAPHQRARGRSGRGLVVRRDDLRQATREGREGNLVLFVVDASGSMAARQRMSAVKGAVLSLLLDAYQRRDKVGLVTFRGSAAELVLPPTSSVDAAAARLESLPTGGRTPLAAGLLKAHDVLRVERLRDPARRALVVLVTDGRATGGPEPVAFAGRAARLFAAEGTASVVVDCESGPVRLGLAGQLAGELGGTAVTLDELRADSIAGLVKDVQGTSRRAA

SEQ ID NO: 334 - protein, 299 aa, Streptomyces SMCD2215
MNGKKFRLPARRLATVATATALAAGPVALAGAGTAHATGDQGHAGAVVLRTGLDVSLLNKTVNVPLAVSLNQVEAPRSAEKTALSATLDGVDGGKPFNVLSAQAASARATVTSGRAEGRTNLVHARLHVPGLPLLSLVEIEKVTSRATCAAGKTPVAESNLLGSVTVLGKKVTLTPGGTTDVKVPGVGEVRLDLSKKETTSRTAAATALQLKVSVNPLKLNVADVEGEVTLARATCEAPAAAEQSSAPTTDPGDTKAQGAESGLAETGGNSLTPYIAGGAIALVLAGGGALALARRGRN

SEQ ID NO: 335 - protein, 363 aa, Streptomyces SMCD2215
MSDRTVLHVKGRVLAGPDDVRDELWVVGGRISYDRPAGARDVRTVEGWALPGLVDAHCHVGLGPHGPVEQDVAEKQALTDRDAGALLLRDAGSPSDTRWIDDREDLPKIIRAGRHIARTRRYIRGYAWEIEPDDLVAYVAQEARRGDGWVKLVGDWIDRDLGDLSPSWPRGAVEAAIAEAHRLGARVTAHCFAENSLRDLVEAGIDCIEHATGLTDELIPLFASRGVAIVPTLVNIATFPQLADGGADKFPQWAAHMRRLYERRYDTVRNAYDAGIPVYVGTDAGGHLGHGLVAAEVAELVTAGIPPVEALSATAWGAREWLGRPGLDEGAPADLVVYEEDPRADVRVLAAPRRVVVDGHPVG

SEQ ID NO: 336 - protein, 365 aa, Streptomyces SMCD2215
MNHPLLDLPPMSAAQFASIEDRVAKLLGTAQDVVIMQGEALLPLEGAIRGTAGPGTVALNVVTGPYGQTFGNWLRDCGATVIDLSVPFHTAVSAAQIREAFAEHPEIDFVSLVHAEAATGNTNPVAEIGEVVREQGALFYLDAVASIGAEPVLPDAWGVDLCVVGAQKAMGGPAGVSAVSVSERAWARMAANPGAPRRSYLSLLDWKERWVDGGRRALLHAPAQLEMLALEACLERIETVGLAAVMSRHASAAAATRAGALALGGVEPYVHEAHEAAPVATTLRTPQGIIASDLVTQALTTDPALPLAAGGGALAASMIRVNHYGPDATPEAVRSCLTALGTALTENGVTVDLEAARGAVAEAWA

SEQ ID NO: 337 - protein, 202 aa, Streptomyces SMCD2215
MDVELPELPFALRTYGPEGNWSYEDGILTGWAGPRQDRFVPPTGEALEPASDAPRLLGAPEGDFQLIARVTVGFAGAFDAGVLYVHVGERAWAKLCLEYSPDVPTVCTVVTRGHSDDANSFTVDGSSVWFRVSRTGRAFAFHASRDGHRWTFVRLFTLGTEKETGDALIGFMTQSPMGEGCVVTYDHLEYRPTWPSDLRDGS

SEQ ID NO: 338 - protein, 295 aa, Streptomyces SMCD2215
MVLGTASQVPTRHRNHNGYLLRWDGEGLLFDPGEGTQRQMLRAGVAAHDLNRVCVTHFHGDHSLGLAGVVQRINLDRVPHEITAHYPRSGQHFFDRLRYATAYRETVALTETPVDADGILAVTGSYTLEARRLSHPVESYGYRLIEPDGRRMLPERLAAHGIKGPDVGRLQREGSFDGVSLADVSEVRRGQRFAFVMDTRLCDGVHALAEGCDMLVIESTFLDEDTALATEHGHLTAGQAAAVAREAGVRHLVLTHFSQRYPEPDEFERQARAAGFEGELTVAHDLLRVPVPKRR

SEQ ID NO: 339 - protein, 117 aa, Streptomyces SMCD2215
MPGEPQDDCLFCKIVEGHVPATIVRETQTTVAFRDINPQAPTHVLVIPRAHYENVAALAAADPDLAADVLREAKAVADEDKLESYRVVFNTGPGAGQTVFHVHAHVLGGRGMQWPPG

SEQ ID NO: 340 - protein, 303 aa, Streptomyces SMCD2215
MSSAAFETQRAALADVVAIPVTPFAEDGTVDQDVHRALLRRLLDGGVTTLTPNGNTGEFYALTPEERRLVTELTLDEAGDRAVVLAGVGLDVPTAVESARHAREHGARMVMVHQPVHPYVSQAGWVDYHRAIAESVPDLGVVPYIRNAQLTGARLAQLADACPNVIGVKYAVPDAAKFAAFARDAGLDRFVWVAGLAEPYAPSYFSAGATGFTSGLVNVAPSVSLNMIEALRSGDYPAAMKVWEQIRRFEELRAANGSADNVTVVKEALASLGLCRREVRPPSKPLPESKRAEVAAIAAGWSI

SEQ ID NO: 341 - protein, 418 aa, Streptomyces SMCD2215
MTQLPGLLDVEAIRKDFPVLDRQVHDGKKLVYLDNAATSQKPRQVLDALNEYYERYNANVHRGVHVLAEEATALYEGARDKVASFINAPSRDEVIFTKNASESLNLVANMLGWADEPYRVDHETEIVITEMEHHSNIVPWQLLAQRTGAKLKWFGLTDDGRLDLSNIDEIITEKTKIVSFVLVSNILGTVNPVEAIVRRAQEVGALVCIDASQAAPHMPLDVQSLQADFVAFTGHKMCGPTGIGVLWGRQELLEDLPPFLGGGEMIETVSMHSSTYAPAPHKFEAGTPPIAQAVGLGAAIDYLSALGMDKVLAHEHALTEYAVKRLAEVPDLRIIGPTTAEDRGAAISFTLGDIHPHDVGQVLDEQGIAVRVGHHCARPVCLRYGIPATTRASFYLYSTPAEIDALVDGLEHVRNFFG

SEQ ID NO: 342 - protein, 358 aa, Streptomyces SMCD2215
MSSALTDLFPHPIVQAPMAGGVSVPHLAQAVSEAGGLGFLAAGYKTADGMYQEIKQLRGLTNRPFGVNLFVPQPDSADPGAVEIYAHQLAGEAAWYETELGDPDSGRDDGFDVKLAVLLDNPVPMVSFHFGVPSRDVIDSLHRVGTFTLVAATTAEEALAVERSGADAVIAQGVEAGGHQGTHRDVPERGGAGIGLLSLVAQVRETVSIPIIAAGGIMRGGQIAAVLAAGASAAQLGTAFLVTPESGASAVHKQALTNPLFVRTELTRAFTGRPARGLVNRFLREHGPYAPAAYPEVHHLTAPLRKKAAASGDAQGMALWAGQGHRMARELPAGQLVEVLVAELDAARTALSAEGDLR

SEQ ID NO: 343 - protein, 695 aa, Streptomyces SMCD2215
MSTKPTTTDLEWTELDQRAVDTARVLAADAVQKVGNGHPGTAMSLAPAAYTLFQKVMRHDPADPDWVARDRFVLSAGHSSLTLYTQLYLAGFGLELDDLKSFRTWGSKTPGHPEYGHTRGVETTTGPLGQGVANAVGMAMAARYERGLFDPDAPQGESPFDHFIYCIAGDGCLQEGISSEASSMAGHQQLGNLILLWDDNHISIEGDTETAVSEDTVKRYEAYGWHVQRIAPKPDGDIDPHAVYNAIEAAKAVTDRPSFIAMRSIIAWPAPHAQNTEAAHGSALGDEEVAATKRVLGFDPDKTFEVSDEVLKHTRQALERGREAKAEWEKSFQLWRQNNAERAAEFDRIAKGELPAGWEEKVPVFEPGKGIATRAASGKVLQALGAIVPELWGGSADLAGSNNTTIDKTSSFLPASNPLPEADPYGRTIHFGIREHSMAAEMNGITLHGNTRVYGGTFLVFSDYMRNSVRLSALMHLPVTYVWTHDSIGLGEDGPTHQPVEHLASLRAIPGLNVVRPADANETAIAWREILRRYTKVFGKGAPHGLALTRQGVPVYEPNEDTARGGYVMLEAEGGEPQVVLVATGSEVHVAVEAREQLQADGVPTRVVSMPCVEWFEEQDQGYRDSVLPPNVKARVAVEAGIGLTWHKYVGDAGRIVSLEHFGASADAKVLFREFGFTAENVAAKARESLAAAQR

SEQ ID NO: 344 - protein, 423 aa, Streptomyces SMCD2215
  misc_feature (149)..(149): Xaa can be any naturally occurring amino acid
MADFADRVRSGAWTGHTGKRIKNVVNIGIGGSDLGPAMAYEVLRGFTDRGLTVRFVSNVDGADLHEATRDLDAAETLFIIASKTFTTIETITNATSAREWLLAELKAGQEAVARHFVALSTNAGKVTEFGIDPDNMFEFWDWVGGRYSXDSAIGLSLMIAIGPDRFREMLDGFHLVDEHFRTAPAESNVPLLLGLLGIWYGNFHDAQSHAVLPYSHYLSKFTAYLQQLDMESNGKYVGRDGQQVDWQTGPVVWGTPGTNGQHAYYQLIHQGTKLIPADFIGFAEPVAELSGTLKAQHDLLMANFFAQTQALAFGKTPDEVRAEGVAEDLVPHKTFKGNHPTTTILARELTPSVLGQLIALYEHKVFVQGAVWNIDSFDQWGVELGKVLAKRVEPALTEGARVPGLDESSTALVAKYRELRGRA

SEQ ID NO: 345 - protein, 258 aa, Streptomyces SMCD2215
MSTRTPIMAGNWKMNLNHLEAIAHVQKLAFALADKDYEAVEVAVLPPFTDLRSVQTLVDGDKLKIKYGAQDISAHDSGAYTGEISGPMLSKLKCTYVVIGHSERRQYHNESDEQVNAKVKAAYKHGLTPILCVGEELEVRDAGNHVAHTLAQVEGGLKDLPAEQAESIVIAYEPVWAIGTGKVCGAEDAQEVCAAIRGKIAELYTQELADQVRIQYGGSVKSGNVAEIMAQADIDGALIGGASLDADEFVKIVRFRDQ

SEQ ID NO: 346 - protein, 403 aa, Streptomyces SMCD2215
MKTIDELLAEGVAGKRVFVRADLNVPLDGTTITDDGRIRAVLPTVKALVEADAKVVVASHLGRPKGAPDPAFSLLPAAEHLGELLGAPVAFAQDTVGPAAHDAVDGLQPGQVAVIENLRFNTGETSKDDTERGEFADRLAALADVYVGDGFGAVHRKHASVYDLPARLPHYAGYLIATEVGVLKKLTDEVQRPYVVALGGAKVSDKLAVIDQLLGKADRILIGGGMAYTFLKAKGYEVGASLLQEDQIPAVLEYIERAEKTGVELVLPVDAVVAPAFPDLKTKAPADATTVAADAIPADRMGLDIGQASGKLYASKITDAATVFWNGPMGVFEHPDFAEGTKAVAQALLDSPAFTVVGGGDSAAAVRLLGFDETAFGHISTGGGASLEYLEGKTLPGLAALED

SEQ ID NO: 347 - protein, 335 aa, Streptomyces SMCD2215
MTIRVGINGFGRIGRNYFRALLEQGADIEIVAVNDLGDTATTAHLLKYDTILGRLKAEVSHTADTITVDGHTIKVLSERNPADIPWGELGVDIVIESTGIFTKKDDAAKHIAGGAKKVLISAPAKDEDITIVMGVNQDKYDPANHHVISNASCTTNCVAPMAKVLDENFGIVKGLMTTVHAYTNDQRILDFPHKDLRRARAAAENIIPTTTGAAKATALVLPQLKGKLDGIAMRVPVPTGSATDLVVELARETTKDEVNAAFKKASEGELQGYLSYTEDQIVSSDIVSDPASCTFDSSLTMVQEGNTVKILGWYDNEWGYSNRLVDLTVFVGNQL

SEQ ID NO: 348 - protein, 317 aa, Streptomyces SMCD2215
MNKQDGQQTQGGDGAQVSTGASGDAVPVPDAAIPELVIISGMSGAGRSTAAKCLEDLGWFVVDNLPPALIPTMVELGARSQGNVARIAVVVDVRGRRFFDNLRESLADLDSRRVTRRIVFLESSDDALVRRFESVRRPHPLQGDGRIVDGIAAERELLRELRGDADLVIDTSSLNVHELRAKMDAQFAGEEEPELRATVMSFGFKYGLPVDADLVADMRFLPNPHWVPELRPFTGLNEEVSAYVFNQPGAKEFLDRYAELLRLIAAGYRREGKRYVTIAIGCTGGKHRSVAMSEKLAARLAAEGVETVVVHRDMGRE

SEQ ID NO: 349 - protein, 218 aa, Streptomyces SMCD2215
MTYSGQVTVGGPADVHELKDLMITKIAVGPMDNNAYLLRCRATDEQLLIDAANDADTLLGMIGDDGIASVVTTHRHGDHWQALAQVVTATGARTFAGRNDADGIPVPTDVLVDDGDTVRVGQVELTARHLVGHTLGSIALVYDDPHGHPHVFTGDCLFPGGVGNTHKDPKAFASLIHDVETKIFGMLPDETWVYPGHGNDTTLGAERPHLPEWHARGW

SEQ ID NO: 350 - protein, 188 aa, Streptomyces SMCD2215
MTKGQAISLQKNDGGSLAAVRMGLGWQAAPRRGLFGSRTREIDLDASAVLFADKQPVDVVFFRHLVSDDGSVRHTGDNLVGGVGQGGDDEAILVDLSRVPVHIDQIVFTVNSFTGQTFQEVQNAFCRLVDETNGQELARYTLAGGGAYTAQIMAKVHRSGPGWTMTALGTPANGRTFQDLMPAILPHL

SEQ ID NO: 351 - protein, 501 aa, Streptomyces SMCD2215
MTSSTETTATTPQVAVNDIGNEEAFLAAIDETIKYFNDGDIVDGVIVKVDRDEVLLDIGYKTEGVIPSRELSIKHDVDPNEVVAVGDEIEALVLQKEDKEGRLILSKKRAQYERAWGTIEKIKEEDGIVTGTVIEVVKGGLILDIGLRGFLPASLVEMRRVRDLQPYVGKELEAKIIELDKNRNNVVLSRRAWLEQTQSEVRQTFLTTLQKGQVRSGVVSSIVNFGAFVDLGGVDGLVHVSELSWKHIDHPSEVVEVGQEVTVEVLDVDMDRERVSLSLKATQEDPWQQFARTHQIGQVVPGKVTKLVPFGAFVRVDEGIEGLVHISELAERHVEIPEQVVQVNDEIFVKVIDIDLERRRISLSLKQANEAFGADPSTVEFDPTLYGMAASYDDQGNYIYPEGFDPETNDWLEGYETQREAWEHQYAEAQQRFEQHQQQVIKSREADAAAAAEGGDTAGGAAPAASGGGGSYSSEGADNSGALASDEALAALREKLAGGQS

SEQ ID NO: 352 - protein, 908 aa, Streptomyces SMCD2215
MAEKASKKTETTADGARPRLMLMDGHSLAYRAFFALPAENFTTATGQPTNAIYGFASMLANTLRDEEPTHFAVAFDVSRKTWRSEEFTEYKANRSKTPDEFKGQVELIGELLDAMHASRFAVPGFEADDIIATLATQAEAAGFEVLIVTGDRDSFQLVSEHTTVLYPTKGVSELTRFTPEKVFEKYGLTPAQYPDFAALRGDPSDNLPGIPGVGEKTAAKWINQFGSFAELVERVEEVKGKAGQNLRDHLESVKLNRRLTELERNVELPKSVADLAREPYDRKAVSLVLDTLEIRNPSLRERLFGVDPGAEEAEVTPIATDGVELDGAVLGTGELAPWLAEHGGEPLGVATVDTWALGTGSVAEVALAAADGAAGWFDPSQLNEADEKAFAAWLADAGRPKVFHNAKSAMRVFAEHGWSIAGVRMDTALAAYLVKPGRRSFDLDALSLEYLHRELTPAATADGQLAFGTDDGAEAEALMVQARTVLDLGEAFEGRLAEVGAADLLRDMELPTSALLARMERHGIAADRAHLEAMEQMFAGAVQQAVKEAHAAAGHEFNLGSPKQLQEVLFGELALPKTKKTKTGYTTDADALAWLAAQTDNELPVIMLRHREQAKLRVTVEGLIKTIAADGRIHTTFNQTVAATGRLSSTDPNLQNIPVRTDEGRAIRRGFVVGEGFESLMTADYSQIELRVMAHLSEDEGLIEAFVSGEDLHTTAASQVFAVEPAAVDAEMRRKIKAMSYGLAYGLSAFGLSQQLNIEAAEARGLMDAYFERFGGVRDYLRRAVDEARATGYTATLFGRRRYLPDLNSDNRQRREAAERMALNAPIQGTAADIVKIAMLKVDGALREAGLTSRMLLQVHDEIVLEIAPGERATAEEIVRREMSDAVHLNVPLGVSVGVGTDWESAAH

SEQ ID NO: 353 - protein, 763 aa, Streptomyces SMCD2215
MATKPPQSDPVQDAPQVAGPKHAAAGLPAIGHTLRVAQQQMGVRRTALTLLRVNQKDGFDCPGCAWPEPEHRHTAEFCENGAKAVAEEATLRRVTPEFFAAHSVADLATRSGYWLGQQGRLTHPMYLPEGADHYEPVTWERAFDIVAEEIAALDSPNEAVFYTSGRTSNEAAFLYQLFARQLGTNNLPDCSNMCHESSGSALSETIGIGKGSVLLEDLYKADLIIVAGQNPGTNHPRMLSALEKAKAGGARIVSVNPLPEAGLERFKNPQTAQGMLKGAALTDLFLQIRIGGDQALFRLLNKLILEADGAVDEAFVREHTHGYEEFAAAAKAADWDETLAATGLTRAEIEHALGMVLASKRTIVCWAMGLTQHKHSVPTIREIVNFLLLRGNIGRPGAGVCPVRGHSNVQGDRTMGIFERPAPVFLDALEREFGFAPPREHGFDVVRAIRALRDGEAKLFFAMGGNFVSASPDTDVTEAAMRRARLTVHVSTKLNRSHAVTGARALILPTLGRTERDLQGSGEQFVTVEDSMGMVHASRGRLDPASRHLLSEPAIVCRLARRVLGEESTVPWEEFEKDYATIRDRIARVVPGFEDFNARVTGSAGRPGGFALPHAPRDERRFPTKTGKANFTAAPVEYPELPEGRLLLQTLRSHDQYNTTIYGLDDRYRGIRNGRRVVLVNPDDARALGAAEGSYVDLVSEWKDGVERRANGFRVVHYPTARGCAAAYYPETNVLVPLDATADTSNTPASKSVVVRLEQSATD

SEQ ID NO: 354 - protein, 841 aa, Streptomyces SMCD2215
MACMSVLTRDEAQTRAKLLDVHRYTIELDLTTGDETFDSSTVIRFSAHTDADTFVELKPAHLRSATLDGQPLDPHTLHENRLPLTALTAGEHELRIDASMRYSRTGEGMHRFTDPTDGETYLYTQLFMEDVQRVFAAFDQPDLKAVFELTVKAPEGWSVLANGVTEHLGEGRWQAAPTPLISTYLVAVAAGPWHSVHTEHRGLPFGIHCRRSLAPHLDADAEEILEITKQCYDRYHEKFQEPYPFDSYDQAFVPEFNAGAMENPGLVTFRDEFVYRSAVTDTERQTRAMVIAHEMAHMWFGDLVTLRWWDDIWLNESFAEYMGYQTLTEATRFTDTWTDFGVARKAWGYDADQRPSTHPVAPENVDDTASALLNFDGISYAKGASALRQLVAWLGEKDFLAGINTHFARHKFANATLADFIDSLASATERDVHAWADAWLRTTGVDTLSPVVTRQDSGTYTLQVERTGSRPHRIAVGLYDQDVADEDRHLTLRERIDLDIPQSEPHTLGKRPALLLLNDGDLTYTKIRFDDGSFEAVRTGLSGLPDPLTRAVVWNALRDAVRDGELPPAAHLETARAHLPRETDLALVQGVLAFAGAQVTDRYLTPEERPAALGTLSSLCRDLIRRTEDGDNPGLRLIAVRHFIDVAAHPDTIAAWLADGTVPGGPELDPELRWRILGRLAVLGATDEAAITAELDRDPSATGQEGAARCRAALPDPQAKARAWQAMFGGDDRTDLSNYLFIATAQGFWQPEQADLVRDYVPRYYEDAVAVAARRGPAIADAAGRWAFPLHAVDTETLRLGKSCLKNANPIPALRRKLVDQLDDLARALRVREVPTSPSGV

SEQ ID NO: 355 - protein, 549 aa, Streptomyces SMCD2215
MDGARSANETVTSARREPPGKGERVADWADGRLGLYSLAKANMRKVFPDHWSFMLGEVCLYSFLILILTGIYLTLFFEPSGVEVIYHGSYTPLNGVPMTRAYESTLDISFDVRGGLLIRQIHHWAAVVFIAGMLIHMMRVFFTGAFRKPRELNWLFGWTLLFLGIITGLTGYSLPDDLLSGTGIRFADGAILSVPIVGTYLSMFLFGGEFPGHDIISRLFPIHVLLLPGIMLGLVVAHLILVFYHKHTQYPGPGRDQKTVVGMPFLPVYMAKAGGFFFLVFGVLTIMGGVASINPVWAFGPYRPDLVTTGAQPDWYLGFSEGLIRVMPGWELNFWGHTLELGVFIPFSLFPLIMLAIGVYPFIEAWITGDKREHHILDRPRNMPVRTGLGVAWLSLYGVLLIGGGNDVVATHLHLSINVITWFVRISFFVMPVVAFLVTKRVCMGLQRRDRDKVLHGRESGTIKRLPHGEFVEVHEPLEQDQLFTLTQHEQEPPYEIGPLVDANGVRRQVTVSQRVRAQLSKAMFGSESHIPKPTVEEYRELTSGDHHH

SEQ ID NO: 356 - protein, 269 aa, Streptomyces SMCD2215
MSVLDEIIDGVRADLAERQARVSLDELKERAAKAPAAKDGLAALRGDGVKVICEVKRSSPSKGALAAIADPAGLAADYEAGGAAVISVLTEQRRFGGSLADLEAVRARVDIPVLRKDFIVTSYQLWEARAYGADLALLIVAALEQPALESLIERAVSIGLTPLVEVHDEDEVERAVDAGAKVIGINARNLKTLEVDRGTFERVAPEVPADLVRVAESGVRGPHDLIAYANAGADAVLVGESLVTGRDPKTAVSDLVAAGEHPALRHGRG

SEQ ID NO: 357 - protein, 197 aa, Streptomyces SMCD2215
MSRVGRVERVTKETSVLVEIDLDGSGKVDVSTDVGFYDHMLDQLGRHGLFDLTVKTEGDLHIDSHHTIEDTALALGAAFKQALGDKVGIYRFGNCTVPLDESLAQVTVDLSGRPYLVHTEPENMAPMIGEYDTTMTRHILESFVAQARIALHVHVPYGRNAHHIVECQFKALARALRYASERDPRAAGILPSTKGAL

SEQ ID NO: 358 - protein, 441 aa, Streptomyces SMCD2215
MISRIDLRGDALPEGPALRDLLPRADFDVAAALEKVRPICEAVHHRGDAALIDFAEKFDGVRLDQVRVDAEVLTKALDELDPAVRAALEESIRRARLVHREQRRTNRTTQVVPGGSVTEKWVPVERVGLYAPGGRSVYPSSVIMNVVPAQEAGVESIALASPAQAEFGGLPHPTILAACALLGVDEVYAAGGATAVAMFAHGTESCPPANMVTGPGNIWVAAAKRYFTGRIGIDAEAGPTEIAILADDTADPVHVASDLISQAEHDPLAAAVLVTDSVALADAVEKELEPQVAATKHIEDRIRPALAGRQSAIVLVDGVDEGLRVVDAYGAEHLEIQTADATAVADRVKNAGAIFVGPWAPVSLGDYAAGSNHVLPTGGCACHSSGLSVQSFLRGIHIVDYGKDALAEVAHHVVTLAEAEDLPAHGAAIKARFGWKVPEGK

SEQ ID NO: 359 - protein, 556 aa, Streptomyces SMCD2215
MTSRYRSSEANQSLNPLAPRRRTVVKAAAATAVLAGPLAAALPARAAADVPAFLHGVASGDPLPDGILLWTRVTPTSDAVPGSGRGPDTEVGWIVAKDKALTNIVAKGSVTATAASDHTVKADIRGLQPATDYWFRFSAGPTDSPVARTRTAPAADAAVPGLRFGVVSCANWEAGYFSSYRHLAARGDLDAWLHLGDYIYEYKSGEYAARGTVVRPHAPANEIITLADYRTRHGRYKTDPDLQALHHKAPVVAIWDDHEFADNAWSGGAVNHTEGAEGTWTDRKAAAKQAYFEWMPVRPAIAGTTYRRLRFGRLADLSLLDLRSFRSQQASTASGSVDDLDRTITGRAQLDWLKAGLKASDTTWRLVGNSVMISPFAVGSLPADLLKPLAKLLGLPQEGLALNTDQWDGYTDDRRELLAHLRANAIRNTVFLTGDIHMAWANDVPVDAGTYPLSASAATEFVVTSMTSDNLDDIVKVPEGTVSAIASPVIRAANRHVHWVDTDRHGYGVLDITADRAQMDYYVLSDRTDENATAEWVRSYRTRSGTQKVERTYDPV

SEQ ID NO: 360 - protein, 207 aa, Streptomyces SMCD2215
MSKRPPDGAVGPGWHHGLMNIMLFHSAFGLRPAVRDAADRLRGAGHEVWIPDLFEGRTFETVEEGMEFKDGIGKDELLKRAVLAAAPYSGRGLVYAGFSLGASIAQTLALGDEKARALLLLHGTSDIAPDASVDELPVQLHVAEPDPFETDDWLSAWYLQMGRAGADVEVYRYAGAGHLYTDPGLPDYDEEAAEATWRVALGFLETL

SEQ ID NO: 361 - protein, 294 aa, Streptomyces SMCD2215
  misc_feature (68)..(70): Xaa can be any naturally occurring amino acid
MSTIPEIRTLPVPDGLEGERVDAAISRMFGFSRTKAAELAAAGKVMVDGSVVGKSERVHGGAWLEVEXXXDDDVVVIVKPVGVAAHPSPGWSGPTVIGGLAAAGYRISTSGAAERQGIVHRLDVGTSGLMAVAKSERAYTSLKRQFKERTVDKRYHTLVQGHPDPTSGTIDAPIGRHPNHDYKWAVTADGKPSVTHYDLIEAFRAASLLDVKLETGRTHQIRVHMSAHRHPCVGDLTYGADPTLAKRLHLTRQWLHAVRLGFEHPGDGEWVEFASEYPADLQKALDQVREETYG

SEQ ID NO: 362 - protein, 551 aa, Streptomyces SMCD2215
MVAKKTAVQQSASEQATDGAARAAHATGLVRTVREVVGEGPGAARTPGLSAQSHKKAAGKGSAAGGKKRATAAPGRDTERTAGSPAKSLSAKKSTPKGAEASRSTGGKGAAKSAAGKGGAGKSGAEAGVAAGTGGGKRATRTSATKRTAAAKSAAAETAAGKAAAAETVTGKNEATKSAARKRAPARSAAGKTAPAGSATAKSVAGKRAPAKAAARKTTAAESATAEPEAKKTTTTTAKAAAKKSAAAEPATAKDPAKKTAPAKAAAKKTTASEPAAKKTEPAEAAAKKTAAVESASARPAAAKSASPAPATAKSAAAKPSTAKPAAAKHAAAKPDAGEGMAGAGVGKERVRKAGGGTKGARGKGAGAERVGRKSTAKTVGAAQAAEETGATTVVAKKTPGTATAAKTAVPKARVAAVEPGELAVRPGEDPWTPQEVEEARTELLAEMTRLKEEISSSESAIQGMMRDSGDGAGDDQADTGTKNITREHEMALAANAREMLTQTERALQRLDAGTYGLCENCGNAIGKARMQAFPRATLCVECKQKQERRY

SEQ ID NO: 363 - protein, 1045 aa, Streptomyces SMCD2215
MTMPTYRQVPAQVDLPALEHAVLDFWREQKIFAKTLEQSEGRPEWVFYEGPPTANGMPGAHHIEARVFKDVFPRFRTMRGYHVARKAGWDCHGLPVELAVEKELGFTGKRDIEAYGIAEFNAKCRESVTRHTDAFEELTTRMGYWTDLTDPYRTMDPEYIESVWWSLKEIFNKGLLVQDYRVAPWCPRDETGLSDHELAQGYETIVDPSVYVRFPLTSGPLAGEAALLVWTTTPWTLVSNTAVAAHPDVTYVVVTDGTEKLVVAEPLVGKALGEGWETTGESFSGTDMERWTYQRPFELVEFPEPAHFVVNAEYVTTEDGTGLVHQSPAFGEDDLKVCRAYGLPVVNPVRRDGTFEEDVPLVGGVFFKKADEKLTEDLQQRGLLFKHIPYEHSYPHCWRCHTALLYYAQPSWYIRTTAVKDRLLQENENTNWFPDTVKHGRYGDWLNNNIDWALSRNRYWGTPLPIWRCEDDHLTVVGSRAELTELTGSDQSELDPHRPYIDDVTFDCPSCAKTATRVPEVIDAWYDSGSMPFAQWGYPYKNKDLFEARYPAQFICEAIDQTRGWFYTLMAVGTLVFDKSSYENVVCLGHILAEDGRKMSKHLGNILQPIPLMDQHGADAVRWFMAAGGSPWAARRVGHGTIQEVVRKTLLTYWNTVAFQALYARTSDWAPSKADPAPSDRPVLDRWLLSELHALTDQVTQSLEAYDTQRAGKLLSAFVDDLSNWYVRRSRRRFWQGDKAALRTLHEVVETVTKLMAPLTPFITERVWQDLIVPVTPGAPESVHLSTWPEADLSAIDPELSKQMVLVRRLVELGRATRAESGVKTRQPLSRALVAASGFDTLDRELHAQITEELNVSSLASLSEVGGSLVDTTAKANFRALGKRFGKRVQEVAKAVANADAAALSLALREGTASVEVDGETIALAPDEVIITETPREGWSVASDSGATVALDLEITEELRQAGLARDAIRLIQEARKNSGLDVADRIALRWTSTDPAVIAALTEHAGLIADEVLATDFAQGEADASYGEPFTDEGLSLAFRLRKA

SEQ ID NO: 364 - protein, 245 aa, Streptomyces SMCD2215
MIGQRSRTSTAGGAHFAFTDRWGGVSAVPYEELNLGGAVGDDPEAVRTNRELAAKSLGLDAARVVWMDQVHGAEVAVVDEPWGDRPVPEADAVVTTRRGLALAVLTADCTPVLLADPVAGVVAAAHAGRPGMVAGVVPAAVRAMTGLGAEPGRIVARTGPAVCGRCYEVPEKMRAEVAAVEPAAHSETSWGTPAVDVTAGVHAQLERLGVRDREQSPVCTLESGDHFSYRRDRTTGRLAGYVWLD

SEQ ID NO: 365 - protein, 471 aa, Streptomyces SMCD2215
MIALSLAEIAEVVGGQTHDIPDPSVQVTAPVVRDSREVEPGSLFVAFVGERVDGHDFAQQVVDAGAVAVLASRPVGVPAIVVEDVQTALGALARHVVRRLGATLVALTGSAGKTSTKDLIAQVLQRKAPTVWTPGSLNNEIGLPLTALTATEETKFLVLEMGARGIGHIRYLAGLTPPRIGLVLNVGTAHIGEFGGREQIAQAKGELVESLPSSDEGGTAVLNADDPLVRAMASRTKAKVVLFGEADEADVRAENVRLTDTGQPAFRLRTPSGASDVTMRLYGEHHVSNALAAAAVAHELGMSAQEIATALSEAGSLSRWRMEVTERPDGVTIVNDAYNANPESMRAALRALVAMGRGRRTWAVLGKMAELGDEALAEHDAVGRLAVRLNVGKLVAVGGREASWLQLGAYNEGSWGEESVHVSDAQAAVDLLRSELRPGDVVLVKASRSVGLESVAQALLATGAEGEVAAR

SEQ ID NO: 366 - protein, 202 aa, Streptomyces SMCD2215
MTAFSRPRTATESQVTSNVMSMTTPASVPTESQGAIRGGTVTDRLVEANERYAAAFTDPGMDAHPVLHVAVVACMDARLDLHQALGLELGDCHTIRNAGGVVTDDVIRSLTISQRALGTRSVVLIHHTGCGMEAVTEDFRHDLEMEVGQRPAWAVEAFRDVEQDVRQSMQRVRTSPFLLHRDDVRGFVFDVKTGLLREIDPE

SEQ ID NO: 367 - protein, 228 aa, Streptomyces SMCD2215
MSAAVTSRGTAPVTIRAMESSSTAPGGSTRREATRQKLYEAAVTLIAEQGFSATTVDEIAERAGVAKGTVYYNFASKSVLFEELLRHGVGLLAASLREAAEKTARDGGSKVDALDAMVRAGLVFIDRYPAFTQLYVAEMWRTNRAWQSTLMVVRQQAVAVVEDVLREGVEGGEFSDEIDVPLTASALVGMVLVAALDWQSFQPERSLDDVHAALSRLLQGRVSGPGRG

SEQ ID NO: 368 - protein, 219 aa, Streptomyces SMCD2215
MPDTTAATARARLADARVYLCTDARRRQGDLPEFLDAVLAGGVDIVQLRDKGMEAAEELEHLKVFADACARHGRLLAVNDRADVAHAAGADVLHLGQGDLPVPAARAILGDDVLIGRSTHADTEAETAAVQEGADYFCTGPCWPTPTKPGRHAPGLDLVRHTASLGTDRPWFAIGGIDLENLDEVLAAGARRVVVVRAITEADDPGAAAAEFAKRLRQA

SEQ ID NO: 369 - protein, 300 aa, Streptomyces SMCD2215
MKSQQLRNPVGSHVPVAGGLRSVGLSYAHDLEAETVQVFVANPRGWATPVGSPRQDEEFRAVCEAESIPAYVHAPYLINFGSHTEATVERSVDSMRHSLRRGREIGALGVVVHTGSATGGRDRSVALKQVREHLLPLLDELTHDDDPFLLLESTAGQGASLCSRTWDFGPYFEALDAHPKLGVCLDTCHIFAAGHDLTGPSGMHQTLDLLVDTVGEGRLKLIHANDSKDVVGAHKDRHENIGSGHIGEDPFRALMTHPATEGVPLVIETPGGKEGHAADVERLKRLRDSTHLSPHIEEYP

SEQ ID NO: 370 - protein, 159 aa, Streptomyces SMCD2215
MQGDPEVIEFLNEQLTAELTAINQYFLHAKMQENFGWTKLAKYTRHESFDEMKHAEVLTDRILFLDGLPNYQRLFHVRVGQTVKEMFEADRMIEVEAIDRLRRGIKVMREKGDITSANIFESILADEEHHIDYLDTQLELVEKLGDALYIAQLIEQPES

SEQ ID NO: 371 - protein, 544 aa, Streptomyces SMCD2215
MSTNDTTATRRGKAPAGERVADWADGRLGIYSLAKTNMRKIFPDHWSFMLGEVCLYSFIIIILTGVYLTLFFHPSMNEVEYHGSYIPLQGQMMSEAFNSTMHISFDVRGGLLIRQIHHWAALIFLAGMFVHMMRVFFTGAFRKPREVNWLFGFLLLVLGMFTGFTGYSLPDDLLSGTGVRFMEGAILSVPIVGTYLSMFLFGGEFPGGDFVARFYSIHILLLPGIMLGLLVGHLILVFYHKHTQFAGPGRTNNNVVGMPLLPVYMAKAGGFFFLVFGVIAAIAAIASINPIWTMGPYRPDMVSTGAQPDWYMGFSEGLIRVMPGWEINLWGHTLVLGVFIPLVIFPLVLVAIAVYPFVEAWVTGDRREHHILDRPRNAPTRTAFGAAWVSWYFVLMIGGGNDLWATHFHLSINSITWFVRVGFFVVPVLVFLATKRMCLGLQRRDRDKVLHGRESGIIKRLPHGEFIEVHEPLSQDALHTLTAHEQYKPLEIGPTTDDNGVERKLKGSQKLRAKLSEAYFGDESQISKPTVEEYKEITSGHGHH

SEQ ID NO: 372 - protein, 238 aa, Streptomyces SMCD2215
PTGVKFFNWIGTMWKGSLSFETPMLWATGFLITFTFGGLTGVILASPPLDFHVSDSYFVVAHFHYVVFGTVVFAMFSGFHYWWPKMTGKMLDERLGKMTFWMLFIGFHGTFLVQHWLGVEGMPRRYADYLAADGFTALNTVSTISSFLLGLSILPFLYNVWKTAKYGKPVGVDDPWGYGRSLEWATSCPPPRHNFLTLPRIRSESPAFDLHHPEIAALDQLENAPHEHALAGGKEAGK

SEQ ID NO: 373 - protein, 118 aa, Streptomyces SMCD2215
MPAEELRNYPPGAVTYMLFAADKGDINTIIGGIAPDWGPFGSLGNEAKVMIEVVMAVAILLCLGLAVWGAAKQRIGATALRDTFSAEQGKGLIIAGLTGVFIIGSLGTLFTIVYGMAV

SEQ ID NO: 374 - protein, 258 aa, Streptomyces SMCD2215
MAKRIDVSGLTAYYSSHKAIEDISMTVEPRTVTAFIGPSGCGKSTFLRTLNRMHEVTPGGRVEGKVLLDDEDLYGAGIDPVSVRREIGMVFQRPNPFPTMSIFDNVAAGLRLNGSYKKSELADVVEKSLKGANLWNEVKDRLNKPGSGLSGGQQQRLCIARAIAVEPKVLLMDEPCSALDPISTLAIEDLIGELKERFTIVIVTHNMQQAARVSDRTAFFNLAAVGQPGKLIEIDDTERIFSNPSVQATEDYISGRFG

SEQ ID NO: 375 - protein, 308 aa, Streptomyces SMCD2215
MTSDDTARPGRIRSIETHAELTPEQTEAVLSLLADAAREDGQQAVSEQGRLQLRGGPREGVSHLLLTVGEQLVGYAQLEDTDPVEAPAAELVVHPSYRGHGHGRALGSALLAASGRRLRVWAHGGHAAARHLAQVLGLTLFRELRQMRRSLTDLNLPEPVLPAGVSVRAFEPGTDDAAWLEVNAAAFAHHPEQGSLTQRDLDDRKAEPWFDPAGFFLAFRDGELVGFHWTKVHATERLGEVYVLGVRPGVQGGGLGKALTTIGLRHLEAQGLPTAMLYVDGDNKAAVSVYERLGFATYETDLMYRTET

SEQ ID NO: 376 - protein, 191 aa, Streptomyces SMCD2215
MIEIPSDLHKDLVPLAFLLGDWAGAGVHDFPGAEKCNFGQEVTFSHDGRDFLEYHSHTWVLDGDGNKVRPLESESGFWRIDADRKVEVTMTRDDGVIEIWYGELAHQKPQIDLVTDAVARTAASAPYTGGKRLYGYVKSDLMWVGEKQTPEVELRPYMSAHLKKVVTPEDVERWAKALPDDMPDDGIAFFK

SEQ ID NO: 377 - protein, 253 aa, Streptomyces SMCD2215
MADAPYKLILLRHGESEWNAKNLFTGWVDVNLNEKGEKEAVRGGELLKDAGLLPDVVHTSLQKRAIRTAQLGLEAADRHWIPVHRSWRLNERHYGALQGKDKAQTLAEFGEEQFMLWRRSYDTPPPPLEDGAEFSQSDDPRYASIPPELRPRTECLKDVVHRMLPYWYDGIVPDLLAGRTVLVAAHGNSLRALVKHLDGISDADIAGLNIPTGIPLYYELNADFKPVTPGGKYLDPDAAAAAIEAVKNQGKKK

SEQ ID NO: 378 - protein, 226 aa, Streptomyces SMCD2215
MTRVLVVEDEESFSDALSYMLRKEGFEVAIAATGPDGLDEFERNGADLVLLDLMLPGLPGTEVCRQLRGRSNVPVIMVTAKDSEIDKVVGLEIGADDYVTKPFSSRELVARIRAVLRRRGEPEEVTPAALEAGPVRMDVDRHVVTVSGSKVDLPLKEFDLLEMLLRNAGRVLTRMQLIDRVWGADYVGDTKTLDVHVKRLRAKIEPDPGAPRYLVTVRGLGYKFEP

SEQ ID NO: 379 - protein, 465 aa, Streptomyces SMCD2215
MTIRLYDTNARQIRDFAPLTPGCVSIYLCGATVQAAPHIGHIRSGLNFDIMRRWFEYRGYDVTFIRNVTDIDDKIIAKAAEQNRPWWSIGYDNERAFNDGYTALGCLPPTYEPRATGHVTEMVEMMQGLIERGHAYEAEGNVYFDVRSFPGYLELSRQELDNLQQPSGTGETGKRDPRDFAMWKAAKPGEPTWATPWGRGRPGWHLECSAMAHKYLGSAFDIHGGGLDLIFPHHENEIAQAKAYGDEFARYWVHNAWVTMAGDKMSKSLGNSVLVSEMVKQWRPIVLRYYLGTPHYRSMIEYSEESLREAESAFARIEGFVQRVVEKAGVVEPSPEVPPAFAEAMDDDLGVPQALAIVHTTVRQGNSALAADDKEAAVARLAEVRAMLGVLGLDPLDAHWAGETDRGEDLHGVVDSLVRLVLDQREAARARKDWATADAIRDQLGQSGLTIEDSPQGPRWSLGPR

SEQ ID NO: 380 - protein, 191 aa, Streptomyces SMCD2215
MAVSLSKGGNVSLTKEAPGLTAVTVGLGWDVRTTTGTDFDLDASAIAVNPEGKVYSDAHFVFFNNKQTPDNTIVHTGDNRTGEGAGDDEAINVNLAALPADVDKIVFPVSIYDAETRSQNFGQVRNAYIRIVNQAGGTEIARYDLSEDAATETAMVFGELYRNGAEWKFRAVGQGYASGLSGIAQDFGVNV

SEQ ID NO: 381 - protein, 465 aa, Streptomyces SMCD2215
MASTHGAHQVLVASNRGPVSYEVQDDGSLAAKRGGGGLVSGLSAIGPDAGALWVCSALSDGDREAVRRGIGEDGVRMLDIPGDVHADAYNGIANSVLWFVHHLLWQTPLEPVFDAEFRRQWASYETYNRAFAEALAEEAGPGAAVLVQDYHLCLVPGMLRELRPDLRIGHFSHTPWAPVEYFRLLPDDIAEQVLRGMLGADRLGFLTRRWADAFTACCTAFVGGLGGTEVGVHGLGADADFLRERSHRDDVTERMAALRDEIGEGRRTVVRVDRTELSKNIVRGLLAYRQLLDSRPEWRERVVHVAFAYPSRQDLAVYRDYMAEVQRVADEINSRYGTPGWTPVVLHLKDDFARSLAAYRLADVALVNPIRDGMNLVAKEVPLVSDNGCALVLSREAGAHAELGEDAITVNPYDIVETANALHEALTMPAEERAERAKRLSAAATALPPAQWFLDQLNALTGQAG

SEQ ID NO: 382 - protein, 439 aa, Streptomyces SMCD2215
MRKMRRKGLASMAAQTAASTTDSTTVDLGPAAALSCRECGHRVPLGPVFACEECFGPLEIAYDFSAYEPEDLRKRIEAGPANIWRYAPLLPVPADVADKPNINPGWTKLVKADNLARELGVTGGLYVKDDSGNPTHSFKDRVVAQALEAARVFGFTTLSCSSTGNLAGAVGAAAARAGFRSCVFIPHDLEQGKVVMAAIYGGELVGIEGNYDDVNRFCSELIGDPAGEGWGFVNVNLRPYYAEGSKTLAYEICEQLGWKLPDQLVIPIASGSQLTKIDKGLQELIKLGLVEDRPYKIFGAQAEGCSPVSVAYKAGHDVVRPQKPNTIAKSLAIGNPADGPYVLDIARRTGGAVEDVNDEQVVEAIKLLARTEGIFAETAGGVTVGVTKKLVENGVLDPSLTTVVLNTGDGLKTLDAVAGTGLTATIRPNLESFREAGLA

SEQ ID NO: 383 - protein, 311 aa, Streptomyces SMCD2215
MTSTSNPRELRAELETLTTEAFRPDLAEIDRLPTLEIARLMNGEDATVPTAVAERLPEIAAAIDAVAERMARGGRLIYAGAGTAGRLGVLDASECPPTFNTDPDQVVGLIAGGPDAMVTSVEGAEDSAQLARDDLDQLRLIAADTVVGISASGRTPYAIAAVEHARALGALTVGLACNPDSALAAAAEHGIEVVVGPELLTGSTRLKAGTAQKLVLNMLSTITMIRLGKTYGNLMVDVRASNEKLRARSRRIVALATGAPDDEIERALAATDGEVKNAILAILAGVDGPTAARLLEDSDGHLRAALAAAAG

SEQ ID NO: 384 - protein, 283 aa, Streptomyces SMCD2215
MTSEQPLQIAYSPCPNDTFVFDALAHGRVPGAPALDVTFADIDITNGMAERGEFDVLKVSYAVLPYVLDEYALLPCGGALGRGCGPLVLTREPGADLTGRTVAVPSERSTAYLLFRLWAADTVPGGVGEIVVMPFHEIMPAVRDGKVDAGLVIHEARFTYQNYGLHKLADMGEHWENTTGLPIPLGAIVAKRSLGAPALTALADAIRTSVQAAWDDPEASRPYVMEHAQEMDPSVADQHIGLYVNEFTADLGTDGYAAIRGLLTRAAAEGLVPALGPDALSFP

SEQ ID NO: 385 - protein, 383 aa, Streptomyces SMCD2215
MRFHRGDTLRLVAEIQIPADIKPADGRFGAGPSKVRTEALDALAATGTCLLGTSHRQAPVKNLVGKVREGISELFQLPEGYEVILGNGGSTAFWDIATHGLIENKSQHLSFGEFSSKFAKASKLAPWLAEPTVISSDPGTHPEPAAEAGVDVYAFTHNETSTGVAMPIKRVAGADEGALVLVDATSGAGGLPVDIAETDVYYFAPQKSFASDGGLWIGVFSPAAIERAERIHASGRHVPEFFSLPTAIDNSRKNQTYNTPALATLFLLNEQLEWLNGQGGLDWSVRRTATSSRTLYGWAEDVKFATPFVTDPAKRSQVIGTIDFSDEVDAAAVAKVLRANGVVDTEPYRKLGRNQLRVAMFPAVDPADVEALTKCVDYVIEKL

SEQ ID NO: 386 - protein, 414 aa, Streptomyces SMCD2215
MTTTGTEETRIALDPFVTDLDGESARLRAAGPLAAVELPGGVPVWAVTHHAEAKQLLTDPRLVKDIDVWGAWQRGEIPPDWPLIGLANPGRSMLTVDGADHRRLRALVAQALTPRRVERMRERISTFTESLLDRLPADADADGVVDLKASFAHPLPMYVVADLMGIDEARLPRLKELFEKFFSTQTPPEEVLATLTELAGIMADTVAAKRAEPGDDLTSALILASENGDHLTDQEIVSTLQLMVAAGHETTISLIVNAVVNLSRHPDQRALVLSGAADWSAVIEETLRHSTPTSHVLIRFATEDVPVGNKVLPAGDALIVSYAAIGRDEQAHGPTAGAFDITRTSQNRHISFGHGPHVCPGAALSRLEAGVALPALYARFPELDLAVPPAALRHKPVVTQNDLFELPVRLLPLV

SEQ ID NO: 387 - protein, 366 aa, Streptomyces SMCD2215
MSDFVPGLEGVVAFETEIAEPDKEGGALRYRGVDIEDLVGHVSFGNVWGLLVDGAFNPGLPPAEPFPIPVHSGDIRVDVQSALAMLAPVWGLKPLLDIDTEQARADLARAAVMALSYVAQSARGQGRPMVPQREIDKARSITERFMIRWRGEPDPKHVAAVDAYWTSAAEHGMNASTFTARVIASTGADVAAALSGAVGAMSGPLHGGAPSRVLGMIEEIERTGDAGAYVKQALDKGERLMGFGHRVYRAEDPRARVLRRTARELGAPRFEVAEALEKAALEELHARRPDRVLATNVEFWAAIVLDFAEVPAHMFTSMFTCARTAGWSAHILEQKRTGRLVRPSARYVGPGARGPQEIEGYGDIAH

SEQ ID NO: 388 - protein, 469 aa, Streptomyces SMCD2215
MSASRRSGTTDELGPDEPERVGPVGPDGSDLLAALLDGMDAALCAFDAGGVVTHWNREAERILGWTAAEAVGRHGFAGWAVREADAEEVERRLMSAMEAPGRQVHEFALLTKDGGRVLVRTQSAAVRGPDGKPAGVYCAFSEVHTQIDLERSIALSEALFEDASWGVVLVDADLRPAVVNAHAARALGIGRTSALGRPLGELLAQGVEELESALTHVLAEGAPPAPAEIWVAVRTAEGEERRCWRCGFVRLASPLAEEPVPLGVAWLFQDVTEGKHTEQEAAQLRFRANQLHRAARAAGECEDPREAATVHLDFALAGFADHALIDRVAGGAVADGEAEGPVRLVRVATTPAGAPGPSLHTGKAGLPVRYGPGHPALQCVERTGSVRATVGAVPPAQAREWALARQWPGDTVHALCAVLRSRGRTLGVVTFLRGGGRSAFERVDTVYAEDVAVRIAAALDLASVVRRDG

SEQ ID NO: 389 - protein, 291 aa, Streptomyces SMCD2215
MARRIDVSGAGGVRLAAWEFGDPPKTDPVTGSTGEDTPGVLLLHGLMGRASHWASTARWLAERHRAVALDQRGHGQSEKSPQTSFTREAYVEDAAAALEQLGLAPAVLIGHAMGALTAWQLAAARPDLVRGVIICDMRASALGAASQREWAAWFKAWPVPFATLADVRKWFGEDDPWVERPNPARGEFYAEVMHESADGWRPVFEPEQMLRSRETWVYDAHWEELAQVRCPALVVRGLDGELGRAEAQEMVRVLPLGEYAEVADAGHLVHYDQPEGWRAAIEPFLESVRGV

SEQ ID NO: 390 - protein, 215 aa, Streptomyces SMCD2215
MTGQVRTVDGRVAGRRGQATRQKLLDCLSEMLSSSPYRDVKVIDVARKAGTSPATFYQYFPDVEGAVLEIAEQMATEGAGLTELLEGRSWVGKAGWQTAQELVDGFLEFWRKNDAILRVVDLGAAEGDKRFYKIRMKILNSVNNSLADSVAELQSKGRVDKDVNPAAVAGSLVAMLAAVASHQKGFQSWGVKQAELKPNLALLVHLGVTGKKPTK

SEQ ID NO: 391 - protein, 172 aa, Streptomyces SMCD2215
MSSKRTEVQVRPGAEEDLEALTGIYNHYVRETAITFDTAEFTAEERRPWLLSHPEDGPHRLMVATDGDTQEILGYATSSPYRPKPAYETSVEVTVYVAPHAGRRGIGTLLYKALFAALAGEDLHRAYAGIALPNEASTRLHERFGFRHLGTHREVGRKFGRYWDVAWYENEL

SEQ ID NO: 392 - protein, 710 aa, Streptomyces SMCD2215
MSEMITADLVDLDLSADTKEAAARALAERMVSAGRVTDLEGFLADVAAREAQMPTGLDGGIGIPHCRSEHVTEPTLAFGRSAAGVDFGAADGPADLIFLIAAPAGADDAHLTILSSLARQLMNAEFTDALRAAGDPAAAAALIRGDETPAPAAGTENSAVASGAASSEAAAGSTAPAADASAEDASAPAPGAPDAPDASDAPNASDAPDARPFRIVAVTSCPTGIAHTYMAAESLENAGREAGVEVTVETQGSAGFTRLDPAVIAAADGVILAHDVPVREKDRFAGKPTVDVGVKAGINRPGELISEVREKAERGEVTSGSAPSTPVERGGEAGEGYGTKLRKWLMSGVSYMVPFVAAGGLLIALGFAIGGYKINKAPSVMDHFIWTQGDSWAALLFQIGGVAFAFLVPVLAGYIAYGMADRPGLVPGFVGGSIALTINAGFLGGLAAGLIAGGVVMAIQKVRIPAPVRGIMPVVVIPLISSAIVGFLMFVVIGKPIASAQKNMTDWLNGLSGANAVLLGALLGLMMCFDLGGPVNKVAYTFATAGIAVSNPSDSAMKIMAAVMAAGMVPPLAMALATTVRGRLFTQTERENGKAAWVLGASFISEGAIPFAAADPLRVIPSSMVGGAITGALSMAFDATLRAPHGGIFVVPLIGNPFLYLIAIAVGTCVTTALVVVLKGMRKSAPGTTAPGPADGTAATTAEAKQPVAA

SEQ ID NO: 393 - protein, 277 aa, Streptomyces SMCD2215
MANADIGVIGGSGFYSFLDDVTEVQVETPYGPPSDSLFLGEVAGRRVVFLPRHGRGHHLPPHRINYRANLWALRSVGVRQVLGPCAVGGLRPEYGPGTLLVPDQLVDRTKSRANSYFDGLPLPDGKVPNVVHVSLADPYCPVGRAAALKAARGRDWEPVDGGTLVVVEGPRFSTRAESLWHQAQGWSVVGMTGHPEAALARELELCYTSMTLVTDLDAGAETGEGVSHDEVLRVFSANVDRLRGVLFDAVAALPSNEDRDCLCTTALGGMDPGFELP

SEQ ID NO: 394 - protein, 170 aa, Streptomyces SMCD2215
MTEPSRGETPGPPAQDRLTHIDEAGAARMVDVSGKDVTARTARAAGRVLVSPRVIELLRGEGVPKGDALATARIAGIMGAKRTPDLIPLCHPLSLSGVKLDLSVADDAVEIRATVKTTDRTGVEMEALTAVSVAALTVIDMVKAVDKGAVITDVRVEEKTGGKSGDWSRA

SEQ ID NO: 395 - protein, 180 aa, Streptomyces SMCD2215
MTDDPSTGGALLAPYSALVITASNRAAAGVYEDKGGPAIVAGLEGLGFAVDGPQVVPDGDPVEAALRAGAEAGYDVIVTTGGTGISPTDRTPEATRRVIDYEVPGIAEAIRAFGREKVPTAALSRGLAGVAKGTLIVNLPGSTGGVRDGLAVLEPLLTHAVDQIRGGDHPRPGAGSGGAS

SEQ ID NO: 396 - protein, 296 aa, Streptomyces SMCD2215
MPSNSSGPREKNAAPPLPEPLRVAVADSHTHLDMQSGTVEEGLAKAASVGVTTLVQVGCDVRGSQWAAETAQRHDSVHATVALHPNEAPRIVHGDPDGWSRQGEREPGGTAALDEALDEIARLAALPQVKGVGETGLDFYRTGPEGKDAQEASFRAHIEIAKRYGKALVIHDRDAHADVLRVLKEEGAPERTVFHCYSGDAEMAEVCARAGYFMSFAGNVTFKNAQNLRDALAVAPLELVLVETDAPFLTPAPYRGRPNAPYLIPVTVRAMAAVRGIDEDALATALAANTARAFGY

SEQ ID NO: 397 - protein, 271 aa, Streptomyces SMCD2215
MPAAPTWDPAQYLRHADHRARPFTDLLARIPELPADPPRIADLGCGPGNVTVLLADRWPTAHITGYDNSPEMLDKAHVDHAGPTPGGGRLDFDHGDARTWTPGEPHDLIVSNATLQWVPGHTERFADWIAALAPGGTFAFQVPGNFGAPSHVLMRELAASARWKNRLGDLLRHDDAVLDPGAYLERLTSLGCTADVWETTYLHLLTGEDPVLDWVKGTGLRPVLTALADDPAAREEFVREYRTALREAYPRTEHGTAFPFRRIFAVARKEA

SEQ ID NO: 398 - protein, 913 aa, Streptomyces SMCD2215
MSSADDQTVPQTMSGSELRADIRRLGDLLGETLVRQEGPELLDLVEKVRRLTREDGEAAAELLRGTELETAAKLVRAFSTYFHLANVTEQVHRGRELRERRAAEGGLLARTADRLKDADPEHLRETVRHLNVRPVFTAHPTEAARRSVLNKLRRIAALLETPVIEADRRRHDTRLAENIDLVWQTDELRVVRPEPADEARNAIYYLDELHAGAVGDVLEDLTAELERVGVKIPDDTRPLTFGTWIGGDRDGNPNVTPQVTWDVLILQHEHGINDALEMIDELRGFLSNSIRYTGATEELLTSLRTDLDNLPEISPRYKRLNAEEPYRLKATCIRQKLENTKQRLAKGTPHEPGRDYLGTGELLTDLTLIQTSLREHRGGLFADGRMNRTIRTLAAFGLQLATMDVREHADAHHHALGQLFDRLGEESWRYTDMPREYRARLLAKELRSRRPLASTPAPVDAAGEKTLGVFETVKRALAVFGPEVVESYIISMCQGADDVFAAAVLAREAGLIDLHAGWAKIGIVPLLETTDELKAADTILEDMLADPSYRRLVALRGDVQEVMLGYSDSSKFGGITTSQWEIHRAQRRLRDVAHRYGVRLRLFHGRGGTVGRGGGPSHDAILAQPWGTLEGEIKVTEQGEVISDKYLVPSLARENLELTVAATLQASALHTAPRQSVEALARWDAAMDVVSDAAHAAYRELVEDPDLPTYFLASTPVDQLADLHLGSRPSRRPGSGVSLDGLRAIPWVFGWTQSRQIVPGWYGVGSGLKALREAGLDTVLDEMHEQWHFFRNFISNVEMTLAKTDLRIAAHYVDTLVPDELKHVFDTIKTEHELTVREVLKVTGETELLDAQPVLKQTFTIRDAYLDPISYLQVTLLKRQRDAAAAGVDPDPLLARALLLTVNGVAAGLRNTG

SEQ ID NO: 399 - protein, 324 aa, Streptomyces SMCD2215
MTGIKTTGEKKMMFFSGRAHPELAEEVAHQLGVGVVPTKAFDFANGEIYVRYQESARGADCFLIQSHTAPINKWIMEQLIMIDALKRASARSITVIVPFYGYARQDKKHRGREPISARLVADLMKTAGADRILTVDLHTDQIQGFFDGPVDHLFALPLLADYVGAKVDRNKLTVVSPDAGRVRVADRWCDRLGAPLAIVHKRRDKDIANQVTVHEVVGEVKGRVCVLVDDMIDTGGTICAAADALFAHGAEDVIVTATHGVLSGPAADRLKNSKVSEFVFTNTLPTASELELDKITVLSIAPTIASAVREVFEDGSVTSLFDEQ

SEQ ID NO: 400 - protein, 505 aa, Streptomyces SMCD2215
MSPTKRPGILRMSPPVQKPKGNPVSAIRPAAVVVLAAGEGTRMKSATPKVLHELCGRSLVGHVLSAARELDPENLVVVVGHAREKVGAHLAEIDPDVRTAVQAEQNGTGHAVRIALEELGGSVDGTVVVVCGDTPLLTGETLRGLAATHASDGNAVTVLSAEVPDATGYGRIVRDEDTGAVTEIVEHKDATEAQRAIREINSGVFAFDGQLLADALKKIRTDNSQGEEYLTDVLGILREAGHRVGASVAGDHREIAGINNRVQLSEARRILNDRLLTAAMLAGVTVVDPATTWVDVTVTFEQDAVVHPGTQLHGSTHLGEGAEVGPNSRLKDTRVDAGARVDNTVADGAHVGPQATVGPFAYLRPGTRLGLKAKVGTYVETKNASIGEGTKVPHLSYVGDATIGEYTNIGAASVFVNYDGQEKHHTTVGSHCRTGSDNMFVAPVTIGDGSYTAAGSVITKDVPPGSLAVARGQQRNIEGWVARKRPGSAAAKAAEATARRGESED

SEQ ID NO: 401 - protein, 350 aa, Streptomyces SMCD2215
MPAGLWITSGAVGAVSYVRIVNATSPEEAPGRIVLLTTSHRVAPGLLSWPAWQALHAADRVLCADGAHPQLPYLREAGTAVDETSPTAEELVALCAGGHTVVVVATGEGEPALTDGLARLAGSGRVQMPELELLPASYDLPGARLLDLVQVMDRIRVECPWSSQQTHKGLAKYGIEEAYELVEAIEDGDRDELREELGDVLLQVIFHARIAEDDPDAPFSVDDVAAGIVAKLIHRHPHVFGDATASTPEEVKEHWLRTKAVEKQRTSVTEGVPLGQPGLALAAKLASRARTANLDVPLPPAEGIGYELLALAIRAETEGVDPETALRAAARAYRDAIIRTEEGGPAAAGG

SEQ ID NO: 402 - protein, 426 aa, Streptomyces SMCD2215
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAETFSEALRWGAEVYHTLKKVLKSKGLSTGLGDEGGFAPNLESNRAALDLILEAIKEAGYVPGQQIALALDVAASEFYKDGKYLFEGKERSAAEMTEYYEELVAAYPLVSIEDPLYEDDWAGWKVITDRIGDKVQLVGDDLFVTNPERLARGIEEGSANALLVKVNQIGSLTETLDAVELAQRNGFKCMMSHRSGETEDVTIADLAVATNCGQIKTGAPARSERVAKYNQLLRIEEILDDAAVYAGRSAFPRFKG

SEQ ID NO: 403 - protein, 313 aa, Streptomyces SMCD2215
MRSRNPVFSRRGFSRDNGYAGFNAAPQAGGQAVGTQGNPYGQGNPYGQGNPYAQPPGAPYAQNPYAQNPYAQQGLQGAPPQAPATTGRMTMDDVVLRTATTLGTLIVTAALAWALLPVDDAHINRSYGIGIVAALIGMVLAFVQSFKRKATPALIVSYAAFEGVFLGVVSSIVDNRIASGAAMQAVIGTMAVFAGVLIAYKAGWIRVNRRFYGFVMAAALGFVLLMAVNLLFAVFGGGDGLGFRSGPLGVFFGVVGILLGACFLALDFKQVEDGIAYGAPKDEAWLAAFGLTLTLVWIYMEFLRIIAILNSND

SEQ ID NO: 404 - protein, 406 aa, Streptomyces SMCD2215
MPEAVIVSTARSPIGRAFKGSLKDLRPDDLTATIIQAALAKVPELDPKDIEDLMLGCGLPGGEQGNNLGRIVAVQMGMDHLPGCTITRYCSSSLQTSRMALHAIKAGEGDVFISAGVEMVSRYVKGNSDSLPDTHNPLFAEAEARTAEVAQQEGTTWHDPREDGLVPDPYIAMGQTAENLARLKGVTRQDMDEFGVRSQNLAEEAIKNGFWEREITPVTLPDGTVVAKDDGPRAGVTMEGVAGLKPVFRPDGLVTAGNCCPLNDGAAAVVIMSDTKARELGLTPLARIVSTGVSGLSPEIMGLGPVEASQQALGRAGLTIDDIDLVEINEAFAAQVIPSYRDLNIPLEKLNVNGGAIAVGHPFGMTGARITGTLINSLQFHDKQFGLETMCVGGGQGMAMVIERLS

SEQ ID NO: 405 - protein, 554 aa, Streptomyces SMCD2215
MSGPRPVRAPRGTELSALGWQQEAALRMLQNNLDPEVAEHPDKLVVYGGTGKAARDWRSFDAMVRTLRTLKQDETMLVQSGRPVGVMQTHEWAPRVLIANSNLVGDWANWEEFRRLEALGLTMYGQMTAGSWIYIGTQGILQGTYETFAAVAAKKFNGTLAGTITLTAGLGGMGGAQPLAVTMNDGVALCIDCDPRAIERRIEHRYLDVKADSLEHALQLAVEARDARRPLSIGLLGNAAELLPRMLAEGAPIDIVTDQTSAHDPLAYLPLGMDFDDMASEAAKDPAGFTTRARESMARHVEAMVGFMDAGAEVFDYGNSIRGEAQLAGYDRAFAFPGFVPAYIRPLFCEGKGPFRWAALSGEASDIAKTDKAILDLFPENESLARWIKMAGERVHFQGLPARICWLGYGERDKAGERFNDMVASGELAAPLVIGRDHLDCGSVASPYRETEAMLDGSDAIADWPLLNAMVNVASGASWVSIHHGGGVGMGRSIHAGQVTVADGTALAGEKVRRVLTNDPGMGVIRHVDAGYDIAESVAGERGVRVPMREGGDA

SEQ ID NO: 406 - protein, 453 aa, Streptomyces SMCD2215
MSQRSGEPSGDGPVGAGLSSPGAASAVPTRSALRNDCPQLDGSQPAGSGSFHSMWRELLPIGRHADSHGYRRFAWSRADGECREWFKEQAEGRGLVYEVDRNGNQWAWLGDPEAGDAVVTGSHLDSVPDGGAFDGPLGVVSSFAALDELRGRGAEFRRPLAVVNFGDEEGARFGLACVGSRLTSGQLTVENARKLTDGDGISLPRAMEAAGYDPDAIGADPERLARIGAFVELHVEQGRALDLSGDRVGIASAIWPHGRWRFDFRGEANHAGTTRLVDRRDPMLSYAETVLAARREAELAGAVATFGKIAVEPNGVNAIPSLVRGWLDSRAAGQASLDQVVGGIEKAAREYAAAHGVDLDVVRESFTPVVEFDHALRDELARILGKDTDLTVPVLGTGAGHDAGILAGSIPTAMLFVRNPTGVSHSPAEFAAEDDCVAGVLALADVLEGLACR

SEQ ID NO: 407 - protein, 225 aa, Streptomyces SMCD2215
MTRVLLAEDDASISEPLARALRREGYEVEVREDGPTALDAGMQGGVDLVVLDLGLPGMDGLEVARRLRAEGHAVPILILTARADEVDTVVGLDAGADDYVTKPFRLAELLARVRALLRRGAVEPAQPPATHGVRIDVESHRAWMGDEELQLTAKEFDLLRVLVRDAGRVVTRDQLMREVWDTTWWSSTKTLDMHISWLRKKLGDDAANPRYIATVRGVGFRFEKS

SEQ ID NO: 408 - protein, 394 aa, Streptomyces SMCD2215
MTSLEEARSLLREFPVVDGHNDLPWALRKIGYDLDARDISRHQNAHLHTDIPRLREGGVGAQYWSVYVRSDLPDAVPATLEQIDCVRQLLARHPADLAPALTAADMEQARRDGRIASLMGAEGGHSINCSLGTLRGLYELGVRYMTLTHNDNNPWADSATDEPNVGGLSAFGREVVREMNRLGMLVDLSHVAATTMRDALDTTSAPVIFSHSSARAVCDHPRNIPDDVLERLPGNGGVAMVTFVPKFVLQAAVDWTLAADENLRAHGFHHLDTSPEAMKLHRAFEERTPRPVATVSTVADHLDHMREVAGVDHLGIGGDYDGTAFTPDGLGDVSGYPNLIAELLDRGWSKADLAKVTWQNSVRVLGAAEDVARELRATRPVSNATIESLDGREG

SEQ ID NO: 409 - protein, 956 aa, Streptomyces SMCD2215
MSETNPAAAAEVAAPHRYTAAMAAEIEARWQDVWDAEGTYAAPNPEGDLAGDPAVVARPKKFIMDMFPYPSGAGLHVGHPLGYIATDVYARFQRMTGHNVLHTLGFDAFGLPAEQYAVQTGTHPRVSTESNIVNMKSQLRRLGLGHDKRRSFATIDPDYYKWTQWIFLQIFNSWYDEESGKARPIAQLIAQFESGERAVPGGRTWSALSAGERADILGEYRLAYASDAPVNWCPGLGTVLANEEVTADGRSERGNFPVFKAKLRQWNMRITAYADRLLDDLEELDWPEAIKLQQRNWIGRSEGARVDFPIDGERITVFTTRPDTLFGATYMVLAPEHPLVEKFTPAAWPEGTHDVWTGGHATPSEAVAAYRAQAAAKSDVERQAEAKDKTGVFIGAYATNPVNGEQIPVFIADYVLMGYGTGAIMAVPAHDTRDFEFARAFELPIKCVVEPTDGRGTDTSAWDEAFVSYDAKIVNSTGEGVSLDGLGVVDAKARITEWLARKGIGEGTVNFRLRDWLFSRQRYWGEPFPIVYDEEGIAHALPESMLPLELPEVDDYSPRTFDPDDADTEPETPLSRNEDWVHVTLDLGDGPKKYRRETNTMPNWAGSCWYELRYLDPHNSERLVDPEIEQYWMGPREGQPHGGVDLYVGGAEHAVLHLLYARFWSKVLFDLGHVSSAEPFHKLFNQGMIQAYVYRDSRGIAVPAAEVEERDGAYYYQGEKVSRLLGKMGKSLKNAVTPDEICAEYGADTLRLYEMAMGPLDVSRPWDTRAVVGQFRLLQRLWRNVVDEATGAVTVVDAEPDEDTLRALHKAIDGVRQDLEGLRFNTAIAKVTELNNHLTKAGGPVPRSVAEPLVLLVAPLAPHIAEELWRKLGHTDSVVHQDFPVADPRYVVDESVTCVVQIKGKVKARLEVSPSISEEELEKVALEDEKVVAALDGAGIRKVIVRAPKLVNIVTA

SEQ ID NO: 410 - protein, 454 aa, Streptomyces SMCD2215
MAADLSQIVKAYDVRGVVPDQWDESLAELFGAAFVRVTAADAIVVGHDMRPSSPGLSRAFARGAAAQGADVTEIGLCSTDQLYYASGALNLPGAMFTASHNPAQYNGIKMCRAGAAPVGQDTGLTQIRELAEQWTESGAPRPAEKQGTITQRETLSDYAAHLRSLVDLTSVRPLKVVVDAGNGMGGHTVPTVFEGLPLTLVPMYFELDGTFPNHEANPLDPANLVDLQQRVREEGADLGLAFDGDADRCFVVDEHGDPVSPSAITALVAARELARNGGKGVIIHNLITSWSVPEVVREHGGTPVRTRVGHSFIKAEMANAGAIFGGEHSAHYYFKDFWNADTGMLAALHVLAALGGQSGPLSALTAEYDRYVASGEINSTVADQTARLAALKSAYATREDVTLDELDGLTVTSTDWWFNVRPSNTEPLLRLNTEARDEATMTKIRDEALGLIRG

SEQ ID NO: 411 - protein, 383 aa, Streptomyces SMCD2215
MDRLDNTIRPYAWGSTTAIPALLGVEPSGEPQAEMWMGAHPGAPSRTERGTLVEVVDADPEQELGAAAVAKFGPRLPFLLKILAAGAPLSLQVHPNLKQAKEGYEDEERRGIPVDAPHRNYKDANHKPELICALTEFDGLCGFREPLQAADLLAGLGVDSLKPYVDLLHAHPEDAALREVLTAILTADPEEMRHTVAAAATACTRLGGAYAPYADIAHHYPGDPGVLAAMLLNHVRLQPGEALFLGAGIPHAYLNGLGVEIMANSDNVLRCGLTPKHVDVPELLRIVRFEASDAGVLRPEASPDGEEVYETPIDEFRLSRYVLPEGGGRHDLTRDTPQILLCTAGTVRADGHELLPGQSVFVAAGEKAEVSGAGTIFRATVIV

SEQ ID NO: 412 - protein, 352 aa, Streptomyces SMCD2215
MESIEAVLDLDRMRADIAVLEEQAAAPSLWDNPDEAQKITSKLSHLQAEVRKAEALRGRIDDLAVLFEMAEEEDDPDTRAEAESELTAVRKALDEMEVRTLLSGEYDAREALVNIRAEAGGVDAADFAEKLQRMYLRWAEQKGYKTEVYETSYAEEAGIKSTTFAVQVPYAYGTLSVEQGTHRLVRISPFDNQGRRQTSFAGVEVLPVVEQTDHIEIDESELRVDVYRSSGPGGQGVNTTDSAVRLTHLPTGIVVSCQNERSQIQNKATAMNVLQAKLLERRRQEEQAKMDALKGDGGNSWGNQMRSYVLHPYQMVKDLRTEFEVGNPEAVFNGEIDGFLEAGIRWRKQREK

SEQ ID NO: 413 - protein, 223 aa, Streptomyces SMCD2215
MSATGEVSAGRPGRGRRVILWRHGQTLWNVERRFQGTTDVALTETGIAQARRAARLLASLEPDAIVASDLRRAADTAAELAALTGLEIAHDEGLRETYAGDWQGLTHEEIIARHGEQYAAWKRGEPVRRGGGELETEVADRAAPVVLRHAEKLPDDGTLVVVSHGGTIRTTIGRLLGLEAHHWESLGGLSNCCWSVLGEGARGWRLLEHNAGTLPEPVLGDDD

SEQ ID NO: 414 - protein, 937 aa, Streptomyces SMCD2215
MSVLSKIMRAGEGKILRKLHRIADQVNSIEEDFIALSDAELRALTDEYKQRYADGESLDDLLPEAFATVREAAKRVLGQRHYDVQLMGGAALHLGYVAEMKTGEGKTLVSTLPAYLNALSGDGVHIITVNDYLAERDSELMGRIHKFLGLSVGCILANMAPAERREQYACDITYGTNNEFGFDYLRDNMAWSKDELVQRGHNYAIVDEVDSILVDEARTPLIISGPADQATKWYGDFAKLVLRLKRGEAGNPLKGLEETGDYDVDEKKRTVAIHEPGVSKVEDWLGIDNLYESVNTPLVGYLNNAIKAKELFKKDKDYVVIDGEVMIVDEHTGRILAGRRYNEGMHQAIEAKEGVDIKDENQTLATITLQNFFRLYDKLSGMTGTAMTEAAEFHQIYKLGVVPIPTNRPMVRMDQSDLIYRTEVAKFEAVVDDIAEKHEKGQPILVGTTSVEKSEYLSQQLSKRGIQHEVLNAKQHDREATIVAQAGRKGAVTVATNMAGRGTDIKLGGNPDDLAEAELRQRGLDPEEHIEEWAQFLPAALERAEKAVKAEFEEVKELGGLYVLGTERHESRRIDNQLRGRSGRQGDPGESRFYLSLGDDLMRLFKAQMVERVMSMANVPDDVPIENKMVTRAIASAQSQVEQQNFETRKNVLKYDEVLNRQREVIYGERRRVLEGEDLQEQIGHFMDDTIDAYIAAETAEGFAEDWDLERLWGAFKQLYPVRVTVEELEEAAGDRAGLTAEFISESIKDDIHEQYEQREAQLGSEIMRELERRVVLSVLDRKWREHLYEMDYLQEGIGLRAMAQKDPLVEYQREGFDMFTAMMEGIKEESVGYLFNLEVQVEQQVEEVPVEDTTPVDMEKQDAVPAQAGVRPEIRAKGLDAPQRRNLHFSAPTVDGEGGTIEGDFAGDDEPVRSEADGLTRAERRKQARGGRRRRK

SEQ ID NO: 415 - protein, 229 aa, Streptomyces SMCD2215
MMSFMKGRVLVVDDDTALAEMLGIVLRGEGFEPSFVADGDKALAAFRESKPDLVLLDLMLPGRDGIEVCRLIRAESGVPIVMLTAKSDTVDVVVGLESGADDYIVKPFKPKELVARIRARLRRSEEPAPEQLAIGDLVIDVAGHSVKREGQSIALTPLEFDLLVALARKPWQVFTREVLLEQVWGYRHAADTRLVNVHVQRLRSKVEKDPERPEIVVTVRGVGYKAGPS

SEQ ID NO: 416 - protein, 147 aa, Streptomyces SMCD2215
MTATDRSLELINTAAQAAADKLAHDIIAYDVSDVLSITDAFLLASAPNDRQVKSIVDEIEERLNKELGAKPVRREGDREARWVLLDYVDIVVHVQHSEERVFYALERLWKDCPELELPADAKATRGKAEEHARTQAAEEAADLGGEW

SEQ ID NO: 417 - protein, 374 aa, Streptomyces SMCD2215
MSTTQQARPGRTLDVDHSDAFYRDWLKEAVRKVQADANRSADTHLLRFPLPEKWGIDLYLKDESTHPTGSLKHRLARSLFLYGLCNGWIRPDRPVIEASSGSTAVSEAYFAGLIGVPFIAVMPRTTSAEKIRLIEFHGGRCHFVDDSRRMYEESARLAVETGGHYMDQFTYAERATDWRGNNNIAESIFRQLELERFPEPAWIVATAGTGGTSATLARYVHYTQRDTRICVADPENSCFFEGWTAGDPDVTCDCGSRIEGIGRPRMEPSFVPGAIDRMMKVPDAASVAAVRALERAIGRKAGGSTGTGLWSSLKIVAEMVAGGRQGSVVTLLCDPGDRYLDKYYSDAWLAEQGLDIGPYSAAIDSLLRSGVWPD

SEQ ID NO: 418 - protein, 450 aa, Streptomyces SMCD2215
MSKGSNTPVPTAALRVELGWRSGPGVPDADASALLLVGGKVRSDGDFVFYNQPAHSSGAVRHEGKRDGGGQIVDSLLVDLARVEPAIETVVLAASADGGNFGQIPDLYIEVRDAAQGGVVARFDSTGASVETAFVLGEFYRRQGAWKFRAVGQGYSSGLEGLATDFGITVDEPQQAAPAAAPAPPPAAPPVAPPVTMPPPVAPPAAVQPPPPVAPPAAAAQQPWPHAPSAPSAPPAQPVSLSKVTLTKAAPSVSLAKQGGTSGSMRVNLNWQVRKQFSGWGSKRGRAVAMHRDLDLDLCALYELTDGRKGVIQALGNAFGALHQPPYIHLDGDDRTGAVESGENLTVNLDHKQDFRRILVFVTIYEGARSFADLHATVTLQPQYGAPIDFSLDECTVPSTVCALALITNNGGDLIVQREARYLVPERGVSPQRTIDHAYGWGMNWSPGRK

SEQ ID NO: 419 - protein, 366 aa, Streptomyces SMCD2215
MSDDGHEHNGPENVPSRQRRRFPGISSRAYEHPADRSALVALRKLSGFDTVFKALSGLLPERSLRLLFLSDSVRVSDEQFAHLNDMLRDACYILDLEKVPPMYVNQDPQPNAMCIGLDEPIIVVTTGLVELLDEEEMRAVVGHEVGHALSGHSVYRTILLFLTQLAIRVAWIPLGNLAIMAIVTALREWFRKSELSADRAGLLVGQDLRASMRGLMKIAGGNHLHEMNVDAFLKQAEEYEAGGDLRDSVLKILNVLPRTHPFTTVRAAELKKWAESRDHQRIMDGHYPRRDEDKNTSVSDSFRESAASYAGHVKSSKDPLMKLVSDIAGGAGGLGGRVRRGFDGFTGSSTSQEHPPKDEPPTEEEH

SEQ ID NO: 420 - protein, 428 aa, Streptomyces SMCD2215
MTTLSPYDSMSPVTQAAYRAKSAAADLAPLPRAEKDDALLAIADALEVRTSEIVEANAKDIAKARENGTSEAIIDRLTLTPERVRAIASDVRDVAALPDPVGEVVRGSTLPNGIDLRQVRVPLGVVGIIYEARPNVTVDAAALCLKSGNAVLLRGSASAYESNTALVRVLRDAVGGAGLPADAVQLVPGESRESVRELMRARGLVDVLIPRGGASLIQTVVAESTVPVIETGVGNCHVYVDAAADLDMAIDILINSKAQRPSVCNAAETLLVHQDIAAEFVPRALDALAEAGVTVHADPRVLAYAKDSKATVVEATPEDWDTEYLSYDIAAAVVDSLDRAVQHIRLWSSGHTEAIVTSSQQAARRFTKLVDSTTVAVNASTRFTDGGQFGFGAEIGISTQKLHARGPMGLPELTSTKYIVTGDGHIRR

SEQ ID NO: 421 - protein, 322 aa, Streptomyces SMCD2215
MALFDLPLDELREYRSVSTEPEDFDAFWSKTLQEAREHDLDARFEPVDTGLTTVDVYDVTFAGFGGHLVKGWLTLPAGTEEPLPLVVEFIGYGGGRGLPHEHLLWASTGRAHFVMDTRGQGSAWGGGGGTPDPVGGAPAYPGFMTRGIDAPENYYYRRVFTDAVRAVEAARSHPLTDASRTVALGASQGGGITIAVGGLVPDLTAVAPDVPFLCDYPRAATLTDRHPYREIGLFLKTHRGRTEDALRTLSYFDGVHFAARGRAAALFSAGLEDQTCPPSTVFAAFNAWAHDDKTIEVYDFNDHEGGGPHQEAAKLAWLRSYV

SEQ ID NO: 422 - protein, 330 aa, Streptomyces SMCD2215
MKMLINVPESVVTDALRGMAAAHPELAVDLENRVIVRRDAPVAGKVALISGGGSGHEPLHGGFVGPGMLSGACPGEVFTSPVPDQMARAAAAVDSGAGVLFIVKNYTGDVLNFDMAAELAEDEGIQVAKVLVNDDVAVTDSLYTAGRRGTGATLFVEKIAGAAAEEGQPLERVEAIGRQVNENSRSFGVALSACTTPAKGSPTFDLPSGELELGIGIHGEPGRERRAMMTSGEIAEFAVNAILEDMPPRNPVLVLVNGMGATPLLELYGFNAEVQRVLTERGVSVARTLVGNYVTSLDMAGASVTLCQIDEELLRLWDAPVRTPGLRWGM

SEQ ID NO: 423 - protein, 593 aa, Streptomyces SMCD2215
MTDEAAGRPGLSRRQLARRALALGGALAVAPFPAGPAAEAATGSGHPTLRHGSAERAGLLATHLRQLVTDAETFLGPSPKHPWYAGAVLLAGRGGTVALHEPIGMAVRYQAYDEKTDSGVEFPADEQIPMARDTIFDLASVSKLFTSLLAVQQMERGALKLEGTVASYVPEFGAAGKQDITIRQLLTHTSGFRDWIPLYKAPTREGKLQLIYDEAPINPPGTKYLYSDLNLISLQLVLEEITGRTLDTLLHENITGPLGLNRTRYNPPATWKPKIAATEDERAPWSGLDRGLVWGEVHDENAYSLDGVAGHAGVFSSAWDLAVLGRTLLNGGVYGSTRILRPESVDLLFTNFNTAFPGDEHGLGFELYQHWYMGAMATPRTAGHTGFTGTSLVLDPTTDSFLIVLGNSVHPVRSWRSGSAPRVAAGNNLARAVPVRPELGRTAWFAGMASATTATLTLPALDTTPGRARLSNALWWDTEPASDVLVLEATTDGGTTWHPIPFTTARHGEQPQGHPSGSVTGWSGRVWHRVSADLPAHPALTLRWRYTTDKLYVGRGVYVDGVRVEVGGRVLFDDGRKGDSARIVAAGWEASAD

SEQ ID NO: 424 - protein, 128 aa, Streptomyces SMCD2215
MRHVALVTLVVDDYDEAIGFYTEALGFRLVEDSPRPDGSRWVVVAPGDQGTALLLARAKGDEQRARVGDQTGGRVGFFLHTDDFTRDHARMLAAGVTFLEEPRHEPYGSVAVFRDLYGNRWDLLQPTG

SEQ ID NO: 425 - protein, 876 aa, Streptomyces SMCD2215
MTENAQQQPPAPSTELPTQYAPADVEGPLYERWVERGYFEADAKSEKPPYTIVIPPPNVTGSLHLGHAFEHTLIDALTRRKRMQGFETLWQPGMDHAGIATQNVVERELGKEGKSRHDLGREAFVERVWQWKGESGGQISGQMRRLGDGVAWTRERFTMDEGLSQAVQTIFKRLYDDELIYRAERIINWCPRCLTAISDIEVEYQDDDGELVSIRYGEGDETVVVATTRAETMLGDTAVAVHPDDERYQHLVGKQIKLPLTDRSIPVVADEHVDPEFGTGAVKVTPAHDPNDFEIGRRHDLPAIAVMDEHAVITVHGPFQGQDRFEARSAIVAALRAEGRIVAEKRPYVHSVGHCSRCKTTIEPRLSMQWWVKVGPLAKAAGDAVREGKVTIHPQEMEKRYFDWVDNLHDWCISRQLWWGHRIPVFYGPNGEVVCVGPDEQPPGTEAEGWKQDTDVLDTWFSSGLWPFSTLGWPEQTESLAKFYPNSVLVTGYDILFFWVARMMMFGLYAMDGTPPFHTIALHGMVRDQFGKKMSKSFGNAVNPLDWMDKYGSDALRFTLARGANPGVDVPIGEDWVQGSRNFANKIWNATRFALMNGATVEGPLPDAAEMSSTDRWILSRLNSVVAEVDALYEDYQFAKLSDALFHFAWDEVFDWYVELSKTTFQAGGAPAKVSQRVLGEVLDVTLKLLHPIVPFVTETLWTTLTGGESVVIAEWPHDSGFRDTAAEREIESLQSVITEVRRFRADQGLQPGQRVPARLTLDGTALAPHEAAIRQLLRLQPEGESFTATATLPVAGAEVALDLSGTIDVAAERKRLAKDLAAAEKEKAQATAKLGNEAFLAKAPDHVVDKIRGRLAKADEDITRIKAQLDRLPEQ

SEQ ID NO: 426 - protein, 124 aa, Streptomyces SMCD2215
MSERALRGTRLVVTSYETDRGIDLAPRQAVEYACEKGHRFEMPFSVEAEIPPEWECKVCGAQALLVDGDGPEEKKAKPARTHWDMLMERRTREELEEVLEERLAVLRSGAMNIAVHPRDSRKSA

SEQ ID NO: 427 - protein, 276 aa, Streptomyces SMCD2215
MTRLSSAVRGLITALAALLAVTAASAPAPAASAPARAKAEPKAPKDFVTLASVDPTIIQEMRYFTPHDFVGERIDGYQQPICILTRPAAEALHKAQTRLRHKGYSLKVYDCYRPQRAVNHFVRWAKNLDDQAMKGEFYPNVDKTRLFEDGYIAEKSGHSRGSTMDLTIVKLPARPTRPYHPGEPLVPCFAPKDERFPDNSIDMGTGFDCFDTLAHTLDPRIQGQQRANRLFLKSTLERLGFVNLAEEWWHYTFQPEPYPDTYFDFPVSRKSLIGRR

SEQ ID NO: 428 - protein, 556 aa, Streptomyces SMCD2215
METTLRGVGVSHGVAIGEVRHMGTAVLEPPAKQIPAEDAEREQGRARQAVEAVAADLMARGNLAGGEAQAVLEAQAMMAQDPELMADVERRIAVGSTAERAVYDAFAAYRALLAGAGEYLAGRVADLDDVRNRIVARLLGVPMPGVPDSDKPYVLIARDLAPADTALLDPALVLGFVTEEGGPTSHSAILARALGVPAVVALPGAGELAEGTVIAVDGSTGEISVNPSEELKARLEAAAAERKAALAAATGPGATSDGHKVPLLANVGGPADVPAAVEAGAEGVGLFRTEFLFLDDSKNAPSLEKQVEAYRQVLKAFPEGRVVVRVLDAGADKPLDFLTPADEPNPALGVRGLRTLLDHPEVLRTQLTALARAAEGLPMYLEVMAPMVADRADARAFADACREAGLQAKFGAMVEIPSAALRARSILQEVEFLSLGTNDLAQYTFAADRQVGAVSRLQDPWQPALLDLVALSAEAAKAEGKSCGVCGEAASDPLLACVLTGLGVTSLSMGAASIPYVRAALGKYTLAQCERAAAAARATESAEEARNAAQAVLSGE

SEQ ID NO: 429 - protein, 225 aa, Streptomyces SMCD2215
PTGVKFFNWIGTMWKGSLSFETPMLWATGFLVTFLFGGLTGVMLASPPLDFHLSDSYFVVAHFHYVVFGTVVFAMFSGFHYWWPKFTGKMLDERLGKMTFWMLFIGFHGTFLVQHWLGAEGMQRRIPDYLAVEGLTTLNTVSTIFSFLLGSSLLPFFYNVWKTAKYGKKVEADDPWGYGRSLEWATSCPPPRHNFTTLPRIRSESPAFDLHHLQNPAADRELTAP

SEQ ID NO: 430 - protein, 160 aa, Streptomyces SMCD2215
MYLGSDHAGFELKNHLVEWLRAAGHDPVDCGPHIYDAQDDYPPFCLRAAERTAADPDSLGIVIGGSGNGEQIAANKVKGVRAALAWSEETASLGRQHNNANVVAVGARMHSQEEATKFVETFLGTPFSGDERHIRRIDMLAEYETTGELPPIPAHHPQQD

SEQ ID NO: 431 - protein, 337 aa, Streptomyces SMCD2215
MGGGGNSTYGKKSFKRSKSHFADRITADGRDGWPVEAGRYRLVVSRACPWASRALVSRRLLGLENALSLAVADPIQDDRSWRFTLDPDGRDPVLGIRYLSEAYDRRETGYPGGVSVPAIVDVPSGQLVTNDYQQITLDLATEWTALHRDGAPDLYPQARRDEIDTVMAEVYEDVNNGVYRAGFANNQAEYEGAYAGVFRRLELLTQRLERQRYLVGDTITEADIRLFTTLVRFDAVYHGHFKCNRWKVTENPILWAYVRDLYQTPGFGDTVDFDHIKRHYYQVHSGINPTGIVPVGPELSGWLAPHFREELGGRPFGEGTPPGPVPAAEEIAAAGRP

SEQ ID NO: 432 - protein, 215 aa, Streptomyces SMCD2215
MPVYTLPELPYDYSALAPVISPEIIELHHDKHHAAYVKGANDTLEQLAEARDTGSWGAVGGLEKNLAFHLSGHILHSIYWQNMTGPKDGGGEPLAADGTGDLADAISASFGSFAGFKAQLTKAAATTQGSGWGVLAYEPLSGRLVVEQVYDHQGNVGQGATPLLVFDAWEHAFYLQYRNQKVDFIDAMWAVVNWQDVARRYEAARTRADVLLLAP

SEQ ID NO: 433 - protein, 154 aa, Streptomyces SMCD2215
AAFTDNFDGPAGAAVDGSKWQTETGDNVNNHEREYYTPGTNNAALDGQGHLVITARKENPANYQCWYGTCQYTSARLNTSGKFNAQYGHVEARMKIPRGQGMWPAFWMLGTPVNWPDSGEIDVMENVGFEPSTVHGTIHGPGYSGSGGIGAPYT

SEQ ID NO: 434 - protein, 220 aa, Streptomyces SMCD2215
MSETATTSGKTPVDFWFDPLCPWAWMTSRWVLEVEKVRDIEVRWHIMSLAVLNEDKLDTLPEEYRDMLETKAWKPARVVTAAWQKHGADVLGPLYTALGTRFHNNGEGPTTEAIAGALADAGLPADLIDYADQKDFEFDAELRASHKEGIDKVGQEVGTPVIAVPGADGEQIAFFGPVVTPAPKGEDAAKLWDGTLAVASIPGFYEIKRTRTVGPDFSNL

SEQ ID NO: 435 - protein, 286 aa, Streptomyces SMCD2215
VPWAIGSPEGGHDAVHPKLGTMEDFTRFVARARELGMEVALDFALQCSPDHPWVHKHPEWFHHRPDGTIAYAENPPKKYQDIYPIAFDADFDGLLAETLRVLRVWMAAGVRIFRVDNPHTKPVVFWQQVIAEINAADPDVIFLAEAFTRPAMMHTLAQIGFQQSYTYFTWRTTKQELTEYGTELSGEAAAYMRPNFFVNTPDILHAYLQRGGRPAFEVRAVLAATLSPTWGIYSGYELCENTPLKDGSEEYLDSEKYQLKPRDWDTAEREGRTITPLITRLNTIRR

SEQ ID NO: 436 - protein, 300 aa, Streptomyces SMCD2215
DVNGQRVQGRHVLLATGSVPKSLPGLEIDGNRIISSDHALVLDRVPKSAIILGGGVIGVEFASAWKSFGADVTVIEGLKHLVPVEDENSSKLLERAFRKRGIKFNLGTFFSKAEYTQDGVKVTLADGKEFEAEVLLVAVGRGPVSQGLGYEEQGVAMDRGYVLVDEYMRTNVPTISAVGDLVPTLQLAHVGFAEGILVAERLAGLKTVPIDYDGVPRVTYCHPEVASVGITEAKAKEIYGADKVVALKYNLAGNGKSKILNTAGEIKLVQVKDGAVVGVHMVGDRMGEQVGEAQLIYNWE

SEQ ID NO: 437 - protein, 855 aa, Streptomyces SMCD2215
MPGENLTRDEARERAALLSVDGYEVALDLRSAVGEHDGDGPRTFRSVTTIRFRSNEPGAASFADLIAPSVTSVSLNGRDLDPGQVFDGSRILLEDLAAENELVVDAQCAYSRTGEGLHRFVDPEDGEVYLYTQYEPADSRRVFANFEQPDLKAPFRFEVRAPEGWTVWSNGAGELTDGVWRFAETKPISTYITCVTAGPYHYVTDSYERTFEDGTKLRIPLGALCRKGLAPYFDSDDVFLVTKQGLDFFHDHFDYPYPFGKYDQAFVPEYNLGAMENPGLVTFREEFIFRGKVTRASYEGRANVILHEMAHMWFGDLVTMEWWDDLWLKESFADFMGAFSLVGATRFTDGWITFANRRKSWAYRADQLPSTHPITADIRDLQDAKLNFDGITYAKGASVLKQLVAYVGQDAFLEGARRYFKRHAYGNTRLGDLLSVLEETSGRDMGTWARGWLQTAGVNSLTPQVLLDAEGRVDELAVVQEAAESHPELRPHRVAVGLYRREDGRLVRYARAEVDVDGPRTVVTELAGAQAPELVLVNDDDLTYCKIRFDDTSLATLREHLGAIEDPLARALCWSALWNMTRDALLPASGFIDLVVRFGRRESDIGVLQMLHAWAGSALTHYSPASWRPRGEELLARTALRDLRACEPGSEQQLAWARFYATVASAPDDLRLLRGLLEGTEKIEGLKVDQELRWTFLEPLAAHGAVDESVLAAELARDDTASGKRHQVRCLAARPSAAVKAQAWAQVVESDALSNALVEATIAGFAQASQRELLAPYAARYFEVIERIWTERSIQIGMDVVRGLFPALQDSPATLEATDAWLAAHEGAAPALRRLVLEARDDLARALRAQALAND

SEQ ID NO: 438 - protein, 327 aa, Streptomyces SMCD2215
TTTDHKTIGTLYLVTSFAFFLIGGVMALLMRAELARPGLQIMTNEQFNQAFTMHGTIMLLMFATPLFAGFTNWIMPLQIGAPDVAFPRLNMFAYWLYLFGSLIAVGGFLTPQGAADFGWFAYAPLSDAIHSPGVGGDLWIMGLAFSGFGTILGSVNFITTIICMRAPGMTMFRMPIFVWNVLLTAVLVLLAFPVLAAALFALEADRKFGAHVFDPANGGALLWQHLFWFFGHPEVYIIALPFFGIISEVIPVFSRKPMFGYMGLIGATIAIAGLSVTVWAHHMYVTGGVLLPFFSFMTFLIAVPTGVKFFNWIGTMWKGSLSFETPM

SEQ ID NO: 439 - protein, 149 aa, Streptomyces SMCD2215
MTEASDSFDLVVLGGGSAGYAAALRGAQLGLRTAMVEKYKLGGTCLHNGCIPTKALLHAGEIADRTRDAELFGVRASFESIDMASVQRYKDDTVAGLCRGLTGLVKARDITYIEGEGRLSSPTSIDVNGQRVQGRHVLLATGSVPKSLP

SEQ ID NO: 440 - protein, 150 aa, Streptomyces SMCD2215
MANDASTVFDLVILGGGSGGYAAALRGAQLGLDVALIEKDKVGGTCLHRGCIPTKALLHAGEIADQARESEQFGVKATFEGIDVPAVHKYKDGVISGLYKGLQGLIASRKVTYIEGEGRLSSPTSVDVNGQRVQGRHVLLATGSVPKSLP

SEQ ID NO: 441 - protein, 512 aa, Streptomyces SMCD2215
MTALTLSTAAASGLRADAIVIGVAKGAKGPVVAPGAEAVAKAYDGSLAGVLETLGASGAEGEVTKLPAPSGFKAPLVVAVGLGPEPGKDADGAGFDAEALRKAAGAAARALTGAKKAAFALPVEDASDVAAIGEGVLLGAYSFDTYKEAAPKTARSGNGKAPLAEAALLGAKPRDKEHKAAVERATAVAEELNRARDLINTPPNDLDPAAFAAIAQAAAKEHGIKVQVLDEKALEKGGYGGILGVGVGSASGPRLVKLSYTSSKAKKHLAFVGKGITYDSGGISLKPAGHNETMKCDMSGAAAVFAAVVAAARLGLEVNVTGWLALAENMPSGSATRPGDVLRMFSGKTVEVLNTDAEGRLVLADALWAASQEKPDAIVDVATLTGAMVLALGSRTFGIMANDDAFRSAVQEAAEEVGEPAWPMPLPEHLRKGMDSPTADIANMGERMGGGLVAGLFLREFVGEGITWAHLDIAGPAFNEGGPFGYTPKGGTGTAVRTLVRLAELTASGDLG

SEQ ID NO: 442 - protein, 394 aa, Streptomyces SMCD2215
MTTAQTPELDVQPTPLALLLLGREADPRSERGVECPGDLPSPSDPDLVARARAAKEKLGDKVFVLGHHYQRDEVIQFADVTGDSFKLARDAAARPEAEYIVFCGVHFMAESADILTSAEQKVVLPDLAAGCSMADMATAEQVAECWDVLTEAGVAEQVVPVSYMNSSADIKAFTGKHGGTICTSSNAQRALEWAFQQGEKVLFLPDQHLGRNTAVRDMGMSLEDCVVYNPHKPNGGLTAEQLRDAKMILWRGHCSVHGRFSLDSVNDVRERIPGVNVLVHPECRHEVVAAADYVGSTEYIIKALEAAPAGSKWAIGTELNLVRRLANRFAPEGKEIVFLDKTVCFCSTMNRIDLPHLVWALESLAEGNLVNRIEVDQETEAFAKLALERMLALP

SEQ ID NO: 443 - protein, 118 aa, Streptomyces SMCD2215
MSVSDETTTVTDGIILTDAAASKVKALLDQEGRDDLALRVAVQPGGCSGLRYQLFFDERSLDGDVEKDFGGVKVVTDRMSAPYLGGATVDFVDTIEKQGFTIDNPNATGSCACGDSFS

SEQ ID NO: 444 - protein, 324 aa, Streptomyces SMCD2215
MRIAVTGSIATDHLMTFPGRFADQFVADQLHTVSLSFLVDNLDVRRGGVGANIAFGMGQLGTRPILVGAAGFDFDEYRAWLERHGVDTDSVRISETLHTARFVCTTDADHNQIGSFYTGAMSEARLIELKTVADRVGGLDLVLIGADDPEGMLRHTEECRSRGIPFAADFSQQIARMNGDEIRILLDGATYLFSNEYEKGLIESKTGWSDAEILAKVGTRVTTLGSRGVRIERDGEDPIEVGCPAEDRKADPTGVGDAFRAGFLSGLAWGVSLERAAQIGCMLATLVIETVGTQEYQLRRGHFMDRFSVAYGDEAASEVRKHLG

SEQ ID NO: 445 - protein, 856 aa, Streptomyces SMCD2215
MPGTNLTREEAQQRAKLLTVDSYEIDLDLSGAQEGGTYRSVTTVRFDVAETGAESFIDLVAPTVHEVTLNGDALDAAELFKDSRIALPGLLQGRNVLRVVADCAYTNTGEGLHRFVDPVDQQAYLYTQFEVPDARRVFASFEQPDLKATFQFTVKAPPGWTVVSNSPTPEPRDDTWVFEPTPRISSYITALIVGPYHSVHSVYEKNGQSVPLGIYCRPSLAEYLDSDAIFEVTRQGFDWFQEKFDYAYPFEKYDQLFVPEFNAGAMENAGAVTIRDQYVFRSKVTDAAYEVRAETILHELAHMWFGDLVTMEWWNDLWLNESFATYTSIACQAHAPDSRWPHSWTTFANSMKTWAYRQDQLPSTHPIMAEINDLDDVLVNFDGITYAKGASVLKQLVAYVGMDAFFAGVQAYFKRHAFGNTRLSDLLGALEETSGRDLKTWSKKWLQTAGINVLRPEIETDADNVITSFAIRQEAPALPVGAKGEPTLRPHRIAVGLYDLDADSGKLVRGDRIELDVDGELTAVPQLAGRPRPAVILLNDDDLSYAKVRLDEASLAVVTEHLGDFEASLPRALCWASAWDMTRDAELATRDYLALVLSGIGKESDIGVVQSLHRQVKLAIDLYADPATREALLTRWTDATLAHLRSAAPGSDHQLAWARAFTATARTPEQLDLLESLLDGSQTVEGLAVDTELRWAFVHRLAAVGRWDEAEIAGEYELDRTAAGERHAASARAARPTAEAKAEVWASVVESDKLPNAVQEAVIGGFVQTDQRELLAPYTEKYFEVVKDIWESRSHEIAQQIAVGLYPAIQVSQETLERTDAWLASAEPGAALRRLVSESRSGIERALRAQAADARA

SEQ ID NO: 446 - protein, 831 aa, Streptomyces SMCD2215
MKAVVMAGGEGTRLRPMTSSMPKPLLPVANRPIMEHVLRLLKRHGLTETVVTVQFLASLVKNYFGDGEELGMELSYANEEKPLGTAGSVKNAEEALKDDAFLVISGDALTDFDLTELINFHKEKGALVTVCLTRVPNPLEFGITIVDEEGKVERFLEKPTWGQVFSDTVNTGIYVMEPEVFDYVEADVPVDWSGDVFPQLMKEGKPIYGYVAEGYWEDVGTHESYVKAQADVLEGKVDVELDGFEISPGVWVAEGAEVHPDAVLRGPLYIGDYAKVESGAEIREHTIIGSNVVVKSGAFLHKAVVHDNVYVGQHSNLRGCVVGKNTDIMRAARIEDGAVIGDECLIGEESIVQGNVRVYPFKTIEAGAFVNTSVIWESRGQAHLFGARGVSGILNVEITPELAVRLAGAYATTLKKGSTVTTARDHSRGARALKRAVISALQASAIDVRDLENVPLPVARQQTARGSAGGIMIRTTQGVPDSVDIMFFDGNGADLSQGSQRKLDRVFARQEYRRAFPGEIGDLHFPSSVFDSYTGSLLRNVDTTGISESGLKVVVDATNGSAGLVLPSLLGKLGVDSLTINPGLDESRPTETADVRRSGLVRLGEIVASSRAAFGVRFDPVGERLSLVDEKGRIVEDDRALLVMLDLVAAERRSGRVALPVTTTRIAEQVAAYHGTQVEWTTTSPDDLTRVGGGDATIFGGDGKGGFIIPEFSSVFDGTAAFVRLIGLVARTQLTLSQIDARIPRAHVLKRDLATPWAVKGLVMRRVVEAAGERFVDTTDGVRVVETDGRWVMVLPDPAEAVTHLWAEGPDDASAQALLDEWSAVVDSAGR

SEQ ID NO: 447 - protein, 178 aa, Streptomyces SMCD2215
MSALVCTRCGNRNAENSRFCSNCGAPLRAGATPERPSETTSTISISGIEAYDAEATGQTQMPALSPEAQAAVDALPVGSALLVVRRGPNSGSRFLLDGDLTTAGRHPQSDIFLDDVTVSRRHVEFRRGGDGSFTVADVGSLNGTYVNRERIDQVGLNNGDEVQIGKYRLVFYASQRGY

SEQ ID NO: 448 - protein, 961 aa, Streptomyces SMCD2215
MTPHRIPLTELEKGIPFEQRHIGPDLEARAKMLAQVGYGSLDELTAAAVPDVIKNADSLALPGARTEAEVLAELRELAERNEVLDSMIGLGYYGTFTPPVILRNVMENPAWYTAYTPYQPEISQGRLEALLNFQTMVADLTGLPTSGASLLDEGTAAAEAVALSRRMGRNKKGLFLVDADVLPQTIAVIQTRAEPAGVEVVVADLSDGIPAEVAEREINGVLLQYPGASGAVRDIKPLIDQAHELGALVTVAADLLALTLLKSPGELGADIAVGTTQRFGVPMGFGGPHAGYMAVHEKFARSLPGRLVGVSVDADGHKAYRLALQTREQHIRREKATSNICTAQVLLAVMAGMYAVYHGPDGLRAIAQRTHRYATILAEGLRAGGVEVEHGSYFDTLTVRVPGRGAEIVAAARKNGVNLRLVDADRVSLACDETTKRAQLAAVWNAFGVQADIEALDAAAEEALPQDLLRNDAVLTHPVFHQHRSETAMLRYLRRLADRDYALDRGMIPLGSCTMKLNATTEMEPVTWPEFGQLHPFAPAEQAEGYLTLIHELEDRLAEVTGYDKVSLQPNAGSQGELAGLLAVRGYHRANGDEQRTVCLIPSSAHGTNAASAVMAGMKVVVVKTAGDGEIDVEDLRAKIEQYRDELAVLMITYPSTHGVFEEHVADICAQVHEAGGQVYVDGANLNALVGLAKPGHFGGDVSHLNLHKTFCIPHGGGGPGVGPVGVRAHLAPYLPNHPMQPAAGPETGVGPISAAPWGSAGILPISWAYVRLMGGEGLKRATQVAVLSANYIAKRLEPHYPVLYTGPGGLVAHECIIDLRPLTKATGVSVDDVAKRLIDYGFHAPTMSFPVAGTLMIEPTESEDLTELDRFCEAMIAIRAEIEKVGAGEWPADDNPLRGAPHTAAALGGEWEHAYSREEAVFPAGVSAADKYWPPVRRIDQAYGDRNLVCSCPPLDAYED

SEQ ID NO: 449 - protein, 253 aa, Streptomyces SMCD2215
MSTTEQRVAVVTGGARGIGAATAVRLAAEGHAVAVIDLDEAACKDTVEKITAAGGRALAVGADVSDEAQVEAAVARVADELGAPTILVNNAGVLRDNLLFKMSASDWDTVMNVHLRGAFLMTKACQKHMVDAGFGRIVNLSSSSALGNRGQVNYSAAKAGLQGFTKTLAKELGKFGITANAVAPGFIATEMTKATAERVGMGFEDFKAAAATQIPVARVGEPDDIANAIAFFTGEAAGFVSGQVLYVAGGPLD

SEQ ID NO: 450 - protein, 364 aa, Streptomyces SMCD2215
MFLPAALPAAGPSPSPTPSGSATPVVPTLQDAQESATNAAGWVEQNWSTWLAIGLRVLLILVIAMVLRAVVKRAITKLIDRMARTAQAAEGTALGGLLVNNERRRQRSQAIGSVLRSVASFVILGTAALMILGAFQINLAPLLASAGVAGVAIGFGARNLVTDFLSGVFMILEDQYGVGDTIDAGVASGEVIEVGLRVTKLRGDGGEIWYVRNGEVKRIGNLSQGWATAGVDVTVKASEDLDRMKATLDEVTEKMSAEEPWNELLWSPIEVLGLDSVLLDSMVVHVSARTMPGKSLTVERELRWRIKRAFDAADIRIVGGATAVPEEELPDPTAVVAAPSAYANSESPQAAAATPITQQRPPLR

SEQ ID NO: 451 - protein, 139 aa, Streptomyces SMCD2215
MYGDEATIRKILTESGDTWAVVGLSSNERRAAYGVAKVLQRFGKRIVPVHPKAETVHGEKGYASLADIPFDVDVVDVFVNSDLAGPVADEAVAKGARAVWFQLGVIDEAAYDRTRAAGLDMVMDRCPAIEIPRLGQPSL

SEQ ID NO: 452 - protein, 404 aa, Streptomyces SMCD2215
MDSTRALPGSTRALPASTRALATEAVHAGRDDLARQGLHAAPIDLSTTYPSYDSRGEAARIDAFATTGAEPEGPPVYGRLGNPTVARFETALARLEGTESAVAFASGMAALTAVLLVRASTGLRHVVAVRPLYGCSDHLLTAGLLGSEVTWTDPAGITDALRPDTGLVMVESPANPTLAELDLRAVAHGCGSVPLLADNTFATPVLQRPAEQGARLVLHSATKYLGGHGDVMAGVVACDEELAGQLRQVRFATGGVLHPLAGYLLLRGLATLPVRVRAASANAAELAGRLAADPRVTRVHYPRIGGAMIAFEVAGDPHEVIAGVRLVTPAVSLGSVDTLIQHPASISHRIVDADDRRTAGVSDRLLRLSVGLEDVEDLWADLDNALGRVGVPPGARELGRVSAP

SEQ ID NO: 453 - protein, 238 aa, Streptomyces SMCD2215
MTSTDSAAQTPAKAPAKDPWDLPDVSGLVVGVLGGTGPQGKGLAYRLAKAGQKVIIGSRAAERAQAAAGELGHGIEGADNAECARRSDVVIVAVPWDGHGKTLEGLREELAGKLVVDCVNPLGFDKKGAYAIKPDEGSAAEQAAALLPDSRVTAAFHHLSAVLLQDPEIDEIDTDVMVLGEVRADVETVQALAGRIPGMRGVFAGRLRNAHQVESLVANLISVNRRYKAHAGLRVTDV

SEQ ID NO: 454 - protein, 294 aa, Streptomyces SMCD2215
MTTETETDVFEEHRPVLMGVAYRMLGRVADAEDVVQEAWLRWSGGDRGDVREPRAYLVRITTRLAIDRLRQVKARNEAYVGPWLPEPYATDFGDTVPDAAERAVLADSVSLAVMVVLESLSPLERAVFVLREAFGYPYADIAAMLERGEAAVRQLAGRARKHVDERRPRYEVDPARRRELTERFLAAAGEGDLEGLLELLAPDVRLVGDSGGKSRAPLRVLESADKVGRFLIGAAEKGVPDPTVRLLELNGGIAILVLSAGKPDSVFQVDVYEGRIQSVYIMRNPDKLQSLAAS

SEQ ID NO: 455 - protein, 102 aa, Streptomyces SMCD2215
MDVQLTPHEQERLLIHVAADVAEKRRARGLRLNHPEAVALITSHILEGARDGRTVAELMASGRKLLTRDDVMEGIPEMIHDVQVEATFPDGTKLVTVHDPIV

SEQ ID NO: 456 - protein, 103 aa, Streptomyces SMCD2215
MIPGEILFADEPVAYNEGREVTRLTVLNAADRPVQVGSHYHFAEANPGLDFDRAAARGKRLDIPAGTSVRFEPGIPVEVSLVPIAGARVVHGLRGETGGALDA

SEQ ID NO: 457 - protein, 573 aa, Streptomyces SMCD2215
MPEISRAAYADLYGPTTGDRIRLADTDLLVEIEEDRCGGPQLAGDEAVFGGGKVIRESMGQSRATRADGTPDTVITGAVIIDHWGIVKADVGLRDGRITGIGKAGNPDTMDGVHPDLVIGPETEVIAGNGRILTAGAIDAHVHFICPQIADEALSAGVTTLVGGGTGPAEGSKATTVTPGPWHLARMLEAMEQYPLNIGLLGKGNTVSHEAMLSQIRGGALGLKLHEDWGSTPAVIDASLTVAEQTGIQVAIHTDTLNEAGFVGDTLAAIAGRGIHAYHTEGAGGGHAPDIMTVVSEPHVLPSSTNPTRPFTVNTAEEHLDMLMVCHHLNPAVPEDLAFAESRIRPSTIGAEDILHDLGAISIISSDSQAMGRVGEVVLRTWQTAHVMKRRRGALPGDGRADNRRVRRYVAKYTINPALAQGLAREIGSVETGKLADLVLWEPAFFGVKPQLVIKGGQIAYAQMGDANASIPTPQPVLPRPMYGAIGRAPATNSVNFVAPLAIEDGLPERLSLGKRFTAIESTRGVTKADMRENDARPQVRVDPDSFAVHIDGELVEATPAAELPMAQRYFLF

SEQ ID NO: 458 - protein, 534 aa, Streptomyces SMCD2215
MRGMRPNRRITALGSAGALVTATLIAGAVTAPTASANAESRHGQDREARGVAVAAQRAARTGIDWADCPADWALAKPIQCGWVSVPVDYAKPYGKQIKLAVDRIGNTGTKSDRQGSLVYNPGGPGGSGLRFPTRVTTKNPVWANVAKAYDFVGFDPRGVGHSAPISCIDPQEYVKAPKMDPVPDSEADKQAQRKLAREYADGCADRTGKAMLQQMTTPNTVRDLDVIRAALGEKKLNYLGVSYGTYIGAVYGTMFPGHLRRMIVDSVVNPSREKIWYQANLDQDVAFEGRWKDWEDWVAANDAAFHLGTTRAAVQAKWLALRATAKKNPIGGVVGPAELIGFFQNAPYYDSSWVPVATVFSKYVAGDTQALVDAAAPDLSDTAGNISAENGNAVYTAVECTDAKWPTNWHKWDRDNTELNKDYPFMTWANAWLNLPCATWPVKQQNPVNVRTGKGLPQVLIVQSTRDAATPYDGAVELHHRFKGSRLITEKDAGSHGVTGLVNPCINQKVDAYLLNGKLDAKDVTCTPHATPKP

SEQ ID NO: 459 - protein, 406 aa, Streptomyces SMCD2215
MTAPVTARSSADLIRAEEPVLAHNYHPLPVVVARAEGAWVEDVEGRRYLDMLAGYSALNFGHRHPALIEAAHRQLDRLTLTSRAFHNDKLAEFAERLAALTGLDMVLPMNTGAEAVESGIKVARKWAYEVKGVPADRATIVVAADNFHGRTTTIVSFSTDETARAGFGPFTPGFRIVPYNDLAALEAAVDETTAAVLIEPIQGEAGVVIPDDGYLTGVREVTRRKGCLFIADEIQSGLGRTGRTLAVEHEGVVPDMLLLGKALGGGIVPVSAVVAHRDVLGVLRPGEHGSTFGGNPLAAAVGTAVVELLETGEFQRRAAELGATLRDGLAALSGKGVTTFRARGLWAGVDIDPTIGTGREIGERLLHEGVLVKDTHGSTIRLAPPLTITAEELRSALGALGKVLGA

SEQ ID NO: 460 - protein, 464 aa, Streptomyces SMCD2215
MPIATVNPANGETLKTYEAMGEEELERRLQLAEATFRTYRTTTFAERARLMHKAADLLDESGEDIARVMTTEMGKPIKQARAEAAKCAKAMRWYADHAEELLADEEPAESDAKDSGASRVLVRYRPLGPVLAVMPWNFPLWQVVRFAAPALMAGNVGLLKHSSNVPQTALFLEDLFHRAGHPEGCFQTLLIGSGAVDDILRDDRVKAATLTGSEPAGRAVASTAGEMIKKTVLELGGSDPYVVMPSADLDRAAEIAVTARVQNNGQSCIAAKRFIVHTDVYDAFAERFVAGMKALKVGDPMDEDTDVGPLSTEQGRADLEELVDDATRSGATALCGGHRLRRPELPGWYYPPTVLSGITREMRIHREEAFGPVATLYRAADLDEAVLIANDSPFGLSSNVWTRDEAEVDRFVRDLEAGGVFVNGMTASHPAFPFGGVKRSGYGRELSGHGIREFCNITTVWHGA

SEQ ID NO: 461 - protein, 210 aa, Streptomyces SMCD2215
MAAVRVERLVTSGTFSLDGGPWDVDNNVWLVGDDHEVIVVDAAHDADAIAEAVGDRALRAVVCTHAHDDHVNAAPELAARTGAPVLLHPDDLPLWKQTHPDRTPDADLADGQTLTVAGVELTVLHTPGHAPGAVCLYAPALGALFSGDTLFAGGPGATGRSYSDFPTIVESIRERLLTLPAGTTVHTGHGDTTTVGAEAPHLQEWIDRGF

SEQ ID NO: 462 - protein, 449 aa, Streptomyces SMCD2215
MNALNTPLAQLDPEVHDALRAELHRQQSTLEMIASENFAPTAVMEAQGSVATNKYAEGYPGRRYYGGCEHVDVTERLAIERIKSLFGAGFANVQPHSGAQANTAVFFALLQPGDTVLGLDLAHGGHLTHGMRINYSGKMLNVVPYHVSEADNLVDMDEVERLAKEHRPKMIIAGWSAYPRQLDFAAFRRIADEVGALLMVDMAHFAGLVAAGLHPNPVPHAHVTTTTTHKTLGGPRGGVILTNEADLAKKINSAVFPGMQGGPLEHVIAAKAVSFKVAASPEFADRQARTLAGARILADRLTQADAAAAGVKVLTGGTDVHLVLVDLRDSDLDGRQAEDLLHDIGITVNRNAVPFDPRPPMVTSGLRIGTPALATRGFTEDDFTEVADVIALALQPAPDTAALRARTRALAARHPLYPHLSQAASPSQAASLSQAASLSQAATEAGDTA

SEQ ID NO: 463 - protein, 137 aa, Streptomyces SMCD2215
MGDVNEIRRGTLQEQTFYEQVGGEETFRRLVHRFYEGVAEDPVLRPMYPEEDLGPAEERLTLFLIQYWGGPTTYSDNRGHPRLRMRHAPFAVNREAHDAWLRHMRDAVDELGLSEEHEQQLWKYLTYAAASMVNTAD

SEQ ID NO: 464 - protein, 199 aa, Streptomyces SMCD2215
MERARPTTSRRRFLKGAALAAVPYALLPDTQARAQAQAVDYPGAEWQPASTSNYTSSNRPTAYPIDYVVIHVTQETYADALSIFQNPAKQVSIHYLVRSADGHVAQCVRERDIAWHAGNWDYNTRSIGIEHEGWVDQPAYFTDALYEQSAKLTAALCTKYGLPKDRAHIIGHYEVPGTDHTDPGPLWDWTRYIRLVNFA

SEQ ID NO: 465 - protein, 388 aa, Streptomyces SMCD2215
MNYQPTPEDRFTFGLWTVGWQGRDPFGDATRRALDPVESVQRLSELGAYGVTFHDDDLIPFGSSDTERESHIKRFRQALDTTGMTVPMATTNLFTHPVFKDGAFTANDRDVRRYALRKTIRNIDLAVELGAKTYVAWGGREGAESGAAKDVRVALERMKEAFDLLGEYVISQGYDLKFAIEPKPNEPRGDILLPTVGHALAFIERLERPEMYGVNPEVGHEQMAGLNFPHGIAQALWAGKLFHIDLNGQSGIKYDQDLRFGAGDLRAAFWLVDLLETAGYEGPRHFDFKPPRTEDLDGVWASAAGCMRNYLILKDRAAAFRADPEVQEALRASRLDQLAQATASDGLQSLLADRSAFEEFDPEAAAARGMAFEHLDQLAMDHLLGVRG

SEQ ID NO: 466 - protein, 130 aa, Streptomyces SMCD2215
MVHVLSSRTLLHPVDPERSRRFYGELLGLSVYREFGTGPERGTVYFLGGGFLEVSGRSQEGPSPAVQLWLQVADADAAHEELLAKGVEIVRPPVKEPWGLVEMWIADPDGTRIVLVEVPEDHPIRYRPGI

SEQ ID NO: 467 - protein, 357 aa, Streptomyces SMCD2215
MNPPRTDARRHHDPEVRGFASDNYAGAHPEVLAALALANGGHQVAYGEDDYTENLQSVVRSHFGAAAEAFPVFNGTGANVVALQAVTDRWGAVICAESAHINVDEGGAPERMGGLKLLTVPTPDGKLTPELIDRQAYGWDDEHRAMPQAVSITQSTELGTLYTPDEIRAICEHAHARGMKVHLDGSRIANAAASLDVPMRTFTNAVGVDILSLGGTKNGALFGEAVVVLEPGAVSHMKHLRKLSMQLASKMRFVSVQLEALLAKDLWLRNARHSNEMAQRLAEGVRAVHGVEILYPVQANGVFAKLPHAVSERLQKRFRFYFWDENEGVVRWMCAFDTSEDDVDAFVAALKEEMARQ

SEQ ID NO: 468 - protein, 315 aa, Streptomyces SMCD2215
MQTDLVAALDIGGTKIAGALVDDQGRILVRAQRATPAQQDGETVMGAVAEVLGELTASPHWGRAMALGIGSAGPVDASAGTVSPVNVPGWRDYPLVRRVREAAGGLPVELIGDGVAITAAEHWQGAARGHDNALCMVVSTGVGGGLVLNGQLHPGPTGNAGHIGHISVDLDGDPCPCGSRGCVERIASGPNIARRALENGWRPGPDGDTSAAAVAAAARAGDPVAVASFERAAQALAAGIAATATLVEIDIAVIGGGVGKAGDVLFTPLRKALGQYATLSFVQRLEITPAQMGTDAGLVGAAAAALAKRADAAAV

SEQ ID NO: 469 - protein, 451 aa, Streptomyces SMCD2215
MSSNPVAGTVASLMPRARTELAELVAFKSVADFDQFPKSESEGAARWVADALAAEGFQDVALLDTPDGTQSVYGYLPGPEGAKTVLLYAHYDVQPPLDESAWTTPPFELTERDGRWYGRGAADCKGGVIMHLLALRALKANGGIPVHVKVIAEGSEEQGTGGLERYAEEHPDLLAADTIVIGDAGNFRVGLPTVTATLRGMTLVRVQIDTLEGNLHSGQFGGAAPDALGALIRVLDSLRAEDGSTTVDGLTGGSGWEGLQYDEEQFRQDAKVLDGVELIGSGTVADRIWARPAVTVLGIDCPPVVGATPSVQAGARALVSLRVPPGVDAAEATKLLQAHLEAHTPWGARVRTEQIGQGQAFSADTSSPAYAAMAEAMAVAYPGQEMQYAGQGGSIPLCNTLAALYPRAEILLIGLSEPEAQIHAVNESVSPEELERLSVTEALFLRNYAAS

SEQ ID NO: 470 - protein, 377 aa, Streptomyces SMCD2215
MRTTLSAALLLGTWAAVGSQAASATDSTAHSTEAPASAQLLSAMQHDLGLTKSQAVARLAAEKTATAVERKAKRAAGSAYGGSWFDAADGKLTVAVTRGADTDAVRATGASVRLVEHSARQLDAAKARIDALSAPSGVSNWYVDVKTNKVVVDVVTAHRADNDVRAFLAKARKAGPVTVKHTAEAPKTLAAGTVGGDPYYTGNVRCSIGFSVIGGFVSAGHCDVHAGAVYGWDHSYVGNFQGSSFPDNDYSWVNVGSGWWTVPVVLGWGTVSDQLVRGSAEAPVGASICRSGSTSHWHCGNILAKNETVNYSEGAVHEMTKTNVCAEPGDSGGSFISGDQAQGVTSGGWGNCTSGGETWYQPINEILNRYGLTLQTA

SEQ ID NO: 471 - protein, 285 aa, Streptomyces SMCD2215
MSGQSLLVPGELSPTRSVPGNIRRPEYVGKPAPTPYTGPEVQTPETIEAMRIAGRIAAQAMEEAAKLIAPGVTTDELDKVAHAYMCDHGAYPSTLGYRGFPKSLCTSVNEVICHGIPDSTVLRDGDIVNLDVTAYIGGVHGDNNATYLVGDVDEESRLLVERTRESLTRAIKAVKPGRQINIIGRVIESYAKRFGYGVVRDFTGHGINSSFHSGLIIPHYDSPHATTVIRPGMTFTIEPMLTLGTHEYDMWDDGWTVVTKDRKRTAQFEHTLVVTETGAEILTLP

SEQ ID NO: 472 - protein, 448 aa, Streptomyces SMCD2215
MKWDAARNPSVPGDQLTATYRQPGVVLTDRYFTVPLDHDDPAGETIELYAREVVASDKAQQNLPWMVYLQGGPGFGANRFVGKQAWLGRALKDHRVLLLDQRGTGHSTPANRQTLPLRGGPAEQADYLAHFRADAIVRDCEAIRAQVTGGAPWTALGQSFGGFCTVNYLSTAPEGLAAAVITGGLPSLDAHADDVYRAAYPRIERKVAAHYARYPQDVERARRIADHLLTHDVTLPNGYRFTVEAFQSLGTVLGGSEGSHRLHFLLEHAFVRTPQGPALSDAFQEDVQGMLSYASHPLYALVHEACYAQDERPTAWSAERVRAEFPQFDAAKALTGDGPLLFTGESVHPWMFECDPALRPLRETAELLAARTDWRPLYDPARLAVNEVPVAAAVYHDDMYVDTAHALRTARGIRGLRTWVTDEFEHDGVRAGGPRVLDRLLALTRDEA

SEQ ID NO: 473 - protein, 321 aa, Streptomyces SMCD2215
MSNLDREPVPALCGGRGFVVAEPVRELLSPRRVKLGESTEVRRLLPNLGRRMVGAWCFVDHYGPDDIADEPGMQVPPHPHMGLQTVSWLHEGEVLHRDSTGSLQTIRPRELGLMTSGRAISHSEESPRPHARLLHGAQLWVALPDDHRHTDPRFEHHAELPLVTAPGLRAALILGDLDGATSPGTTYTPIVGADLALARGADVRLPLQPDFEYAVLSMSGEAHVDGVPLLPGSMLYLGCGRAELPLRAESEAGLMLLGGEPFEEELIMFWNWIGRTQQEIEQARTDWMTGTRFGEVKGYDGDPLPAPELPPVPLKPRGRVR

SEQ ID NO: 474 - protein, 477 aa, Streptomyces SMCD2215
MTESETIAYDVVVLGAGPVGENVADRTRAAGLSTAVVERELVGGECSYWACIPSKALLRPALARADARRVPGLRQMVQGPLDAAEVLAHRNYYTSDWHDDGAAQWLVGVGADLYRGQGRLDGPRTVTVTGSDGGRKVLTARHAVAVCTGTDAVLPDLPGLAEVGPWTSRDATSAQEVPGRLVVVGGGVVAAEMATAWQALGSKVTLLVRGKGLLNRMEPFAGEFVAEALIEAGADVRTGTSVESVTRENGTVVVVTDTGERIEADEILFATGRKPRTEDIGLDTVGQKPGGWLPVDDSMLVSGSDWLYAVGDVNHRALLTHQGKYQARIAGAAIAARASGVPILESDAWGAHAATADHHAVPQVVFTDPEAAAVGLSLAEAEQAGYRVRAVDVDMASAAGAGLYADGYRGRARMIVDMNEEILRGVTFVGPGVSELIHSATVAVAGQVPISRLWHAVPSFPTISEVWLRLLETYRDN

SEQ ID NO: 475 - protein, 326 aa, Streptomyces SMCD2215
MVQHAAEVTHRTVATPAGRIHLVEQGSGPLVLFVHGFPESWYSWRRQLPALAEAGYRAVALDVRGYGRSSKPAATEAYRMLDLVEDNVAVVHALGEESAVIVGHDWGATIAANSALLSPEVFRAVGLLSVPYTPRGGPRPSDIFARMGGEEEFYVSYFQKPGRAEAEIEPDVRGWLAGFYAALSADTMPAPGAPDPHFVAKGGKLRDRFPAGRLPAWLGESELDVYAGEFERTGLTGALNRYRNMDRDWEDLAAYDGAPITQPSLFAGGSLDASTTWLADAIEAYPVTLPGLVSSHLLDGCGHWIQQERPDEINRLLTEWLAALPA

SEQ ID NO: 476 - protein, 334 aa, Streptomyces SMCD2215
MTRIAINGFGRIGRNVLRALLERDSDLEIVAVNDLTEPTALARLLAYDSTAGRLGRPVTVDGDTLVVDGRRIKVLAERDPAQLPWAELGVDVALESTGRFTSAKAARAHLDAGAKKVLVSAPSDGADITLAYGVNSDLYDPALHTIVSNASCTTNALAPLAAVLDELAGIEHGFMTTVHAYTQEQNLQDGPHRDPRRARAAGVNIVPTTTGAAKAIGLVLPGLDGKLSGDSIRVPVPVGSIVELNTTVARDVTRDEVLAAYRAAADGPLAGVLEYSEDPLVSSDITGNPASSIFDSALTRVDGRHIKVVAWYDNEWGFSNRVIDTLELLAGTRS

SEQ ID NO: 477 - protein, 157 aa, Streptomyces SMCD2215
MESRLDFFNHPLAGKVLRHINSANKVVADSTLPHATQELVKIRASQINGCGFCTDMHTKDAAAEGETQQRLNLVAVWREAKVFTEAERAALELAEQGTRTADAAGGVTDEAWENAAKHFDEDQLAALVALIAIINAYNRVNVITQQPAGDYQPGMFG

SEQ ID NO: 478 - DNA, 432 bp, Glycine max var. Williams 82
atggagaattcaaattctaattccagaaaaccaccaaagaattggaataggatgattttggagagaggggtagttgggttgggcatagtagcagccatgaactccactgatgttgttgtctcctctgctaaagctgctgctaactttcgtggaaccacaacctatgactatggcattttctatgcttcccctctcaacaatattggaacccgcttccctcattttctcaattcctgcaatctttgcgacaaacatcttcatggggttgacatcttcatttacagaggcgagaaagcgttttgtagtgcagaatgccgtgagacacacattagcattagcaacgatgatcaccaagacgtagtcaagtgcagatctcgtgttgtagagcacaatcctgtcacactcacatcttctattcttgctgcagcatga

SEQ ID NO: 479 - DNA, 474 bp, Glycine max var. Williams 82
atggttccaaccccccaactcaagtatgttcttctcctcttttattgtacttttgcctttaacttgttatccactcctgcctgtgccctcaacataggagctgaaaccactggagtcgctgtctctgtgagcaaagagtgcagtagacaatgcgagtcaagtttctgctcagttcctccattattgagatatggcaagtactgtggacttttgtatagtggatgccctggggaaagaccttgtgatggccttgacgcttgttgtatgaagcatgatcaatgtgtgtcagccaaaaacaatgactacctaagccaagagtgcagtcaaacattcataaactgtatgaataactttaagaactcgagggctcctacattcaaaggaaacacgtgcgatgcggatgatgttattgaagttatacatgttgtgatggaagctgctttactggctggaagagttctccacaagccatag

SEQ ID NO: 480 - DNA, 717 bp, Glycine max var. Williams 82
atggaaaacatcaaagatccatcaatttaccgcaatccagtcatattgcagagcgaggacttaaccaagtatattctggaaactgctgtttaccctagagaacctgcgcctctaaaagagctgagggaagccactaataatcacccttggggcttcattgctactttacctgaagcgggtcagctaatgaccttacttttgaagctgttgaatcccaaaaagaccattgaagtgggagtgtttactggttattcccttctcctcaccgcactcaacattcctcatgatggaaagattacagccatagatattaacaggaaaacttatgaggttggtttaccagtcatcaaaaaggctggagttgagcacaagattgatttcatagagtctccagctctaccaattttggataagctacttgaagatcctgcaaatgaaggatcttttgactttgccttcattgatgctgacaaggagaactatgtgaactaccatgagaggcttataaagctggtcaagattggggggttgcttgtgtatgacaacacactgtggggtggacgtgtttgctggcctgaagacaaagttccaccacacgctagatcagggagggacgctgcaattgaatttaacaaaacaatcacaaacgattctcgtgttgaatttgctcttacttccgtaggggatgggctcaatatttgtaggcgcgttgcttga

SEQ ID NO: 481 - DNA, 3504 bp, Glycine max var. Williams 82
atgttttacagtgtggtccaattactattttctgagtgttttgcagtgttcaatgggggcaacaagttacctggtgaccattgtggtgattctggttttgaccaaagggtcctaactgctcccataaaatctgctgttgacaagttccagcttattcctgagttcctcaaggttaggggattggtgaagcaacatttggattcctttaactattttgtgaggacagatataaagaaaatcgttcgtgctaacaatcttatcatggcgagtaggtacccacacatatatctaaggtttttaaatgtcggaattggtaaaccatccatgatgattgatgaggttactgagggccttactccacaaacgtgccgcttaagtgacctgacgtatgcggctccaatatgtgctgatgttgagtacacgctacgaagtcacgataaaccagacaacaagagaacgctcagagttgaaattggaagaatgcctattatgctgcggagttgttgttgtgtcttgcatgggaaagatgaagctgaacttgctaaacttggtgagtgcccccttgatcccggaggatattttgtaatcaaagggactgagaaggtgattttgatacaagaacaactgtcaaagaatagaataattatagacaccgacaagaaaggaaacattactgcatctgttacaagcagcacggagaaaataaaaacaaaaactgttattgtgatggaaaatgagaagctctggttacaattgaataaatttcctaagaaggttcctcttatggtagttatgaaagctatggggatggagagtgatcaagaagttatacagatggttggaagagatcctcgttatagttttctactgttgccctctattgaggaatgtagaaaatgtaaggtatatacaaaagagcaagcattggagtaccttgataagctggtaaaacgtcccacttattcaagcaattcagctgaaaaggaaggagcagcattttctgccctaagagatgtatttcttgcaaatgtgcctgtggatcaagataattttcagaaaaaatgtatatatgttgctgttatgatgagacgcataatggatgcaattttaaataaagatgcaatggatgacaaggattatgtgggaaacaagcggttggagttatctggccagttaatatctctgctttttgaggatctctttaagtcaatgacaaccgaagttaagaacttgacagacaaaatgttagataagccggacaaggctaagaattttgacatatgtactcttcttactaggactcggagtatcatcactctaggtctggaaaggactctctccactggtaattttgaaattaaaaggttcagaatggaaaggaaaggaatgacacaggtgttacaaaggttatcatttattggtgctttgggccacatgacaagagtctcaccacagtttgagaagtccaggaaagtaagtggacctagagctttgcagcctagccagtggggcatgctttgtccttgtgatacccctgaaggtgagtcttgtggactagtaaagaacttggctttgatgactcatgttactactgatgaagaggagaagcccttgatttctctgttctattctttggatgttgcacgcatagaacacctctttgcagaggagcttcatacaccggattcctttcttgtcatttttaatggtttaatccttggcaagcataggaggccactgcattttgctactagaattagaaagttgcggagagcaggtgaaattggtgagtttgtgtctgtctatgtcaatgaaaagcagcattgtgtctacttagcttctgatggtggtagagtttgccgtcccctggtcattgctgacaagggaatatcaagaatcaaacagcatcatatgaaagaattaatggatggagtatgcacatttgatgattttttacgagatggcttgcttgagtatcttgatgttaatgaagaaaacaatgctttgattgctttatatgaaggagatgccacatcagaaactactcatattgagattgagccttttaccatcttgggagttattgcagggttaattccatatcctcatcataatcagtcacctagaaacacgtatcagtgtgccatgggtaagcaagctatgggaaatatagcatttaaccagctgcgccggatggacagtttgctttacctactggtttatcctcaacgacctttgcttacaactaagacaattgagctggttggatatgataagcttggagccggtcaaaatgccacagtagctgtaatgagctatagtggttatgatatagaagatgccattgtgatgaacaaggcatctcttgatcgtgggtttggtcgttgtattgttatgaagaagtataatgccatcattcagaagcattcgaatgacacatcagaccgaatacttaggcctaatagaactgcagacaccgctggacgtatgcagatacttgatgatgatggtattgctgctcctggggaaattcttaggccatatgacatctatatcaataaacaatcaccgattgatacacgtactccaaaaacaggatctgcagcaaatttgccagatagtgcatatcggtccaatgcacaatcattcaagggtaatggaggagaagtagttgatagggtggttctatgctcggataaggataataacatgtgtatcaaatttctaattcgtcacactcgtagacctgagcttggtgataagtttagcagcagacatgggcaaaaaggtgtttgcggaactattgtcccgcaagaagactttccgttttctgagaaaggcatttgtcctgatctgattatgaatcctcatggtttcccaagtcgaatgactgttggaaagatgatagagcttcttggggggaaagcaggggtttcatgtggtaggtttcattacggcagtgcttttggggagagaagtggtcatgctgacaaggttgaaaccataagtgaaactcttgtgagtaaaggcttcaactacagtgggaaagatttcatttattcaggtattacgggttgcccactgcaagcatatattttcatgggtccaatttactaccagaaattaaaacatatggtgcttgataagatgcatgctcgtggtagtggccctcgtgtcatgttaactagacagcctacagaagggagagctagaaatggaggtcttcgtgttggagaaatggaacgtgattgcttgattgcatatggtgctagtatgttaatttatgagcgactcatgttgtctagtgatccttttgaagttcaggtatgtaccgcatgtgggttgttaggatattacaaccataagctgaaaactggtatttgttcatcttgtaagaatggagacaatatttctaccatgaagctaccatatgcatgcaagctcatgattcaggaactccaatcaatgaatattgttccccgcttaaaactggcagatgcgtga

SEQ ID NO: 482 - DNA, 3033 bp, Glycine max var. Williams 82
atggaactattcacctcatcatgtcttaaatttctatttcactctcttgtgatcttattcgtcctctttaaccatgcaaactctcagtctcagttgcatgatcaagaacgtgcaactttactgaagataaaggaataccttgaaaaccctgaattccttagtcactggactccatcaagctcctctcactgctcatggccagagataaaatgcacctccgatggctcagtcactggattgactttgtccaacagcagcatcactcaaaccataccctctttcatatgtgacctcaaaaacctcacagttgttgatttctacaacaattacattcccggggagttcccaacaactctctacaattgctccaagttggagtacctagacctgtcccagaacaactttgttggtagcatccctcatgacattgacagactctctaatttacagtatctcagccttggttacaccaatttctctggtgacattcctgcaagcattggaaggctaaaggaactcagaaatcttcaatttcaaaacagtcttttgaatggaacattccctgctgagattggcaacttgtccaatcttgacaccttggacttgtcctctaacaacatgctccctccttcgaggttgcacgatgactggacccggctgaacaagttgaagtttttttttatgtttcagtccaacttggttggggagatccctgaaaccattgtaaacatggtggctttggagagattggatctatcgcaaaacaatttgagtggaccgattcctggcggtttgttcatgctggagaatctgagcataatgtttctttctagaaacaatctttcaggggaaatacctgatgtggttgaagcattgaatttgaccatcattgatctcactcggaatttcatctcaggaaaaataccagatggttttggaaagctccaaaagttaactggtttggctttgtctattaataacttggaaggggagataccagcaagcataggacttcttccatctctggtagattttaaagtgtttttcaacaatttatcaggtattcttcctcctgattttggtcgctactcaaagcttgaaacatttttggttgcaaataatagttttagtggaaagctaccagagaacttatgctataacggtcacttgcttaatatatctgtgtatgaaaattatctgagtggggaattgccacaatcacttgggaattgtagtagcctcatggaactgaaaatctatagcaatgagttttctggtagcattcctagtggtctttggactttaaacttgtcaaatttcatggtgagtcataataagttcaccggtgagcttcctgagagattgtcctcaagtatttcgcgcttggagatagattacaatcaattttctggtagaattccaactggggtatcttcatggactaatgtggtagtgtttaaagccagtgagaactaccttaatgggagtattccaaaagagttaacagctcttcccaagctaaatattttattgcttgatcagaaccagctcacagggtcacttccgtcagatataatatcatggcagtcccttgtaactctaaatttgagccaaaaccaactctctggacatatcccagattcaattggtctgttacctgtccttacgatacttgacctgtcagaaaatcaattgtctggtgatgttccttctatacttcccagactcaccaatctcaatctatcctccaattatttgacagggagggttccaagtgaatttgacaatcctgcttatgacaccagctttttggacaattctggcctctgtgctgataccccggcactgagcctcagattgtgcaattctagccctcaaagccaaagcaaggactcatcttggtctcctgctttgattataagccttgtggcagtggcctgcttgctggctttgttgacatcactcttgatcatcagattttacagaaaaagaaagcaagtattggatagatcatggaagctcatttccttccaaaggctgagtttcactgaatcaaacatagtgtcatcactgacagaaaataatattattggcagtggcggatatggtgcagtataccgtgttgcagttgatggtttaggctatattgctgtgaagaagatttgggaaaacaagaagttagataaaaatcttgagagctcatttcacactgaagttaagatattgagcaacattcgccacagaaacattgtgaaattgatgtgctgtatctctaatgaggactctatgctccttgtctatgagtatgtggaaaaccgtagccttgacaggtggctgcaccggaagaataagtcatcagctgtgtcaggttcagtccatcatgttgtccttgattggccaaagagattgcatatagccattggagctgcacaaggtttgagctacatgcatcatgattgctcaccacctattgttcatcgagatgtgaaaacaagtaacattcttttggattctcaattcaatgcaaaagttgctgattttggtctggctaggatgttaatgaagccaggggaacttgccaccatgtcatctgtgatcggctcatttggctatatagctccagaatatgctaaaacaactcgagtcagcgaaaagattgatgtgttcagctttggagttatcctattagaactgacaactggtaaggaagctaattatggtgatgagcactcatctcttgcagagtgggcgtggcgccaccagcagttaggaagcaacatagaagagctgctagacaaggatgtcatggaaaccagttacttggatggaatgtgtaaggttttcaaactagggatcatgtgctctgcaacacttccttctagtagaccttccatgaaagaggttctacaaatattgctttcttgtgaagattcattttccaaaggagagagcattattggccactatgatgatgttccccttctcaaaaattcaaaaagagagcataagttggatattgataatgatagctag

SEQ ID NO: 483 - DNA, 1224 bp, Glycine max var. Williams 82
atggcagcttgcactgtctactcaacacaatctctgagcacaaattgctccatctcaaccccatcaaagacgcaactcagttttttccaccaaaagcaggtagttttctggaggaacagcaagaagggcagctgcagcagcagaagaagctatgtgataacatgtgcagcaggtgactcacagacagtggtgattggcctggctgcagactcagggtgtgggaagagcaccttcatgaggaggctgaccagtgtgtttggaggagcagcagagccaccaaagggtggcaaccctgactccaacactctcatcagtgacaccaccactgtcatatgcttggatgattaccactctttggacagaactggaagaaaggagaagggtgtcactgcccttgaccctagagccaatgattttgatctcatgtatgaacaagttaaagctcttaaggatggaattgctgttgaaaaaccaatctacaaccatgtcactggtctcttggatccccctgagctcattaaaccccccaaaatcttagtcattgaaggtttgcacccaatgtttgattcccgtgtcagagatctcttggactttagcatctacctagacattagcaatgaggtcaaattcgcttggaaaattcagagagacatggcagagcgtggacacagtcttgaaagcatcaaggctagcattgaagcaaggaagcctgattttgaagcatatattgatccacaaaagcaatacgcagatgcagtgatagaagtgttgccaacgcaactcattccagatgacaacgagggtaagattttgagagtgagattgatacagaaagagggggttaagtactttagcccggtttacttgtttgatgatggctctaccatttcatggataccatgtggaagaaagcttacatgctcctaccctggcatcaaattcttctatggacctgagacttactacggaaatgaggtgtcagttgtagaaatggatggacaatttgacagactagatgaactaatatacgttgagagccacctaagcaacctctctacaaagttctatggagaggttactcaacagatgttgaagcatgctgattttcccggcagcaacaatggaacaggtctcttccaaaccatagttggtttgaagataagagatctatatgagcagctaatagccagcaaggctgagactccagtagctgcaaaagcttag

SEQ ID NO: 484 - DNA, 1557 bp, Glycine max var. Williams 82
atggaggtgaagaatgaaaagaaagccccgagtgttgaaaggaggcatattgaggcgcccaaaaatttgatggaggtagtgtccatattaacggaagccataaagtcgctcggttacaaggagaaatggcacatcctcaacttgcccatagccattgcttccgctgtgttggacatgggtaagaaaacagttgcaagagaatgcggtgaaagaagtgattgtgtacagctgaaggcccccgaagtcataaaggagttatatgagataaagaaattgttgacacggaccttgcttttcagcagaaaacggtttcatgggttcttatttgctgctggattcgacaaggaggatgtcctcctaagaaagagaacagctcggattctaaggccagttttcacagttatacgtgatatagaatcaaaaagtgtgttggtgtttattcggggaactcgtagcctaaacgacacgctaacagctgcactctgtgctcccgtctccttcgagcataggaggaacaacaacattgtttcaggacatgcacaccgtggtatggttgctgcagcttattggattctagactactgcactcctgtactaaaaaaggctcttgatcaatacccccacttcaaaatcaagatcgttgggcactcgcttggtggtggtaccgctgcactgctgacatttaagctaagagaaatacaagagttctcttcaagcacttgtgtcacgtttggcccagctgcctgtatgacattggagttagccgaatttgggaagccctttatcatttccattatcaatggttatgacatagtgcctacattgtcagtttcttctgttcatgatttcatttctgagggtcgcgatcggagcaatgatcaaaacatcctaaccgcagttagatctcacataccaatcgcaaaagccattgcaggacatgcaataacccgctgcacagaggttgtgaagaaacataaacacggaactcgctcattgcttccctggcacatacgtgagaatattgactcatcgccaagctcaaaatcagataacatagctgaagcttatggatcatctgagacaaattttgaatctctcttgactgaagagcacttaatcatggagtctatgtcagatgatgacgaatataattcttctagtgaaggatctgacggtgatgactccgatggcgacgaagacgaattgtcgaataaagtggggaagcttaaactgggaaaagaagtagccacaaacaaaaacatagctgaagaagagagtgattgtccaatcacaacatcaagtagacgtcgtctttatcctcccggaaggatcatgcatattattcctattgcacattcgtctgaaaatcctaattcaaaccacaatggttgtgatgagaaacatgtttccctatatgaaacgcctagagagctctatggaaagctcagactttcaagaaggatgatacttgatcataagtcaaacaagtatctgaaggtgttacaacaattaatcaatcaactagagaaagagagcttcaaatatcatggaggatga

SEQ ID NO: 485 - DNA, 1983 bp, Glycine max var. Williams 82
atggcgtcgaacgggaatggcagcgttgcgaacggtaacgggagcgctaggaacggacttgcgaagattcagacgcagaagaagcatgacgggatttgtcacgacgacagcggtccaacggtgaaggctcagaccattgacgagcttcactcgctgcagaagaagaaatccgcacccaccacccccgttacggggtttcaggctcctttcgccaccctcaccgaagaagaacgtcataagcaacaactccaatccatcagtgcatctctggcatcactgaccagagaaactggaccgaaactggtgaagggagacccagctaggaagtcagatacccagaaggttactcacgtgcaccatcatgtcagcactcccaccattgttgtcagcgacagttctttgaaatttacccatgtcctctacaatctctccccagctgaactttatgaacaagcgattaagtatgagaaaggatcattcatcacttcaaccggggcattggcaacactttctggggccaagacaggtcgctctccaagggacaagcgcgtcgtcaaggatgatcttactgagaacgagctttggtggggaaagggttcccctaacatcgagatggacgaacacactttcatggtgaacagagaaagagctgttgattacttgaactcgttggacaaggtcttcgtcaacgaccaattcttgaattgggacacagagaacagaatcaaagtccggattgtctctgccagagcttaccattcattgttcatgcacaacatgtgtatccgccccactcctgaagagctggagaattttggtactccggacttcactatatacaatgctggacagttcccctgtaatcgttatactcactacatgacatcctccactagtatagatcttaatcttgctaggagggaaatggtcatcctcggcacacaatacgccggggaaatgaagaagggtcttttcggtgtcatgcattatctcatgcctaagcgccaaatcctctccctacactctggatgcaatatgggcaaagatggggatgtggcactcttctttggactctcaggtaccggaaagaccactctttcgaccgatcacaataggtatctaatcggagatgatgaacactgttggggtgacaatggtgtctccaacattgaaggtggttgctatgccaaatgcattgacctctcacgggagaaagagccagatatttggaatgcaatcaggtttggcacagtgttggaaaacgtggtgtttgatgagcacgaccgagaagttgattactctgacaaatcagttacagaaaatactcgtgctgcttatcctatagagtacattccaaatgcaaagttaccttgcgttggccctcatccaaagaatgtcatacttttggcatgtgacgcatttggggtactcccacccgttagcaagctaaacctggcacagaccatgtaccatttcattagtggatatactgctttggtggcgggcacagaagaaggtattaaggagcctcaggcaactttttcagcttgttttggtgcagcattcattatgctacaccctacaaagtatgcagcaatgcttgctgaaaagatgcagaagcatggtgctaccggatggcttgtcaacactggttggtctgctggcagctatggctatggaagtcgcattaaactacaatacacaagaaaaatcattgatgctattcactcaggaagtctgctgaatgcagagtacaagaagactgaaatttttgggcttgagatccccaccgaagtggagggtgtcccttcagaaattctagaccctgtgaacacttggtcaaacaaaaagggctacaaggagacactattgaagttggctggattgttcaagaacaattttgaaaccttcaccaactacaagattggcaagggcaacaacaacctgacagaagagattctcgcagctggtccaatcttttga

SEQ ID NO: 486 - DNA, 2043 bp, Glycine max var. Williams 82
atggttactgggtggagaagagcgttctgcacatccatccccaaagacagagaacccaaagtgttaacagagaaacaacaacaacaaccacaacaacagcattgcgagaacaccaccaccaccaccaacaacaacaacaataatcacagttccaagtttggatttttctccaacccatcaagaccccggtgcgagtctcagccttcatcaacccctagccttcgatgtcaaaccacatgctcagtcccaaacagcccaaaacttcaatgcaaaacaaaaactccaaggttgttccataactccaatccctcatcccccaagtcaccttccagcttctcacttctcaaatccaccctacgcatatccaaaagtcgatgtggaatctgtatgcagagcgtgaggagtgggcaaggaactgcaatattcacagcggaatgctctcacacgtttcacttcccttgcatagtgaagaagcacccgatcgtcacgtgccccgtgtgcaacacaagctggaaggagcttcctgtgctctccatcaaccacaacaacgacaagtgcgacaagagaggattcaaggtctacaacgacgacgagcctctcatgtctccaacttcactctctcgcttcaatcctattcccgagtccgaaaacgaagacgaagacgaagatgataacattaaaacggagtttaagggctttaatgtcaatccactttccaatttaccgtcctctccggcaattaggaggaacctcgagctatcgttgatgccggaggtggccattgtcgccgccaaccgaaactacgagagttacgtcgtcgttttgaagctgaagccgccgcacctgaccaaaccggcgcgtcgagctccaattgatctcgttgccgtgctcgacgtcggcggagccatgtccggcaacaagctccgcctcatgaaaaactccatgcggcaagtgatctcatcgctccgtccaaccgatcgtctttctatcgtcgcattctccgccggatccaagcggctgcttccgctgcggcgtatgaccggcggaggccagcggtcagcgcgtcggatcgtcgacgccctcgctgcgattgaccgaacacgagaaggaactccggtgaagaatgatgctgtgaaaaaagccgcgaaagttctcgaggaccgccgcgagaagaacgtcgtcgcgagcattgtagtcctctccgatatcaaggactcgcacgccgggatcagtatccacaaaccctcgctcgtttccaccacacgccttactcaccttgaagtgcctgtccacgcggtgcggctgggagagtctccccacgcgctttccgacgacgcgctcgcgaaattcgtgggaggtttgttgaacgtggtggctcaggacgttaggattcagttagaggtggtgtctcgatcacgcgccgtggagatcgcgggcgtgtactcattttcgggtcgacccgttccactcgggtcgtcgggttggatccgtctcggcgacctctacgtcgaagaagagatagaattgctcgtggagctcaaggtacctgcagcttccgctgggtcccaccacgttctgaccgtacgatcttcctatcgggaccctctcactcgagagcctttaaatcccgttgagcaggcaatgctcgttccccgtccccacgccgtacgatcatcgtgcgccaggatcgaacgcttgcggaacttccacgtcaccgcacgagccgtcgctgagtctagccggctcgcggaacacaatgatctcactggagctcatcagttgctctcctcggctcgcgcgcttctcttgcagtcaagtgagccggatgaggagtttctccgctggctcgaagccgaacaagccgagcttcaacggcgcaggcaaaggcaaacactgagaaacagtcgcgttgaagagaaggctgagccgcttacgccgacttcggcttggcgagccgctgagaggttggctaaagtggctatcatgagaaagtctatgaacagagttagtgacttgcatggatttgagaatgccagattttag

SEQ ID NO: 487 - DNA, 2016 bp, Glycine max var. Williams 82
atgactcaagccaatggccaccgtcgtgttgatcaaacagtgattgacataaagaaaccgccggtgagcttcaccgggggtctggtgttcgagtgcctcacttacaccgttacaaagaagaagaaggttgaggagaagtggtcgaatcaagaggtggacctgctgcatgaaatcactagctatgcaccaaagggttgcatcactgcagtgatgggccctagtggcgcaggaaagtccactctcttggatggccttgctgggaggattgcgagtgggagcctcaaagggagggtctccttggatggggcaactgtgagtgcaagcttgatcaagagaacttctgcatatatcatgcaggaagataggcttttcccaatgctaactgtctatgagactttgatgtttgctgctgattttcgtcttggaccactttcacttgctgataagaagcagagggtggagaagctcattgaccagcttggcttaacgtcatctcgaaacacctacataggagacgaaggtacaagaggaatatccggcggagagcggcggcgggtctcaatcggcgtggacatcatccacggcccatccctcctcttcctggacgagccaacctcagggctagactccaccagcgcccacagcgtgatcgagaaagtgcacgacatcgctcgcggcggcagcaccgtgatcctcaccatccaccagccctcatcaagaatccaactcctcctcgaccacctaatcatcctcgcaagagggcaactcatgttccaaggctcaccccaggacgtggcactccacctgagtcgcatgccacgcaaaatccccaaaggagagagccccatcgagcttctcattgacgtgatccaagagtatgatcagtctgaggttggagttgaggcacttgctgagttcgcacgcactggtgtcaagccacctcctttgtctggccaacaacaacactctgtgtcttctgttgctccgtcctcgcaccttagccataggtatgaggaaaattctcaggacttgtcttactcgtcgcaagtgagtagaagggtcgttgatggttttgatcacagtctcagaagttcccataacaacaacacatcaatgtcgtggagcactgggaatagtgcggcgtttttgaaattcactccttcgcggcttaagaatgatcacaagctgcagaataccgcgagaaccaatgcttcacctggatactacgcacactggagtgaaatcctcgaagccactccaacaccccgtagcagtgactacacagtgaatgagaaggactacctcgctccctcaaacgccacacaggaacaccttggagcaaagtttgcaaattcctacctaggagagatttggatccttatgcgtcgcaacttcataaacataaggcgcacccctgagctcttcctttcaagactcatggttctcaccttcatgggcatcatgatggccaccatgttcttcaagccaaaagaaactttgcaaggaatcaccaaccgcctcagcttcttcatcttcacagtgtgccttttcttcttctcctctaacgacgccgtcccggccttcatccaagaaaggttcatcttcataagggaaacctctcacaacgcctatagagcttccacttacaccattgcaggcctaatcactcacatgccctttattcttctccaagcaactgcttatgccgtcattgtttggtttgccctaaaacttagaggcccttttctttacttcttgcttgttctcttcgtttctcttctttcaaccaattcatttgttgtgtttgtgagctcagtggttccaaactacatcttgggttatgctgtagttattgccttcactgccttgttcttcttgttctgtggatacttcttgaacagcaacgacattccccattattggcgttggatgaacaaaatttcgaccatgacgtacccttatgaggggctattgatgaaccagtaccagaccaatgatacctttgggtttgggtaa

SEQ ID NO: 488 - DNA, 1080 bp, Glycine max var. Williams 82
atggcagcacaagctgaaattgagcatcctaggaaagcattcggatgggcagctagggattcttccggtcttctctcccctttcaatttctgcagaagggaacccggtgagaaagatgtggcattcagagtgttgtactgtgggatatgccactcggacctccacagcataaagaacgaatggggtacttccatctatccaatggttcctgggcatgaggtagctggtgtagtaacagaggtgggaagcaaagtagagaagttcaaagttggggacaaggttggtgtgggatgcctggttgattcctgccgcacctgccaaaactgttgtgacaatcttgagaattattgtcctcaatctacgttcacatatggtgccaaatatagagatggaaccatcacatatggaggctactctgactcaatggttgctgatgagcattttgtggttcgcattccagatagattaccacttgatgctgctgcacctcttctttgtgctggcatcactgtgtatagccctctcagatattatggacttgacaagcctggtctgcatgtgggtgtggttggtcttggtggactaggccatatggctgtcaagtttgccaaagcttttggtgctaaggtcacagtaataagtacttcaccaaacaaaaaggaagaagcaatacaaaatcttggagctgattcctttctaataagccgggaccaagatcagatgcaggctgcaatgggtactttggatggtattattgacacagtttctgccgttcatcctctcttacctctcattggtttgctcaagtctcatggaaagcttgtaatggttggtgcaccggagaagcctctggaactgcctgtttttcctttacttgcggggagaaagatagttgctggcactctgattggagggctaatggagacgcaagaaatgattgattttgcagcgaaacacaatgtgaaacctgacattgaagtcattcctatggactatgtcaacacagcaatggagcgcctccttaaagcagatgttaaatatcgatttgttattgatattggaaacacactgaaattctga

SEQ ID NO: 489 - DNA, 1488 bp, Glycine max var. Williams 82
aagatgtgaacaatgtcaccaaaccaaacacgtcaatacttgatactgcccttataaatacatcttttgttggcagctcctacatgcacgtattaatttctgtctcatatatattaacccttctgtgctatcctgagagacacacttaattattataatctcttcctcttgtctttgaaatccttttctaattcaaatattatataacgattgaaatggcagcacaagctgaaattgagcatcctaggaaagcattcggatgggcagctagggattcttccggtcttctctcccctttcaatttctgcagaagggaacccggtgagaaagatgtggcattcagagtgttgtactgtgggatatgccactcggacctccacagcataaagaacgaatggggtacttccatctatccaatggttcctgggcatgaggtagctggtgtagtaacagaggtgggaagcaaagtagagaagttcaaagttggggacaaggttggtgtgggatgcctggttgattcctgccgcacctgccaaaactgttgtgacaatcttgagaattattgtcctcaatctacgttcacatatggtgccaaatatagagatggaaccatcacatatggaggctactctgactcaatggttgctgatgagcattttgtggttcgcattccagatagattaccacttgatgctgctgcacctcttctttgtgctggcatcactgtgtatagccctctcagatattatggacttgacaagcctggtctgcatgtgggtgtggttggtcttggtggactaggccatatggctgtcaagtttgccaaagcttttggtgctaaggtcacagtaataagtacttcaccaaacaaaaaggaagaagcaatacaaaatcttggagctgattcctttctaataagccgggaccaagatcagatgcaggctgcaatgggtactttggatggtattattgacacagtttctgccgttcatcctctcttacctctcattggtttgctcaagtctcatggaaagcttgtaatggttggtgcaccggagaagcctctggaactgcctgtttttcctttacttgcggggagaaagatagttgctggcactctgattggagggctaatggagacgcaagaaatgattgattttgcagcgaaacacaatgtgaaacctgacattgaagtcattcctatggactatgtcaacacagcaatggagcgcctccttaaagcagatgttaaatatcgatttgttattgatattggaaacacactgaaattctgagaccaagctcttaaatattgcacgatttacatttcagagaacgaaccgtgggcgactagtagatagtaaataacaaaaggggagagagatgtgataactttcaaccctgccacttgtcatggaactattgatttcgatttatattatgtatttttgttaggtcatgtcttgaataatattttttcttttgcat

SEQ ID NO: 490 - DNA, 1359 bp, Glycine max var. Williams 82
atggcaaccacggataatcacgtgaaagagtttacgatcgacgacgagtcatcgccgagggcgattctggaaacccctgtttcgggaacagagtccgacaacagtggaagcagcgaaagcttcagttccgtctcgccggagaagtcgccggcggtgaccggaaaagaggttcccaaggaaggttacgtgcaacagttgaagtccatgatcgacgttttcaagttcaagtctgtgagaaagttaacagccgttcctctgctttcggtgggccatgatatctctcggaaagggttcaccaaaaaacttgctcgtattcgaagtgctgaagatagtattgatattggagcttttcccacgaaaccctcttggaggaacttcgattatgaagagttagctgctgctactggtaattttagttatgagaacttgattggaaaaggtggtcacgctgaagtgtacaaaggctacttacccgatggtcaggttatagctgtaaagaggctaatgaagaatgaaaaggatgctgcagacagagctggtgatttcttgacggagcttgggatcatagcacacataaaccacccaaatgcgacgcgccttgttggttttggggttgattgtggcctatactttgtcctacagcttgctccacatggcagtctttcttctttgctttttggttctgaatgcttggactggaagataagattcaaggtagctattggggtggcagagggattgcattatctccataaagagtgcccgagacgaatcattcatagggacatcaaggcctccaatatattactaaacgaaaacttcgaagctgagatatccgattttggactggcaaagtggctcccaagtaagtggacaaaccacgttgtcttcccaatagaaggaacatttggatatttggccccagagtactttatgcatggagttgtggatgagaaaactgatgtatttgcttttggagttttgctgttggagctcataacaggtcaccgtgctgttgattcgaatagtagacaaagtcttgtcatctgggcaaagccactgctggacacaaacaatgtaaaggatttagcagaccccagattaggagaggaatatgatcttactgaaatgaagcgcaccatgttgacggcttccatgtgtgtccaccatgcatcctccaagcggccatacatgaatcaggttgtgcttctactaaagggtgaagagacaattatagaaccaaagaaaaatttagttgcacagaaatctctcatgttagaggcatgtgacctagaagattatacttgctcaagttacttgaaggacctcaatcgccacaggcaattaatcatggagtaa

SEQ ID NO: 491 - DNA, 1386 bp, Glycine max var. Williams 82
atgaatcccaatcccaacaccaacgatttccctctcctctcccaccttcttaaccaccttgatccccaaacacacccacccctccccgcagagctagaccaatctctattaacccaattccctcacttgaaccaccccagcgtgttatcctcactcgcccgtcacgcctccaccctcaacgtcacccccacactctccctcctccgcaccctcggcccccgcccagacccctccgctgtcgccgccgcccgcgccaggatcgccgacccccacgcgcgcgaggacggcggcgaggcccacgtggtccacgcgctggtgcgcgtggacgacacgcacgaggagtgcgtgaagcagctgagagcctccgagaaaaagctcctcgaggcctatgctgaatcggtgaaaggggtcgttgaagaagtgagcgaaggagtggttagggtattgaagaaagcggagagtgaggaagtggaaagggttgatctctctgggtcccacttgaggattctccccgaagcgttcgggaagattcgtggcctcgttgtgcttaatttgtctcagaatcagttagaggtgattcctgattcaatagcaggactacagaggcttgtggagctggatgtttcatctaatgttttagagtccctacctgactctattggattgttggttaatctgaagatctttaatgtgtcagcaaacaagctaactgctcttcctgaatccattgctctttgcaggtcactagtcgaattggatgcaagctttaacaacttaatgtgtctgccaacgaacatgggttttggacttgttaaccttgagaagctcttgatccatttgaacaagatacgatttcttcccgcctccattggagaaatgaaatctctcaggcatcttgatgttcatttcaatgagcttcatggcctacctcaatccattgggaaactcacaaatctggaatatctgaatgttagcagtaactttagtgacatgacagagctacctgaaacacttggtgatctggtcaacttaagggagcttgacctcagcaacaaccaaatccgagctcttccttactcgttcggtaggcttgaaaaattgacaaagctcaacctggaccagaatccaatcatagttcccccaattgaggttgtaaatcaaggggctgaggctgtgaaggagttcatggccaagtggtggctcgatctcattgaagaagctcaacagaaaagcatgtccgaaacacaaaatcagcaagcacagacaggatggctcgcatggggagcctcattgttgaataatgttgctgaagtttctgaaagtgttgcagaatattttggcgctaaaaaagctcctagagacccatggttggatcaacagctgtga

SEQ ID NO: 492 - DNA, 729 bp, Glycine max var. Williams 82
atgctgaagcgtgttgttcactcgttaggcctagtggataaaaatccaagaagaaagagcaaagtgagaggaaccatgacaccttctgactttggcttgagatcaaaggagttatatgtgagggtagttcatcagggtggacaacaagaggtgtatcaccatgcatttccggcatccaagttgacggcgaagtatcccggtatgtgtgttgcaagagcacaagtcttcatggctcctcatcaggcagtgctaaggcctgaagagcatttgctgcttggtcacaagtatgtcgtaatctcgtgtacagatgtggagaaactgaagcgtaagcatcctcagcaatgcaaaaccaaagaacataatggggtggtaacatcggaggtaaacatcattagtgaatgccatcttagtggacacaaaccaaaagagaatgacaaactcagtgtcccaaatgagatgattaacacaaggataactctatctcctactcccagtgaatgcaaaattcatgagaatggtgaagttaaagagccaaacattctagggaaagagaaagtgaatgcagagaaggatgacttttatgtaggcaaggataagttatcaagatattcaagaagaaaaggaataaaagtgaagaagccttttttgccacctcttccaaatggaagatcatataggggtttgggatggcaacccagccttgtcactgtgcaagagctctctctatga

SEQ ID NO: 493 - DNA, 1860 bp, Glycine max var. Williams 82
atggcttcttctctagtggcacttctttctcttctcctcactcttcttgcaacttcatgtctaagtgcaactgtgttttccctccaagtttcaatcaaaacaacttacttggaacctttcaaatgctcccctaagatcaccacatgcaatgcctcactctaccacataagctacggcaacaacatagacgacatagcaaccttttactccgttagtacctcccaaatcaaaccgataatgcgcactaccgagcaagattacctcataacagtgccttgctcttgcaatgacaccaatggacttggcggatatttctatgatacaacctacaaggtgaagtccaatgacacgtttgtgaatattaacaactttgtttacagtggtcaagcctggcctattaacggagaattggaccaaaatgaggagttaacaatacatcttccatgtgggtgttcagagaaaagtgattctcaaattgttgtcacgtacacggttcagcggaatgatacacctgtatcaattgctgctctgctaaatgctacgttagatgacatggtgagtatgaacgaagttctggctcagaacccctcattcatagatgttacttgggtgttgtatgttcctagggaattgaatggtttaccactttccaaaggaaaagacaagaaacaaaagttggagataatcattggcatcttagcgggtgtgacattactttcaattattaccttgattattctcagtgtcgttcttaggagatccagagccaataaaactgccaaaaatgatccaagtgttgtctctaaaagatcaatcaccaatagaactatttccataaagaaccgagactttcatacagaatatattgaagatgcaacaacatttgaatcagaaagaccagtaatttatgctctagaggagattgaagatgctacaaataactttgatgaaacccgaaggattggagtaggtggatacggtacggtgtatttcggaatgttagaggagaaggaggttgctgtgaagaagatgaggtctaataaatccaaagaattctatgcagaactcaaggccttgtgcaggatacatcatattaacattgtggagttgttgggatatgctagtggagatgaccacctttatttggtgtatgagtttgttccaaatggatctctctgtgaacatcttcatgatccattactgaaaggtcaccagccactgtcttggtgtgctaggattcaaattgcactggatgcagcaaaaggtcttgaatatatacatgattacacaaaagcacgatatgtgcaccgtgatataaagaccagtaatattcttcttgatgagaagctcagagccaaggtagcagatttcggacttgcaaagctagtagaacgaaccaacgatgaagaattgatagcgactaggcttgttggaacaccaggctaccttcccccagaatctgtgaaggagcttcaagtgactataaaaaccgatgtatttgcatttggtgtggttctggcagagttgataacagggaaacgtgcactatttcgtgacaaccaagaagccagcaatatgaaatcacttacttcagttgttggccaaatattcaaagatgatgacccagagactgttttagcagatgccatagatgggaatcttcaacgtagctatcctatggaagatgtctacaagatggcagaactagctcattggtgcttgtgcgaagatccaaatgtcaggcctgagatgagggagattgttgtggcattgtcacagattgtgatgtcctccacagaatgggaagcatcactaggtggagacagagaggtcttcagcggggtacttgatggaagatga

SEQ ID NO: 494 - DNA, 1860 bp, Glycine max var. Williams 82; identical to SEQ ID NO: 493

SEQ ID NO: 495 - DNA, 762 bp, Glycine max var. Williams 82
atggcgatgacgtttgttccttcttcaacttcttccactttccgaccaacgttgattcgctgcgccagcgccaatgagcggcaggcgctgtttagccgcattgctcctgtctatgataacctgaatgatttgctgagccttgggcaacaccggatttggaagagaatggcagtgtcctggactggagcgaaaatgggagactgtgtgttggatgtttgctgtggaagtggggacttatcctttctcttgtccgacaaagttggctctcatggcaaggtgattggtcttgatttctcgaaggatcagctatcctttgccttatctcggcagcaatcactttcaaagaattgcttcatgaatatcgagtgggttgaaggtgatgctcttgacttgccattttctgatggttggtttgatgctatcactatgggctatggtcttcgaaatgtggttgataagcaaaaggccatgcaggaaattttccgcgtcctaaaaactggctctacagtatctatcctggattttaataaaagcaatgagttgctaacttctgcagttacggaatggatgattgacaatattgttgtccctgttgccactggttatggtctttcagaggaatacagatacctcaaacgttcaataagagaatttttaacagggaaggagttggagaaacttgccttgggagttggattttctgctgctcgacattatgagattggtggaggcctcatggggtgtttggtagctaagcgttag

SEQ ID NO: 496 - DNA, 1617 bp, Glycine max var. Williams 82
atggcttcatcaatgaggatctcaaggctgctctctcgttcttttctttctgcttccactactcctttgttctctagaggtggaagtggtgctcttggtgcagggctcagtaaattcagcactgctgctgcaattgaagaaccaatcaaaccaccagttaaagtagaacacacccagctcttaatcgatggaaaattcgttgatgctgctactggcaaaacttttccaacgttggaccccaggacaggagatgtgatttctcatgttgctgagggtgaccatgaagatgttgatcgagcagttgcagctgctcgcaaagccttcgaccatggaccttggccaaagatgacagcctatgaaagacaaaggatattgctgcgtgctgctgatctgtttgaaaagcacaatgatgagcttgctgctcttgagacttgggataatgggaagccatatgaacaatctgctcaaatcgaaattccaatgctggttcgcctatttcgatactatgctggttgggcagataagattcatggtctcacagttccagctgatgggccatatcatgtgcaaacattgcatgaacccattggtgttgctggtcagatcattccgtggaacttccctcttgtcatgtttgcctggaaggttgggccagcattggcctgtggtaacaccattgttctcaaaacagctgagcagactccattatctgctttgtatgcatcaaagttgcttcatgaggctggacttcctcctggcgttctgaatgtaatatctggctttggtcctaccgctggtgctgccattgctagtcacatggacatagataagcttgctttcactggttcaaccgaaactggaaaagttgtccttgaattggcagctagaagtaatcttaagcctgttactctggagcttggtgggaaatctccttttatagtatgcgaagatgctgatgtagatgaggctgttgagctagcacactttgcattattctttaatcagggacaatgctgctgtgctgggtctagaacatttgtacacgaacgtgtgtacgatgaatttattgagaaagcaaaggcacgtgctttgaagcgtgctgttggtgatccattcaaggggggaatagagcaaggtcctcagattgattcagaacaatttcagaaaatactgaagtatattaggtccggtgttgaaagtggagctactcttgaaactggaggagatagatttggcaactcaggcttctatattcagcctactgtcttctcaaatgttaaggatgacatgctgattgcaaaggaagagatctttggtccagtgcaaaccatattaaaattcaaggaccttgatgatgtgattcaaagagcaaataacacacactatggccttgcagcaggggtgttcacaaaaaacattaacacagctaacactttgactagagcattgcgagttggaacagtgtggattaactgctttgatacatttgatgcagcaattccctttggagggtacaaaatgagtggccaaggaagagaaaaaggagaatacagtctcaagaactacttgcaagtgaaggctgttgttacatccttgaagaaccctgcttggctttga

SEQ ID NO: 497 - DNA, 1524 bp, Glycine max var. Williams 82
atggcaaagctccattttgcgttgagtttcacacttttgcttctactctgcaatgcctcagctgcaccatccactactttacccgccaagattgttagtgggtttctctcaaatgccgtgcctgcattcaccaaatgggtgtggtcactcaaagcacccaccaaaaccgcgattggtgcgaagtcgatgatgaagttcgagagtgggtacactgtggaaaccgtgtttgatggaagcaagcttggaattgagccttatgcagttgaggtgttgcctaatggggagcttctcattctggattcggctaatagtaacatttataggatttcgtcctcgctttctttgaatagcagaccgaagctggtggcaggatctgctgaaggatattctggacatgttgatggaaggtttagggaggcgaggatgaatcaccccaaagggataacggttgataaccgaggaaatatctatgttgcagatataatgaacatggcaattaggaaaattagtgattcaggggtgacaacaattgctggaggaaaatggagccggggagggggtcatgttgatggtccaagtgaagaagctaaattttctaatgattttgatgttgtttatgttggaagtagttgctccctacttgtcattgatagggggaaccaagccatcagggagatccaactacactttgatgattgtgcttatcaatacgaaaatggatttccacttggaattgcagtgctcattggtgctggcttctttggttatatgcttgcattattacagcgtagacttggtacaattgtggcatctcaggatgctgagggtgcagctatgtctggcatttcaccaagtccatatcaaaaacccttgaattctgccagacctcctttaattccatcagaagatgaatcggataagcaagaagaaagtttctttggatccattgggaagcttcttactaatgctggggcatcagtagtggaaataatgggagccttatttcctggtttcagaaaaaacccaccacagagctatgaatttcaaagcccaccactgttccagcaacctcaaaagcaagtaaatgcttggcctgtgcaagaaagctttgtgattccagatgaagatgagcctccttcaattgaccctagaacaccaacaccacggaaaacgtatgctttcatgtcgaaggatgcagaaaagatgcaacaactttggcaaagtcgcgcattctatagtggatgggacggagatcttcagcagcagcaacaactaaaacaccaacagcaacagcagcaacaacaactaaaacatcatcgccatcagtaccattcatcagtccctcacacttactatgagcaaagccatgaggaaaccaatgagatagtatttggggcagtgcaagagcaggatgggaagaagggcactgtggttattaagcctgtggattatggtcaatctgtctatgatcatcactatattcgacctcgaatcagttctatgggtcatatcaacaagtactaa

SEQ ID NO: 498 - DNA, 1059 bp, Glycine max var. Williams 82
atgcaaggcgcagtaactgcagcaatggttgtgtgcctcttcttgaccgtgggtttgaacactctcataaaagcaaacatgtctaaaggaatgagcaatttcgttttcgttgcgtattcaaaccttctcgcgttcgtttttctgctactagcaaccacaatccgccacagaaacagggctcctacaccaatcactaattcaattatcttcagaatttttcttattagcttgctcagcgtttctgttcagacgctttattatattggacttggatatagctctcccactcttggctcaaccatggaggaccttgttccagcttatactttcattattgccattgtttccaggatggaaaagctggatttaaaactacgaagttgttgggcaaaatctattgggactgtggtctcaattgttggagcattaactgtgaccttatacaaggggttgcctatgacaagtggtttggtgtcaaacgatgtgattctctcatcacaaccatcaaaatggctgttaggaggctttcttcttgcaattggtaccttttgtggttcagtctcgcttgttatccagacctggactatcaaagactaccctgaagagctaatactaataaccattagtaccagtttctctgttatcctatctttcataactgctttcgttgcagaggaaaatcctaaggcatggatacttaaacctgatatgaagttggtgtgcatattctattcagcaatctttgtgatgtctacacgaagtgtggtgtatgcatgggcatgtcgaaagaagggggctgtatatgttgctatgttcagtcctttagaaattgtcattgcacttgcaatgggggttgcatttttgggagacgctttatatcttggaagtatgataggagctgctataatagcagttgggttttatggtgtaatatggggccaagctcaagaggaaaagattgtctgtgaaaattatgaaattagtaccattatctcatcgtcatcttctgaagccgcattattgctggaccaaagcaagggcaaaagttcttttgtatga

SEQ ID NO: 499 - DNA, 813 bp, Glycine max var. Williams 82
atggggagatgggtgaattgtaggggcaatatattcccattcctggggatggtgatggctatgctagctcaaagtggaagcatggtggtaatcaaagttgccatgactgatggaataaacaaatatgtcatggttgtgtactctttggcactctccaccatcttgcttcttccctttgccttgtttcttcacaggtcagagcgtcctcctcttacattctctgcactttgcagtttcttcttgcttgcattctttgggagttcaggacagataatggcttatgttggcatagatctaagctctcctactcttgcatcagccatgcttaatctcattccagctttcacttttatacttgctctcatttttaggatggaagaagtacattggaaacattccagcagccaagccaagttcttaggaacaatagtatcaattgctggagcatttgttgtgatactgtacaagggcccacccatctttaagacacatttgtcaaactcttcgaacaaatttctattttcgcagcaactaaactggatcttgggagggatgttctgtgctggcgattctatagtttgttccctgtggtacatatatcaggcttcggttgcatacaaataccctgctgtaacaaccatagtattcttccaactcttattttcaaccattcagtgtggagtatttgccttaattgtagttcagatcaaacgaatgggagctgaagttagatattgggttgattggcattgtatatcaggcaattgctgcaacattgatacgttacatcttatgcacgtggtgcgtccttaa

SEQ ID NO: 500 - DNA, 1314 bp, Glycine max var. Williams 82
atgggaggcacaaatcctttcaaagacaaattggtttctttcacaaagagaattgttccttccactctctatgctctgcttcccattgttctgctttgtacatacttcgaccttctctccctcactccacattccaccaccaccacctaccacctttctctttctcctcctccacctcctccaccttcatcatcttcttctttttctacagaaaagaacaaaacttaccaaaacccatgtgactactctaatggtgattgggtacgtgacacaagaggccctttatacaatgtaactagttgtggtacaatcaaagagagtgagaaatgcgtatccaatggaaggcctgactcaggctatctatattggagatggcaacccagtgagtgcaatcttccaaggtttgaacctctcacttttctccaacttgttcagaacaaacacatagcatttgttggtgactctttggctaggaaccaattagagtcccttctttgcatgttatccaccgtttcaagtccaaaccttgtctaccaaagtgccaatgacaacaaattccgtcgctggcacttcccttctcacaatgcaaacttctccttgtattggtcaccttttcttgtgcaaggtgtcgaaaggtcaaatgaagggccatattacaatacaatgtacttggatcatgttaatgagaggtgggcaagggatttggattggtttgacatggttgtggtgtcatttgggcattggtttttgcttccttcggtttactatgaaaatggttcggttataggtagcctaaattgtcatgatcttaatcacactaagatggatttttatgttccattaaggaaggttttgaggaccactcttagtagcataattgagagaaaaaggggtaagggaaataatggagttgatgtaatcgtgaagacattttcacctgctcattttgaaggtgattggaataaggctggtacttgttcaaagactaagccttataagaaggaggaaaaagagcttgaaggaatggatgctgagataagaaagattgagatagaagaagtggagaatgcaaaggcaaaagctagtgaattaggagggtttagatttgaggtacttgatgtgaccaaattggcattgttgagaccagatggtcatcctggtccttatatgaatcctttcccatttgctaagggagttccagaacgtgtgcagaatgattgtgttcattggtgcttgccagggcctatagacacttggaatgagattttcctagagatgattaaaaagtgggaggaacaagagaaaggtgattga

SEQ ID NO: 501 - DNA, 1149 bp, Glycine max var. Williams 82
atgaaggaagcgacctgtatctttcatcaacagctacactctctctttcttcactcttcaccgcaactcacacttccggcgaaacctccccggaagccatggccagagaatgagtctccgccgattgccatgtcggtctcctgctccaactgcttccccgacgacgaccactccttcctcctctgcggcgaggactcctccggaatcatggattcctcgccggagtgttcctccgacctcgattcctcgccgccgtcggaggcggagtccatcgccggattcatggaagacgagcgcaacttcgtccccggattcgaatacctcaataggttccaatctcgctctctcgacgcctctgccagagaagaatccgttgcatggattctcaaggtgcaggcttattacgcttttcaaccggtcacggcttatctttccgttaactacttggatcggttcttgaattctcgaccgttgccgccgaaaacgaatgggtggccactgcaacttctctctgttgcgtgcttgtctttagcagcaaagatggaggaatctctagttccatctcttttggaccttcaggtagaaggtgctaaatacgtatttgaacccaaaacaattagaagaatggagctacttgttctgggcgtgttggattggaggctaagatcggttaccccatttagcttcctcgatttctttgcgtgcaagttagattcaactgggacttttaccgggttcctcatttcacgtgctacacaaattatcttatctaatatacaagaggctagctttcttgcgtattggccatcatgcattgctgcagcagccattctccatgcagcaaatgaaattcctaattggtctctcgttaggcctgagcatgcagagtcatggtgtgaggggttaagaaaggagaaaattatagggtgctaccaattaatgcaagaacttgtgattgacaataaccagaggaaaccccctaaggtgttaccacagctgcgagtgacaatatctcggcccattatgaggtctagtgtctcatccttcttagcatcatcctcttcaccttcatcatcctctttgtcttgtagaaggaggaaattaaataactctttgtgggtagacgatgacaaaggaaactcccaatga

SEQ ID NO: 502 - DNA, 1398 bp, Glycine max var. Williams 82
atggttcatcagaggcaaaacaacatccatgttcttgttcttccataccctgcccaaggccacatcaacccccttgtccaattcgcaaaaagattagcttcaaagggtgtcaaagccacagttgccaccacccactacactgccaactccatcaatgcacccaacatcacggtcgaagccatctccgatggtttcgaccaagccggcttcgcccagaccaacaacaacgtgcaactcttccttgcctccttcagaacaaacggctccaggaccttgtctgagctcatcagaaaacaccaacaaactccctcccccgtcacctgcattgtctatgactcatttttcccctgggttctcgacgtggcgaagcagcatggcatttacggagccgcctttttcaccaactctgctgcggtctgcaacatattctgtcgcctacaccatggtttcattcagctccctgttaagatggaacaccttccccttcgtgttccggggcttcctcccttggattcccgcgctctccccagtttcgtcaggttccccgaaagctaccctgcttacatggccatgaaattgagccaattctccaacttgaacaatgcggattggatgttcgtcaacacctttgaagcattggaaagcgaggtgttgaaaggcttaacggagctctttccggcaaagatgataggaccaatggtcccttctggttacttggatgggaggattaaaggggacaaagggtatggagcaagtctatggaagccgctaactgaagagtgcagcaattggttggaatcaaagcctcctcagtctgtagtgtacatctcctttggaagcatggtgtcattgacagaagaacagatggaagaggtggcttggggattgaaagaaagtggggtgagtttcttgtgggttttaagagaatctgagcatggaaaattgccctgtgggtacagagagtcggtaaaagataagggtctaattgtgacatggtgtaaccaacttgaattgctggctcaccaagccactggctgctttgtgactcattgtggctggaattccaccctcgaaagtcttagcctcggcgttccggtggtgtgtttgccacagtgggctgaccagttgcctgatgctaaatttttggatgaaatctgggaggttggtgtgtggcctaaggaggatgagaaaggaattgtgaggaagcaagaatttgtccagagtttgaaggatgtgatggagggtcaaagaagccaagagattagaaggaatgccaataaatggaagaagttggctagggaagcagttggtgaaggaggcagctctgataagcacattaatcaatttgtggatcatttgatgaatgcagataaaaatggaagtttgaatgtatactga

SEQ ID NO: 503 - DNA, 1683 bp, Glycine max var. Williams 82
accaaaacatttgatatcactcaaaaaaaacaaaaacagaaacaaaagatggttcatcagaggcaaaacaacatccatgttcttgttcttccataccctgcccaaggccacatcaacccccttgtccaattcgcaaaaagattagcttcaaagggtgtcaaagccacagttgccaccacccactacactgccaactccatcaatgcacccaacatcacggtcgaagccatctccgatggtttcgaccaagccggcttcgcccagaccaacaacaacgtgcaactcttccttgcctccttcagaacaaacggctccaggaccttgtctgagctcatcagaaaacaccaacaaactccctcccccgtcacctgcattgtctatgactcatttttcccctgggttctcgacgtggcgaagcagcatggcatttacggagccgcctttttcaccaactctgctgcggtctgcaacatattctgtcgcctacaccatggtttcattcagctccctgttaagatggaacaccttccccttcgtgttccggggcttcctcccttggattcccgcgctctccccagtttcgtcaggttccccgaaagctaccctgcttacatggccatgaaattgagccaattctccaacttgaacaatgcggattggatgttcgtcaacacctttgaagcattggaaagcgaggtgttgaaaggcttaacggagctctttccggcaaagatgataggaccaatggtcccttctggttacttggatgggaggattaaaggggacaaagggtatggagcaagtctatggaagccgctaactgaagagtgcagcaattggttggaatcaaagcctcctcagtctgtagtgtacatctcctttggaagcatggtgtcattgacagaagaacagatggaagaggtggcttggggattgaaagaaagtggggtgagtttcttgtgggttttaagagaatctgagcatggaaaattgccctgtgggtacagagagtcggtaaaagataagggtctaattgtgacatggtgtaaccaacttgaattgctggctcaccaagccactggctgctttgtgactcattgtggctggaattccaccctcgaaagtcttagcctcggcgttccggtggtgtgtttgccacagtgggctgaccagttgcctgatgctaaatttttggatgaaatctgggaggttggtgtgtggcctaaggaggatgagaaaggaattgtgaggaagcaagaatttgtccagagtttgaaggatgtgatggagggtcaaagaagccaagagattagaaggaatgccaataaatggaagaagttggctagggaagcagttggtgaaggaggcagctctgataagcacattaatcaatttgtggatcatttgatgaatgcagataaaaatggaagtttgaatgtatactgagtgcctatgctcatcataagttgttatttgttagtggaagcatgtattctgggtgcatttgtgttcattttttcaacatgaaaatttatgtgaatgtatgacatcctttttcagtttcattcttgccaaccaattatacctttctcttctaatttctcatgtatttgttacaaattcttgatttaaaaaatgtatcacttcattcatatcagtatatcacatatggcagtccagagt

SEQ ID NO: 504 - DNA, 222 bp, Glycine max var. Williams 82
atggcttcaccactcaagttcactgtgttctcagcttgtgttttggttttgtgtgtggtggttgctgctcaatatgatgggcctggcaatggctctgacatgcccaaggacatgcctatgggtcctgcaccacattccaatgcttctcttacttgtcctgcaatcataactattctccttccctttatgcttgcctttcttgctgctaaggagagaatttaa

SEQ ID NO: 505 - DNA, 966 bp, Glycine max var. Williams 82
atggctgcctcagctttgtcactaacatccccattccatttcagaaaaccccacaacagggtttcacctctcaatgctcatcctctcattctcatccaaaagggtaaacaatctcttaaatcaaacttctcattctcaaccctgaatgcttccccccacttcagaccccctattgccattgctccttccacactgaccctaacaagagcttcttcctctgatgaatgctttgaccctgctggtgaagcccaaaggttgctgctttctgaggaaaaaccagttaattttgctttctgggtcatattttgggcctctttgtccctggcttggtttgctgtttcaagggatgctaatgctgctgttgaatcctccatcaaagcctctggctttggcttcaacattgccaattcgttgaggaaattgggttggcctgattgggttgtggtgttcacccttgccactcttcctgtgcttgagcttcgtggggctatacctgttggttactggatgcaacttaaccctgtaactttaacagtgttatctattctggggaacatggtccctgtgccattcatcgtgctctaccttaaaaaaattgcgtctttcgttgctgcgaggagcccttctgcgtctcgattccttgacatgctgttcgagaatgccaaagagaaggctggtccagtggaggagtttcagtggcttggtctgatgctctttgtggctgttccttttcctggaacaggagcatggaccggagcctttatagcatccattcttgatatgccattttgggctgctgtgtctgctaatttctttggtgttgtatttgctgggttgctagtaaatttgttagtgaaccttggtctgaagtatgccatcattactggtgtcatccttttctttgtttccacattcatgtggagtgtccttagaaatcttaaaaaaggtttgagctcgtcaaattga

SEQ ID NO: 506 - DNA, 558 bp, Glycine max var. Williams 82
atgggtgcttctggcaacaattttctccaagtggtcgccaagaacttcgatgttcttgctctgcccttggtcacccttgtttaccctttatatgcttcaatcaaggccatagagaccaggtctagtactgatgatcagcaatggctgacttattgggttctctattcattgatcacactcttcgagctcacatttgccaaagttcttgaagtgcttgccatatggccctatgccaagttgatactcagttgctggttggttcttccaaactttaatggggcagcacatgtttataggcactatgttagaccattctatatgaatccacaaatgcctcaaatgcctcaaatgcctcaaatcccaggaacttctcaaatgtggtatgttcctagaaagaacatctttagtaagcaggatgatgtccttactgctgctgagagatacatggaagagcatggaacagaagcatttgaaagactcataaccaaggctgacagagaagctagagcaaggaggaatggaaattatatgatctttgatgatgattatatagattaa

SEQ ID NO: 507 - DNA, 891 bp, Glycine max var. Williams 82
atggacctaaccaaggacaccaacacccttgacacaaattctcaaaccccaccacaacccttcaccaccaacggctccctcaaggaccatcaccatcaccaccccaccaccgtgtcaccgccgcaacagccaccgtctacggcggttgcctacaaagagtgcctcaaaaaccatgcagccagcattggtggccacgcgcttgatgggtgcggtgagttcatgccctcctctttctccaaccccaacgaaccgcgctcgctaacgtgcgccgcgtgtggatgccaccgtaacttccaccgtcgccgcgacacaccggaaaatcatcaccgctccaactccaggcccaatttcttaagcttctaccactccccgccaccgtctcgtcacggggcgggcccgagctccagcccaagcccaagcccgatgtcgagcccgagcccaccgccaatctctcatcatttcccaccttcctcccaccatttccaaggcccaataccagcccacgggctcttgggccttggaaatgaacatcatcatcacatgagttttaattttaactcttcttcccactggaatccagaaaactcgggtgggaagaagaggcataggaccaagttcagccatgaacagaaagaaaaaatgcacaatttcgccgagaaattgggttggagaatgcagaaaggggatgaaggattggtgcaagatttctgcaaggagattggcgtttcaagaggggtcttcaaggtgtggatgcacaacaacaagaacacttctggcaggaagaaatcgttggaaccaggtgaaagaatcaatggcaccggtagtgatagtacagataataataataatcatccttacaacacaaacagcaccaacgatgacacccactga

SEQ ID NO: 508 - DNA, 753 bp, Glycine max var. Williams 82
atggctcaagtttgtttgctcttggtggggcttctcacaatgttctcctctgcctatggctatggatatggtggtggctgggttaatgcacatgccaccttctatggaggaagtgatgcctcaggaacaatgggtggggcatgtggatatggcaacctctacagccaagggtatggaacaaacactgctgctttgagcactgctttgttcaacaatggtcttagttgtggctcatgctatgaaataaggtgtgtgaatgaccataggtggtgcctccctggctccattatggtcactgccaccaatttctgccctccaaacaatgccttaccaaacaatgcaggaggatggtgcaaccctcctatgcaccattttgacctctctcagcctgtcttccttcgcattgcacaatacagagcaggaattgtgcctgtgtcctacagaagggtaccctgcaggagaaggggaggcataaggttcacaatcaatggccactcctactttaacttggtcctcataacaaacgtaggaggtgctggagatgttcatggtgtggccatcaaagggtcaagaactgggtggatgccaatgtccagaaactggggtcaaaattggcaaagcaacaactatctcaatggccaaagcctctcattcaaggtcaccactagtgatggccgtacagtggtgtcctacaatgttgcccctgctggttggtccttcggccaaacctacactggtgctcaattccgctag

SEQ ID NO: 509 - DNA, 840 bp, Glycine max var. Williams 82
atggagaatagaacaagctctgtactcccacctggcttcaggtttcaccccactgatgaggaactaattgtgtactacctttgcaaccaagcctcatcaaggccatgccctgcatcaatcattccagaagtggatatctataagtttgatccatgggaattacctgataaaacagactttggagaaaaggagtggtacttctttagcccacgagagaggaagtatccaaatggggtgaggcctaatagagcaaccgtgtctgggtattggaaggccactgggacagataaagcaatctatagtgggtctaagcatgtaggggtgaagaaggctttggttttttacaagggtaagccaccaaagggtctcaagacagattggattatgcatgagtatagattaattggatcaagaagacaagccaatagacaagttggatccatgaggctagatgactgggtcttgtgtaggatttacaagaagaagaatattggaaaatcaatggaggcaaaagaggactacccaatagcccaaatcaaccttacaccagcaaacaataacagtgaacaagaattggtgaaatttccaaggactagttcccttactcatcttttggaaatggattacttgggtccaatatcacatatattacctgatgcctcatacaattcaacctttgattttcaaattaacactgccaatggtggaatagacccgttcgtaaaaccacagctggttgaaatcccttatgcaacagattcagggaagtaccaggtgaaacagaatagcaccatcaaccccaccatatttgtgaaccaagtgtatgatcaaagaggataa

SEQ ID NO: 510 - DNA, 1368 bp, Glycine max var. Williams 82
atggctggcggcggaggtggggaccggccgccgtggaaggaggcggcgccgccacgacccaccatcactctgccgccgcggtcgggttccatggagacccttttcaatggagggttcagccctggtcccatgactctgctttctggctttttgggtgatggggatgatggaaagtccttctctcagctcctcgccggagctatggcttctccggtggccggagctgtcgccgacggagtgatggactcacctagtctcttttcaccttctcaggtgtcttttggaatgacacaccagcaggccctaacacaggtctcagctcaggcttcacaagccaactcaaatatgcatatccaggctgaacattcattgacacaggcttctgcagctactttcaatacaacacaacagctgattccacccttaaatgcagactcttgggccacaatgactgaatcagcagatcattctcattctgaacaaagattgcaatcttcattgttgaatgttgataagccggcagatgatggctacaactggaggaagtatggacagaaacaggtgaagggtagtgagtttcctcgaagttattacaagtgcacgcatccaaactgttctgtcaagaaaaaggtcgagcgctcacttgagggtcatgtaactgcaattatttataaaggagaacacaaccatcaacgtcctcatcctaacaagcgctcaaaagacaccatgacttcaaatgcaaattcaaatatccaagggagtgtagattcaacttatcaagggacaactacgaactcgatgtctaagatggatccagagtcaagtcaggcaacagctgatcatctatcaggaacaagtgaaagcgaggaagtaggcgatcatgaaaccgaagtggatgagaaaaatgttgagcctgaccccaagaggagaaaagcagaagtctcgcagtcagatccagcttcttcacataggactgtcactgagcctcgaatcattgtgcaaacaacaagtgaagttgatctcttggatgatgggtatagatggcgaaaatatgggcagaaagttgtcaaaggcaacccttatcctaggagctattacaaatgtacaacccaaggttgcaatgtgcggaagcacgtggagagggcttcaacagatcctaaagctgtcataacaacatatgaaggaaaacacaatcatgatgtgccagcagctaagaataacagccacactatggccagcaatactgcatcacagttaaaatcgcataataccaatcctgagaagcataattttggcagcagaggtatgggaggaaatgaacaacagccggttgcacggcttcggttgaaggaagagcagatcacctag

SEQ ID NO: 511 - DNA, 558 bp, Glycine max var. Williams 82
atgggttccacttcactaccatctttcattcagatgtcatctactacacactccagcttcagtgaaaaactcatcacccctcaaaagaagtttcaaattgggacacccacaacaactgcaagagacacacacacaacaatttcttggtcttttccttctcctttatgcaaagctcttcacaaatcagttcctttggctgcttcactttcaattcttctctggtcaacccctgcacatgctgggttcatgtcaggaatttctggaatagaggctattcctggtcctcagctacctcagattgactttctcaaacagctcaatgaagaaaaccagaagaaatatgttgagaatgatgaaagaattaaatcatcccccttgatgaaggaactgcttgagaaatccaagttgaataaagagaagaaccgtaaagaaattgagaacaaatactgcatacgtggggcagaatggggagttggagattgttcaacacagggaatgtcttcagaggagagggagaaattcatagctatgttgaagcagaaggctggagaagagtaa

SEQ ID NO: 512 - DNA, 447 bp, Glycine max var. Williams 82
atgcttttaaactcagaattgaaaatctttggacatatatctccattgctaccatttcaagcccaaacttatccatctccaccacaaccacagggatcccaacaccatggatctgagttcaatatacctcaacaatcaacaaacaaacatccaccacagggatccatgcaacttgccatagtccccaccaaccgaatcaaacccaattcgcacatccaacaacgattcataaactggggtttggtgcatgtgccatgggctcgtcgggatatggtaggtatgcctcaggcttgtcagggtttggtgggtgcgcgatggaattgtcgaggtttggtgggtgcacgacggagttatccgaggtttggtgcatatgcgacgaagttgttgaggtttggtgcgtgtgcaatgagttcactagattttggtggctatgtgacaggtcgctaa

SEQ ID NO: 513 - DNA, 1845 bp, Glycine max var. Williams 82
atgcaaaccaaacccattcacaacaccccaacatacattcctccacccataaggccatcaccaccggtgcaccaaccgcctccctctataccacctaccaaacctcgtgcagtatctatatccgcacctaatactcctgttgccgtaccaattcctccaattgtagagcctgatgactccaatgctgcctattatgactaccaattcttgttcatatcacaaagatccgaaacaagtcaacccgtcactctaagcaccgtggaaggcgtgatcccagccgatttcccatccggcacgtactacctaaccggaccggggcttctggccgatgatcacgggtccacggtgcaccccctagatggccatggttaccttagggcattcacttttgataacgctactaagaacgtcaagtacatggctaagtacattaagacggatgcacacgtggaggagcatgacccaaagacggacaagtggaaatttacacatagaggcccattttccgtgttgaagggtggaaaaaaggttgggaacactaaggtcatgaaaaatgtggctaacaccagtgtactaaagtggggggaaaagctcctgtgcatgtgggaaggtggggaaccgtatgaaatccaagctggtacgttagatacgattggacggtacaacatgatggatggtgctgatttggaaaatcatgatgagagcaaagatggtgttgatgtatgggaggttgctgctaacctattgaagcctatattatatggagtgtttaagatgcccccaaggagactcttgtctcactataaggttgattctagaagaaacaggctactcaccgtgtcttgcaatgctgaagacatgttgcttccacgcagtaattttacatttgccgaatatgactcaaattttaatgtagtacagaagcaagttttcagaatcccagatcacttgatgatccatgattgggctgtaacggatacccactatatagtatttgccaatcgcataaaacttgatgtactgggatccattgcagcagtgtatgggatgtctccaatggtatcagcattaagggtaaacccaagtaagagcacatcccccatatacctgattcctaggtttccagacaaaaataaagacaaagagagagattggagagtaccatttgaagcaccttcacagttgtggctgctccatgttggcaatgcctttgaaattagataccctcatcggaatttggacatacaaatacaagctgctgcttgctcttaccagtggttcaatttcagcaagttatttggatacgactggcaaaagaagaagctggacccatcaataatgaatgtaaaaggtggaaatgagttattgccccatcttgttcaggtgtctataaaattagattctgactacaattgccaagaatgtgatgtgaaaccgatgaagaaatggcagaaatcctcagattttcctgctaccaacccaacgttttcaggcaagaagaacaaatatctctatgcagcaactaccttaggatctcgcaaaacattgccatgtttccctttcgataccgttgtgaaattagacctagagagtgataattctgcccaaacttggactgctggaagtagaagatttattggtgaacctatttttgttcccaaaggtgacgaagaagatgatggctatcttcttgttgttgagtatgccgtttcaatgaatagatgttacctcgttatcttggacccaaaaaggataggagcagataatgcccttattgcaagaatcgaaattccgagccacttgaattttcctctaggttttcatggtttctgggcagctaattag

SEQ ID NO: 514 - DNA, 2079 bp, Glycine max var. Williams 82
tttcaataccaaagccttagtaattaactccaaaaaaatgcaaaccaaacccattcacaacaccccaacatacattcctccacccataaggccatcaccaccggtgcaccaaccgcctccctctataccacctaccaaacctcgtgcagtatctatatccgcacctaatactcctgttgccgtaccaattcctccaattgtagagcctgatgactccaatgctgcctattatgactaccaattcttgttcatatcacaaagatccgaaacaagtcaacccgtcactctaagcaccgtggaaggcgtgatcccagccgatttcccatccggcacgtactacctaaccggaccggggcttctggccgatgatcacgggtccacggtgcaccccctagatggccatggttaccttagggcattcacttttgataacgctactaagaacgtcaagtacatggctaagtacattaagacggatgcacacgtggaggagcatgacccaaagacggacaagtggaaatttacacatagaggcccattttccgtgttgaagggtggaaaaaaggttgggaacactaaggtcatgaaaaatgtggctaacaccagtgtactaaagtggggggaaaagctcctgtgcatgtgggaaggtggggaaccgtatgaaatccaagctggtacgttagatacgattggacggtacaacatgatggatggtgctgatttggaaaatcatgatgagagcaaagatggtgttgatgtatgggaggttgctgctaacctattgaagcctatattatatggagtgtttaagatgcccccaaggagactcttgtctcactataaggttgattctagaagaaacaggctactcaccgtgtcttgcaatgctgaagacatgttgcttccacgcagtaattttacatttgccgaatatgactcaaattttaatgtagtacagaagcaagttttcagaatcccagatcacttgatgatccatgattgggctgtaacggatacccactatatagtatttgccaatcgcataaaacttgatgtactgggatccattgcagcagtgtatgggatgtctccaatggtatcagcattaagggtaaacccaagtaagagcacatcccccatatacctgattcctaggtttccagacaaaaataaagacaaagagagagattggagagtaccatttgaagcaccttcacagttgtggctgctccatgttggcaatgcctttgaaattagataccctcatcggaatttggacatacaaatacaagctgctgcttgctcttaccagtggttcaatttcagcaagttatttggatacgactggcaaaagaagaagctggacccatcaataatgaatgtaaaaggtggaaatgagttattgccccatcttgttcaggtgtctataaaattagattctgactacaattgccaagaatgtgatgtgaaaccgatgaagaaatggcagaaatcctcagattttcctgctaccaacccaacgttttcaggcaagaagaacaaatatctctatgcagcaactaccttaggatctcgcaaaacattgccatgtttccctttcgataccgttgtgaaattagacctagagagtgataattctgcccaaacttggactgctggaagtagaagatttattggtgaacctatttttgttcccaaaggtgacgaagaagatgatggctatcttcttgttgttgagtatgccgtttcaatgaatagatgttacctcgttatcttggacccaaaaaggataggagcagataatgcccttattgcaagaatcgaaattccgagccacttgaattttcctctaggttttcatggtttctgggcagctaattagctgaaacccaaacttagattattataaattttcctttatagtgaaaaccaataaattatattcaatgttaaaattgatatttatagtatcatatgattacatataaaatatttaatggtttgtcatagttgtaagcttttgtctagatttgatctagcattaagttgttcacatatttaataaaatctattttacca

SEQ ID NO: 515 - DNA, 1377 bp, Glycine max var. Williams 82
atgagccagtgtgttcccagttgggatgtcgaagacaacccaccaccctcaagagtctcacttcgctccaactctaattcaactgcccctgatgttcccatgttggactacgaggttgctgagctgacatgggaaaatgggcaactttctatgcatggcttagggctaccgcgtgtgccggtaaaacccccaacagccgtcacgaataagtacacatgggagaagcctcgcgcaagtggcaccttggagtccatagtgaaccaagtcacgagctttcctcaccgaggaaagccgacaccattaaacggcggtgggggcggcggcgtttacgggaacttcagggtgccgtggttcgaccctcatgccactgccaccaccacgaacaccgtgacgatggacgcattggtgccctgctcgaaccgggagcagagcaagcagggcatggagtcggtccccggcggcacgtgcatggtggggtgctccacgcgtgtggggtcatgctgcggggggaagggggcgaaggggcatgaggcgactgggagggatcagagcgtgagtgggagtgccacgtttgggagggatagcaagcacgtgaccctagacacgtgcgacagggagtttggcgtgggtttcacttccacctccatcaactcgctcgaaaacaccagctccgctaagcactgcaccaagaccaccaccgtagacgaccacgattctgtttcccacagtaaaccagtgggagaagaccaggatgaagggaagaaaaagagagcaaacggaaaatcatcggtgtccactaaaaggagcagagctgcggctatacacaaccaatctgaaaggaaaaggagggataagataaaccaaagaatgaagacattgcaaaagttggtcccaaattccagcaagagtgataaagcttcaatgttggatgaggtgatagaatatttgaagcagttgcaagcacagttgcagatgataaatagaatcaacatgtcatcgatgatgctgccattgaccatgcagcaacagcttcaaatgtcgatgatgtctccaatgggcatgggattagggatgggtatggggatgggtatgggaatggggatggatatgaactccatgaaccgtgctcacatccctggcatccctccagtcctccacccttctgccttcatgcccatggcagcctcgtgggatgccgcggccgcagctggtggcggcgaccgacttcaagggactccggccaacgtgatgcctgaccccttgtcgacattttttggatgccaatcacagcccatgaccatcgatgcctacagtagacttgctgccatgtatcaacaactgcaccaacctcctcctgcttctggttccaagaactga

SEQ ID NO: 516 - DNA, 558 bp, Glycine max var. Williams 82
atgagaacacatattgatgatagtgcatctgggaagaatcaccatcttccaatgctttggttttttgattcttctctgaggctttgtgctattcctctatctgtggcaaccatgtggatcactgtgactaacaaggaggacaacagcagctatggaatgctgaaatataacaacctctctgctctaaagtatatggttttagtcagtgccctctgtgcttgctatgctcttcttgctgcagcttgctccttggtcagatgttttgtatccaaagcttggattttctttgtctctgatcagattgtggcatatttagcgatcacatcagttgctgcagtaatggagatgtattacctggcttacaatggtgctaaggaagattcttggagtgaagcctgcagttcctatggcagtttttgcagcaaagtcaagttggctttgatactccatacgatcacattttgctgcttctttgttatagccgtgatttcagcttttcgagcgtttagtgtctttgatcctccttttgtcaattctcaagaggtgcaaggagattga

SEQ ID NO: 517 - DNA, 1506 bp, Glycine max var. Williams 82
atggaccaaaatatgttaccattatttgttcttttagcttttcccattttgctattattcttcagaaaacgcaaaacatctaagaagccaacctttccaccaggccctagaggccttccctttattggcaatctttatcaactcgatggttctactctttgtttgaaactctatgaactctcaaaaaaatatggtcccatcttttcccttcaactaggttcaaggccagccctcgttgtttcctcaccaaaactggccaaggaggtaatgaaaacccatgaccttgagttctgtgggcgaccctccctcataagcacaatgaagttttcatataatgggctagacatggcattttcaccctatagagattattggagacacactagaaaaatttccatcatccatttccttagcctcaagcgtgtcttaatgttttcctcaataagaaaatacgaggttacccaattggtcaaaaagataacggaacatgcttcttgttccaaggttaccaacttgcatgagttgctcacgtgtcttacgagcgctgtagtgtgtagaactgctttgggtagaaggtacgaagaggaagggatcgagagaagcatgttccatggcttgcttaaagaagctcaagaattgacagcttccaccttctacacagattatattcctcttgttggaggagtggttgataaactcactgggttgatgggtcgtcttgagaaaatgttcaaggtgttggatgggttttatcagaatgctattgatgaacaccttgatcctgaaaggaagaaactcactgatgaacaggatataatcgatgccttgcttcaattgaagaatgatcgttcgttctcaatggatctcactcccgctcacatcaaacccttgatgatgaatataattttggcagggacagatacaagtgcagctgcagtagtttgggcaatgacggcactaatgaagagcccgatagtaatgaagaaagcccaagaagagattagaaacatttttggcgggaaagattttatagaggaagatgatattcaaaagcttccttatgttcaggcagttataaaagaaacaatgagaatctacccaccattgcccttgcttttacaaagggaaacgattaaaaagtgtagcattgcagggtacgaaattccagagaagacattggtgtatgtgaatgcttgggcagtgcatagagacccagaaacttgggaggagccagaagagttttatcctgagagattcctagacagcaaaattgattttaggggttatgatttcgagttgattccatttggcgcaggccgaaggatttgcccgggcataaatatgggaattatcacagtggaacttgtgcttgctaatcttctgtattcatttgattgggaaatgcctcaagggatgaaaagggaagacatagacactgatatgcttccaggacttatccaacacaagaaaaatcctctctgcctagttgctaagaagcaagggtga

SEQ ID NO: 518 - DNA, 945 bp, Glycine max var. Williams 82
atgtctaaaacgaatgtgagaagacatgctcttgagaagtgcaggagtgtgaaagagacacagaaagtattgaaccacaactttttcaccagaaacctcaagaaagtgtaccctattgggcttcagaaaagcacctcatctttgtctctgtcttcaatttcattgtctttgtcacaaaactcaaatgactcttcacaggctgattctttgactccactggatgaaaagatttcgctggcactgcgtttgatatcgccaagggaaagaagagaacctacaatagctacttctaagcctcttcagcaacagcaaccaccaagtccaccacccactactgagcctggggaattgaaaagatgtaactggatcacaaagagcagtgataaggcgtacatagaatttcatgatgaatgctggggagttcctgcttatgatgacaacaaattgtttgagctgcttgcattgtctggattgctcatggactacaactggacagaaattctaaaaagaaaggaaactctaagagaagttttcgctggatttgatgccaataccgttgccaaaatggaggaaaaggaaatcatggagactgcatcaaacaaagcactttctttagccgatagcagagtcatgtgcgtagtagacaatgccaaatgcataatgaagattgttaaagaatgtggatcattcagcagttacatatggggttacgtgaatcataaaccaataataaacagatacagatacccaagaaatgtgccattgaggagtccaaaggcagaggcacttagcaaggacttggtgaagcgtggatttcggttcgtgggtccagtgatagtgcactcttttatgcaagctgcagggttgaccattgaccatcttgtggattgttacaggcatagtgaatgtgtgagcctagcagaaagaccttggaggcatatctaa

SEQ ID NO: 519 - DNA, 1302 bp, Glycine max var. Williams 82
atgagcattccaactgtgctagttttaccatatccagctcaagggcatgtcaatcccttgatgaccctctcacaaaagttggttgagcatggttgcaaagtcatttttgtgaacacggactttgaccacaagcgagtggtagcttccatgggcgagcaacaagatagtcttgacgaatcccttctaaagttggtttctatccccgatggtttagaacctgatgatgaccaaaacgatgcaggcaagttatgtgatgctatgcaaaacaccatgccaactatgcttgagaagctcatagaggatgttcatttgaatggtgacaacaaaatcagcttaagtgttgcagatttctgcatgggatgggctttggatgttgggagtaaactgggaatcaaaggagccctgttgtgggcttcaccagcagctttatttggccttctatacaacatccctaagcttatcgatgatgggatcatagattctgatggtggactaacactaaccacgaaaaagacaattcacatatcacaaggtatacctgagatggacccacgagactttttttatctaaatctgacgaaatggtggctttgcaacaccacaaatgaacttgaacctgggccattatcctctattcctaagcttgtgccaattggtccattgttgagaagttatggtgacacaattgcaactgcaaaatcaatcagacaatactgggaagaagatctctcttgtatgagttggctcgaccaacaacctcatggttctgtcttgtatgttgcctttggtagtttcactcattttgatcaaaaccaattcaatgaactagctcctggaattgacctcaccaatagaccttttctttgggttgtgcgtcaagacaataagagggtataccctaatgaattcttgggaagtaaaggtaagattgttggttgggctcctcaacagaaggtgctaaaccaccctgccatagcttgttttcttacccattgtggttggaattctaccatggaaggtttgtctaatggggttcctttactgtgctggccatattttggagaccaactttataacaaagcatatatttgtgatgagttgaaggttgggctgggagttgacaaagataaaaatggactcgtgtcacgcatggagttaaaaaggaaagtagaccaactctttaatgatgagaacataaattcaagttttctggagttgaaggacaaagttatgaaaaacataaccaatggaggtcgatcattagagaaccttaataggtttgtcaactggcttaaaaaataa

SEQ ID NO: 520 - DNA, 312 bp, Glycine max var. Williams 82
atgctgactaagtacctagctccaatttatactcatctcaaatgggtattcgattttgttctctactaccccttttacatgctttatgattctcatccacccataaatcttggaactgaattgagtacatttcattatgaattaacctctggctcagaggaacatgtggattgtgctgtgtgtctaagcaaatttggagaaagagatgaggtgattagagttatgagatgtgagcatgtcttccacaaaggttgtttggatagatggttggtttcaagaatgccacgtgtcctctttgcagaggatcagtga

SEQ ID NO: 521 - DNA, 612 bp, Glycine max var. Williams 82
atgaagagtactatcttctttgctctctttctagtttgtgccttcaccatctcatacctgccttcagccaccgctcagttcgtgctcgacactgatgatgatcctcttcaaaacggtggcacatactatatgttgccagttatgagaggaaagggcggtggaatagaagtagattcaactggaaaagaaatatgccctctcactgttgtgcaatcacccaatgagctcgataaggggattggactagtctttacatctccattacatgccctttttatcgccgaaggctatcctttgagcattaagtttggttcatttgcagttataacgctgtgtgccggcatgcctactgagtgggctattgtggagagagagggtctacaagctgttaaacttgctgcacgcgatacagtagatggttggtttaatattgagagagtttcccgtgaatacaatgactataagcttgtgttctgtccacagcaagctgaagataacaaatgcgaggatattgggattcagatcgacgatgatggaatcaggcgtttagtgctgtctaagaacaaaccattagtggttcagtttcagaaatttagatcatcaactgcatga

SEQ ID NO: 522 - DNA, 912 bp, Glycine max var. Williams 82
atggctttggaaactcttgcttccaatgagttctccaacttcattatctatgacactatctctgcaactccatttagcagccatggctctccggaggctagtttcttggaaagtttagtgaactatcaggagcatgaccctgcatttgataacagcgcattgaggacccgaaatcaccaagccggcgaacaagaaagcgttggcaggaggcagaatgtggtgggggtgcaagtgcaagggaggaagaagaggagaaggaaaccaagggtttgcaaaaacaaggaagaggctgagacacaaagaatcacccacattacagtggaaagaaaccgccggaagcagatgaatgaacaccttgttgtccttcgttcactcatgcctgagtcctacgttcaaaggggtgaccaggcctctatagttggtggtgccatagagtttgtgaaggagctggagcacctcttgcaatcacttgaagctagaaagttgcaacttttacatcaagaagttgtacaagccaatgaaaatacggccatttccaaactcatgcaacccccttttgcacaatttttttcgtatcctcagtacacatggtcgcagactcctaacaaatacacatccaagaccaaagctgccatagctgatatcgaggttactttaatcgagacccatgcaaatcttcggattctcactaggagaaacagccccgggcagctaacaaagttagtagctggttttcaaacactgtgcctcaccgtcctacatcttaatgtcaccactatagaccctttggtattctattccatcagtgctaaggttgaagaaggattccaactttgttcagtagatggtattgcaacggcaattcatcatttgcttgctagaatcgaagaagaggcttccctttgctcttga

SEQ ID NO: 523 - DNA, 1947 bp, Glycine max var. Williams 82
atgccgacaagtgacaacgctggaaacggaaatgggctggcaaagattcaacaacttggtgacaatgaagaaggtcgtccaacggtgaaggctcaaaccattgatgagcttcactctttgcagaagaagaaatctgcaccttccactcccaagggctctctgcctacgtctgccagcgtttttaccgaggaagaacgcaacaaacagcagcttgagtccatcagtgcatctttggcgtcactaacaagagaaagtggaccaaaggtagtgaaaggggatccagcagctaggaaatacgaagcctcaagggttgaacacgtgccgcaccaaattctcacacctaccattgctgtcagtgacagtgccttgaagtttacacatgttctctataacctctccccagcagaactttatgaacaagcgatcaagtatgagaaaggatcgttcattacttccactggggcattggctacgctttctggggccaagacgggtcggtgtcccagagacaagcgcgtggtgaaagatgaagttactgagaatgaactttggtggggaaagggttctcctaacatcgagatggacgagcacagtttcatggtgaatagagaaagagccgttgattatttgaactctttggacaaggtctttgtgaatgaccaattcttgaactgggacccagagaacaaaatcaaagttaggattgtctctgccagagcttaccattccttgtttatgcacaacatgtgcattcgaccaactaccgaagagcttgagaattttggcacaccagacttcactatttataatgctggacagtttccttgcaatcgttacactcactacatgacatcttctactagcattgatcttagtcttgcaaggaaggaaatggtgatccttgggacacagtatgcaggggaaatgaagaaaggtctctttagtgtcatgcactatctcatgcccaagaggaaaatcctctccctacactctggctgcaacatgggcaaaggtggagatgttgctctcttttttggactctcaggtactggaaagaccactctgtccacggatcataataggtatttaattggagatgatgaacactgttggagtgagagtggtgtctcaaacattgaaggtggttgctatgccaaatgcattgatctctcaagggagaatgaacctgacatctggaacgccatcaaatttgggacagtcttggagaatgttgtttttgatgagcattttcgagaagttgattacacagacaaatcagttacagaaaatactcgtgcagcttatccaattgactacattccaaatgtgaagttaccatgtgttggtcctcaccctaagaatgtgatccttttggcatgtgatgcatttggtgtgcttccacctgtgagtaagctaagcctgtcgcagaccatgtaccatttcatcagtggatacacagctttggtggctggcacagaagagggcataaaggagccacaggcaacattttcagcttgttttggtgcagcctttataatgctacaccctacaaagtatgcagccatgcttgctgaaaagatgcagaatcatggtgctactggatggcttgttaacacaggatggtctggtggaagctatggttgtggaagtcgtattaaactatcttatacaagaaaaattattgatgctattcactctggaagcctcttggatgttgagtacaagaagactgagatttttggacttgagatccccactgaagtggagggagtcccctcggaaattctagaacctgagaacacgtggtcagacaaacaagcctacaaggagacactattgaagctggctggattgttcaagaacaattttgaaacattcacctatggagagaacaaccaagtgacaaaggagattcttgctgctggaccaatcattcatgatgcttaa

SEQ ID NO: 524 - DNA, 2996 bp, Glycine max var. Williams 82
cgagctcaccctaattcagatctgtgctctctcttcggcgctccgaaacgcagcgtttcgtccaacctcagatttaggggaatatttgaagaacactgtgcgaagattgtgcttgtgtgtagagcaatagagcatccatatggagctacgctgttgtggtcatcttcatttcatccaggctattaaaggtgatttagttacaaaagccccaaatgttgttcgtggacaaccaaaacttaaatttaaaaagctcactgacatttatgatggcttattgtctcataatgatgatggaatggctgaaagatcatgcttgggtgaaattgaggaaagccctgtgaaaaccaagcctgatgcttccatatgtaatgtcaatgatgatgatgatcagagaatcattaacttggatgatgacaactttgacaattttaccttaagccaaattaaagcaagttgcaaaacaaggaagcgaaaacactcacaaggtcttgactcctctaaaataaacatgaaagttgaagattcgtcattcctggaggactacagagaggagcaaagggcagcagatgattctgatttcctgcagactctcagtagcttgaaatctaaactatcaaagaatatgaagacgaagaagaaaaagtgctttgaagaaccaagccctactgatacccaagagattatgctagtcatcaaatctgaacctgaagagatcctaaacaatcaagagttcccaccctctagcgaagagatcctagactatcatgagttctcaccttctagccaagagatccaagactgtcaagagttctcaccctcctgtgaagagatccaagacggtcaagagttcccacccactagtgaagagataaaaattgatcaagagatcccattctttagtggagattcagttgcccttgttgaagtgaaatctgaggttcctgaagctgattgctatggcgagccagatgactattgtattatagaaagccaagaagcagagataatctatgaatggaatttggagaatgaattagatgagtggcaggagcgtgttgattttattccattacgaatggtgaggccatcttgtatggatattgtgataagtaattatcaactaagcaatgaccagtctccatacatgcctgcaatagaatttgaaagtgaagaatgcatcatcaatccagatctccattacatctccccacaaggaatctctctggttgaagatcataactctgatattcatgacaatcaacccgatggtgacactgacactgctgtctcattacctaatgtggttactcataaagaccttgattgccttggtgtagagtttaaagatgataatattatcctcgatgactgcagtagtaatgaatttacaactggtgctgaggatcaggtagaatgtagctctactatggaacatgactgcagtaatgatgaatttacagctggcaatgaggatctggtagaacccagctctactattgaacatgactgcagtaatgatgaatttacagctggtaacgaggatcaggtagaacccagctctactattgaacacaacagcagtaatgatgaattttcagctggttctgaggatcaggtagaacccagctctactattgaacatgactgcactaacgatgaatttacagctggtaacgaggatcaggtagaagccagctctactattgaacacgacagcagtaatgatgaattttcagctggttctgaggatcaggtagaacccagctctactattgaacatgactgtattgatgaatttacaactggttctgaggataaggttgaactcagctctactattgaacatggccccaatcctgatgaatgtctggtttgtcactcagatgatccacctgaatatgaggagaagcaatcatttgcttctgtaaacattgctgagaagagacatgtcaatgtggctactgatgaacttacttcttgggatgaatgtgatggtagttcaaagctgcatcattctgaaaggctattatcaacaagaaaggcgatttcaccatcttcagaggaaaggctctgtaaagctgtggagtcggttaatttgaatcataaaaacaatttgaaatgcaaggaaaaactatacttttctgagaagactgataagatgaatagtactgctgaagggcttgatgatatcacaggagctcgactaactgatatctttaacaaaattagtgttattcctaggagtaaaagagtttcccaacctagaggcatttccaagaatgctcattcttctcgccaagcaacccgcatagggtgcaactctgtacagagttgctcaaagagtgcaattgcatttacacagcagcagatgcatgatgcagaatgccttgctatgagactcacgaaggaattgaagtcaatgaaggacattgtggatgatatgttacgatctgaattctgtctaaatacgtctttgagacataaagtaaatgaggcaagaatggctgtcaagaatgccacaagagctgaagaagctacaaaacgatgcctggccttcatgtcaagggattgcagccgtttctgtaaaataatgaaatttgctgatgatagtccatctcctcaaaaacctcctccagatgtagtgcgtaaagagaggaaaaaaatagccttcgctgatgaagcaggtggaaagttgttccaggttaagttctatgaggatgacgcagtatctttgtccaaatctaattgaaagagaaagaatgttgttctaatatgccattttctgtacaaattttcagtgccctaccattcattgtattagttctttttctagaaatgccttatattttaactgatgggggtggttccttcctatgtcagaagttgattcaattgatactgtataacaagcggcgttgagtcaaattttcaacttggggatttatgcttgtgtgtgcggaattatagtaaacatactttagatccagaacatgtag

SEQ ID NO: 525 - DNA, 486 bp, Glycine max var. Williams 82
atggaagggaataagcaaaagggtgcttcttcttcattcacttctgagctctttgggtccaaagagtctcgtccctcttcttcttctgggatttttgggtccattttttctcctccatcgtctaaggtgttagggagagagtctctgcgctctgaaatgagtagcaaaattgccaatgagacctggagctccagaattggtattcaagataacttctccaagggctatggtagcgaggctccgaatgccgtgaacaaggatatgagttccatctatcaggatcaaagagttcaaccatgtcaccttagttcatcaatttattatggtggccaggacatctattcaaatcctcagagtacacagaatgagggattcaactctatggtgagtgacagtgcatttattttttactgttattattgttgttatactagagcggctacgagccttggcgcaacactaaggttgctgcctcatgacctctag

SEQ ID NO: 526 - DNA, 1047 bp, Glycine max var. Williams 82
atggcaccatttcccacttcccattattacttcagggccttcactttctccattttgttcctcaaaaccctagcttttgacccaattcctctgttttattatgctggctttggaaaagatctgaaatttacgcccaacgtggccctttttggtaatgcaaaggttctcaacgaagggtctgggattcatttctctggctctgggagttcaggagacactgggagagtcatgtacaagaaacccatcaagctttttcaaggtaaaccaaggcaattagtgtctttttctacttactttgcattttcagtctcattggaagatgggggtggcttggcttttgttatggctccaaagggttctgaaggtgatatgttttatcaaagttcttatgggttgaatagtagaaaatttgaagttgttggtgttgagtttagtgcctcaaagggtggtagaaaaggggtttcttctagttgtcatgtcaacatgaatattggtggttttgttgctaaaaaaagtaacacctctattggagaaaagttgcatgtttggattgactatgaagctagttcaaagcgcttagaagtgagactgagtcagcatggtaaatcgaggccatcttatccattgctgtggcaatcaattgacttgtcaaatgtgttgaaggagaaagaaatgttggtgggttttagttctgtgaaggggaatgactctcaagcatgctttctatattcatggagctttgttctgaggaatttcccacattcaatgcattcagagcccttggatccaaaggtctttgtcaaaaacactgaaagtccagtggttaaacaaaggagtgattgctttttgagagttcttgctgcaatgatatttggtactggatgtggagctttgacagcatttattgtgctttacttgtggaccatctttggcaacaataaacgtgctgtggtgccagaggaatctgttgtgcaacctgtagatgttgaatataggaaaaatgtcagaattgttgtagataaaaccatcgaagatggtaagaagtag

SEQ ID NO: 527 - DNA, 1920 bp, Glycine max var. Williams 82
atgtcgtccggcggccccaccacgacctcctccaacaccagcccaagggtcgccgcgggccccaccaccactcgccgtcgcgtcgccgacaacaacaacaacatcgtagacgccgaaaaacagcagcaagttacctcaagcttctccgatttctccgaggtcgaagccgacgagaatgtcccccacccccaccccctccacgcccacgcacaccaccaccatgtgcatcccgtcacgcgatacctcctcctccgcgcgcgcatcctcctctgtgtccccgagtccttcttccagcgcgtggagcacctcgtcctctggctcgccggctccgtccaaagcctccggtccggaaaacacgtcggccgcaaaatcttcctcgccctcatcttcatgctcgtcatgtcggtcttcctcaaggtttcgcttctcggaacgggcgttgagatgaacgggaaaagcttcaagagcatcgagaacgggcaattgatactgcagcggttcaaggaggattgggcctcggcccagagggttgtctccgaggccaggaccggaaccgaaacctccatgcccaaacgcgtcctcgagaggttaacgactccagaaatatggatgaagccaaacagtgacaaatattacaaatgcgtttctcgacccaggaatgtaataaggctaaaaaagacaaatggctatcttcttgttcatgcaaatggtggattgaatcaaatgagaactgggatatgtgatatggttgcagtggcaaaaataatgaatgccacccttgtgcttccctctcttgaccatgattcattttggactgatccaagtgactttaaagatatctttgactggaggcacttcatgaaagttttgaaagacgacattgagatagttgagtacttgccggtccaatatgcatcattgaaacctcttgtgaaggcccctgtttcctggtcaaaggctagttactacagaggtgagattcttccattgttgaagcgacataaggttgtacagtttactcacacagattcccggctcgccaacaatggccttgcttcctctatgcagaagctgaggtgccgtgccaattaccatgctctcaagtacacagcagaaattgaagagcttggaagggttttggtgaataggctaagaaacaataatgaaccatacattgcccttcatttaagatatgagaaagatatgctagcctttactggctgcagtcacaatctcactgctgaggaggctgaggagctaagggttatgaggtatgaagtgaagcattggaaggaaaaagagattgatagtgtggatagaagattgcaaggggggtgccctatgtcacctagagaggcagctatttttctcaaggccatggggtacccttccactacaacaatctacattgttgcaggacctatttatggtgccaatagtttggaaggctttcaatctgagttccctaatgtcttttctcattctacccttgcaactgaggaggagctagaacccttcaagccatatcaaaaccgtctcgctgctttggattatatagtggccctggaaagtgatgtctttgtgtatacctatgatggtaacatggccaaggcagtgcagggtcataggaggtttgaagggtttcagaaaaccatcaatcctgacagatcgaattttgttaagctgattgatcaattcgacaagggtgccttatcttgggaagcatttgctactgaggttaagaattcacattccaataggctaggcgcaccttatcttagacaagtaggagagtcaccgagaacggaggagaatttttacgccaatccctttcctgattgtgtgtgcaacaagtctcaggaggaaatcacaagccagaaactagaccatcatcggtttggtattggagcacaaagatag

SEQ ID NO: 528 - DNA, 1425 bp, Glycine max var. Williams 82
atgccttcttcttccaccaccatagtctccaaatgcgtgatccaccccgaccagaaatcaaacatgaaacccttgagactctctgtttctgaccttccaatgttgtcgtgtcactacatccaaaagggcgtgttactaaccgctccgccctcgtctttcgaggatatgatactctcttttaaacactctctttctatcgcgctctctcactttccggctcttgcgggaaggttagagacagattctcatggttatgttaatattgtctgtaacgacgctggcgtggattttatccatgctaaagcaaaacacctgactctgaacgccgtcgtttcaccgtctctcgttgatgttcacccttgctttaaggaggagtttttcgcttacgacatgacaatctcctacgccggccacaacacccccctcgccgccgtccaggtgacggaactcgccgacggcgtcttcgtcggctgcaccgtcaaccactccgtcaccgacggcacctcgttctggcacttcttcaacacgttcgccgccgtcaccaaaggcgggtccgccaagaaactcctccgcgcgccggacttcacgagggaaaccgtcttcaactccgccgccgtcctccccgtcccctccggcggccccaccgtcaccttcgacgccaacgagcctctccgggaacgcgtcttccacttctcccgcgaagccattcagaaactcaaacaacgagccaacaacactgtcaacaacaaggaactaacggaagttatgggaaaacatgtaaatgacggttggaaagtcgttaacggtaacggtaacggtaactgtaacggaatgattaacggtaacggaagaaacgagatctcgtcgtttcagtcgttatctgctcagctctggagagcggtgacacgtgcgaggaaattcaacgacccggccaaaacgtcgacgtttcggatggcggtgaattgccgccaccgtctggagccgaagatggacgcgttctacttcggcaatgcgattcagagcatcccgacggtcgcgaccgtcggagacattctctcgcgcgatctgcgcttctgcgcagatcttctgcaccgtaacgtcgtcgctcatgatgacgctacggtgcgccgcggaattgaggactgggagagtgcgccaaggctgtttcctctcggaaactttgacggcgcgatgatcaccatgggaagctctccgcggtttcccatgtacgaaaacgacttcggctggggcagacccgttgcgattcggagtgggaaagcgaacaagttcgacggaaagatctccgcgtttccggggagagagggaaacggcagcgtcgatttggaggtcgttttggccccggcgaccatggcggggctcgaaaacgacatggagtttatgcaatacgtaacgcaattcgtttga

SEQ ID NO: 529 - DNA, 1479 bp, Glycine max var. Williams 82
atggggaccttccctcgcttcgacccaatcaccacccaagaccggtccaaccagaccgtggcctccgaccttgacggcaccctcctcgtctcccggagcgccttcccctactacctcctcgttgccctcgaagccggcagcgtcctccgcgccctcctcctcctaacctccgccccctttgtctactttacctacctcgtcctctccgaaaccctcgccatcaagacgttaatcttcataaccttcgcaggtctcaaactaaaagacgtcgagctcgtgtcccgctcggtgctaccgaggttctacgccgaggacgtgcaccccgccacgtggcgcattttcaacgcgttcggagggaggcggtgcattgtcacggcgagcccccgggtgatggtggagccgttcgcgaagacgtttcttggcgcggatacggtgctcgggacggagctggcagtgacggcgtcggggagggtgacggggttcgctaaggaacctggtgtgcttgttggtgttcagaagaaggaggtggttttgaaggagtttgggagcaacttgccggatttgggactcggagacagtgtaacggacatggacttcatgtcaatctgcaaggaaggatacatggtgccaaggatcaagtgtgagccactaccaagaaacaagcttctaagcccaataattttccacgagggccgtttagttcaaaggccaactcctctagtggccctcttgaccttcctatggatgccaattggcataatcctctcaatcctaagggtctacctcaacatccctctgccagaaagacttgcttggtacaactacaagcttcttggaataagggtcattaggaagggtacccctccacccccaccaaagaagggccaaagtggagtcctatttgtatgtaaccacaggacagttttagaccctgtggttacagctgttgcattagggaggaaaatcagctgtgtgacatatagcataagcaagttcactgaaataatttctcctatcaaagctgtagcactctctagggaaagagagaaagatgctgccaacatcaagaagttgcttgaggaaggggatttggtgatctgccctgaaggcaccacttgtagggagcaattccttttgaggttcagtgccctctttgccgagctaaccgataggattgtcccggtcgccatcaacacgaagcaaagcgtgttctatgggacatcggttcgcggccacaagctgctggacccttattttgtgttcatgaatcccatgccaacttatgagatcactttcttgaaccagttgccaacagaactcacctgcatgggaggcaaatctgccatcgaagtcgccaattatattcagagggttcttgcagggactctcgggtttgagtgcaccaatttgactaggaaggacaagtatgccatacttgcaggaacagatggaactgttccatctatgaagagtgcttga

SEQ ID NO: 530 - DNA, 366 bp, Glycine max var. Williams 82
atggcgtctctactgctagcatcaccttctccactctccgttcaattgcacaattccacctgtcacctttccttctctcactcccaaactctttcctcaccgctctccacttcctttccttctctctcagcctctgcaaccaccactctctccccaaccccttctgtgtactgtggcagaggggacaggaaaactgcaaagggaaagcgcttcgctcattcatttggaaatgcgaggccaaaggacaagaagaagggtagagggccactgaggccttatgctccaccggcaccttccaaaaaagacaggctcgaagataatgaggtggtgaagattgaaattgacgagtctctcttttctggttga

SEQ ID NO: 531 - DNA, 651 bp, Glycine max var. Williams 82
atggcaacccaattaaacaatgtgttcagaacttcaattctgaagcacaagatccaatcagagacccctttgaaaaccacaataagaaccacaagatttcaagtgatcaatgctaccagcagtgcaaggcagctcatagagtctggcacagtgaggccaatattgccaaaagatgcttccacagccataaactcagagggatttgttctccttgatgttagaccaacttgggagagagaaaaggcccgtgtggcagggtctttgcacgtgccaatgtttgtggaggacacggataacagtcccataactctgcttaagaagtgggtgcattttgggtacattggcttgtggactggccagtacctcactactttgaattctgagttccttagtcaagtggaaaatgccattcctggtaaggaggccaagcttcttgtggcgtgtggagaagggttaaggtcaatgacagcagcttcaaaactgtataacggaggttacaaaaatctgggatggttggctggaggctttaatcgttctaagaacaacgacttcccagcagtagaaggaaaagagaagttgcagcatgcaacagttgggggtgtttcttacatattccttcagttgctcatattattaaaggctgttgattaa

SEQ ID NO: 532 - DNA, 1487 bp, Glycine max var. Williams 82
acagatgcaaaagtaagtgggaaaagacaaaaaagaaagctcagagaaccaatggttttgatccttaacagatttttattttatcatcccaaacaactcaaaccaagtcattcatagcaacacattcttacaatcttacatgtcaaaactaaacaaaagtgagagaaacatcggaacatggcaacccaattaaacaatgtgttcagaacttcaattctgaagcacaagatccaatcagagacccctttgaaaaccacaataagaaccacaagatttcaagtgatcaatgctaccagcagtgcaaggcagctcatagagtctggcacagtgaggccaatattgccaaaagatgcttccacagccataaactcagagggatttgttctccttgatgttagaccaacttgggagagagaaaaggcccgtgtggcagggtctttgcacgtgccaatgtttgtggaggacacggataacagtcccataactctgcttaagaagtgggtgcattttgggtacattggcttgtggactggccagtacctcactactttgaattctgagttccttagtcaagtggaaaatgccattcctggtaaggaggccaagcttcttgtggcgtgtggagaagggttaaggtatgactttttccaattcacaaaatcagaacttaaattcatcacagcaagaagaacaagttgattttgacaataaaggaaaatgttaacttgttggctttggtgagtgattcaggtcaatgacagcagcttcaaaactgtataacggaggttacaaaaatctgggatggttggctggaggctttaatcgttctaagaacaacgacttcccagcagtagaaggaaaagagaagttgcagcatgcaacagttgggggtgtttcttacatattccttcagttgctcatattattaaaggctgttgattaaggaattattttgataacttattaattttcatgtttgtgaatcttttgaatttgtaagcctctgtagcctagtgacaagtacattttattaaaattccatttaaattaagactatgcaattttgtagataagcaggccaggtttccatacttcacacagatcatgcatttcgtgaagtagttttatcaattatcacatcaacattaaatttctttttctagtatcatatttttataggatgaatccaatttatttcctgagtcagaatttcctattctttgtatataaaatggctcattatgaaagtattggtatactgacccatattattttgtatcaaattcaagagagtgaaacgccacaatagtggttgtttactactctgcctcttaaaatggtttacatagttcaatcttgagtaagagattctctaggcagcctttggtgaattagtggatgaccttctcttgcttatttttgtaacataatgcatttccttttctttggtagtagtagttgttggaatatctttaatctttattatt

SEQ ID NO: 533 - DNA, 1428 bp, Glycine max var. Williams 82
atgacagtattcttagccacgaggctcgtgttgcggagatccccgccgcttctctggcggcgcagcttttctcgggcggcggtagaggccgaaaaggacactgttgccgtgccgtcgcttccgttgttcgattactctccgcctccgtatgcggggcccaccgctgacgagattctggcaaagcgcagggagtatctgagtccttccatcttgcacttctacaagaatcccgtgaacatagtggagggtaagaagcagtacctgtttgacgagaaggggagaaggtacgtggatgcgtttggagggattgctacggtgtgctgcgggcactgtcaccctgatgtggtcgaagccatagtcaaccaaaccaaaaagttgcagcactccacagttctctaccttaacaacgccatcgccgatttcgctcaagctttgacttccaagcttcccggtaatctcaaggtggtgtttttcacaaactctggaacagaagcaaacgaattggcgatactgattgcaaggttatacacagggtgtcatgacataatatctctaaggaatgcttatcatggtaatgcagctgggacaatgggagctacagctcaaagcatctggaaatttaatgtagtacagagtggtgttcatcatgcagtaaatccagacccttatagaggcattttcggttctgatggagagaagtatgcaagagatgtacaagatatcattaacttcggaacttctggaaatgttgcagccttcatttctgaagccatacagggagtggggggtatcattgaattggctcctggttacttgccagctgtgtacaataccattaaaaaaacaggaggacttttcattgctgatgaggttcaggctggctttggtcgcactggtagccatttctggggatttgaggcccacaatgttgttcctgacatagtgacaatggctaagggcattggaaatggcattccccttggtgctgttgtaactactcctgagatcgcagaggtcttaacccgccggagctactttaacacatttggtggcaaccctgtttgtactgctgcagggttggctgttttaaaagtaatagagaaagagcagcttcaacaaaacgcgtttgtggttggatcctatttgaaagaaaggctcactgccctcaaggacaaatatgaattaattggtgatgtgaggggaagaggcctaatgctaggagttgaacttgtcactgatcgtgaacttaaaactccagcaaaaggtgaaacgctgcatgtaatggaccaaatgaaagaattaggagtacttattggtaagggtggttactatggaaatgtcttcagaattacacccccgttgtgtttcaccaaagaagatgcagactttgtagcagacgcaatggacttgaccttgtctagaatgtga

SEQ ID NO: 534 - DNA, 1404 bp, Glycine max var. Williams 82
atggagcaaaaaggaggtgtgcttatgcaacgatatgaactggggagattattaggccaaggaacctttgcgaaggtttaccatgctagaaacatcataactggcatgagtgtggccattaagattattgataaggagaagattctgaaagttgggatgattgatcagattaagcgtgaaatttcagtgatgaggctaatcaggcatccacatgtggttgagctttatgaggtaatggccagcaaaaccaaaatttactttgtcatggagtatgtaaaaggcggtgagctcttcaacaaggtgtccaaaggaaagctcaagcaggatgatgctaggagatattttcagcaattgatcagtgctgttgactactgccatagcagaggcgtgtgccatcgcgatctgaaaccagaaaatcttctactggatgaaaacgggaatttgaaggtcacagatttcgggttaagtgcccttgctgaaactaagcaccaagatggattactccatactacatgtggtacccctgcctatgttgctccagaagtgataaacagaaggggttatgatggagccaaagctgatatatggtcatgtggggtgatcttgtatgttctattggctggttttcttccatttagagactctaatctgatggagatgtacaggaagattggcaggggagaattcaaatttcctaactggtttgcaccggatgtacgcagattgctgtcgaaaatcttggatccaaacccaaagacaaggatatcaatggccaaaattatggaaagttcttggttcaaaaaggggttagagaagcctaccattactcagaatgaagatgaagaactggctcctctcgatgctgatggagtatttggagcttgtgagaatggagatcctattgaaccggcaaaaaactcaaagccttgtaataatttaaatgcttttgacatcatctcctattcctcgggttttgacttgtctggtttgttcgaggagaccgatcgaaagaaagaagagcggtttacatccgacaagccagcctcaatcatcatctccaagttggaagaaatttgcaggcgtcttcggctgaaagtgaaaaagaaagatgggggtttgttcaagttggaaggttccaaggaaggaagaaaagggccattgggtatcgatgcagagatttttgagatcaccccagtcttccatctggttgagttaaaaaaatctagtggagatacattggagtaccaaaagcttttgaaacaggaagttaggcctgcacttaaggacattgtttggaactggcaaggagaacaaccacaaccattgcaacatggagtggtgcagaaagaggaacaaccttcttatcctggcatatcagaggttgtgccacaatcaactgcgtaa

SEQ ID NO: 535 - DNA, 1182 bp, Glycine max var. Williams 82
atggattcggggcttgctatatcttctcctaaaccttattcagtgatcacaactggttcttatgcatcaaaagcttcgcagcacacaaaaaaaactcaaataaaatataatttgaagcgggtacaacaattaagtttgggccatcgttacaaatgcattgaaggagggtttgcatatcaagaatgcaatagaaagtatgttgtgcaagcagtccctgaatcatcttttgattctgaacctcatacttccaatcctcaaatcattttgcactctgtcaaagatttcttagctactttatgcacactttcctatccatatgcaatgattggcttagcattatgtgcactttcttcgtctctccttgcagtggaaaaactatcagacatatctctatcattttttgttggtgtgttacaagctgcggtacctcaattgtttttcgcaatttatagtaatgctctaaatcaagtgtctgaccttgaaatagataagataaacaaaccacatcttccattggcatccgggcaattatcccttaaaactgttgtcatcattgctgcgtcatttttaactttgagtttttggcttagctggatagtaggttcatggcctttgatttggaatcttgtattgattacttcaatatggaccgcttattcagtcaatgtacccttcttgagatggaagaaaaacccaatactcgcggcaatgtgcatggtttcatcttgggcatttgtattgccaattacattttttcttcacatgcagacttttgtgttgaagaggccaattgtctttccaagatcacttattttggctattgtaatcatgaacttcttctttgtgggtatggcattggcaaaggatatacctgatgttgaaggagataaaatatatggcattgatacttttgcaatacgtataggtcaaaaacaagtattttggatttgtattttcctttttgaaatggctttcggagtttccctagtggcaggagcaacatcttctagccttttggtcaaaatcatcacgggtgtggggaatgctgttcttgcttcagttctctggttccaagccaattctatagatttgagcagcaaaacttctggtggatccttttatatgttgatctggaaggtaatccacttaaaatttatttaccatttgaggagttcaacataa

SEQ ID NO: 536 - DNA, 507 bp, Glycine max var. Williams 82
atgcaattcaggctcggcaggcgcgttgtaagggttgctaaatgggtcttcggtcgggtcaggatcaaaacccgacccgggtaccaccaccgtctcggttctggttcgtcccatttgagaaatcccataataaagcttctcacctgggggcaaaaattaaagagaggagcgaagaccctatgcgggaaaaaagggtcgggttatcttccaatcgggtcggatccggcttgcgacagggctccggcggtgccaaaggggcacttggcggtgtacgtgggggaggaggacggcgagttccggcgagtgttgattccggtgatttacttcaaccaccctttgttcagtgatttgctgagggaagcagaaaaaaagttcgggtttgaacaccccggtgggatcacgattccgtgtcgactcaccgagtttgaacgggtcaagacccggatcgcgtccgggtcgggtcagcgcgggaggacccggagattggggtggcggctacattattaa

SEQ ID NO: 537 - DNA, 306 bp, Glycine max var. Williams 82
atgaaatgtaatgctcgtccttttctcacattcattctccttgatgctcttcatgaagataaagaaaaacacactccatttctcagtagtgtaatgattgcttggactggtattgagcacttccgcatgggaagatatgaccctcctcctcctgcagaagaacctgaagactttttgtatgatatacgcccaaggtggccactgggggaagaatatgctgaaggaaaaagtgtagcacgttcgttaagaacagctcgcattcatccttctcttacatctgtaattcaagcatcattgcaacaatga

SEQ ID NO: 538 - DNA, 852 bp, Glycine max var. Williams 82
atgtcgaccaaatttaaggtgtttcgtgaattcacaagcgatgactcattcctaaaccaagttatccctgaaaacatcaccgaattccaagtgactctgtccctcgctagagactacgatggcaacaactcaaccaacggaaagttcattccttactgggacactgaaaaggtcactcccgaagtgataaaaaaattcaagaaaaaatacgaacccaccgcactgagggttaaggttcttgtcagcattggaaacaaaaacaaacaatttcctttcaccattggctcggactcgaacagcgaagcatgggtctccgaggccactgcttcgctgaagagcatcattaaaacctacaaccttgatggcatcgatgtcagctacgaggacatcgccgccaacgaagccgactttgttaattccgttggggggcttgtgaggaacctgaagcagaacaagctcattactgtggcttccttcgcaacaagcgctgatgccgccaacaacaaattctacaatctcttgtacgcagaatatgctactttctttgacactgtggtgtttctgagctgggtagggtttactccttctcgcgccaacccagttgcgagcttggaggagaagatccttgccgtggccaacgagtataaggccgtgaaggcctttctggtcgcttacagcaccgttgctgaggattgggctaatttttcgccacctatcttctttatcactctccatggccttctgggtaactctgcggttaagggagcgtccattaaggtcattagtgacgccaccgcctcctttcccgccaagtggatccctgaaattttattgttggctgcctctaaatga

SEQ ID NO: 539 - DNA, 1549 bp, Glycine max var. Williams 82
accaaacccacaaaacactatagcaatagaaacatttgcttttgaaaaacccctcactcttcatcactacactagctagccacatacaatgtcgaccaaatttaaggtgtttcgtgaattcacaagcgatgactcattcctaaaccaagttatccctgaaaacatcaccgaattccaagtgactctgtccctcgctagagactacgatggcaacaactcaaccaacggaaagttcattccttactgggacactgaaaaggtcactcccgaagtgataaaaaaattcaagaaaaaatacgaacccaccgcactgagggttaaggttcttgtcagcattggaaacaaaaacaaacaatttcctttcaccattggctcggactcgaacagcgaagcatgggtctccgaggccactgcttcgctgaagagcatcattaaaacctacaaccttgatggcatcgatgtcagctacgaggacatcgccgccaacgaagccgactttgttaattccgttggggggcttgtgaggaacctgaagcagaacaagctcattactgtggcttccttcgcaacaagcgctgatgccgccaacaacaaattctacaatctcttgtacgcagaatatgctactttctttgacactgtggtgtttctgagctgggtagggtttactccttctcgcgccaacccagttgcgagcttggaggagaagatccttgccgtggccaacgagtataaggccgtgaaggcctttctggtcgcttacagcaccgttgctgaggattgggctaatttttcgccacctatcttctttatcactctccatggccttctgggtaactctgcggttaagggagcgtccattaaggtcattagtgacgccaccgcctcctttcccgccaagtggatccctgaaattttattgttggctgcctctaaatgaatgaggtatgacatgaagggtgaacacgtatctcagaagtgttatgtgatatgtatgatgtgtgaatcttgaaataatatcttaagggcaagaagttattagttaaaattattagaggtagttttatgaatgggtcataataataaatgctagctatatgtaccactatggaataagattgggtcataataataaagctagcttgctagctatatgtactatacgtaactatggaataagacccatactagtgctataggggcttgctatatgtatgtgtttcatctgcaaattaagagctgagacgcttgccatgcaaggcagacaactattatatatattatgttatgtgtttgaaaaaataatgcatgtgtgtgtcttgtgaataaaatatatttttaagttccaaatgtgcatgttttcatatatttccaatcatggtattcattaaattatggtgtctataactacacttgtggctgcgatcatatcgcaacctttgcaattggtgcattttcccacaatttcttgtaatgttgaagatgggacgaaactgtaattatgactgcaaccacaatctaaatctatttttccaatttaatgtagcta

SEQ ID NO: 540 - DNA, 1281 bp, Glycine max var. Williams 82
atgaatcaactttgtggtgttatccttttggttcactcagtcttgtgtttccatgctagagcacagactgctgcaccttcaggagatgctgtctccaatttccaaccaagccttgctgttgtcataggaatccttggtgtcatgttcttactcacattctttcttctcatgtatgcaaaattctgtcaacgctgcgcttcttcgcccgttggagacacagaaaatcaactcccttttgttagatcaagatctagattctcaggaattgacaagaatgtcatagaatcactccccttcttcagattctcttcactcaaagggtcaaaggaagggctggagtgtgcagtgtgcttatcaaagtttgaagatgttgaaattctcagacttctaccaaagtgcaagcatgcttttcatattgattgcatagaccactggcttgaaaaacactctagctgtcctatttgcaggcacagagtcaaccctgaggaccacacaaccttcacatattcaaacagtttaaggaggctagcaaaccagtcagaggtaggtgaagaatctaacatagagatctttgtccagagagaggaagagcatcatggttcatcaagattcagttttggaagcagctttcggaaaacgggaaagtacgtcaaggaagaagaattcctcattgaaaaaggagcagaagatagtgatggtaatcagaagggatatcacaaacacaaccacaggattactatatctgatgttgtgttcaagcacaggtggagcaacgtgagttcttcagaccttatgtttctgaattcggagatgctgaacgatgcatcaagcaacagattcagcaacttggaatcaaatgctgacatgatgtctagtacaagaggggtggtggaaaatgagcaaattatgaatattaaggaggagatggagaggaagatttcatttgagagcaaagttggtgtactgaacaacatcaaatcagtttcagataagcatcttctttttacatcagattctgcagggaaatcaactcatgcaccaaagtatgcgaatcccggtgagaaaaggtcaatgtcagaaatcactgctgtctctagatttggagatttaggcatgaaaatgagggtcttcaaggattcttcttcccttcaaaacaaccttaaagaggaaagaatgaggcagatttggtttccaattgcaagaagaacagctcaatggtttgtgaatagagaaagaaggtctcaacaatctcagaataaacaacagccattagatgtataa

SEQ ID NO: 541 - DNA, 1850 bp, Glycine max var. Williams 82
ccttaatattttaaatgaagaatcaaattcagacgcaaaacgtagcctgagaagaaaccaagaaaaaactgacataaggaagggttgctacttgggggaggatcaatgaatcattgaataatgaataatgtctccatgcacaccaaccatcccattataaattcctaagttttcaactcatcatcaattagcacttttgctgcagaatgcttgaggagaacaagaaccatgaatcaactttgtggtgttatccttttggttcactcagtcttgtgtttccatgctagagcacagactgctgcaccttcaggagatgctgtctccaatttccaaccaagccttgctgttgtcataggaatccttggtgtcatgttcttactcacattctttcttctcatgtatgcaaaattctgtcaacgctgcgcttcttcgcccgttggagacacagaaaatcaactcccttttgttagatcaagatctagattctcaggaattgacaagaatgtcatagaatcactccccttcttcagattctcttcactcaaagggtcaaaggaagggctggagtgtgcagtgtgcttatcaaagtttgaagatgttgaaattctcagacttctaccaaagtgcaagcatgcttttcatattgattgcatagaccactggcttgaaaaacactctagctgtcctatttgcaggcacagagtcaaccctgaggaccacacaaccttcacatattcaaacagtttaaggaggctagcaaaccagtcagaggtaggtgaagaatctaacatagagatctttgtccagagagaggaagagcatcatggttcatcaagattcagttttggaagcagctttcggaaaacgggaaagtacgtcaaggaagaagaattcctcattgaaaaaggagcagaagatagtgatggtaatcagaagggatatcacaaacacaaccacaggattactatatctgatgttgtgttcaagcacaggtggagcaacgtgagttcttcagaccttatgtttctgaattcggagatgctgaacgatgcatcaagcaacagattcagcaacttggaatcaaatgctgacatgatgtctagtacaagaggggtggtggaaaatgagcaaattatgaatattaaggaggagatggagaggaagatttcatttgagagcaaagttggtgtactgaacaacatcaaatcagtttcagataagcatcttctttttacatcagattctgcagggaaatcaactcatgcaccaaagtatgcgaatcccggtgagaaaaggtcaatgtcagaaatcactgctgtctctagatttggagatttaggcatgaaaatgagggtcttcaaggattcttcttcccttcaaaacaaccttaaagaggaaagaatgaggcagatttggtttccaattgcaagaagaacagctcaatggtttgtgaatagagaaagaaggtctcaacaatctcagaataaacaacagccattagatgtataattcaatccaatccaaccttcctgaggtacacatgtttggtttcagtccttgattaacaactacatgtagattttatgttgtttttttgttgatttgtatttagttaagtaaagcaggtacaggttccttgtttttgtttcaatctctctatttttttaattcttatgatctgcataaaaactttgttaatctttctatgacagagaatttaaggaccccttgtgaccagaataatagaaacccttgtagacttaaaattgtgtcttctttttcatttcctaatcaattttctattgattttcaacaagaataatagaagacagcttcatgcctctgtgctc

SEQ ID NO: 542 - DNA, 1098 bp, Glycine max var. Williams 82
atgctcatagtcatggctgcttcaagctctcttttgaggatggaacaaatacctggcaaaggaagaggtcttgttgcatcacagcctctaaaagcaggtcaaatagtcctcactgaatcccctctcattctctactcagcttctcctctcctcacaccctcttcttcaccttacacttactgtgaccattgtttcagaatcttacctctcactcacaatagtactactgtcacgtgcccttcttgctcaaaccacagtttttgttcccagaagtgcttctcccttgcactcaaatcctcacactccacttgggtatgcaaagcactcatgtctcttcaacaacaccccaattcaacacttcttcaacaacacccccaagaacgccaagtccaagcccgtttaattgttgcttctcacaagctcttccttcacaatcacaccccttctgagctagacacttttctttctcttcatggcaccccagatgatgctattcttgatgctgctaactttcttcactcgctaatctcaccacttttcccacctcaggctcaactctctgtggatctcattgcacaacttcttgcaaaggacagactcaactcctttggcttaatggacccttattcccctgatggccctcagagatctattaaggcttatgctatttaccccaaagccacgttcttcaaccatgactgtgttcccaatgcatgcaggtttgactatgtggacagtactaatgatgattatgaacacaacagtactgacattgttattaggttgattgaggatgttgatgaggggaaagaggtttgcatcagctatttcaggattggtagggactattgtacaaggaaaaggatcttgatggaggattatgggtttacttgtggatgtgataggtgcaagattgaagctaattgggatggtgaagaaaacaacagtgaccttccacacgtgcggtttcttagcaagtatgtttgtgagaggaagaattgtgcgggaactatggctcctctgcctccaaaagatgatgtgccatctaatgttctggaatgtaacttctgtggtaattttaagattgatgctgcttaa

SEQ ID NO: 543 - DNA, 1971 bp, Glycine max var. Williams 82
tttggaatagtaacatatatgttaagtagaatttatatttaaagaaataatacgataaatctatattttatttttagtacaactccataagatccaaggtgaaatcaattttacaagataagatgcaacatggaatcagtttcactagaaatagcctaatttctgcaacgaaacagagcaagaactaaatatgaacacagaagagaccatgagagcttcaacaagacacgtagctccctatctgggaaatgacgtgaccaacttcttcgattaatccaatctttttatacggcatgctaccatcgtattaatggtcgaggacgccttcattgccacctatgttatgcatcctcttcaaactcacactcttcatacataattagatacattggttgcgcgctcttcctcgtttcctttgtctttctctttcggctttttccatcccttcctttctgcatgcagtgtaagtgctgggatgctgtgataaactgtgttagagcaacatcatggaacttttcaacatgtaatgattaagaaggaagatcattcatttaactgattaatggcactgatttccgagctactggctaacacaatactcttggtgatgaggcatttttctctacttagactggcatgcttgtttggtatcagaatcgcattaactgtcatatatacttggacggagttgatcggaacaacaattagcttccatgcaaacataatattaagaattatcacatggacatttgggcttatctccctgcctgcaagagttgtgtatgcctttcaaagggagaggcagctggaacaaaaactacatgaaatgcagatagagttggagaatttagtgtgggataagaaggaactacaagaacattttaaaatggctgtcaaagagcgcaaaatgatggagatgctactagtggagcttgaagaggagcatgatatggccattgaaaaaattgaaaagttagagggaaaggatcagacaaatgaaaatcttcggctgaaagaaattcaaggaaagagatactggagctccaaagatcaaagcaacagcgacagagtccaaaccatcaatgacagcaactacaacatttctcatcctatactctcactgaactccaactacaacgggagtggaatctctcttcaggatcttataatgtgcaaagatatttgggaagatgagagcaaaaccagaagtgagttgcttaaactcttaaaagcagtaccaaagtccgggccagtagttaagtccaaaacgagcgaagcactagactaccatcgagacgtagctctttcacaatctctcttcagtgccattatgtcacttgtggttggagtcactgtgtgggaagctgaggacccttgcacgcctcttgtggtggctctctttgccgtagtaggcatgtccttgaagagtgtggtgcagtttttctccaccattagaaataaacctgcatctgatgctgttgctcttttaagcttcaattggtttattcttggcactctaacctaccctaccttaccaagggttgctcgcatgctggctccactagtgttacgccttatggaccaaaccatgacacctggttcggtctcctttccatagcttgacactgcttttttcttttctgttgtgttatattatgtgctgtataatctgaattttgtgtccttttttactgtggtgtgcgtttcttattgcttgtacaatacgaggaatctctgtaatttagttgtctgtgttgtgatattctgttttttctgtttccagctcacaaacatgaaagggagataggaaatcagtttttgttttcttcaccattttttcagagttcagtgagctattgtttttgttaactttgatcaatgttctgctggattatttaaggatcatgcaggttcgatatgtttacttatatagatatagagatatatacaaagggagagaagaaggaaaaa

SEQ ID NO: 544 - DNA, 828 bp, Glycine max var. Williams 82
atgaaattagacactatcttcgcctttatcgtagtttatattctgctggtaacctcatcagagttccctagtgttgctgcagatgatgttagcagcatcatcagtgcttcccaatttgagcaattgctgaaacacagaaacgatcaaatttgtgaggggaagaacggattctacagctacaatgcttttgtcactgctgccagaacctttgatgggtttggcactacgggtgatgttaacactcgtaagagggaggttgcagctttcctagcccaaacctctcacgagaccacaggaggaggaggatggcctaatgccccagatgggccatatgcttggggttattgctttgtcacagaaagagataaatccaataattattgtgaaattagcaaggcaccatgtgcctcaggcaaatcatactatggtcgaggaccccttcagctgacacacaactacaactatgatctagctggaaaagccatacattcagacttgataaacaatccagacttggtagcccaagacccagtggtatcattccagacagctatatggttttggatgacatcacaagccaataagccctcatgccacgacgtgatcaccaataggtggaccccatcttctgtcgacatggcagctaatagagccccaggttatggtgtgatcaccaacatcatcaacggtaggattgaatgtgggaatggtccttctccagcctcaaatgacaggatcgggttttataaaaagtattgtgagatttttgggctctcagatgctaccaacttggattgcagtagccaaaagtcctttgatcaagattaa

SEQ ID NO: 545 - DNA, 939 bp, Glycine max var. Williams 82
atggcttctaccttttcaccaaaacattctcgtggctatgccattcgatccataagcttgccaactagatcacatccaagcacagttccaattgaagaggagctgaacaagctcaaatcatgggaaacatcatcttcctctgaggtggagagaattttctttggtctttcaggccttgcaaacttgtacaagtgcatggaagatcttttgaagttgccactcacccaacaagcactatctcatcatcacaaccaaaaatgggttgatgagttgctagattgtccagtgagattcttggacatattgggagaaacaagggatgcaatcatgcaaatgaagggaaatgttagaggccttcaatcagcccttagaaggagaaaagttggagacttggtggttgaaagccatgtttcttcatattggattctcagaagaaacacaaggaaacaatgcacaaaatctcttgttttattgaagcacagtactgaagggtcatcatttggggcatctcctcctttggacctcaatcaccacctctcagcagttgtcagggttctaagagaagctagtttgatcaccagctccatctttcagtcacttgtggggtttctttcttcaccaatcttgaggtcaaagattaataataagtggacatttgtgtcaagagtgatgcggaaaggggtgcttcagcttcaatgcaacaatcaagtggagaatgtgaatgaacttgaaaaggtggaccttgcactttgcagaatggtcatggataatgcaaccaaggattttgaggctgagaatattcaatttgcacagaaagagcttgaggctgtggtggtagtcattgaagggcttgaaaatggattggattgcttgtttaagcaccttattaatactcgtgtgtcttttctgaatatagtttctccctcaggtagaatatga

SEQ ID NO: 546 - DNA, 477 bp, Glycine max var. Williams 82
atgatttcttccgtgtcctttccagcgtctcttcccgccgttaacttctccggcaacgccgtggcttctccgtcgtgccgcgtcaaatccaggcctatagttgccttcgccaccgccaccgccaccgcggaagctcgctcttcctggacggagcaaccgagaccttcgtatctgaactcctcttgctcttcgctctacgaggttctcggcatccccgccggcgcctctaaccaagaaatcaaggcggcgtaccggcgactggccagagtcttccaccccgacgtggcggcgattgaccggaaaaactcatccgccgatgagttcatgaagatccacgctgcgtactctactctctcggatcccgacaagcgcgccaactacgatcagaggctcttccggcgacaacggccgttgtcgacggcggcggtgttctccggttatacgcgtcggaactgggaaacggatcagtgttggtag

SEQ ID NO: 547 - DNA, 2861 bp, Glycine max var. Williams 82
tttgtctgtctctcttctcttcacactccaaagtcaaagacttaagtcactctttgagcccttcaggagccaacacaccccattcaattccaatcctcattttcattctgcttttgttgcttccaccgcatcaactaaaaaaattctattttttccggggtaggattttgagatggaccgccggggttggctatggaagaaaagatcatccgataaaaacataaaggttgagaatgagaaaccagtgtctacttctgaatttgttggtcctaccttgttttctgtggcacatgtaggagatcagcaagacagcagcaaaaataagaactatgttcaaataacaatggaatcatacgcacatatgtctggattggaagatcaagttgtaaacttggaggatcaagtaaaagctttggaagaaaagctatctgcagtttattcagaattaaataacaaggatgatctagttaaacagcatgcaaaagttgctgaggaagcaatctcaggttgggagaaagctgatgccgaagttgtttccttaagatgtcaacttgaatctttgtctctctctaagcttactgttgatgagaaagctgctcacctagatgaagccctaaaagagtgcatgaagcagataagaacagtaaaggaagaaagtgaccagaaactgcaggaggtaattcttatgaaatctcatcagtgggagaaaatcaagttagaacttgaagcacaaatagacaatttggatgaaggacttcgtgagttagccaatgaaaatgctgcccttctaaaatcagttcaagaaagttcgaacaaaatagtgaaactaaaagaagagaagtctgaagcagaggcagaggtagagcatctagagaagagtgttcaatcaaaagaaaaagaaataacttcactaaagtatgagctgcacatgatttctaaggagctggatatccgtaatgaagagaagaatatgattatgagatcggcagaagtggcaaacaagcaacacactgaggatgtcaagaacatcaccaagctagaaagtgagtgccaacgacttcgtggtcttttgagaaaaaagttacctgggcctgctgcattggcacaaatgaagttagaagttgagagttcacaccatgtcttcagtgcaacccatctgagaaaaactagttcaaaaactgatagcctgcaagaatccgagtttcttaccaaacagttgaaggtgttggaagaagaaacaaagacattgaaagaagcattggcctcaagtaatgctgaactgcaggcttctagaaacttgtatgctaaaacggttggcaggcttaagtgcttggaagcagagatgcatcaagaaagaaacgcccagaaagcaattttggcaaccaattatggaaactccttcagtagagtttatagctatccaccaaccatcacttctatccctgacaatgggcatgaggattcagaaagtcctgttgagtcaagtgcagcatcaattcctgaccattctgatatcaggaggattggaagtgtaggtaaatttgagaatcataagactgaaactatctcagaactgatggatgactttctggaagtggagaagatggcatgtttatcagacaatggtggtgtacctctttgcatcattagtaaagctaatgatgatgctgaagataaaaaggagactagctgtttatcttcaaataaaaattgttttgatgggacaaaccaaacaatagaacctgaggcagctgaatatgatgagcatatgcaagatcttaaggaaaaaaggatgatgttagaggaaaacatgcagcttctagaagaactgaaagcacaattggtgtcgtctaataaatcatgtagtttagctgagattcagctgaaatgcatgactgagtcttacaagtcacttcaaacacgtgtagaggagttagaagctgaaaataagtatttaaaggaaaagatggatgagctaaagaatgatcttgcagaggaaaaacaaagtcatcatgatgctttggtgaggtacagagaaattaaagagaaaatgcaaagggacaagtgcttggtgtgtgcagcaaattcggtggcaaattctgggaaggataaagagctagcagctgcagagaaaaagctggcagaatgtcaggaaactctgtctatacttggtaggcaattgcaagctatgtgccctcagataggggtaaccatgactcatcatagtaaaaggcttcaaatgaatgaaaagttagccaaaccaacttatggctggtcaaattcttatgggtcatgtaactcaaatgaaattgatcatgctgaggcatgtagcatagtgtctgacattcaaggagtgactgatgagttttcatcgcataactctggtgccacatcatgtctttcagacaccgaaggcaacttttggttaaacacttgagtaactcttaagtaggctcaaaccacccaggttaaactcttactgaatcaaattcccattcttctgccactgttacatggaagaatgctcatggtttgagccacttctttttgtcaggagagtagtcactaacattgttaattctcaagtgtcatcgagagctccccgatgatgttgtacatagactatatagtcaaattttgtggagaatgttgtgtgtaattctcttcagtatgttgattttgggtaaactttggttcttattccagcacttgtattccatgaatctgtgagggttcaccaatctggttataaaacatacagatcctttttgctctttcggcctccatcaaagagacaatgaaactctcacttttatctcgcaattgtgtactgaaattggtaagttgttaacaagttatta

SEQ ID NO: 548 - DNA, 579 bp, Glycine max var. Williams 82
atgaagatggaaattgaggaagttggcaactgcgaagcacttcccctgctttcactcaaccacgtgtccctcttgtgcagatcggtgtgggtgtctatgaggttttatgaggatgtcttggggtttgttcccatcaaacgcccttcttctttcaagttcactggagcctggttttacaattatggtattggaatacacttgatcgagaatcccaacattgatgaatttgatacctgcgtgaatgaagaaaggcctataaatcccaaggacaaccatatctcattccagtgtactgatgttgaacttgttaagaagaggttggaagagagggggatgaggtatgtcacagctgtggtggaggaaggaggaatccaggtggaccaggtgttcttccatgaccctgatggttacatgattgagctctgcaactgtgagaatatcccaatcattcctatttcttcttgctctttcaagcctcgaggtcatagctttaagaaggctgctcccaacaagtgtggattcatggagaatgtgatgatggaaagcttgagcaccgacatgatcaatttctccttttaa

SEQ ID NO: 549 - DNA, 1266 bp, Glycine max var. Williams 82
atggggactctctgcttccctctatttgcgaccatggcaatttgggggctattgttaggagcagaatcaaaaacacatgtcggagatgcagaggttctgaaggagctgaagcaaggtttggagcctggttcggtgaagccaggctcgtgcgtgagctcctgggacttcaccttggacccatgcgacaaccttttcggcgacaagttcacgtgtggcttcagatgcgacgtcgtcgtttcggggctgagtcgagtcacggaactcgccttagaccaagctggttactctggctccctctccttcacttggaaccttccttatctacaaactctcgatctctccaacaactacttctccggtcaaattccatattccttctcaaatctcactcgtctgagccgactcagtctctcgtccaactcgttctccggcgagataccctcttctctcggcacactctccaacctccaagagctttacctcgacaacaacaacctgcgaggaacaatcccacaaagtttcgacaacctggccaaccttaaaagactcgaactccagtcaaacaaactcaacacccgccttccaaacctggggtccctaagaaaccttaaatttctctacctaagcgacaactccgtcactggaacattgccggcttctctccctgtttccttggttcagatttcactcaggaacaacaacttaagcggtgtcttagttggtgaaagtttcaagagcttgacgaggttgcaggtggtggatttcagctccaaccaattgagtagtgctgttccctctgttttcttccagcttccgtcgttgcagcagttgacactgtccttcaacgaattcacgaatctcgaagcgccttataagggaacggaatctcagagcgggcttgtagcggttgatctgagcaacaacaggcttaaggggtttttgccgtcgttcatggcggtgatgccgaagctttcgtcgttatcgttggagaacaacgagttcacggggagaataccgacccagtttggggtgaaaacggtgtttcccgaaaagggggtgtcttcgttcgggaggcttctgttaggtgggaattacttgctgggagggatacctcgacccttgttagcgctgaaacgcgattctgcgaacgtgagtttggttgataactgcttatacaggtgccctcatagtttctttttctgccagggtggccaacagaagtccttggcacagtgtaatagatttagccctgcctccactccttaa

SEQ ID NO: 550 - DNA, 1551 bp, Glycine max var. Williams 82
atggctgtgctgctccttccgccaaacacggagcagacccaggccttactggagagatgttcaaatatgaaagaactgatgcagattcatggccaattgttgaaaaaaggcaccatcaggaaccaattaacagtaagcacgctcttggtttcatacgccagaatagagttggttaacttagcctatactcgtgtggtttttgacagcataagctcacctaatactgtcatatggaacaccatgctcagagcatactcaaatagtaatgacccagaagcagcgcttcttttgtaccatcaaatgcttcacaactcagtacctcacaattcttacactttccctttccttctcaaagcatgttctgctctctcagcctttgaagaaacccagcaaatccacgctcacattatcaaaaggggttttggtttggaggtttatgccacaaactctcttcttcgtgtttatgcaatttcaggcaacatccaatctgcacatgtcctattcaatcagcttcccacgcgagatattgtttcttggaacataatgattgatgggtacataaaatttggaaatctagacatggcctacaagatttttcaagcaatgccggagaagaatgtcatctcttggacaaccatgattgttgggtttgttaggataggcatgcacaaagaagccttgtctcttctacagcaaatgctagttgcaggcatcaaacctgatagtataaccttgagttgctctctttcagcatgtgcaggccttggtgcattggagcaaggcaagtggattcacacctatattgaaaaaaacgaaataaaaatagatccagttttgggttgtgttcttacagacatgtatgttaaatgtggtgaaatggagaaagccctactagtgttcagtaagttggagaagaaatgtgtctgtgcttggacggcaataatcggtggcttagcaatccatggaaagggtagagaagctctagattggtttacccaaatgcagaaagcaggaattaacccaaactcgatcacttttacagcaattctgactgcatgtagtcatgccggactaactgaagaaggaaagtccctgtttgagagcatgagttctgtttataatattaaaccttctatggagcattatggatgcatggtggatcttatgggtcgtgcagggttgttgaaagaagcaagggagttcatagagtccatgcccgtcaagccaaatgcagcaatatggggagcactgctcaatgcttgtcaactgcacaaacattttgagcttggtaaagagattggaaaaattttgatagaattagaccctgatcatagtggccggtatattcatttggcaagcatttatgctgctgctggagaatggaaccaagtggtcagagtgagaagccagatcaaacataggggactgctaaatcatccaggatgcagtagcatcaccctgaatggggttgtccacgagttctttgctggggatggatcccacccacatatccaagagatatatggcatgcctaatcttcttgcaaattga

SEQ ID NO: 551 - DNA, 1473 bp, Glycine max var. Williams 82
atgtctgactcactcttaactttctattctctttcagccattcttgctcttctcccaatcttcatcttcattctcatcaaaagaaagcaaagcaaacccaggctcaaccttcccccaggtaacatgggttggccatttcttggtgaaaccattggctatttgaagccttattctgccaccacaataggggaattcatggagcaacacatagcaaggtatggtacaatttacaagtcaaaactgtttggggagccagcaatagtgtcagcagatgcaggactcaacaggttcattctacaaaacgaagggaaattgttcgagtgcagctatcctagaagcatcggtggaatactaggaaaatggtccatgttggtcttagttggtgacatgcatagagacatgcgggttatatcactcaactttctaagccacgccaggctcagaacacacctcttgaaagaggtggagaagcaatccctcttggttctgaactcttggagccaaaattccatattctcagcccaagatgaagctaagaagttcaccttcaatttaatggctaagcatatcatgagcatggatcctggggatatcgagacagagcaactaaagaaagagtacgtcactttcatgaaaggggtggtttccgcgccattgaatttacctggaactgcataccgaaaggcattgaagtctcggtccattatactaaagttcatagaggggaaaatggaagagagagttagaagaatccaagaggggaatgagagtttggaggaagatgatcttctaaactgggttttgaagcattcgaatctttcaacggagcaaattcttgacttgattctcagcttgctcttcgctggccatgaaacttcgtcggtagccatagctctagccatttatttcttacccggttctcctcaagctatacaacagttaagggaagaacacagagaaattgccagagccaaaaagcaaacaggggaagttgaactcacttgggatgactacaaacgaatggaatttactcattgtgttgtgaacgagacacttaggttgggaaatgttgtgaggtttctccacaggaaggctgtgaaagatgttagctataaaggttatgacattccatgtgggtggaaagtccttccggtgattgcagccgtgcatctggatccttcactttttgaccaacctcaacacttcaatccatggagatggcagaacaatggtagtcgtggtggaagttgttcaagcaagaacacagcaaacaacaactttcttccgttcggaggaggaccacgattatgtgcaggatcagagttagctaagcttgaaatggctgttttcattcaccatctcattctcaactaccattgggaattggctgatacggatcaagcttttgcctacccttttgtcgacttccccaaaggcctacccattagagtccaagcccactctttgctttga

SEQ ID NO: 552 - DNA, 1191 bp, Glycine max var. Williams 82
atgccagaatcgtactgcgtgaaggagagtaaaccctgtgtgggttgggttgagaaatacttggatgattgtctctgcaatttgaaagataaaatctcctttggctttggcttcataagtctcgtatgttggggagtagcagaaattcctcagataataaccaactttcgcgctaagtccagccatggtgtctccttagcctttctcctcacttgggtcgctggcgacatattcaacctccttggttgccatctggagccagccacgttgccaacccagtactacacagctctgctttacacaatcactacgatcgtgttagtacttcaaagtttctattatgactacatctataaatggggcaagcctcttcggaagattaacatcgatgaggctcatgaagaagaagagaaaaaacctttgagacagaaaccaggccgcgactctgggattccaatacaaaatgacggacccaaagaaacgcctcgacgggattactactataggtcagcgagatctttggctgctaatgatactccaccatttggtacctacttgagagctgctaaaagtgtcccttcagccatggaaatgaacaatgattcatcctcagatgatgaggcacctccactctcttctacgaagcctgtaacacagcctagaccaatcccccgttctgtccctgcaagctatggaacttttctagcagcatctatgaacttgccccggcagggtaatgctttgatggagggatacaaaagattcaatggaagaaagctactctcgcaggagcacaacatgcacagtgctttgggtcaatggttaggatggctcatggctgttatctatatgggtggccggcttcctcaaatatggttgaatattaaaagagggagcgtggagggcttaaatccactcatgttcatctttgcattgatcgccaatgccacttacgtgggaagtattcttgtacgaactatcgaatgggaaagtatcagagctaatatgccatggcttttggatgccattgtttgcgtggcattggacctattcgactataaagttggtaaacctcaacagtggcagataattttgcagtatgccaactacagatacgttcggaagaaaacaggaagtgatgatgctgattatggagactacaaagaagccagcaaaacttttgtgtcttga

SEQ ID NO: 553 - DNA, 1564 bp, Glycine max var. Williams 82
acaaattgaatacatattgtggcatctagtttggtaatttcagcaggctagctcttcctttaaaaatagaagcagataaaccctctctccaagtgcaaggaaaacgagagcaattaagaaataatgccagaatcgtactgcgtgaaggagagtaaaccctgtgtgggttgggttgagaaatacttggatgattgtctctgcaatttgaaagataaaatctcctttggctttggcttcataagtctcgtatgttggggagtagcagaaattcctcagataataaccaactttcgcgctaagtccagccatggtgtctccttagcctttctcctcacttgggtcgctggcgacatattcaacctccttggttgccatctggagccagccacgttgccaacccagtactacacagctctgctttacacaatcactacgatcgtgttagtacttcaaagtttctattatgactacatctataaatggggcaagcctcttcggaagattaacatcgatgaggctcatgaagaagaagagaaaaaacctttgagacagaaaccaggccgcgactctgggattccaatacaaaatgacggacccaaagaaacgcctcgacgggattactactataggtcagcgagatctttggctgctaatgatactccaccatttggtacctacttgagagctgctaaaagtgtcccttcagccatggaaatgaacaatgattcatcctcagatgatgaggcacctccactctcttctacgaagcctgtaacacagcctagaccaatcccccgttctgtccctgcaagctatggaacttttctagcagcatctatgaacttgccccggcagggtaatgctttgatggagggatacaaaagattcaatggaagaaagctactctcgcaggagcacaacatgcacagtgctttgggtcaatggttaggatggctcatggctgttatctatatgggtggccggcttcctcaaatatggttgaatattaaaagagggagcgtggagggcttaaatccactcatgttcatctttgcattgatcgccaatgccacttacgtgggaagtattcttgtacgaactatcgaatgggaaagtatcagagctaatatgccatggcttttggatgccattgtttgcgtggcattggacctattcgactataaagttggtaaacctcaacagtggcagataattttgcagtatgccaactacagatacgttcggaagaaaacaggaagtgatgatgctgattatggagactacaaagaagccagcaaaacttttgtgtcttgatttgtgggactgtagccgacacatgtaggtcttccccattatgaaccaatattatacttcaattccaccatgacattcagctattagtaaaggtctggctagaaaaatgaggtggactagttaggaaacgcttctatatattagcgtcttaaaatgtgctatacgattaccagctatcaatgtaatcaagtttatgaattatgaatcgttcacggttcttacaccagctatatatcaaagttataaagtt

SEQ ID NO: 554 - DNA, 2145 bp, Glycine max var. Williams 82
acaaattgaatacatattgtggcatctagtttggtaatttcagcaggctagctcttcctttaaaaatagaagcagataaaccctctctccaagtgcaaggaaaacgagagcaattaagaaataatgccagaatcgtactgcgtgaaggagagtaaaccctgtgtgggttgggttgagaaatacttggatgattgtctctgcaatttgaaagataaaatctcctttggctttggcttcataagtctcgtatgttggggagtagcagaaattcctcagataataaccaactttcgcgctaagtccagccatggtgtctccttagcctttctcctcacttgggtcgctggcgacatattcaacctccttggttgccatctggagccagccacgttgccaacccagtactacacagctctgctttacacaatcactacgatcgtgttagtacttcaaagtttctattatgactacatctataaatggggcaagcctcttcggaagattaacatcgatgaggctcatgaagaagaagagaaaaaacctttgagacagaaaccaggccgcgactctgggattccaatacaaaatgacggacccaaagaaacgcctcgacgggattactactataggtcagcgagatctttggctgctaatgatactccaccatttggtacctacttgagagctgctaaaagtgtcccttcagccatggaaatgaacaatgattcatcctcagatgatgaggcacctccactctcttctacgaagcctgtaacacagcctagaccaatcccccgttctgtccctgcaagctatggaacttttctagcagcatctatgaacttgccccggcagggtaatgctttgatggagggatacaaaagattcaatggaagaaagctactctcgcaggagcacaacatgcacagtgctttgggtcaatggttaggatggctcatggctgttatctatatgggtggccggcttcctcaaatatggttgaatattaaaagagggagcgtggagggcttaaatccactcatgttcatctttgcattgatcgccaatgccacttacgtgggaagtattcttgtacgaactatcgaatgggaaagtatcagagctaatatgccatggcttttggatgccattgtttgcgtggcattggacctattcataattttgcagtatgccaactacagatacgttcggaagaaaacaggaagtgatgatgctgattatggagactacaaagaagccagcaaaacttttgtgtcttgatttgtgggactgtagccgacacataatgaaaaattgaaaaccttccacttcatgttgctgtaagaccgatgggattgatgattttgtattaactcatgtaagaacaaagtgatagctcgactggccaggaggcaagaggtgccaaggcctaaggtaaggcttcagtgtggcttgatgtgatcatagattacaggtgtatatgtctggatacatctttacttatgcacacatccaaagggatatcaaacgggtcaacccgatccaactcatttttatctgttaaaaatgagttgggttgagttaaactctgattaagtctcactttctaccatgactgaatcctgaatgtagaaagacctctacaacttatgtaaaagggtcatttatagttgtgtcacttttttgtgtgcgtgtgtgagagagagactttctcaaattttacttttatgattcatagcatatctgaagttcagatgttgcttcgtgtaatgcaattacaatgggacgtaacaagaagtaacaatgaagggagattgctttgggtacccaacatttttgctgggacacccagcaacctaggtgaaagggctaaaatgtccttcacctatttaatataaataggaacaatgactcgtccgtatgagtcattgcctctctcgtgcgcgccgcttcttcttcgtcctctgcttattcttttcttcttcctctctacttctttgtttcttcttgttcctccgcttcacgcacattggtgcttcttctcacactttctcacacatgttgctacttcctctggttcttcttcttcttcgtgcttatttttgtcacgcactttgcttgattcattgttttggttgattgaat

SEQ ID NO: 555 - DNA, 1544 bp, Glycine max var. Williams 82
acaaattgaatacatattgtggcatctagtttggtaatttcagcaggctagctcttcctttaaaaatagaagcagataaaccctctctccaagtgcaaggaaaacgagagcaattaagaaataatgccagaatcgtactgcgtgaaggagagtaaaccctgtgtgggttgggttgagaaatacttggatgattgtctctgcaatttgaaagataaaatctcctttggctttggcttcataagtctcgtatgttggggagtagcagaaattcctcagataataaccaactttcgcgctaagtccagccatggtgtctccttagcctttctcctcacttgggtcgctggcgacatattcaacctccttggttgccatctggagccagccacgttgccaacccagtactacacagctctgctttacacaatcactacgatcgtgttagtacttcaaagtttctattatgactacatctataaatggggcaagcctcttcggaagattaacatcgatgaggctcatgaagaagaagagaaaaaacctttgagacagaaaccaggccgcgactctgggattccaatacaaaatgacggacccaaagaaacgcctcgacgggattactactataggtcagcgagatctttggctgctaatgatactccaccatttggtacctacttgagagctgctaaaagtgtcccttcagccatggaaatgaacaatgattcatcctcagatgatgaggcacctccactctcttctacgaagcctgtaacacagcctagaccaatcccccgttctgtccctgcaagctatggaacttttctagcagcatctatgaacttgccccggcagggtaatgctttgatggagggatacaaaagattcaatggaagaaagctactctcgcaggagcacaacatgcacagtgctttgggtcaatggttaggatggctcatggctgttatctatatgggtggccggcttcctcaaatatggttgaatattaaaagagggagcgtggagggcttaaatccactcatgttcatctttgcattgatcgccaatgccacttacgtgggaagtattcttgtacgaactatcgaatgggaaagtatcagagctaatatgccatggcttttggatgccattgtttgcgtggcattggacctattcataattttgcagtatgccaactacagatacgttcggaagaaaacaggaagtgatgatgctgattatggagactacaaagaagccagcaaaacttttgtgtcttgatttgtgggactgtagccgacacatgtaggtcttccccattatgaaccaatattatacttcaattccaccatgacattcagctattagtaaaggtctggctagaaaaatgaggtggactagttaggaaacgcttctatatattagcgtcttaaaatgtgctatacgattaccagctatcaatgtaatcaagtttatgaattatgaatcgttcacggttcttacaccagctatatatcaaagttataaagtttatgaattatcaa

SEQ ID NO: 556 - DNA, 1521 bp, Glycine max var. Williams 82
atggaagctcaagcgtcgttcttgtttattagcttgtttttctctctggtgttgcatttgcttgcaaagcattattacaagccaaaaaccaccctttctcacaaactacccccgggaccaaagaagctacctctgatagggaacctgcatcaactagcaatggctggttcacttccacatcgtactctccgagaccttgcccttaaatacggacctctcatgcatctccaacttggtgaaatttcttccgtggttgtatcctcccccaacatggccaaggagataatgaaaacccatgatcttgcttttgtgcagaggccacaatttcttcctgctcaaattttgacctatgggcaaaatgatattgtttttgctccatatggggattattggagacaaatgaagaaaatatgtgtctcggagcttctaagtgccaagagagttcagtctttctctcatattagagaagacgagacatccaaatttatagaatcaattcgaatatcagaaggttcaccaatcaatcttactagtaaaatttactccttggtaagttcttctgtttccagggtagcatttggcgacaaatctaaggaccaggaagagtttttgtgtgtgcttgaaaaaatgatattagcggggggaggatttgaacctgacgatttgtttccttcgatgaaacttcatctcataaatggaaggaaggccaaattggagaagatgcatgagcaggttgacaagatcgcagacaacattctcagagagcatcaagaaaagcgccaaagggcactacgagaaggcaaggttgacctagaggaggaggatcttgttgatgttcttttgagaatccaacaaagtgacaacctcgagatcaaaattagtaccacaaacatcaaagctgttatattggacgtatttactgctggaacggatacttcagcatcaacacttgaatgggctatggcagaaatgatgagaaacccaagagtgagggagaaagcacaggctgaagtaagacaagcatttagggaattgaaaataatccatgaaacagatgtagggaaacttacatacttaaagttggtgatcaaagagacattaaggttacacgctccttctcctttattggtccctagagaatgctctgaactaaccatcattgatggatatgaaatacctgtcaagactaaagtcatgataaacgtgtgggcaattggaagagatccccaatattggactgatgctgagaggtttgtcccagagagattcgatggtagttctatcgatttcaaagggaataactttgagtatcttccttttggggcaggaaggagaatgtgcccaggaatgacatttggtttagccaacattatgcttccactcgctctattactctatcacttcaattgggaacttccaaatgagatgaaacctgaggatatggatatgtctgaaaactttggattgacagttacaaggaaaagcgagttgtgtttgattcccattgttaatgatctttga

SEQ ID NO: 557 - DNA, 1893 bp, Glycine max var. Williams 82
atggcggttgaaggcgtaggagaaaatagaatgctgagactgaaatttactccaaggcacaaacgttcaaagagttttcctgataagaaaagaattgaggaggataaaccagataatcgcattcaggcctcaggtcgaattaaggacatgggatacctcgcggaatgtgataaagctaggaaaaaccgaagccctacaaatgaagtccacagtactccgaagcaagagattctacagcttgagagaagattacaagaccaatttcaggtcagatccacgttagaaaaggcacttggattcagatcttcatctctcgttaattcaaatgagatgatgatacccaagccagccacagaattaattagggaaattgcagtgttagagttggaagttgtgtatttggagcaacaccttctctccttgtaccgtaaagcttttgatcaacaattatcttctgtatctccgacttctaaggaggaaagtgtaaagttccctctaacaacacatagcgcacgattcatcaatttttctatgcctgaggtcttaaccaagagagaatgttctacagtacaatctaatgagcataataagcttgagactttgagaaaggagtatgacagatatgagcctgagacttttaggaaagaacagagtagagatctgctagaagaaaagcatttagattctggagtttaccgttgtcattcctctttatcccattgtccagcatttacaagagaatctcctccagcagattctttagctaaatctctgcgtgcctgtcattcccagccgttgtccatgttagagtatgctcaaagctcctcatcaaacataatcagtctcgccgaacatcttggtacacgaatatctgatcatgttccagtggcacctaataaactttctgaggatatggtcaaatgcatatcagctatatattgcaagcttgcagaccctcctatggcacaaccaggactttcatctccaagttcatccttgtcctcggcaagtgccttttccattggagatcaaggtgaaatgtggagtccaaggttcaggaataattcctcttttgaagtgcgcttagataatcctttccacgtggaaggacttaaggagtttagtgggccatatagcaccatggttgaagtatcatggctttatagagagagtcagaagtcggctgatactgagaagctgctccagaatttcaggtcacttatttgtcgattagaagaagtagaccccggcaggttgaaacacgaggagaagatagctttttggatcaacatacacaatgctttagtgatgcatgcatttttggcttatgggattccacaaaacaatgtgaaaagagtctttcttctattgaaggctgcatataatgttgggggtcatacaattagtgcagacacaatacagaatacaatactaaagtgccggatgtctcgcccgggacagtggctgcgcttgttattttctcaaaggtcaaaattcaaagctggagatagacgacaagcctatgcactggagcaagctgaacctctttcacactttgcactctgttcaggaaaccattctgatcctgcggtacgtgtatatacaccaaagagggtgtttcaagagctagaagttgcaaaggacgaatacattcgagctaacttaggcgtacgcaaggaccaaaaaatactcttaccaaagcttgttgagtcattcagcaaggactcaggtttgtgccccattggtgtcatggatatgatcctagaatctctacccgaatacctgagaaagaatgttaagaaatgtcggcttgcaaaatcccggaagtgcatagaatggattccacacaactttacttttcgatacctcatatctaaggatatggtaaaatga

SEQ ID NO: 558 - DNA, 990 bp, Glycine max var. Williams 82
atggcagcctcactacaagctgcagctaccttcatgcaacccaccaaggtgggcatggccactcgcaacctcaaatctacacaatgcatttctaaggcttttggcttggaacccgctgcagctaaactcatttgctcccttaagcccgatctcaaagattttgctcaaaaatgtgtcgacgccaccaaaattgcaggattcgcccttgccacctcagctctcgttgtttctggagcgagtgcagaaggtgttccaaagaggctaaccttcgacgaaatccagagcaagacatacttggaagtgaagggaactggaactgctaatcagtgcccaaccattgaaggtggagtggactcatttgccttcaaggcagggaaatacaaggcccagaagttgtgcctggaaccaacttccttcacggtgaaggcagagggtgtggccaagaatgccccgctcgaatttcagaacaccaagctcatgactcgtctgacctacaccctggacgagatcgagggtcccttcgaggtttcatccgatggaacggtgaaattcgaggagaaagacggaattgactatgctgctgtcactgtacagcttccagggggagagcgtgtgccattcctcttcaccattaagcagttggtggcatctgggaaaccagacagcttcagtggggagttcctagtgccgtcttaccgtggttcctctttcttggaccccaagggaaggggtgcctcaactggttatgacaatgctgttgctttgcctgctggtggaagaggagatgaagaggaacttgccaaggagaacaataaaagtgcttcatcttccaaagggaaaatcaccttgagtgtcaccaagtccaagcctgagactggtgaggttattggggtgttcgagagtgttcagccttctgatactgatttgggggctaaagctcctaaggatgttaagattcaaggcatctggtatgctcagcttgactcatag

SEQ ID NO: 559 - DNA, 1125 bp, Glycine max var. Williams 82
atggcagcgaaatatcataacacatttgcccttttgcttttgcttgtgaatctgagatttcatggaaatgttgcggctcagaatgctaagttagcagcttctttcatctttggggactcgttggttgatgcaggaaacaacaactatctctcaactctttccaaggcagacgttccccctaatggaattgatttcaaggcctctggaggaaatcccacaggacgtttcaccaatggaagaaccattagtgatattgttggagaggaattaggacaagcaaattatgctgtcccatatttggcaccaaacacatctgggaaaaccatactcaatggagtgaattatgcttcaggaggaggagggattctcaatgcaacaggaagcttatttgtgaataggctcggaatggatattcaaattaattacttcaacataacaagaaaacagattgacaagttgctaggcaaatcggaggcgagagagtacataatgaagaaatccttgttctccatcattgttgggtccaatgattttttaaacaattatcttcttccttttgtttcctctggagttagagcttcgcagaatccagatgctttcgtcgatgacatgatcaattatttcaggatccaactttacagactttaccaactggatgctcggaagtttgtgatcagcaacgttggcccagtagggtgcataccttaccagaggattataaatgagctgaacgatgaagattgtgtggatttggctaacgagcttgcaacccaatacaattcccgattgaaagatttggttgctgagctaaatgacaacctccctggagccacctttgtcctcgcaaatgtgtatgatttagtgtcggaactgatcgtaaattatcataaatatggattcacaacagcaagcagaggttgctgtggaattggaagtgggggtcaggttgcagggataatcccttgtgtgccaacatctagcttgtgctcagataggaacaagcatgtgttctgggatcaataccatccaagtgaggcagccaacataatacttgccaagcagcttattaatggagacaagagatacatatctccaatgaatcttagacaacttatagatctttga

SEQ ID NO: 560 - DNA, 1383 bp, Glycine max var. Williams 82
atgacagggtcatcgagaaaaggacgcgggtacatggatgaaggaagtatccatggaagaaagtacggaaagttaaagaaagacgagttcgatggttacaactccgatagccatccaagaaaaaacaaccccatcacattggacgcgcctcatttggatcctcaaatggaagcagacaacgctccctacgacccttccctctctcccttatccaaatctccatggtcctctcacacgaacgatgacgctttttccggctctaacgaaaatgacgctctcgtgggctcccttgtccgcgaagagggtcacatttattccctcgctgcaaccaaggacttgttatacacgggttccgacagcaagaacatccgcgtgtggaagaaccagaaggagttcgcggggttcaaatccaacagcggcttggtgaaagccattgtaattgccggagagaaaatcctcacaggacaccaagacggaaggatcagggtttggaaagtgtcggggaaaaacgagcaacaacacaagcgcgtggcgacgctgccaacgctgagaaactacatcaaatgttccatgaaaccgagcaactacgtggaagtgagacggcaccgtaacgtaatatggatcaaacactacgacgctatttcctgcctcagtttaacggaggatcattctctcatatactccgcctcgtgggacaagacttttaaggtttggcgaacatcgaatttcaagtgtttggagtccgttaaggcgcacgacgacgccgttaacgcgcttgttgtggggttgaatggtatggttttcacggggtccgctgacggcaccgttaagatttggcggcgcgaggttcaggggaaggggacgaagcattttttttcgcagacgctgttgaagcaggagtgtgcggtgacgtcgctagcgataaatgaagaggggaatgttctatacgcgggttcctctgaagggttggtgaattattgggttcatgaaacgaatttggagcataaaggggttttgaggggacacaagttggcggtgctgtgcttggctgcggcggggagtttggtgttcagcgggtctgcggacatggcgatatgcgtgtggaagaggacgctgagtgaggagcacacgtgcgtgaaaattctgtcggggcacactgggcctgttaagtgtttggcggcggagaaggaccctgaagcgatgtgtaacgagagaaggtggattttgtatagtgggagtttggataagtcggtgaaggtgtggaaagtgtcggagaatattaatgcgggtgcgcagaacaacaaccaccagccaccgaggcttagtgttgatcagttccccagagtgtcttccttaaggaaaatggggtcaaggagatactag

SEQ ID NO: 561 - DNA, 2085 bp, Glycine max var. Williams 82
atgtttattcttcgtcaccatacaaatctcgctatagtcctcacaatcttcatagcttgcacaacaagagcacaaaacctcaccacctgcaatggcaaatgcggggagcacacccttcagttcccttttggcttctcccaaggttgtccaatccagcttgactgttccaacgaccaagtccaacttcgcagcgaattcggtgaatttctggtccaaaacgtaacaaacagcaacatattcgtaaatctccctgcaaaatgcaaccgtaccatggaatcaattcagccaatttttactgagaattttgccccaacgattaacaatagctttctggtgcaagattgtagagaggtgtttggtgggtgtgttattcctgctagttttgtgagcaaccaaattgatgttgagaactgcagcaacaaaagtgctaatatcagttgcttttcgaaacaagatgaagtttttgtgacgtacgctgatttgaacgggactaagtgtaagtacttgttctctgcggtttcttttgggcagagcaaggagattccgctgcagtttcaggttgttgagttggggtggtggcttcctgggcagtgcgatgatcatcaatgttctaacaacgctacctgcacaacggtcgacagggttgggttccggtgccagtgtatcgaaggtttcaccggagacggcttcaaaaacggcatcggttgccggaaagcttcggcttcaagttgcagtgcttcaacactaacgtccggtggatgtgggaaagcaactaaaatcggtgttgttgttggagtaatcaccactggagctttggtggtggctggtctgtttcttctatgctactgtgccaggcggcgttctacttggttgagaaaacataccatggtaaagcgccaattacgcgaagctgcaggcaactctagtgtacctttctatccctacaaagaaatagaaaaggcgacaaattttttctctgagaaacacaggcttggaactggggcatttggtacagtttatgctggaaaactgcacaatgatgagtgggttgctataaagaagttaaggcaaagagacaccaacagtgctgatcaagtcatgaatgaaatcaggctactttcttcagtgagtcacccgaatttagttcgcctcttaggttgctgcatagagaagggagagcatatccttgtttatgagtttatgcaaaatggaacactttctcagcacttgcaaagagagaggagtaaaggactaccgtggacaataagacttaccattgctaccgaaactgctaatgctatagcatatctccattctgcaattcatcccccaatttaccacagagacataaaatctactaatatactcttggattatggcttcaaatctaaaatagccgattttgggctttctaggcttgcattgacagaaacatctcatatctcaaccgccccacaagggactccaggttatgtcgatccccaataccaccagaactttcagctttctgataaaagtgatgtctacagttttggagtggttttggtagagataataactgccatgaaagtggttgattttgctcgacctcgaagtgagattaatttagctgcacttgctgttgataggattaggagaggtgctgtagatgagatcatagaccccttccttgaaccacatagagatgcttggacactgtattctattcataaagtggccgagcttgcatttagatgccttgcttttcatagtgacatgaggcctactatgatggaagtagcagaagagctagaacacattagacgcagtggatgggcatctatggaggaaactctcacggcttcaccgattgggtccactagttcatcacctcgtcatggaagtgagaagtcactgggtggtatcaaaaaagctcggcaaggccaagggagtgagagattgattgttccgcagaagacggagagctttttgcaatctatggaggtgaaggacagctcccctgtatcagtgcatgatccaattccttggtcaagtggacacagctcaccttcatcaaacagcttgttgggaaatgtcatcccttga

SEQ ID NO: 562 - DNA, 510 bp, Glycine max var. Williams 82
atggtttgtgcaatctcgtcatcaccgttctcaactctctcgtttcggcgtctcgtcgtacgcaatgcgacgccgtctccgtgcaagccgcgtgccgttaaacccttaacggcacttccgagcgcggggcggaggcagttgctgttttttctgacggcgacgacggcgttgacggcgagggaagcggcgtccgtggcgcaggacattcccttgttcgggatacggaagagtctgaagaaggtggaggaggaagcggaggagattgtgagagagggatttgaggctgcggataagggattggtggcggcggagaaggggctggagacggcggagaaggggttggtggcggcggagaaggggatagaggaagcggagagggagatagaggagacggtgagttttggggggttggcgcaggcgggagcggtggcgggagcggaggtttttgggattttggttgcaacggcggtggtgaacggtattttgggtcctgaagctcaaaaatcgtga

SEQ ID NO: 563 - DNA, 1785 bp, Glycine max var. Williams 82
atgaagccacctttaaatgatgacaaagacaagatggaaactcgagggagcaaggcaatggtggctgcagagaaaaccgtgaaaaatgggcgtcgatccaatagagaaaggaaaatagccttgacacaagatgttgataagttgaagaggaagctcagacatgaagagaatgttcacagagcgttagaaagagcattgacaagacctttgggatcccttcctcgtcttcctccttatcttcctcctcatacattagagcttgtggctgaagtggcagtattggaggaggaggtggttagactagaagagaaggttgtgaatttcagacaaggtctatatcaggaagctgtctacatttcctctaagaggaatgcagaaaatttgagggactcaatggaccagaactccatcaggagctccaaacatcaaagatcaaagtctttgtcccaaagtgagctcaattcaactaccatggctaggcctcaaatttctcttgctagaagtgcttccagtagaaggctgttctctgacattttcactgatcactctggcaagctagtgaacgggaaactattgcacataaatcaagattcactatcatcaatcccagaagagggacggcgaaaagagaatccactgttttatagctctctgaaggataagcaatctccagagaagaaaacggccaaagtcattgctccagtgaagaagtctccaatcaaaaaagaatcagctgataagtgtgtagatcacttgaagttacagatggaggggagattagtagatcaagaaacagctgagagttcttcaagttcattacatgataaggtgtcagaagttgatagcacacccaaccgaatttcggaggatattgtcaagtgcttgtgtagaatatttgtgagagtaggcacattcaaggaaaaattaggggaatcaaaaacacctctcagttctacatctgtatgcagcaaggaaaaggatcagttgtgtgatccatatggtatctgttcagaatctaaaatgagggatattggtacatacaatagtttgtgtgagatcaaagcctccaatgttgacctcaatcgaacaagatatgtagtttttctgatccgtaggttaaagtttctactcgggaaacttgcctccgtgagcatgaaggatcttactcatcaagagaaacttgcattttggataaacacttataattcctgcatgcttaatgcatatttagagcacggcatacccgagagtcctgaaatgattgtagcactaatgcagaaggcaacaatagaagtgggggggcagctgctcaatgcaattacaatagagcacttcatcttgagacttccttatcacctgatgtttacctgcccaaaagctgcaaaacacggcgagatgaaattgcgaagcatatttggcttggaatggtcagagcccttggttacatttgcactttcctgtggaagctggtcttcacctgcggttaggatatacacagcatcacaagttgacaatgagttggaagcagcaaagagggattatttacaggcaacagttggcattacaaaaacaaacaagttaataattccaaagttactagattggtatttacttgactttgcaaaggacttggaaactttgttggattgggtttgcctccaactacccattgaactgagaaaggaagcaattgaatgccttgaaagaagggaaagacagcccctttcacagctggtacaaatgatgccctatgacttcagttttaggttgcttttacaccaataa

SEQ ID NO: 564 - DNA, 2370 bp, Glycine max var. Williams 82
tcttactttgttctcactctgttcgatatttttttaatgttatgcaaacaaaaaaccgtgttgtcttcttcttcttcttcttcttttattttaaacgcagaagccggcatttgtgttcccgtgtcttccctgctttctcagttttttctatgtgactctgtttccatagtccgtgttttctatcattgcttattacccttttgcagatttactttatcaatgtcataaaacttttacatgtttcatcttttttttgcagtactagattgcattgttttctttctcgttttccgggaaagtgatcacatagtaggtgaataccagagctcacaccactcttcaggcaatgaagccacctttaaatgatgacaaagacaagatggaaactcgagggagcaaggcaatggtggctgcagagaaaaccgtgaaaaatgggcgtcgatccaatagagaaaggaaaatagccttgacacaagatgttgataagttgaagaggaagctcagacatgaagagaatgttcacagagcgttagaaagagcattgacaagacctttgggatcccttcctcgtcttcctccttatcttcctcctcatacattagagcttgtggctgaagtggcagtattggaggaggaggtggttagactagaagagaaggttgtgaatttcagacaaggtctatatcaggaagctgtctacatttcctctaagaggaatgcagaaaatttgagggactcaatggaccagaactccatcaggagctccaaacatcaaagatcaaagtctttgtcccaaagtgagctcaattcaactaccatggctaggcctcaaatttctcttgctagaagtgcttccagtagaaggctgttctctgacattttcactgatcactctggcaagctagtgaacgggaaactattgcacataaatcaagattcactatcatcaatcccagaagagggacggcgaaaagagaatccactgttttatagctctctgaaggataagcaatctccagagaagaaaacggccaaagtcattgctccagtgaagaagtctccaatcaaaaaagaatcagctgataagtgtgtagatcacttgaagttacagatggaggggagattagtagatcaagaaacagctgagagttcttcaagttcattacatgataaggtgtcagaagttgatagcacacccaaccgaatttcggaggatattgtcaagtgcttgtgtagaatatttgtgagagtaggcacattcaaggaaaaattaggggaatcaaaaacacctctcagttctacatctgtatgcagcaaggaaaaggatcagttgtgtgatccatatggtatctgttcagaatctaaaatgagggatattggtacatacaatagtttgtgtgagatcaaagcctccaatgttgacctcaatcgaacaagatatgtagtttttctgatccgtaggttaaagtttctactcgggaaacttgcctccgtgagcatgaaggatcttactcatcaagagaaacttgcattttggataaacacttataattcctgcatgcttaatgcatatttagagcacggcatacccgagagtcctgaaatgattgtagcactaatgcagaaggcaacaatagaagtgggggggcagctgctcaatgcaattacaatagagcacttcatcttgagacttccttatcacctgatgtttacctgcccaaaagctgcaaaacacggcgagatgaaattgcgaagcatatttggcttggaatggtcagagcccttggttacatttgcactttcctgtggaagctggtcttcacctgcggttaggatatacacagcatcacaagttgacaatgagttggaagcagcaaagagggattatttacaggcaacagttggcattacaaaaacaaacaagttaataattccaaagttactagattggtatttacttgactttgcaaaggacttggaaactttgttggattgggtttgcctccaactacccattgaactgagaaaggaagcaattgaatgccttgaaagaagggaaagacagcccctttcacagctggtacaaatgatgccctatgacttcagttttaggttgcttttacaccaataaacttagagagtggtactgttcaccactaccatttcagtcagcacagatttctgaattttgatgtggtggatttttgtatatgggatagttcacacataaagtatattatcaaaataatgtgatgcattcatttggtaaagggttttggcctttttggacactgtaattgggtacgtagaaaggcttttgtagaaaataatacatacatagaaatggcggtttcttataagcaaactcgt

SEQ ID NO: 565 - DNA, 2414 bp, Glycine max var. Williams 82
tcttactttgttctcactctgttcgatatttttttaatgttatgcaaacaaaaaaccgtgttgtcttcttcttcttcttcttcttttattttaaacgcagaagccggcatttgtgttcccgtgtcttccctgctttctcagttttttctatgtgactctgtttccatagtccgtgttttctatcattgcttattacccttttgcagatttactttatcaatgtcataaaacttttacatgtttcatcttttttttgcagtactagattgcattgttttctttctcgttttccgggaaagtgatcacatagtaggtgaataccagagctcacaccactcttcaggcaatgaagccacctttaaatgatgacaaagacaagatggaaactcgagggagcaaggcaatggtggctgcagagaaaaccgtgaaaaatgggcgtcgatccaatagagaaaggaaaatagccttgacacaagatgttgataagttgaagaggaagctcagacatgaagagaatgttcacagagcgttagaaagagcattgacaagacctttgggatcccttcctcgtcttcctccttatcttcctcctcatacattagagcttgtggctgaagtggcagtattggaggaggaggtggttagactagaagagaaggttgtgaatttcagacaaggtctatatcaggaagctgtctacatttcctctaagaggaatgcagaaaatttgagggactcaatggaccagaactccatcaggagctccaaacatcaaagatcaaagtctttgtcccaaagtgagctcaattcaactaccatggctaggcctcaaatttctcttgctagaagtgcttccagtagaaggctgttctctgacattttcactgatcactctggcaagctagtgaacgggaaactattgcacataaatcaagattcactatcatcaatcccagaagagggacggcgaaaagagaatccactgttttatagctctctgaaggataagcaatctccagagaagaaaacggccaaagtcattgctccagtgaagaagtctccaatcaaaaaagaatcagctgataagtgtgtagatcacttgaagttacagatggaggggagattagtagatcaagaaacagctgagagttcttcaagttcattacatgataaggtgtcagaagttgatagcacacccaaccgaatttcggaggatattgtcaagtgcttgtgtagaatatttgtgagagtaggcacattcaaggaaaaattaggggaatcaaaaacacctctcagttctacatctgtatgcagcaaggaaaaggatcagttgtgtgatccatatggtatctgttcagaatctaaaatgagggatattggtacatacaatagtttgtgtgagatcaaagcctccaatgttgacctcaatcgaacaagatatgtagtttttctgatccgtaggttaaagtttctactcgggaaacttgcctccgtgagcatgaaggatcttactcatcaagagaaacttgcattttggataaacacttataattcctgcatgcttaatgcatatttagagcacggcatacccgagagtcctgaaatgattgtagcactaatgcagaaggcaacaatagaagtgggggggcagctgctcaatgcaattacaatagagcacttcatcttgagacttccttatcacctgatgtttattacaattcatcccttgattttcatctttccttactgcgacagacctgcccaaaagctgcaaaacacggcgagatgaaattgcgaagcatatttggcttggaatggtcagagcccttggttacatttgcactttcctgtggaagctggtcttcacctgcggttaggatatacacagcatcacaagttgacaatgagttggaagcagcaaagagggattatttacaggcaacagttggcattacaaaaacaaacaagttaataattccaaagttactagattggtatttacttgactttgcaaaggacttggaaactttgttggattgggtttgcctccaactacccattgaactgagaaaggaagcaattgaatgccttgaaagaagggaaagacagcccctttcacagctggtacaaatgatgccctatgacttcagttttaggttgcttttacaccaataaacttagagagtggtactgttcaccactaccatttcagtcagcacagatttctgaattttgatgtggtggatttttgtatatgggatagttcacacataaagtatattatcaaaataatgtgatgcattcatttggtaaagggttttggcctttttggacactgtaattgggtacgtagaaaggcttttgtagaaaataatacatacatagaaatggcggtttcttataagcaaactcgt

SEQ ID NO: 566 - DNA, 1719 bp, Glycine max var. Williams 82
attattcttatggatcatgcaattgctttctgtatgaagaagaggtgtaagctttttatccaaaactgaaactgggttctttcacttctcatgagaaaaacgacaagatggaaactcgagggagcaaggcaatggtggctgcagagaaaaccgtgaaaaatgggcgtcgatccaatagagaaaggaaaatagccttgacacaagatgttgataagttgaagaggaagctcagacatgaagagaatgttcacagagcgttagaaagagcattgacaagacctttgggatcccttcctcgtcttcctccttatcttcctcctcatacattagagcttgtggctgaagtggcagtattggaggaggaggtggttagactagaagagaaggttgtgaatttcagacaaggtctatatcaggaagctgtctacatttcctctaagaggaatgcagaaaatttgagggactcaatggaccagaactccatcaggagctccaaacatcaaagatcaaagtctttgtcccaaagtgagctcaattcaactaccatggctaggcctcaaatttctcttgctagaagtgcttccagtagaaggctgttctctgacattttcactgatcactctggcaagctagtgaacgggaaactattgcacataaatcaagattcactatcatcaatcccagaagagggacggcgaaaagagaatccactgttttatagctctctgaaggataagcaatctccagagaagaaaacggccaaagtcattgctccagtgaagaagtctccaatcaaaaaagaatcagctgataagtgtgtagatcacttgaagttacagatggaggggagattagtagatcaagaaacagctgagagttcttcaagttcattacatgataaggtgtcagaagttgatagcacacccaaccgaatttcggaggatattgtcaagtgcttgtgtagaatatttgtgagagtaggcacattcaaggaaaaattaggggaatcaaaaacacctctcagttctacatctgtatgcagcaaggaaaaggatcagttgtgtgatccatatggtatctgttcagaatctaaaatgagggatattggtacatacaatagtttgtgtgagatcaaagcctccaatgttgacctcaatcgaacaagatatgtagtttttctgatccgtaggttaaagtttctactcgggaaacttgcctccgtgagcatgaaggatcttactcatcaagagaaacttgcattttggataaacacttataattcctgcatgcttaatgcatatttagagcacggcatacccgagagtcctgaaatgattgtagcactaatgcagaaggcaacaatagaagtgggggggcagctgctcaatgcaattacaatagagcacttcatcttgagacttccttatcacctgatgtttacctgcccaaaagctgcaaaacacggcgagatgaaattgcgaagcatatttggcttggaatggtcagagcccttggttacatttgcactttcctgtggaagctggtcttcacctgcggaattaaaaggacacgcgtggataagctaagcgattctcgaaatcattataatacaaaattaaacatagtaaaaaggttgccacttttccatttttcatttttaggatcaataacaatgttagtattattaaatgctacatgctaattttctttcttgatgtg

SEQ ID NO: 567 - DNA, 2372 bp, Glycine max var. Williams 82
tttacattggtccttagatgaggcagtgtgcttaaaacctcgtccttttcttccaccttctacgtactagattgcattgttttctttctcgttttccgggaaagtgatcacatagtaggtgaataccagagctcacaccactcttcaggcaatgaagccacctttaaatgatgacaaagaattattcttatggatcatgcaattgctttctgtatgaagaagaggtgtaagctttttatccaaaactgaaactgggttctttcacttctcatgagaaaaacgtagtcctgtccttctgcttttcctttttctttttctttttcatgaatacagcttgtatcacagatttgatgcatcagtgaatgtaaaaagcaggacaagatggaaactcgagggagcaaggcaatggtggctgcagagaaaaccgtgaaaaatgggcgtcgatccaatagagaaaggaaaatagccttgacacaagatgttgataagttgaagaggaagctcagacatgaagagaatgttcacagagcgttagaaagagcattgacaagacctttgggatcccttcctcgtcttcctccttatcttcctcctcatacattagagcttgtggctgaagtggcagtattggaggaggaggtggttagactagaagagaaggttgtgaatttcagacaaggtctatatcaggaagctgtctacatttcctctaagaggaatgcagaaaatttgagggactcaatggaccagaactccatcaggagctccaaacatcaaagatcaaagtctttgtcccaaagtgagctcaattcaactaccatggctaggcctcaaatttctcttgctagaagtgcttccagtagaaggctgttctctgacattttcactgatcactctggcaagctagtgaacgggaaactattgcacataaatcaagattcactatcatcaatcccagaagagggacggcgaaaagagaatccactgttttatagctctctgaaggataagcaatctccagagaagaaaacggccaaagtcattgctccagtgaagaagtctccaatcaaaaaagaatcagctgataagtgtgtagatcacttgaagttacagatggaggggagattagtagatcaagaaacagctgagagttcttcaagttcattacatgataaggtgtcagaagttgatagcacacccaaccgaatttcggaggatattgtcaagtgcttgtgtagaatatttgtgagagtaggcacattcaaggaaaaattaggggaatcaaaaacacctctcagttctacatctgtatgcagcaaggaaaaggatcagttgtgtgatccatatggtatctgttcagaatctaaaatgagggatattggtacatacaatagtttgtgtgagatcaaagcctccaatgttgacctcaatcgaacaagatatgtagtttttctgatccgtaggttaaagtttctactcgggaaacttgcctccgtgagcatgaaggatcttactcatcaagagaaacttgcattttggataaacacttataattcctgcatgcttaatgcatatttagagcacggcatacccgagagtcctgaaatgattgtagcactaatgcagaaggcaacaatagaagtgggggggcagctgctcaatgcaattacaatagagcacttcatcttgagacttccttatcacctgatgtttacctgcccaaaagctgcaaaacacggcgagatgaaattgcgaagcatatttggcttggaatggtcagagcccttggttacatttgcactttcctgtggaagctggtcttcacctgcggttaggatatacacagcatcacaagttgacaatgagttggaagcagcaaagagggattatttacaggcaacagttggcattacaaaaacaaacaagttaataattccaaagttactagattggtatttacttgactttgcaaaggacttggaaactttgttggattgggtttgcctccaactacccattgaactgagaaaggaagcaattgaatgccttgaaagaagggaaagacagcccctttcacagctggtacaaatgatgccctatgacttcagttttaggttgcttttacaccaataaacttagagagtggtactgttcaccactaccatttcagtcagcacagatttctgaattttgatgtggtggatttttgtatatgggatagttcacacataaagtatattatcaaaataatgtgatgcattcatttggtaaagggttttggcctttttggacactgtaattgggtacgtagaaaggcttttgtagaaaataatacatacatagaaatggcggtttcttataagcaaactcgt

SEQ ID NO: 568 - DNA, 2416 bp, Glycine max var. Williams 82
tttacattggtccttagatgaggcagtgtgcttaaaacctcgtccttttcttccaccttctacgtactagattgcattgttttctttctcgttttccgggaaagtgatcacatagtaggtgaataccagagctcacaccactcttcaggcaatgaagccacctttaaatgatgacaaagaattattcttatggatcatgcaattgctttctgtatgaagaagaggtgtaagctttttatccaaaactgaaactgggttctttcacttctcatgagaaaaacgtagtcctgtccttctgcttttcctttttctttttctttttcatgaatacagcttgtatcacagatttgatgcatcagtgaatgtaaaaagcaggacaagatggaaactcgagggagcaaggcaatggtggctgcagagaaaaccgtgaaaaatgggcgtcgatccaatagagaaaggaaaatagccttgacacaagatgttgataagttgaagaggaagctcagacatgaagagaatgttcacagagcgttagaaagagcattgacaagacctttgggatcccttcctcgtcttcctccttatcttcctcctcatacattagagcttgtggctgaagtggcagtattggaggaggaggtggttagactagaagagaaggttgtgaatttcagacaaggtctatatcaggaagctgtctacatttcctctaagaggaatgcagaaaatttgagggactcaatggaccagaactccatcaggagctccaaacatcaaagatcaaagtctttgtcccaaagtgagctcaattcaactaccatggctaggcctcaaatttctcttgctagaagtgcttccagtagaaggctgttctctgacattttcactgatcactctggcaagctagtgaacgggaaactattgcacataaatcaagattcactatcatcaatcccagaagagggacggcgaaaagagaatccactgttttatagctctctgaaggataagcaatctccagagaagaaaacggccaaagtcattgctccagtgaagaagtctccaatcaaaaaagaatcagctgataagtgtgtagatcacttgaagttacagatggaggggagattagtagatcaagaaacagctgagagttcttcaagttcattacatgataaggtgtcagaagttgatagcacacccaaccgaatttcggaggatattgtcaagtgcttgtgtagaatatttgtgagagtaggcacattcaaggaaaaattaggggaatcaaaaacacctctcagttctacatctgtatgcagcaaggaaaaggatcagttgtgtgatccatatggtatctgttcagaatctaaaatgagggatattggtacatacaatagtttgtgtgagatcaaagcctccaatgttgacctcaatcgaacaagatatgtagtttttctgatccgtaggttaaagtttctactcgggaaacttgcctccgtgagcatgaaggatcttactcatcaagagaaacttgcattttggataaacacttataattcctgcatgcttaatgcatatttagagcacggcatacccgagagtcctgaaatgattgtagcactaatgcagaaggcaacaatagaagtgggggggcagctgctcaatgcaattacaatagagcacttcatcttgagacttccttatcacctgatgtttattacaattcatcccttgattttcatctttccttactgcgacagacctgcccaaaagctgcaaaacacggcgagatgaaattgcgaagcatatttggcttggaatggtcagagcccttggttacatttgcactttcctgtggaagctggtcttcacctgcggttaggatatacacagcatcacaagttgacaatgagttggaagcagcaaagagggattatttacaggcaacagttggcattacaaaaacaaacaagttaataattccaaagttactagattggtatttacttgactttgcaaaggacttggaaactttgttggattgggtttgcctccaactacccattgaactgagaaaggaagcaattgaatgccttgaaagaagggaaagacagcccctttcacagctggtacaaatgatgccctatgacttcagttttaggttgcttttacaccaataaacttagagagtggtactgttcaccactaccatttcagtcagcacagatttctgaattttgatgtggtggatttttgtatatgggatagttcacacataaagtatattatcaaaataatgtgatgcattcatttggtaaagggttttggcctttttggacactgtaattgggtacgtagaaaggcttttgtagaaaataatacatacatagaaatggcggtttcttataagcaaactcgt

SEQ ID NO: 569 - DNA, 2219 bp, Glycine max var. Williams 82
tttacattggtccttagatgaggcagtgtgcttaaaacctcgtccttttcttccaccttctacgtactagattgcattgttttctttctcgttttccgggaaagtgatcacatagtaggtgaataccagagctcacaccactcttcaggcaatgaagccacctttaaatgatgacaaagacaagatggaaactcgagggagcaaggcaatggtggctgcagagaaaaccgtgaaaaatgggcgtcgatccaatagagaaaggaaaatagccttgacacaagatgttgataagttgaagaggaagctcagacatgaagagaatgttcacagagcgttagaaagagcattgacaagacctttgggatcccttcctcgtcttcctccttatcttcctcctcatacattagagcttgtggctgaagtggcagtattggaggaggaggtggttagactagaagagaaggttgtgaatttcagacaaggtctatatcaggaagctgtctacatttcctctaagaggaatgcagaaaatttgagggactcaatggaccagaactccatcaggagctccaaacatcaaagatcaaagtctttgtcccaaagtgagctcaattcaactaccatggctaggcctcaaatttctcttgctagaagtgcttccagtagaaggctgttctctgacattttcactgatcactctggcaagctagtgaacgggaaactattgcacataaatcaagattcactatcatcaatcccagaagagggacggcgaaaagagaatccactgttttatagctctctgaaggataagcaatctccagagaagaaaacggccaaagtcattgctccagtgaagaagtctccaatcaaaaaagaatcagctgataagtgtgtagatcacttgaagttacagatggaggggagattagtagatcaagaaacagctgagagttcttcaagttcattacatgataaggtgtcagaagttgatagcacacccaaccgaatttcggaggatattgtcaagtgcttgtgtagaatatttgtgagagtaggcacattcaaggaaaaattaggggaatcaaaaacacctctcagttctacatctgtatgcagcaaggaaaaggatcagttgtgtgatccatatggtatctgttcagaatctaaaatgagggatattggtacatacaatagtttgtgtgagatcaaagcctccaatgttgacctcaatcgaacaagatatgtagtttttctgatccgtaggttaaagtttctactcgggaaacttgcctccgtgagcatgaaggatcttactcatcaagagaaacttgcattttggataaacacttataattcctgcatgcttaatgcatatttagagcacggcatacccgagagtcctgaaatgattgtagcactaatgcagaaggcaacaatagaagtgggggggcagctgctcaatgcaattacaatagagcacttcatcttgagacttccttatcacctgatgtttattacaattcatcccttgattttcatctttccttactgcgacagacctgcccaaaagctgcaaaacacggcgagatgaaattgcgaagcatatttggcttggaatggtcagagcccttggttacatttgcactttcctgtggaagctggtcttcacctgcggttaggatatacacagcatcacaagttgacaatgagttggaagcagcaaagagggattatttacaggcaacagttggcattacaaaaacaaacaagttaataattccaaagttactagattggtatttacttgactttgcaaaggacttggaaactttgttggattgggtttgcctccaactacccattgaactgagaaaggaagcaattgaatgccttgaaagaagggaaagacagcccctttcacagctggtacaaatgatgccctatgacttcagttttaggttgcttttacaccaataaacttagagagtggtactgttcaccactaccatttcagtcagcacagatttctgaattttgatgtggtggatttttgtatatgggatagttcacacataaagtatattatcaaaataatgtgatgcattcatttggtaaagggttttggcctttttggacactgtaattgggtacgtagaaaggcttttgtagaaaataatacatacatagaaatggcggtttcttataagcaaactcgt

SEQ ID NO: 570 - DNA, 2309 bp, Glycine max var. Williams 82
tcttactttgttctcactctgttcgatatttttttaatgttatgcaaacaaaaaaccgtgttgtcttcttcttcttcttcttcttttattttaaacgcagaagccggcatttgtgttcccgtgtcttccctgctttctcagttttttctatgtgactctgtttccatatactagattgcattgttttctttctcgttttccgggaaagtgatcacatagtaggtgaataccagagctcacaccactcttcaggcaatgaagccacctttaaatgatgacaaaatttgatgcatcagtgaatgtaaaaagcaggacaagatggaaactcgagggagcaaggcaatggtggctgcagagaaaaccgtgaaaaatgggcgtcgatccaatagagaaaggaaaatagccttgacacaagatgttgataagttgaagaggaagctcagacatgaagagaatgttcacagagcgttagaaagagcattgacaagacctttgggatcccttcctcgtcttcctccttatcttcctcctcatacattagagcttgtggctgaagtggcagtattggaggaggaggtggttagactagaagagaaggttgtgaatttcagacaaggtctatatcaggaagctgtctacatttcctctaagaggaatgcagaaaatttgagggactcaatggaccagaactccatcaggagctccaaacatcaaagatcaaagtctttgtcccaaagtgagctcaattcaactaccatggctaggcctcaaatttctcttgctagaagtgcttccagtagaaggctgttctctgacattttcactgatcactctggcaagctagtgaacgggaaactattgcacataaatcaagattcactatcatcaatcccagaagagggacggcgaaaagagaatccactgttttatagctctctgaaggataagcaatctccagagaagaaaacggccaaagtcattgctccagtgaagaagtctccaatcaaaaaagaatcagctgataagtgtgtagatcacttgaagttacagatggaggggagattagtagatcaagaaacagctgagagttcttcaagttcattacatgataaggtgtcagaagttgatagcacacccaaccgaatttcggaggatattgtcaagtgcttgtgtagaatatttgtgagagtaggcacattcaaggaaaaattaggggaatcaaaaacacctctcagttctacatctgtatgcagcaaggaaaaggatcagttgtgtgatccatatggtatctgttcagaatctaaaatgagggatattggtacatacaatagtttgtgtgagatcaaagcctccaatgttgacctcaatcgaacaagatatgtagtttttctgatccgtaggttaaagtttctactcgggaaacttgcctccgtgagcatgaaggatcttactcatcaagagaaacttgcattttggataaacacttataattcctgcatgcttaatgcatatttagagcacggcatacccgagagtcctgaaatgattgtagcactaatgcagaaggcaacaatagaagtgggggggcagctgctcaatgcaattacaatagagcacttcatcttgagacttccttatcacctgatgtttacctgcccaaaagctgcaaaacacggcgagatgaaattgcgaagcatatttggcttggaatggtcagagcccttggttacatttgcactttcctgtggaagctggtcttcacctgcggttaggatatacacagcatcacaagttgacaatgagttggaagcagcaaagagggattatttacaggcaacagttggcattacaaaaacaaacaagttaataattccaaagttactagattggtatttacttgactttgcaaaggacttggaaactttgttggattgggtttgcctccaactacccattgaactgagaaaggaagcaattgaatgccttgaaagaagggaaagacagcccctttcacagctggtacaaatgatgccctatgacttcagttttaggttgcttttacaccaataaacttagagagtggtactgttcaccactaccatttcagtcagcacagatttctgaattttgatgtggtggatttttgtatatgggatagttcacacataaagtatattatcaaaataatgtgatgcattcatttggtaaagggttttggcctttttggacactgtaattgggtacgtagaaaggcttttgtagaaaataatacatacatagaaatggcggtttcttataagcaaactcgt

SEQ ID NO: 571 - DNA, 597 bp, Glycine max var. Williams 82
atgtcatctcaggtcggtgtcaggacacgagcccgagccgcattagccatggaagctgctactgccagttcagctcaaccctcttcgaagagaaagaagatctacgacactaaccatgtggcaaaactctccaaaactccgagaacaagttcttcctccttcttcatacctgcgacggtgacggagattgttcaggaacgctgcctcagccctacctccagtgaaattccggcttcttgctgctccagcaacggatccattggcctcgatgaggataggatcaagctcttagatctggaggtggagagcgcgcaagttgaaacgtcgacgtgcaatggtggtcaagaaattgagaggagagagatgaaaagttccagcgagcttcgagagaattcacaggagccggagccaatggagatcaattctcaccgtgccttatcaaaggcaaaagccatgcctaccgagttggagctcgaggaattcttcgttgctgcggagaaggacattcagaaacgatttcaagacaagtacaattatgatattgttaaggacgtaccactggaaggacgctacgagtgggttcagttgaagccatga

SEQ ID NO: 572 - DNA, 1492 bp, Glycine max var. Williams 82
ctaatcccagctcagccatgatttgtcctaaccttaatccccttggaattcatcatgaggtgtcaatcctccatttggtgacgcttcggcgcaggccatataacggcgccgtcagatttcccgtttctagattcccgtcactgttaacagggactgggccaccaccacgatgcaaaacacacacacacactacccttgccagcaccactaagaaaaagtaaattacccaatcccaaccgttaaacccccctttcgtcattatcacagttttcgtcttctccgtactacacgcgcgaaccagcctacgttcacgccacacctcccttccttccttcctttccaatccgcccctaatttcgctcactttcatcagcaaaaaccaaaacctgaaaaaggaagagtgtgtggaaattggcatcgctcgcaagagcaacaactagtagtacctaaagagacagagagtgtgcacatctatgtcatctcaggtcggtgtcaggacacgagcccgagccgcattagccatggaagctgctactgccagttcagctcaaccctcttcgaagagaaagaagatctacgacactaaccatgtggcaaaactctccaaaactccgagaacaagttcttcctccttcttcatacctgcgacggtgacggagattgttcaggaacgctgcctcagccctacctccagtgaaattccggcttcttgctgctccagcaacggatccattggcctcgatgaggataggatcaagctcttagatctggaggtggagagcgcgcaagttgaaacgtcgacgtgcaatggtggtcaagaaattgagaggagagagatgaaaagttccagcgagcttcgagagaattcacaggagccggagccaatggagatcaattctcaccgtgccttatcaaaggcaaaagccatgcctaccgagttggagctcgaggaattcttcgttgctgcggagaaggacattcagaaacgatttcaagacaagtacaattatgatattgttaaggacgtaccactggaaggacgctacgagtgggttcagttgaagccatgaacgtgtgcgtctcgccaccgaagaagaaaaactccgatcaatttgaacatgtcattttggtctatttatatattgttaattaagtctagtctaggtctttgatttcaatcttaattatctttttaattttacaccagccaagactcttttatattctggttgcagctttttttatatttcggtgtgattataggttaagggtaaacaggaattcagcttcgtttgttctctgtacggagaagcagcttaaagctagcttgtgcagaaaaatactgtaaatttcccttggtgaagaagaacaaacgcttccattttacagacttcaacctctatcgttttttgctctaaacgctcccctaaaatccgtgcccgtttccttgttttaacttcgcttttaaggagaagagagtacaccaaagtca

SEQ ID NO: 573 - DNA, 564 bp, Glycine max var. Williams 82
atgtcgagtttgagtttcctaaagttcaattatagcttctcatggaagccctccgcttcacgcaaaaatgtagtcaagaagaacagcttcatatcaagacagacatcgaatgaaggacaaagtttccttccaaaagaagaggaaatgaaatgggtgttccagaaatttgacaccaacaaagatggcaaggtttctcttgaagagtacaaggctgctgcaagggccttggatagggccattggggaagctgaagcagtgaaagcgtttagggtcatggacactgatgaagacggcttcattgacttcaaagagttcatgaagatgttcaatgaagagggtaggataaaagaaactgagatcaagaatgcttttcaagtgtttgatttgaacggtgatgggaagattagtgctgaggagttgtcccaagttctcaaaaggttaggagagagttgcagccttagtgcctgtaaaaaaatggtcaaaggagtggatgggaatggagatggttttattgacttgaatgagtttacgaggatgatgatgagtgggaagaaactaggctaa

SEQ ID NO: 574 - DNA, 1434 bp, Glycine max var. Williams 82
atggcgtcgaaaccgaaatcaaatggaaattccaaatgcaacaaaggattcgctgacagctatatgctgttgaatcctgaagacgctcatttcttcgatcttgttcatgtgctgtattcccgtaacttgggaaaccgaaaatttgtggacagcaatgctgagggatcttatgagggaagcttccgccaaagatggcttatattcgtctctgtggtgctccagaagcttctgttgctcatcgctaagccactttcgttctttggctcttgcgttgagttcttcatcaacctccttgtcctcaacggtggcttcatcatgatcgttattaacttcctcacaggtcacctggtcgtccccgatcgtaatgcaccaaattatttgtcttgcatcggaaatttggacgcgagagtaaagttggatgccatcacgcgtgatgactgcaggtactatgtttcattagctatgatggcttcaaaggcatcctatgagaatgcagcttaccttaaatctctaataaaaaaccactggaagatggaattcgtgagattttttgattgctggaatgattttcaagaaaaggccacaacccaagtcttgattgttttggacaagcatgagaaccgcgatacttatgtggtagctttccgaggaacggaaccctttgatgcagatgcatggtgcactgaccttgacatctcatggtacgggattcccggcattggaaaaatgcatggtggcttcatgaaagccttagggctacagaaaaatgtggggtggcctaaggagattcaaagggatgaaaatcttcccccgttggcctactatgttattagggacattctaaggaaaggtttgagtgaaaatcctaatgcaaagtttatcattacgggtcatagtttgggtggagcactcgcaatcttgtaccctacgatcatgttcttgcatgatgagaagttgctgattgagaggttggaagggatctacacgtttgggcaaccaagagttggagatgaagcatatgcacagtatatgagacaaaaattgagggaaaattctatcaggtattgcaggtttgtttattgcaatgacatagttccgaggttgccctatgatgataaggacttgctcttcaagcactttgggatctgccttttctttaacaggcgctatgaactcaggattctcgaagaagagccgaataagaactatttctcgccatggtgtgtgatacccatgatgttcaatgctgttttggaactaataaggagctttaccatagcgtacaaaaatggacctcactatagagaaggatggtttctctttagtttcaggttggttggtctgctgattcctggcttacctgctcacggtccacaagattatattaattccactcttctgggatcaattgaaaaacattttaaagcagattga

SEQ ID NO: 575 - DNA, 1368 bp, Glycine max var. Williams 82
atggagacggtgtgtgataagaagaagctgaaggttattttccttcccttcctatcaacaagccatataattcccatcgtagacatagccagattgttcgccatgcacgacgacgtagatgtcaccataatcaccaattccaccaatcgcgattcgtgtcgtggtcgttccatcaggatccacacggtgaaattccctgcttcccaagttggcctccccgacggggtcgagacctttaacgttagcactcctcccgacatgatctctaagattggaaagggcttgtcgttgctccagggagagatcgagcaactgtttcaggatctcaaagctgattgcattgtcaccgacatgttctatccttggacagcggatgctgcggccaacctcggtattcccagattgatgttcctcgggggaagctacctctcccactctgcccaacattccctcaaaaaatacgcgcctcaccacttggagatgacacgcttgcaggtaccggactggcttagagagcccaacggatacacttattcaaaaaaaaagagctatggttcgttgtttgataccttctatgaccttgagggtacttaccaggagcattacaagacagtcaccgggaccaaaacatggagcttaggaccagtttccttgtgggtcaaccaagatgcttctgataaggctggaagagggtatgcaaaagaagaaggttggttgaaatggctcaaatctaagcctgagaaatctgttctgtacgtgagttttgggagcatgagcaagttcccttcttcccagcttgttgaaatagcccaagccctagaagaatccggtcacagtttcatgtgggtagttaagaatagggatgaaggggatgatcggtttctggaagagtttgagaagagagtgaaagcaagcaataaaggctatctaatatggggttgggcaccgcaactgctgatactggagaattctgccattggaggattggtgactcactgcggatggaacaccatcatggaaggtgtgaccgcagggttgcccatggcgacgtggcctctgtttgcggaacagttctttaacgagaagccggtggttgatgtgctgaagattggagtggctgtgggagccaaagaatggagaccgtggaacgactttgggaaagaggttgtgaaaaaggaggacattggaaaggcgattgctttgctcatgggcagcggagaggaaagtgcagaaatgaggagaaaagctgttgttcttgccactgctgctaagacagctatacaagttggaggctcttctcatactaacatgttgggattgattcaagagctcaagtcactcagatttgaaggaaactgcctaccatga

SEQ ID NO: 576 - DNA, 231 bp, Glycine max var. Williams 82
atgaacgaacaggctaagaagaatgagattgtgaatgcacaaaatggcatggaaaagaaggtggaaactgtggattatcgatcttcagcagggcaaaggcaagaagagaggaacgtgcaggtaattcaccagccccattccaccaacaccagtggtggtgtacttgctggtgctgctgctgctgttgcatccactctacagtcagcgaaggatgccatctccaaaaaataa

SEQ ID NO: 577 - DNA, 1740 bp, Glycine max var. Williams 82
atggctcttcagttcatcgagcaagttaccaaaaacactgactccgtccaggagagagtcctttccgagattctcacccaaaacgccgagacagaatacctcaaacgcttcgctctcaacggtgccaccgaccgtgacactttcaagtccaaggttcccgtcgtcacttacgaggatctgcaacctgatattgagcgcattgcaaatggtgaccgctctcccatcttgtgcgctcacccaatctccgagtttctcaccagttctggaacatctgctggcgagagaaagttgatgccaacaattcatgaagagatggaccgtcgtcagttactgtacagcctgctcatgcctgtgatgaaccaatacgtgtccgatttggacaaaggcaaggcgcttcacttcctgttcattaaggcagaggccaagacacccggcgggttaatggcgcgtccggtgctgacgagctactacaagagcgagcaattcaggaaaagaccattcgacccttacaacgtcctcacaagccccaacgaagccatcctttgccctgattccttccagagcatgtatactcagatgctctgtggcctcatcatgcgccacgaggttctccgcgtcggagccgttttcgcctctggccttctccgagccataaggttccttcagctcaattgggaacaactttcccatgatatcctcaccggaaccctaaaccccaagatcactgaaccttccatcaaggaacgcatgtccaagatcttgaaacctgaccccgaactcgccgctttcattaaaagcgaatgctccggagaaaactgggagcgtataatcgtgaggatttggcccaacacaaagtaccttgacgttatcgtcacgggtgccatggctcaatatattcccacactcgattactacagcggtggcctacctaagccttgtaccatgtacgcttcttctgagtgttttttcggcctcaacctcaaacccatgtccgaaccctctgacgtgtcttacaccattttacccaacatgggttacttcgagtttttaccgcatgatgattcctctcctattactctctccaaggactcacctcctcgcttggtggaactcgctgacgtggaacttggtaaatactatgaactcattatcaccacctatgcaggtctttgccgttacagggtcggtgacatactccaagtaaccggtttccacaactcagacccgcaattccgtttcgtgaggcgcaagaacgttttgttgagcattgactcggacaaaaccgacgaatccgaactgcaaaaggccgttgagaatgcctcggagttgctgaaggagttcaataccagcgtggcggagtacacaagcttcgctgacacgaaatccattcctgggcattacgtgatttactgggagctcatgatgaaggactcgtctcaccctccaacgaaccaagttctgaaccagtgctgcttggtgatggaagagtcgctgaactccgtctatagacaagggagagttgccgataactctattgggccgttggagatacgagtggtgaagaatggaacgtttgaggagttgatggactacgctatctcgcgtggtgcgtcgataaaccagtacaaagtgccaaggtgcgtgagcttcacgcccataatggagctacttgactctagggtgctttcttttcattttagcccagctgcaccgcactggaccccagaacgacgtcgttga

SEQ ID NO: 578 - DNA, 1076 bp, Glycine max var. Williams 82
aagttaggattttcctcatttcagctaaacagtggtaactaaaatggaggtgaagtgataccataaaaatgcatgcctgaacattccaacaaaagtagttaaggtacactagctgaactgatctccgatggagaagcttattaggccatgcgataaagaatacatgagaattaccatgctaaaacaccaagacactttcaaagaacaggtactaaatctctttctgttactttgagccatttgtcctcaatcagtgtcaatagagtcttgagtgccctgagaatgttttcaggtgtacgaacttcaccgtttgtatcggattcagaacatattgatgaaaaatatggaagccactagaggtaatgaagtaaatcaacgaggatggaacttaaaaaacgtgattagtttaactcaaaatggttatcataaaggcgcgcagcaaaatcctaagttgaactttgatcttgaaagacctgctaaggaggacatggcagaagctgacagcgatggagttctggaggttataaatgagactgagattgagctgacactaggcccttcaagttacaaacgtaaaaaagtggagacaccactaacttcagattcggcacataggttgtcttcttcttctactggatctagccttataaacaagacaagattgaagacccgtcatagcagttattcagctgcagaagaattaagtggaggcttaattggccttgtccatgtgcgacattcgaccgcagggtgccaaagtggaattagaaggagttatgaaattgaagaacgatcaagagatgagagaacgaaacagccaccttggttttttcaagtattgagtctgaacacgaactaaaaatattctaaggtcaatgtgatgtatattcgattactgtttaagactaactttgtgaatgatgtttctgttaaattttcttcttagttaccaagtgttgtgagggtatgatgatgtcttgtatagaagttacttgttttcatggttaaacaagccaattataattccggaatcacatatgactgatatttctttggtcttgtgactattcatattt

SEQ ID NO: 579 - DNA, 987 bp, Glycine max var. Williams 82
atggctctgcttaacctcatacttgtctggttatttttcttgagtctgtgtctttattcgtgtcctacttcggcccagttaagtagacaccactatgcaaaaacttgccccaatgtagaaaacattgtcagagaagcagtcaaaaagaagtttcatcaaacatttgttacggtccctgccaccattcgtctcttcttccatgattgcttcgtgcagggctgtgatgcctcggttttggttgcatccacaaaaaacaacaaagcagagaaggatcaccctgataatctttcactagctggagatgggtttgatacagtgattaaagcaaaagaagcagtggatgcagttccattgtgcaggaacaaagtttcatgtgctgatattttagctatggcaacccgtgatgttattgcactggctggtgggcctttctacgaggttgaattgggaagatttgatgggctaagatctaaatcttcagatgtaaataggaggctgcctcaggcagagttcaacttgaaccagctgaattcactgtttgcggccaacggcctcacccaaactgaaatgatagctctgtcaggtgctcacactgttggattctcccattgcaacaaattcacgaacagagtatacaatttcaagagcaaaagtcgagtggaccctacactgaacgagaaatacgcaacacagctaaggtcaatgtgcccaaggaatgtggatccaaggattgcaatcgatatggacccaaccactccacggtcattcgacaatgtttatttcaagaatcttcagcaagggaagggcctcttctcttcagaccaagttctcttcacggactcaagatccaaggccacagtaaatgcctttgctagtagcagcaatatctttcatgccaacttcgctgctgccatgaccaaattgggccgagttggagtcaagaatgcacagaatggaaacattcgcaccgattgttctgtcatttaa

SEQ ID NO: 580 - DNA, 732 bp, Glycine max var. Williams 82
atgagttgcaacgggtgccgcgtccttcgaaagggttgcagcgagtcttgtatcctgcggccgtgtctacagtggatcgatacgcccgaagcacaaggccatgccactgtcttcgttgccaaattctttggccgtgccgacctcatgtccttcatttccaacgtccctgaaccccaaaggcccgctctgtttcaatctctgttgttcgaagcgtgtggaagaacggtgaaccctgtcaacggtgctgttgggcttttatggaccggaaactggcacgtgtgccaggcggcggttgagacggtgctccgcggcggcaccgtcaggcccatgccggagcttctcggcctagacgctcccactcccactgccgatgacgcttccgaaggggaagttacctgtaccgacaagtggagagtccgagatccgaacccgaatttcccgggaacccggttcccgggttcgaggtccgataaggccggttctggtggcaaacgcaagcgatttgaagagctcgccaagcttcagacggcgacgacggatctcaatctccggctgacgccgagttttctgcagaacgcggctagctacggctgccggcaggaaattcgctggccagggtcgccgtcaatgaattccgaggagtccgggacgacgacggcgtgcttggagagcgggatcggagatcactacgctcacgacggagaccggaaagtgctgaaccttttcatttga

SEQ ID NO: 581 - DNA, 1140 bp, Glycine max var. Williams 82
atgactagcatgggcgagaattgttttaagcctctccaaaatactaagaaaataactccgatgccacctcccatgccccgttttgcagccacgagttgtccttgtaagtgtttggtgtcaaaaaattcaacaccaccaagagggcgcaacaataatgtctctccagcagcaatagaattttgggagcgtcttttttatcaaggttataaagcagatgtttgcattaatactgataacggtggcgttgtttatgctcattctaacattcttgccatgtctactcctgttttcaggggcatgttgaagcaagcaaattgtcatcgtcgatggcgaacaatctcaattactggggttccacatgatgcagttcaagtttttattcgattcttatacacttccagttatgagaaagaagaaatggatgaattcgtcctacctttgttggtgttgtcacatgtatacgtcgtccctcacttgaagcgtgaatgtgaacagaagttagaactgagtttactcaccatagataatgtggtggatgtatttcaacttgccctactttgtgatgcaccaagacttagccttatttgtcaccgaaaggtgctgaaaaacttcaaagttgtttcagaaacagaaggatggaaaacaatgaagttgagccacccagctctagaaaaggaaattgtcgagtcaatggtcgatgaagacattattaaaaaggagaaaatcagaaaaaataaggaaagagagatatatttgcaattatacgaggccatggaagcccttgttcacatttgtagagatggttgtcgaactattggtcctcacgacaaagacttcaaagcaaaccaaccatgtaagtatacagcatgcaacggattagaattgcttgttcgtcattttgctggatgcaagttgagagtccgtggaggttgtgttcattgcaacaggatgtggcaattattggagttacactctcgattatgtgttgatcctgattactgtagagttcctttgtgcaggaactttaaagagcgaatatcaaaacaaaacaagaaagacgaaattaggtggaaaatattggttcaaaagatcttgagaacaagaggaattgggatagcatcatgctttctgccacaataa

SEQ ID NO: 582 - DNA, 1350 bp, Glycine max var. Williams 82
atggttaaatctgaactctccaatcactaccacaacaacaacaagtctcccatgatgatggcgaagccccacagaaacaaaagctcctctttatttctctccgatggatgtctcttcctcggaggagcattctccgctctcatcctcgtctggggtttctcctccttcaccaccaccatccctaacgacacccccaacttcgaatctctttcaaaaaacgacgccgcttcgcaccacatcgctcccgatttcaacttcgacccacccgacagaacattctacgacgacccgcaaatgggttacaccatggacaagaaagttcgcaactgggacgagaagcgcgaggagtggctgaaactccacccttccttcgccgccggagcgagagaaagggttttcatggtgaccggttctcagccgaagccgtgccggaaccctacaggcgaccaccttctcctgcggttctttaaaaacaaagtggactactgtcggctccacgggtgcgacattttctacaacaacgcgctgttggaaccgaagatgttcgcgtactgggcaaagtacccagcggtgcgggccgcgatggtggcccacccggaggccgagtggatctggtgggttgactcggacgcgctgttcaccgacatggagttcaagctcccccttgagcgttacagggagcacaatctcgtggttcacggctgggcccacctcatacacgagaagcggagctggacgggcctcaacgccggcgtgttcctcatcaggaactgccagtggtcgttggacttcatggaagcgtgggccagcatgggcccacagagccccaattacgaaaagtggggccagacgctgaggtcaactttcaaggacaagttcttcccggagtcagacgatcagacgggcctggcatacttaatcgccatggagaaggataaatgggcggagaggatttacctagagagcgagtactacttcgaagggtactgggaagaaattcagggaacgttcaagaacataacggaaaaatacaaggagatggaaaaaggggtgcagaggttaaggaggcgtcacgcggagaaggtgagtgaaacatacggggagatgagggaagagtatttgaaggatgctgggaacgctaaagggagttggaggagacccttcattacgcacttcaccggctgtcaaccttgtagtggaaagtataatgccatgtattcagcccatgattgctggaacgcaatgcacaatgctctcaattttgccgataaccaagtcatgcgtaaatttggttacagtctactggataacgccgtttcccctctcccttttgattatccccgtcattga

SEQ ID NO: 583 - DNA, 891 bp, Glycine max var. Williams 82
atgtccatggccatcattaacacttttggaaacgttgatgtctatattctattattatcatcatggtttctcgtatctgctgtgtgtgtttggggacgacccgccacttttctgcaagactttgaaatcacgtggtcaaagactcatatcaggcaaattgatcaaggcagatccatccaactcattctagatcaaaactctggttgtggctttgcttccaagagtaagtacatgtttggccgtgttagcatgaagatcaagctcatacccggagactctgctggcactgtcactgcattttatatgaactctgacaccgacactgtacgtgatgagctggattttgagttcttggggaaccgtagtggtcagccttacacagttcagacaaacatctatgctcacggaaaaggagatagagaacaaagggtcaacctctggtttgacccttctgcggattttcacacttatactattatgtggaatcatcatcatattgtattctacgttgatgattttcccattagagtgtacaagaacagtgagggaaagggaatcccatacccaacaatgcaaccaatgggagtgtattcgacattgtgggaagctgataattgggcaacaagaggggggttggagaaaattgattggagtaaagcacctttttatgcatattacaaggactttgacattgaagggtgcccagtgccaggacctgccaactgtgcctctaaccaaagtaattggtgggaaggggctgcataccaagctcttaatgccattgaagcccgaaggtacaggtgggttcggctcaaccatatcatctatgattactgccaagataagtcaaggtttccagtgatcccaccagagtgccttgccggcatttaa

SEQ ID NO: 584 - DNA, 1356 bp, Glycine max var. Williams 82
atgagagagtgcatttccatccacattggccaggccggaattcaggtcggaaatgcttgctgggagctctattgcctcgagcatgccattcaggctgatgggcagatgccaagtgataagaccattggtggaggtgacgatgctttcaacaccttcttcagcgagaccggtgcaggaaagcacgtgcctcgtgcagttttcgtagatcttgagcccactgtcattgatgaagtcagaactggcacataccgccaactcttccatcctgagcagctcatcagcggaaaggaagatgctgcaaacaacttcgctcgtggccactatactattgggaaagagatagttgatctgtgcttggaccgtatcagaaagcttgcggacaactgcactggtctccaaggttttctggttttcaatgctgtaggtggtggcactggttcaggtctaggatcccttctcttggaacggctttcagtggattatggcaagaaatccaagctgggtttcaccgtctatccttcaccgcaagtttcaacctctgtggttgagccttacaacagtgtcctttccacccattcccttctggaacacactgatgttgccgtgctacttgacaatgaagccatatatgatatttgcaggcgttcccttgacattgatagacccacttacacaaaccttaatcgcttagtttctcaggtgatatcatcactgactgcatctctgagatttgatggtgccttgaatgtggatgttactgagttccagactaacctggtaccatatccgaggattcacttcatgctttcatcctatgctcccgtgatttcagcagagaaggcataccatgaacagctttcagttgcagagatcacaaacagcgcgtttgagccgtcctctatgatggccaagtgcgaccctcgccacggcaagtacatggcttgctgtctgatgtacagaggcgatgtggtccctaaagatgttaatgcagccgtagccattatcaagaccaagcgcactatccaatttgttgattggtgccccacagggttcaagtgcggtatcaattatcagcctccaactgttgttccagggggagatcttgccaaggtgcagagggcagtgtgcatgatctccaactccacaagtgttgctgaggttttctcacgcattgaccacaaatttgaccttatgtatgccaagagggcgtttgtgcactggtatgttggtgagggcatggaagagggtgagttttctgaggctcgtgaagatctcgctgcccttgagaaggattatgaggaggtcggagcagaggctacggaaggtgatgaaggcgaggatggagatgagtattga

SEQ ID NO: 585 - DNA, 1107 bp, Glycine max var. Williams 82
atggagaataataacacatcgatggacgcatcagaagccagctggttatctgatttgctgttgcaggaaacggaggatggttgcaacttgttccgacaatgtcaccttgagacgttgctcgacgatgatgaagagttgctttcgcatgagatagcaagtgcctttgagaacttgcagcaacctttgtcttcggagagtaacacttcgtattcggaggctccgatgaactcattcacggaagaaacaagttttgagaagcccatcaagcagcccaaaacgaatgcctctagttggaactcatcgttcactaagcatttttcgttatcttcatccccttcttctccaacctccaagatcctgtctttcgagaactcaaactcgtcccctcccaatcccaacaacaccgatcagtttcatggtattgttgtttcttctgccttaagcccaaagcagatcaagaccaaaggtgcttcagtttcactcccacatacccggaaacgtttatcagaaaaccagaactttgaagctgaaagccccaaaggccatagaagctacaagtccccatctcacgttcgggatcacatcatcgccgagagaaaacgaagagagaagctcagccagagcttaatcgctctagcagctcttattcctggcttaaagaagatggacaaggcatcagtgctgggagatgctataaagtacgtgaaagagctccaagagcgtatgagaatgcttgaagaagaggacaagaatagagatgtggagtctgtggtgatggtgaagaaacaacggctgagctgctgcgacgatggttcagcttcacatgaagatgaagaaaacagtgaaagactcccccgcgtggaagcgagagtgttagagaaggacgtgctccttcggatccactgccaaaagcaaaaggggcttttgctcaacatacttgtcgagattcaaaaccttcatctcttcgttgtcaatagcagtgtcctacctttcggggattccgtacttgacataaccattgttgctcagatgggaaccggctacaatttgaccataaatgatcttgtaaaaaacctacgcgtggctactttgaaatccatgtcataa

SEQ ID NO: 586 - DNA, 1647 bp, Glycine max var. Williams 82
atggctctaacacttcgctcttcaatttcccttgtcaaccagaaagaaaccaaactcccaaaagccaaagacgaggttcccaccaaagtgttttactttggaaaaaccaacccatctttccgtctcagagcaaagagttccatgcaacaaacacacgtcacaccaaacaacagctttaactccgaagtaacgatgataaacgagaaaagggagaaggttcacgctccatcggttgcacatagccacaatgattcaatgagagtgcccgtgtttgtgatgctgccattggacactgtaactatgggagggactttgaataagccgagagcaatgaatgctagtttgatggccctgaagagtgcaggagtggaaggagtgatggtggatgcttggtggggtttggtggaaaaagagggacccttgaagtataattgggaagcctatgctgaacttgtgcagatggtgcaaaggcatggcttgaagcttcaggttgtcatgtctttccatcaatgtggaggaaatgttggagactcctgcagcattcctctacctccatgggtgttggaagaaatcagcaagaaccctgagctggtttacacagacagatcaggaaggaggaatcctgagtacatctccttgggctgtgattcaatgcctgttctgcgcggaaggacgccccttcaagtgtactctgattacatgaggagcttccgttacagattcagagactatttgggcagtgttatcattgaaattcaagtggggatgggtccttgtggggagctgagatatccatcttatccagaaagcaatggaacatggaggtttcctggaattggagaatttcagtgctatgacaagtatatgagagcttccttggaagcatcaactgaggccattgggaagaaagagtggggaaaaaatggaccacatgactcaggccaatacaaccaatttcctgaggacactggttttttccagagggaaggaacatggaacacagaatatggacgattcttccttgactggtactccaccaaacttcttgaacacggtgagaagatccttgtatcagccaaaggcattttcaactcatgcggggtgaaactatctgccaaagtagctggaattcattggcactacaaggcaaggtcacacgcggctgaactaactgcaggctactacaacacgcggtttcgcgatggatacctaccaatagcacaaatgctggcaaaacatggagttgtgctcaatttcacctgcatggaaatgagggacagagagcaacctgagcattgttcccctgaggggttggttcatcaagtgaagatagcagccagaacagcagaagcagaacttgctggggagaatgcacttgagagatatgatgcaggtgctttttctcaagttttgtcaacaagtaactctggttctggattggcagcattcacttatctgagaatgaataagaggttgtttgagggagacaattggaggctctttgtggagtttgtgaaaagcatgtctgaaggtggaaaaagacaaaggcttccagaatctgattcttgtgggactcatctttacgttggacacatcacaggaattcagaagcagcaagaacaagctcaagaggttgctcttgtgtga

SEQ ID NO: 587 - DNA, 729 bp, Glycine max var. Williams 82
atgggtgcattcatcttccttttcctcttgtgtgttttctgcttccaaagtaaggtgacctatgctacaaggtgtggagatgcaggccctgaaatccactatccatatcagataaaaggtcaacagcaacagcataagtcccttcctggttttgagcttctttgcaaagacaacctcaccactatccactttccatcttatggtgatttggtagtgaagtccatttcctatgacaccaaaaacattcacctccttgaccccaaaaactgtgcccatcatgtctttctcaacctcaatctctccctcacaccgttccactatttttatgttctgaaaaactacacatacctcaattgctccaccacccttccacatcctctcgtggaggttccgtgtttaagtgcttcaagctatcatgtatacacagttgaccctgcagtgcctgtgccgggttcatgtgatggagtcaaaaccgtagccattccttttgcatatagcccttatctctcagacaaaagtcttggtcttagattaacatggcacttgcgtgaacctctagacaacgaagcagcagtgaaccggactagaggttcctacaaatcgcgtaatatagttataggctctagcatctgtgttttcgtgatggccatgctattgcttataagcatgaaggttcgtggtgccacgaggaacctccatcagaaagaaggacagttattgcagagctaa

SEQ ID NO: 588 - DNA, 1928 bp, Glycine max var. Williams 82
ttcaaacaggcactcctcgagttcttccttcttccttacaaatcccttcattatgggcataaactccaatatatcagttctatatagcagttgttactcaaaatgaaggacctgttcatttgcatattttgctcattcaaaatcattaaaacgatttaggtttcatagtgaatgataagttagcggaattcaacgactttggattgttaacatccatacatctttctcctaggaagcaaacacaacactccactgatcgtgccctgggttcttaccataattttctttcctttctaatttctatattttttattttattattaattggatattattttcctcagctgattagtatacatggtagccaattttttgtgaattacatatttttttcctaatttggactaaagtctgaaaccgctgacaaagattagtgtccaagtcaagcaaattagtcagagaaatttagttaggatagtggaagaggaagacataagtgttggtggcaagccccttggtgcaaggcgctgaattggtcaacattcaagttcattcaggcacttagtgtgacttttgaaaagtttattccatctgtttgttcctttacaaaaaattgcttatgttaccccccatcagacttctactgctttatgacccgaagcttgttgaagcctgcaagaaaccaagtcttttaatgcttttttgcaaaattcttctagtctagggcggttcaagtttcttaacaaatactagattcatttgtttattcttggtcttcgtcccccaccaataaggtatctaattattattaacttggaaaaaataaaacgcctcatatattctatttccctgggagacttgaccttgcattgcatcctttgcagtctcaagtgatgggtgcattcatcttccttttcctcttgtgtgttttctgcttccaaagtaaggtgacctatgctacaaggtgtggagatgcaggccctgaaatccactatccatatcagataaaaggtcaacagcaacagcataagtcccttcctggttttgagcttctttgcaaagacaacctcaccactatccactttccatcttatggtgatttggtagtgaagtccatttcctatgacaccaaaaacattcacctccttgaccccaaaaactgtgcccatcatgtctttctcaacctcaatctctccctcacaccgttccactatttttatgttctgaaaaactacacatacctcaattgctccaccacccttccacatcctctcgtggaggttccgtgtttaagtgcttcaagctatcatgtatacacagttgaccctgcagtgcctgtgccgggttcatgtgatggagtcaaaaccgtagccattccttttgcatatagcccttatctctcagacaaaagtcttggtcttagattaacatggcacttgcgtgaacctctagacaacgaagcagcagtgaaccggactagaggttcctacaaatcgcgtaatatagttataggctctagcatctgtgttttcgtgatggccatgctattgcttataagcatgaaggttcgtggtgccacgaggaacctccatcagaaagaaggacagttattgcagagctaaacggatttctagctaacagtaatagtaatagatagactttttcaacaacattcctatagttatgtaatactttctactttttttttccctctcttcctgtaatatgacgttacgggttacattttccactcaaatatattttcttatctcacgtaacctagtgagtatatgaatattgaatacagtcattttgactctgtacgagttgtgtgatacttagttacttcatgtttggtactgaattaaaaaaaattgttcttgttatataatatttctagcgaggaaaagcagacaagtaatgttttt

SEQ ID NO: 589 - DNA, 3156 bp, Glycine max var. Williams 82
ccattctgtaaggagttttcccctctacgagacagagtcgttccaagcagggacgcgtcccttcactgagtacaaataaatctgaaccgtttgaaaatctcgcacctaatttctcagtgtttgagaaaatctctctcagttctccgtttggttattatctctgagaaatggataagaggctcaatggacccaccgtttcgtccagctctaacggcggctccgccgtgggacgatcttctcctacgcttcaaccaaactacagtagccgattagttcaggaagcattggaacacttggcatccattgatctgattgagttgtgcaaagaagccaaagttgagcgctgccgagcaactcgagacttgagaagctgtggtcgctatgtccaccatgtcttgaattcatgcggacatgcctctttatgtgaagaatgtagccaacggtgtgatatctgcccaatttgtagaatcccaatttcaaaaagtggtgctaaagtgcatcttcgactttattatgaatgcatagaagcaggccttatttcgaaaaggtgtgatgagaggtttcaagaaatagaagatggggacaaacaactaactgctgacgtacagcgcctttattctctgtttgacgttgcacttgagaataacttggtttctttaatttgccactataatatggacattttaggcttgaaagagagattgagtttacttctgaaattttcattatacttgaagggcatatcaaatgtgctagacattttggagtcatcttttaagggtactctttcagcacaacttcacgatttgcagaatctccaagagagcatcatgaagacaaagcagcatatggatgttattatttggtgtacgagacatcaatttttggaagatgtgagatcacgttttactgatagttcgtcatggtcatcagttgttcggacaaggaaatcagaagcaattagacgtgcttggcctgatccaataaatcaatctgtggagtcatcaggacatgatgggtctctatttattgaagatgcaatgaataatcttgatctggaggaggggtttaggaatgaaattgtagagggattggaaattgcatccttgcagaaggacagtgaatcatttttggggtcaaatactgatcagattctgggttactatcccttcaaaaatcttcgttctgctgttgacttgctctttttacgtggaggctctgatatggtgattgcaaaacaggccatttttctgtattatttatatgatcgccactggacaattcctgaagaagaatggagatacatacttgaggactttgctgctacatttagtattagcaggcactcattacttgaatctttgactttttaccttctggatgatcacacagaggaggctttacaggaagcttgtcgccttcttcctgaaataactggctcaacatcacatcctaaaattgctgaagtactattagaaaggggtagccctgatacagctctcatggttttgaggtgggctgggcgggatggtggacctcacgtgacttcactcagagatgctgtcactgcagtgcgggtgagggttgagtgtgggcttctgactgaagcatttatgcatcagagaatgctctgcaccaaagtgaaggaaaagaatttcaataaaacagcatctgggaatacttctgagaagcaaaaaggtcaatgtaataagtgggtggagtggatggaggtcctggtgactgagatttgttgcctctgtattaggaggaacttggtggatcgaatgctagaattgccatggaattctgaggaagagaagtatatacataaatgtcttttggattatgctattgaagaccctttaaggacaacaggaaatctacttgttgtgtattattttcagcgccacagatactctgaagcatatcaagttcatattaaacttgaaaaggcggagcaagattgcatttcaaaaggttccgtaagtcaacaaaatctgccagtattagagaaggctattcacttcagagccaatttgattaatagatgcttggaattgttgccagaagttgagcagcagcaactgaggagcggaaacttgactgaaggtgttgttacttcttgtgaagaagttgaaattcctgacaaatttgacgttcctcagattcaggatttcttgtcaaccagtttattgattccttcatctgtaaattcttccttgatgttgcataaagatcatccaactggcttgttgagttcattgactttaggaacatcagccaaaataggcatgtctttccctactactggcactgagctaggaatcataggatccgtttcatgaatggttcacccctgaagggatttaccaggacatcaccaagcaattcccaggagaataggccggacaaaatctcgcctggagttgaacaaaataatcaaactaccagtcctatggaatcctggaaggctacagttaaccctgttactagatccacacttagctatcctaaagaatttgcaaatgatctctcaaatgtatctagtaagaatgtccaatcacataaagatgaaagaagttggaacatggggtccactaatgatccaatggatgtttctcggagccttgtagataataaattaaatactgaagaaaacatcaagggtgcacctagatggagatctgatgatgcgagtgatgaggaagatgatcgggatgtgggaagagcaatggatatagcttattattcaactcctccaactcagatgacaagacgaagcagagtttccaggagatgaaaactcaactttttggtgaaaggtttctggaaatttatgtgaagaaacaagaaaatacgtatgttaaagggttgtttttgaaatgagagcttcgcttttttgaaactcgggagttttaacgccggtgtctgttgtgcagctaatattcaatgaagaaaattttaatgttaaaggtgcatttttgtatccttttccttcaatgaatcaatgttagtccaaagtttttaatattttctagttttggagaatgattcatttaaaatgatttttttgagcaaattcaaaggttgtttcatttggcagtatctttcaatttcgtcctagtaaatgatctatctgggaggtcgagttcacat

SEQ ID NO: 590 - DNA, 528 bp, Glycine max var. Williams 82
atgtcggcttacaaagaccaggatccccgtcttcatggcatcaaaactaagattcgtgtcgtccccaatttccccaaatccggtcttatgttcctagacattactactctattgcttgatcccaaagcatttaaggactcaatagatttgttcgtggagcggtacaagggcaaaaacatttctgttgttgcaggaattgaagctcgaggttttatttttggtccccccattgcgctggctataggagcaaagtttgtaccattgaggaaaccaaagaagttgcctggaaaagttatttctcaagaatatattctggaatatggaagggactgtcttgagatgcatgttggagctgttgatgatttgattgcaactggcggaacactctgtgccgctatggacttgttagaacgtgtgggagcagaagtagtggagtgtgcatgtgtaattgaattaccagaattgaagggtcgtgaacgtttgaacgggaagcccttgtgcgtgttggtggaatatgtggatatatga

SEQ ID NO: 591 - DNA, 1416 bp, Glycine max var. Williams 82
atggaaaagaatgtggggattctcgccattgacatctacttccctcccgcttgcgttcagcaggaagcattggagactcatgatggtgccagtaaagggaagtataccattggacttggccaagactgcatgtcattctgtaccgaagtagaagatgtcatctcaatgagtttgacagtggttacttctcttcttgagaagtatgggattgatcctaaacaaatcggtcgtctggaagttggaagcgagaccgtgatagacaaaagcaaatccatcaagacattcctgatgcagatcttcgagaaatatggaaatactgacattgagggtgttgattcaactaatgcatgctatggaggaactgctgctctgtttaattgtgtcaattgggtggagagcaattcatgggatggacgctatggacttgttgtctgcactgacagtgcagtctatgctgaaggacctgcccgacctactggaggagctgctgctattgccatgctaattggtcctgatgctcccatttcttttgaaagcaaattgagaggaagtcatatgtctcatgtttacgatttttacaaacctaatcttgccagtgaatatccagttgttgatggaaagctttcacaaacttgttacctcatggctgttgattcttgctataagaatttctgtcacaagtttcagaaattccagggaaaacaattttctctttttgatgctgaatactttgtatttcactctccttataacaagcttgtacagaagagttttgctcggttgtttttcaatgacttcttgatgaattccagctctgcggatgaggttgccaaagaaaaactgggaccttttgcaactttatctggtgatgagagctaccaaagtcgggatcttgaaaaggcatcccagctacttgcaaagcctctatatgatcagaaggtacaaccaactactttgattccaaagcaagttggaaacatgtacactgcgtctctttatgcagcatttgcctccctcattcacaacaaacatagcacattggcaggtaagagggtgatattattctcatacggaagtggcttaactgccacaatgttttctttgcaattacgagacagtcaacatccgtttagcttgtcaaacatggctagagtgatgaatgtcgatggaaaattgaagtcaagacatgagtttcccccggaggagtttgttgaaaacttgaagttaatggagcatagatatggtgcgaaggaatttgtgacaagcaaggacagtagccttttatctccgggcacattctatctcactgaagttgactccatgtatcggagattctattcaaagaaaactaaagaaagcagtttgactcacgctgagaacggtgtgattgctaatggcgttgctaatggccactga

SEQ ID NO: 592 - DNA, 672 bp, Glycine max var. Williams 82
atggccgtcacgaaaagcctctcaatcttcctcttcatcgcaatgagctgcgtcgccgcagctcaggcagcgaacttcaacatcacaaataactgcacctacacggtgtgggccgctgccgtgcccggcggcggcgcaaggcttaaccctggcgaatcgtggaacatcagcgtgacgaacggcacaacaagaggacgcatctggggtcgaacaaactgcaccttcgacaacgcgggacgcgggaagtgcctcaccggcgactgcgagggtgttctggagtgcaacaaaacaggtacacccccgaacacggtcgttgatttcgcgttgaaccagtataacaacctcgacttctacgacatctccctcgtcgacggtttcaacgttcccctacagctgaccccgacctacaactgcagttccgttaaatgcgccgccgacatcatcggagagtgccccactcagctccaggttcctggcggctgcaacaacccctgcacggttttcaatacgactcagtactgttgtagcaccggagctgctgggtgcggtcccacagattattccaagttcttcaaggagaggtgccctgatgcctacagttaccctatggacgatgcaaccagcatgttcacttgcatgggatccgattatagggttgtgttttgcccttaa

SEQ ID NO: 593 - DNA, 750 bp, Glycine max var. Williams 82
atgttgttttatggggatttttacgtatactttaggagtatcccactcaatattaagaacacatgtagtcatgcagcaaacttcgagatcgtcaacaattgcccctacacggtgtgggccgcggcgagtccgggtggaggccggcgtctggaccgtggccaaacgtggaacctctgggtgaacccgggcactgccatggcccgtatatggggccgcaccgggtgcaactttgatggcagcggccgcggccgctgccaaacgggagactgcacgggcggcctcaattgccaaggctggggggtccctcccaacacacttgcggaattcgcgttgaaccaatttggcaaccaggatttctacgacatctctttggtggacgggttcaacattccgatggacttctaccctctaaacggtgggtgtcacaaaatcagttgcagcgctgatatcaatgggcagtgcccggggccattaagggcacctgggggatgcaacaacccctgcactgtgtttaagacgaatgagtattgctgcaccaatgggcaaggaagctgtgggcccacaaactactcaaggttcttcaaggataggtgccatgattcttatagttaccctcaggatgatccaacaagtacttttacgtgtcccgctggctctaactacaaggtcgtcttctgtccattgggagaacctcatgttactcttcatatgcctgctacaacatgtgacaaaggtattttaaaccaataa

SEQ ID NO: 594 - DNA, 291 bp, Glycine max var. Williams 82
atgaatagaggtgaaagttcaggtggtggacagagctcgttggggtacctatttgggtcagaagagaagccaaatcagcctctgcccacaaggacagctccattaccaccctatggcattgacatcgataactccatgccccatcacggttctaactgccaacttgttgtctcaaacaaccgatctcaaggccaccacttgggaaacattgtaactgatcgtccgtcaacaaaagtcaaatcggtacctggtggtcattcatcgcttggatacttgtttggagataagtga

SEQ ID NO: 595 - DNA, 981 bp, Glycine max var. Williams 82
atgggtcaccattcttgctgcaaccaacagaaggttaagagaggcctttggtcccccgaggaagatgagaagctcatcagatacattaccactcacggctatggttgctggagtgaagttccagagaaagctgggcttcaaaggtgtggtaagagttgtcgcctgagatggattaattatttgaggcctgatattagaagaggcaggtttacacctgaagaggagaagttaattataagtcttcatggggtcgttggcaacagatgggctcacattgcaagccacttaccaggtagaactgacaacgaaataaagaactactggaattcttggatcaaaaagaaaattagaaagccttcttcggtgacttcatcaatgaccactacacaaagtgttgatcatcaccacccccagttcaattataattccaatcaactagatcactatggccaccaagaaaatttaacagcaaagccaccgatgcaagaaaccttattttcctcgacgtgccccctatttatgtttgacactagttcattagatcaagggacaacaacagtagacaccaccaccaatgtacgaacagaattgttccaagattcattgggtttgagcagtactgaaacgtggaacttgagccaccatcaagtccatgttcttcctcctcaactagcagcaacttttacagcagcaacagttattgataccacgaattatctgccaccattgatagagaacgtggacaacatggtgccaaatatggaagtacagtcttgtagtatagacgaggaaggagaaatggcactagagtgtctacggagacaaggtttgaatgagtgggtggagcatcaacaacaatgtcccaactttcttttctgggacagtattaatgtagaaggacaacttggaggggaagaactagcaccaaacacgtcaaatatgggaaacaatacactttcaccttttccatcctctttatga

SEQ ID NO: 596 - DNA, 975 bp, Glycine max var. Williams 82
atgtgcatgcccatacgtgatcacacatgcagcttttcaaacagtaataacggacacagttgccagatgcattccagcaacccaaagaagagaaagcgtccttgcgacgacgactgctacaccaagcccgccgcatcacacggtttcatatccgtgatagggaggcgacgcgcgatggaggacgcggtcaaggtagttccaggtttggtggcggcggaacaacgctgtggcagttacgatttcttcgctgtttacgacgggcacggagggaccttggtggcaaacgcttgccgcgacaggctgcacttgttgctggcggaggaagttagggagagcgcaggaggcagaggcttggattggtgccaggtcatgtgttcgtgtttcatgaagatggacaaggaaattggagttggtgaggagcaagatggcggcggcggaaacaccatgggttcgacggcggccgtggtggtggtcggaaaggaggagattgtggtggccaattgtggtgactcgagggcggtgttgtgccgtggcggtgtagctgtgccactttcacgtgaccataagcctgatcgtccagacgaaaaagagaggatagaagcggcaggtgggagagtcattaattggaacggaaatcgtgttttgggagtacttgctacttccagatccataggggatcactgcatgaagccttttgtgatttcagaaccagagacgaaggtgtacgcacgaacagaggcagatgagtttgtggtggtggcgagtgacgggctgtgggatgtagtgtctaacaagtatgtttgtgaggttgtacgaggttgcctccatgggaaaatgaggaggaaattaaaagaggagcccattataagctatgcaacagaagctgcagcgttgttggctgagttggctatggctcgtggaagcaaagacaacatcagtgtcatagtcatcccactcaacactactacaacttga

SEQ ID NO: 597 - DNA, 1498 bp, Glycine max var. Williams 82
tccgaatccgttcagctttggcgagcgtgggatgctataaaaaagcaacccaaacttaaatagtataagtttcctctgagaaaatcgaaaacaaaacaaaaataaaagtgaagccggtgcgcgctgcctgataccatgtgcatgcccatacgtgatcacacatgcagcttttcaaacagtaataacggacacagttgccagatgcattccagcaacccaaagaagagaaagcgtccttgcgacgacgactgctacaccaagcccgccgcatcacacggtttcatatccgtgatagggaggcgacgcgcgatggaggacgcggtcaaggtagttccaggtttggtggcggcggaacaacgctgtggcagttacgatttcttcgctgtttacgacgggcacggagggaccttggtggcaaacgcttgccgcgacaggctgcacttgttgctggcggaggaagttagggagagcgcaggaggcagaggcttggattggtgccaggtcatgtgttcgtgtttcatgaagatggacaaggaaattggagttggtgaggagcaagatggcggcggcggaaacaccatgggttcgacggcggccgtggtggtggtcggaaaggaggagattgtggtggccaattgtggtgactcgagggcggtgttgtgccgtggcggtgtagctgtgccactttcacgtgaccataagcctgatcgtccagacgaaaaagagaggatagaagcggcaggtgggagagtcattaattggaacggaaatcgtgttttgggagtacttgctacttccagatccataggggatcactgcatgaagccttttgtgatttcagaaccagagacgaaggtgtacgcacgaacagaggcagatgagtttgtggtggtggcgagtgacgggctgtgggatgtagtgtctaacaagtatgtttgtgaggttgtacgaggttgcctccatgggaaaatgaggaggaaattaaaagaggagcccattataagctatgcaacagaagctgcagcgttgttggctgagttggctatggctcgtggaagcaaagacaacatcagtgtcatagtcatcccactcaacactactacaacttgatcgttccccatattcaagctatcgctcactttattttatttgcttctttcctcctttcttttgtttccaatttcattctctcttctaacttttcacgtctaatttttctaagttgtcttgtattgttaggatgggtatatttatctgaaagcatttagcttcaatatccgtaaggacgtatatagtgctagtaggattaattacaacgattacaaaattttcctaccacgagttaggggaatgctctttactaattttgtacagccagaaatatgtttttataagctcatctttagcggtaaaacttcggccatctctctcactaatattttcttctgaaaatagtaattacataaaaagcaaacggattttaaaaaagttacgcaaa

SEQ ID NO: 598 - DNA, 1176 bp, Glycine max var. Williams 82
atggcatcgcgcgtcagcattggcaaccttacctcctccgcgccgtatattaattcccctcactttcgctcaccacttaagatttccaacaacccctctctgcaaaacgcttcgcataaggtacttatgcgcgataagactgtactggtaaccggcggagccggttacatcggcagccacaccgttcttcagctcttgctcggaggtttcagagccgtcgtcctcgacaacctcgaaaattcctccgaggttgccatccacagagtcagggagctcgccggcgaatttgggaacaacctctcctttcacaaggtggacctacgggacagagctgctctagaccaaatattttcttccacacaattcgatgctgtcatacattttgctggactgaaagcagtaggagaaagtgtgcaaaaacctttactatactataacaacaacttgactgggacaatcactctattggaagtcatggctgcccatggatgcaagaagctcgtgttttcatcttcagcaactgtatatggttggccaaaggaggttccatgcacagaagagttccctctgtcagcaatgaacccatatggacgaactaagcttatcattgaagaaatttgccgtgatgtccactgtgcagagccagattgtaaaataattttgttaagatacttcaacccagttggtgcacaccccagtggttatattggggaggatcctcgtggaattccaaacaatctcatgccatttgttcagcaagtagcagttggccgacggcctgcactgacagtttttggaaatgattataatacaagtgatggcactggggttcgggattacattcatgttgttgatttagcagatgggcacattgctgcattgcttaaactagatgaacctaatataggttgtgaggtttataacctgggaacaggaaagggaacatcagttttggagatggttagagcttttgaaatggcatctggaaagaaaattccacttgtgatggctggccgtagacctggtgatgctgaaattgtttatgcatcaacaaagaaagcggaaagagagcttaaatggaaggcaaaatatggcattgatgagatgtgccgtgatcaatggaattgggctagcaaaaacccttatggctatggagatcagggctccaccgattaa

SEQ ID NO: 599 - DNA, 1068 bp, Glycine max var. Williams 82
atggactttcttaactttatgcttaacttgttggtccctccaggcagtatgctcaccttggctttctcatggccagcactttgcttcctcaatgtttgtgagtggctttataatagtatatatggtgaggatatcgataataaagtcgtcataatcactggggcatcttcaggcataggagagcaaattgcatatgagtatgctttgaggagagcaaatttaacgttggtggcacgcagagagcacaggctaagagggatcgctgagaatgcaaagagattgggtgcaagacatgtgatgattatggcagcagatgttgtgaaggaagaagattgtaggagatttgtcaatgaaaccataaatgtctttggccgtgtagatcatcttgtaaatacagtgagtttgggacatacgttctgctttgaagaagttacagacacatcagtattccctgttcttctggatattaatttttgggggaatgtttatccaacatttgtggctcttccttaccttcatcaaagcaacggtcgtattattatcaatgcatcagttgaaagttggttgcctatgccaaggatgagtttatatgctgctgcgaaggcagcattagtgaacttctatgagacactgagatttgagttgaaagatgaggttggaataacgatagccacacatggttggattggaagtgaaatgacgcggggcaagttcatgctagaggagggtgcagagatgcagtggaaggaagaaagagaagtgcatgtgatgggtggaccagtagaggagtttgcaaggttgatagtatcaggggcatgtagaggagatgcatatgtgaagtttcctagctggtatgatgtattcctactatacagggtgtttgctccaagagttcttaactgggcattcaggtttcttatttcgccacaagggacaagaagagcttcttcttatgtagggactggcaaacacattgaagctgtgggtatggtgagacctatggctatgctggagggaacctcacctacacacactggccagctgatcagccagcacaagctcgattaa

SEQ ID NO: 600 - DNA, 780 bp, Glycine max var. Williams 82
atggttatggcagttgagctttcaaaccaacttcaacacctctattttttctcccctccacttccattctattctctctttataaatttccttaccctgctgcactttcccatcatcaaacttccaattccaaactgcacttttgaacacaagcagccaaagcttcaaaacatggaacgttttgtgcgcctaactgtggtattagccatggctatggtgatggctgcaccagcctacgctcagatcagcagcacgccgatagtccggatgataaacagtttgttcaacccttgtatgaatttcctcacaaatagcagtgccaatggcacttcacctactgctgagtgctgcaattccatcaagtcactcacaagtggtggcatggactgtttgtgtctcattatcactggcaatgttccctttagaataccaatcaaccgaaccttggccatctctcttcctcgtgcttgcaatttgcctcgtcttccacttcaatgcaaaacctcaggcggttcaccacttccagctccaggaccagcggcttttgggccatctctttctccatctgctccatctcttagtcctgaagcttcctctgtacttccctcaccttctttggcaccagtgtctgacacaacccctcctcttttgactccgtcatctgcaaccactggaagtggccgttctgatctgaccccatcatctgccatgtcatcttaccgttttctaccttcagttgtgttgattgtgttaggatttgctgttcttaaacactactag

SEQ ID NO: 601 - DNA, 786 bp, Glycine max var. Williams 82
atggcattttctagttcctcaccatctataccagaaaaatacaagaaactcgtatcatctttcttctgttctccaaagctattcgccaatttcacatccaaagtgttgtgtgaaactgaggctatgatgagtccaacctacatacttgacaccaagcccttctctggcttgaagaacccttttcggtcagaaacaaacagccccagaaccccagttggtgaacacaagcgttgttgggataagttggattcaaaggggcttgttgatgctcttggtgaaataacatcaaagtcacaaagcagaatgattctgtttggatcccagctcaagattcagaatcatcctcccctgcctcatgcaacactttctcctaaatctgcttttgggtgtgccaattcagcttttgaaacctccaaatctccgagagttttctctgctagtgaaatggacctttcagaggactacactcgagtgatttcccacgggcctaaccctagaactactcacatatatgataactgcatcgttgagagtggttgttttgatgttggatgctcttcttctcccttggaaaatgtgtttcttcctcctcacatcagctatccctccgagagcttcatgagcttctgtttttactgcaacaaaaatcttgggcaggatatggacatctacatgtacaggggtgagagggcattttgcagccgtgaatgccgtaaccagggaatgctgttggaggaggggatgatcaaattggaaggtggagatatgtatatgggtcatagttga

SEQ ID NO: 602 - DNA, 222 bp, Glycine max var. Williams 82
atgctaatttgtttgaggggaaagtttaaaacggaacattattctgccgagggatgctgtgagatcaaacagtacttttctctccactttgtttattttcttcatattctcttggtgctcactttaatggcatttactttaaatctctttgctatctattgcagcacaaatgcccttggttttaccccaaaatttttaggacgtgtcaagctttatacctag

SEQ ID NO: 603 - DNA, 960 bp, Glycine max var. Williams 82
atggcgaaggagatagtgaaagagcttcttcctctaattcgagtgtacaaggatggcagcgtggagcgtcttctaagctctgaaaacgtggcagcctcccctgaagatccccaaactggagtctcatccaaagacatagtcatcgcagacaacccctacgtctccgctcgcattttccttcccaaatcccaccacactaacaacaaactccccatcttcctctacttccacggtggcgccttttgcgtcgaatccgccttctcctttttcgtccaccgctatctcaacatcttggcctcagaagccaacataatagccatctccgtcgacttcagactcctcccacaccaccctatccctgctgcctacgaagacggttggaccaccctcaaatggattgcttcccacgccaacaacaccaacaccaccaacccggagccatggctactcaaccacgccgacttcaccaaagtctacgtaggaggtgaaaccagcggtgctaacatcgcacacaacctgcttttgcgtgcaggtaacgaatccctccccggggatctgaaaatattgggtggattactatgctgccccttcttctggggctcgaagccaattgggtcggaggctgttgaggggcacgagcagagtttggccatgaaggtctggaactttgcctgccctgatgcccccggtggaatcgataacccctggatcaacccctgtgttcctggggcaccctctttggccactcttgcctgctctaagttgctcgttactatcactggcaaagacgagttcagagacagagatattctctaccaccacaccgttgagcaaagtggctggcaaggtgaacttcaactctttgatgctggcgatgaggagcatgctttccagctcttcaagcctgagactcatcttgctaaagccatgatcaaacgcttggcttcttttctggtttga

SEQ ID NO: 604 - DNA, 636 bp, Glycine max var. Williams 82
atggagactcatttggttttgttgcttgctttgatcttcactgtagttgccggcgttggagcccaaggcccatccacctctcccgcgcctcccacaccccagtcttcaccacctcccatccagtcttctccgccacctgttccttcctcacctcctccggctcagtctccaccaccagcttccactcccccaccagccccactcagctctcctccccctgcctcccctcctccttcatctccaccacccgcatctcctccccctgcctctcctcctccggcatctccaccacccgcatctcctccccctgcctcccctcctccggcatctcctcccccagccactcctcctcctgcttctcctcctcccttttcaccaccaccagcaactcctccaccagcaacgcctccacccgcattgacccctacacccctttcctctccaccagccacttctccagctccagctcctgccaaggtggttgctcctgcactctctccttccttggctcccggccccagcctctccaccatctctccctctggcgatgatagtggggctgaaaagttgtggtcctttcagaagatgattgggagcttagtattcggatgtgctttgctgtccttgttgttctag

SEQ ID NO: 605 - DNA, 4188 bp, Glycine max var. Williams 82
aaaaggtggttttaagttgaaaaaaataaaaagcatgagacaactttgacttgttattagtttggttcttgtagaaacagtgctggttcaaattcaaacaatcttggtggatacacacactagtttctcctccctcagaatgagtttagactcgtctcgctctggtaattctaaacgaagtttctctaattctatatcctccaacgattacattaagaagaagaaaaagaagaagacaacccccaaccagaaaaccctaggcgctgcttggggctcaaagtctaattcccgaaaacccgccttctccgattttgccagttatatgacagagaagaatcggaaattacacaaccagtttgaagctcaggcttccacctcatctttgactttaagtgcctctctattcagtggagtttcaatttttgtcgatggtttcacgattccttccaaccaggaactgcggagctacatgctaaagtatggcggaagatttgagaattatttctctagacatcgtgtaacacatatcatctgcagtaatctgcctgatagtaaagttaagaacctcagagccttcagtgcagggttgccagtggtgaaacccacttggattttagattctgttgctgctaatagactcttgagctgggtgccttatcaacttgaccagcttgctaataaccaaccaaaactgtcagccttcttcacattgaaaagtagtaaaatgtcagaggatgcttatacaaatgacctttgtcaagtagtatcagatattgaagattcatccatgagggttggccgatcagattcagaagatagacactcatccaaagttggggatatgagtgaacttagcgggcaaattagtactgaatctgatgatactatacctgagaatactaatgcaattatgatggaagagctaactagtgttagagagcatgcaggaggaagcaatgctgctactaaagatgagagaaatgtcaaaggtgaacttgaacccgctcatcaagcaccttctacatcatttagtactccatgctcagatgagctgaatgtaaaagaatatccaaattcttcaggcactaagccttctaaacagtgtcattctactcttgcagaccctaattttgtggaaaactatttcaagagctcacgactacattttataggaacctggcgaaatcggtatcgaaagcgttttcccaccttgtctactgggtttaacaatgaaagtgctaataatagtgcctctgatatttctcataattcagtcattatccatgttgacatggactgcttttttgtctcagtggttatcaggaaccaccctgaattgttgggccagcctgtagctgtatgtcattcaaataattcaaatggaactgctgagatttcctctgcgaactacccagctcgtagtcatggtattagggctggtatgtttgttcgagatgccaaggcgctttgtccccatcttgttatctttccatacaactttgaagcttatgaggaagtagccgatcaattttatagtatattgcatcagcgttgcaagaaagtgcaggctgtaagctgtgatgaagcatttttagatgccacagattcagaggttgaagatcctgaactcttagcttcatctattagagaagagatctataagaccactggatgtacagctagtgctggtatagctggaaatatgcttatggctcgtattgctactagaactgcaaaaccgaatggtcaatatcacataactacagaaaaagttgaagatcatttatgtcaactcccaattaatgcacttcctggaatagggtatgtcttacaggagaagttgaagaaacagaatgttcacacgtgtggacagttgcgcatgatttccaaggcttcattgcagaaggactatggtatgaaaacaggagaaatgctgtggatttatagcagaggaattgataaccggttagttggaggctttcaggaaagtaagtctgttggggctgatgtaaattggggtgtgagattcaaagatataaaagactgtgaacacttcctaataaacctttgcaaggaggtctcgttacgattgcagggttgtggagtgcaggggcgcactttcactctcaagatcaaaaagagaagaaaaaatgctgatgaacctgcaaagtttatgggctgtggagactgtgaaaatttgagtcactcagtaacgattcctgttgctactgataatgtggaaatactccaaagaatagtaaagcagttgcttggatgtttttacatagatgtgaaggagattcgaggtattggcttgcatgtttccaggcttgaaagtgcagaagcttctaaacaaggtcatgacaagcagaacagggatagcacttgcagtcgtgcttgtagagatttgccagggtcttcagtagaaatggacaataaaatacctaataaccaagcaagtaccaacccaatttcaacaccccctcctttatgtaaccttgatgtggaagttatacggaatcttcccccggaagtattttcagaattaaatgaaatttacggagggaagttaattgattatattgctaacagcaaaagcacaagtgagaattctagcccttcaggcaactcatttttggagcaagcaataaaaaaggaagaggaactttcctattctaagccggttcctcaaaacaatccattatcaaaaaataaggcaaagcagaatgaggcaggcacaggtgaaggtgaagcagtaccatattcagtgtgtggaccctatttcaaggttactcaccattcaagttttgaaaaagatgatttattgccttcttcttttagtcaagttgatggttcagtgtttcaacaattgcctgaggatttgaaagctgtcattgttgagcagcttcctgcacacaggagggcagagatttgctccaatgttgttgtggcccctcctcttgaaaaccattcattgtcagtaggcattgaaatttctgagaattttcctggatcaagttatcatgacaacttatgggccgggaatcccccaaattgggttgggaagtttaaagttagcagttgcttaatgttaaagaaacttgcagaaatgtattacaaatcagggttgactagcacattatccttagttttgcaccaaattatatctgaattctatgagctaaatctggcccagcagttttctgatgaaactgttaacattatgtgtgagctactgaggcagtatatcaaagtgaagatagaaagagatattgaagagatttatatttgttttcggcttctgaaaaggtttgcagctaagtcccagtttttcctacaagtatataatagtgtatgtccttaccttcaggcaactgttgatgacaattatggagggactttgcttttataatcatagtagcactcaaatgagtgaattcttacctactatgggaaacttgagcaaaattctctggtttaactgaggtcagatccaattcaacagttgctattcaccactgatgctgctgaggtgtcacagtgaaatggtactgtagctcagtcgactttcaaaaggcagaagattaattaattttctgcaagtgaggcatgtggggattggggaccgtactttttccaatcaaattacacgtaacttgacattgacgccaaatccaagactccttggaagagtagttttcttgccactagcaattggaatgatataaacatctctccattttcgagtggattgaggtggaagaaagagagaaacaaggaaaggtaaagacaggagagtaagtaatatatgtgacgagattgggaaaaaaagagatatgaagaaaatggattaaaaataaagtggaagagaaagtgaatatatgtttataattgttatttacaagtcaatactcctacattgcatctggttggaagcggagaaatttgaccaaccaatttcattctcacaagagcggctgtttaatttggcttggtctttcgccaaattaattggtagtacatacgaatttgctttttagatttttgcttcaaagaattgtttatgtcaagataattgagagatggttaacttttgaataagtacccatgcttgacttctgaaacctaaatatactgcctagattaatttcttatataatcttaatccaaaatcaattacatttattt

SEQ ID NO: 606 - DNA, 180 bp, Glycine max var. Williams 82
atgaagaggggttataattatctttcagtggctatttatgtgatgatgtttttggtcttggtctcgtactcctccatcaaggttgagggaatgagaccgctgaaagctgatccatccttcataagtttgataatcaaccgggcttattctgggccaagccacagaggacgcggtcattga

SEQ ID NO: 607 - DNA, 504 bp, Glycine max var. Williams 82
atgctctttcacttgcttctctctttttctgtccttttgcttgtgatgatgggtttcatttcttttccttcatgtaaatttcaggatgattttgtgtatggaatatatgatgaccaccacacttaccacgaaggagaacagaaaggaacattttggggctcaattgcagaagagatggcagtagcagaaccccccactggattccaggggattatttcatggctcttcccaccagccattgctcttggggtgtacttcaatgttccgggggagtacttatacataggagcaggcatatttacaatcatattttgcattattgagatggataaacctgataaaccccaccactttgaacctcacatatacaatatggaaatgggagctcgagacaagttgataaatgactataatactacgagcatatgggaattcaatgaaaaatatggggacctatgggatactactattattatcaagaaggatgacattatgaagagataa

SEQ ID NO: 608 - DNA, 2787 bp, Glycine max var. Williams 82
atggaaacagcgctcacttgcttcttctgtggtagactccctcctgcaactgcaagtagtcagcacttccgttgtagtaatgcttccgcctccggactcgtgcgtttctctttgcctccttcatttaggctgattcgaaacgccactaacaccagtgaaactaatgtcaaaagtagaagaaggagaagaagaacttgtccacctctggaggtggaggagggtattcttcatcagaacggagaccctttcgggaagaaggatctcgggaagagtgtgatgagttggattcgtgatagcatgagggccatggcgtctgatttagctgctgcggaattagagggaggagagggagagtttgagttgtgggagcgcatgggtccgggtctcacttttattatgctggcacagccatatctcaatgctgttcctatgcccattggcctcgagggtctctgcttgaaggtctgcactcactatcccactcttttcgaccattttcagagggagcttcgccaagttctccgagactccttcattcaggactggcgggacaccaagtcttggaaactgcttaaggacctcgctaattcggctcagcatagggcggttgtaagaaagataacacaacccaagagtgtccaaggcgttttaggaatggactttgaaaaggtcaaaacaatacagcacaggattgatgaattcacctcccacatgtcagaactactccgtattgaaagggatgctgaattggagtttactcaggaggaattggatgctgttcctaaaccagatgatacttctgattcttcaaaaccgattgatttcttggttagccatagccagcctcaacaagaactctgcgacaccatttgtaatttaaacgccatcagtacctctagagggcttgggggaatgcatttggtgttattcaaggttgaagggaaccaccggttaccacctaccgctctttcacctggagacatggtttgtgtgagaacatatgacagcacaggtgcaattacaacttcttgcatacaaggatttgtgaacagttttggcgatgatggctatagtattacagttgctttagagtcacgccatggtgatcctacattctctaaactatttgggaagagtgtgcgcattgaccgtattcaaggactggctgatacacttacctatgagcgcaactgtgaagctttaatgctgctccagaagaatggtttaagaaagaagaatccttctatttctgttgttgctacactgtttggagatggggaagatgttgcatggcttgagaaaaatcaattggttgactgggcagaagaaaatttggatgcaagattaggaaatgaaacctttgatgattctcagcagagagcaattgcaatgggtttgaataaaaagagacctgtattggttatccaaggccctcctggtacaggcaagactggtttgctcaagcaacttatagtatgtgctgttcagcaaggtgaaagggttcttgttacagcacctactaatgcagctgttgataacatggttgaaaagctttcaaatgttggattaaatattgtgcgggttggaaatccagctcgtatatcaaaaacagtgggatcaaagtctttggaagaaattgtaaatgctaagcttgcaagttttcgagaagagtatgagaggaagaagtcagatctaagaaaagatctaagacattgcttaaaggatgattcactagcttcaggcatacgccaacttctgaagcagctgggaaggtcactgaagaaaaaggaaaagcagaccgtagttgaagttctatctagtgctcaggttgtgcttgccactaatactggagcagctgaccctttgattcgaaggctagatacttttgacttggttgtcatagatgaagctggacaggcaattgaaccctcttgctggattcctatattgcagggaaagcgctgtattcttgctggtgatcaatgccaacttgctcctgtcatattatctagaaaggccttagaaggtggtctaggaatatctctactggagagagctgcaactttgcatgaagggattctcaccactaggttaacaacacaataccgtatgaatgatgcaattgctagttgggcttcaaaggagatgtacggaggattattgaagtcctctgagactgtcttttctcatcttctagtgaactctccttttgttaagcctacttggataacacaatgcccactgctattgctagatactagaatgccatatggaagtctgtcagttggttgcgaagagcatctagacccggctggaacaggctcactttataacgaaggagaagctgagatagttttgcagcatgtattttccttaatctatgctggtgttagcccaactgctattgcagtgcaatccccttatgttgctcaagtacaacttttgagggacaagcttgatgaatttccagaagcagcaggtactgaggttgcgaccattgacagttttcaaggtcgggaagctgatgcagtaattttatccatggtacgatcaaacacattgggagctgttggattcctcggggatagcagaagaatcaatgttgccatcacaagagcacgcaaacatttagctttggtctgtgacagctcgactatatgccacaataccttcttagcaaggcttctgcgtcatattagacactttggtagggtgaagcatgcagaaccaggtagttttggaggatatggacttgggatgaatccaatattaccttccattaattag

SEQ ID NO: 609 - DNA, 453 bp, Glycine max var. Williams 82
atggcagatgttctgagtgaagaacagattagtgagatcaaagaagcctttggcttgtttgacaaagatggagatgggtgcattactgtggaagaattggccacggttatccggtcattggatcagaaccccacagaagaagagctccaagacatgataaacgaggtagatgcagatggtaatggaaccattgaatttgttgagtttttgaacttaatggccaagaaaatgaaggaaactgatgaagaggaagatctcaaagaggctttcaaggtgtttgacaaggatcaaaatggctacatttcagcaagtgagttgagacacgttatgatcaatctgggtgaaaaactaactgatgaggaggtggagcagatgattgaagaagcagatttggatggtgatggtcaagttaattatgatgaatttgtcaagatgatgatgactattggatga

SEQ ID NO: 610 - DNA, 2292 bp, Glycine max var. Williams 82
atggtgaaattctcaaaggagctcgaagctcaactaataccagaatggaaggaggcctttgttaactacaggcagctcaagaaacacataaagaggatcaaactcaatagagtttcgaagcaattacaagccccagaagagacctttggtcgctccgttttcgattcctttcgcttcataaccaacaagttctgcaattcagacaacaatcataaacaagacatgatccaggtgaggagaaaaacaacggaagagagtgaagaagtgtatgaaactgagctggcacaattgttttcagaagaggatgaagtgcaagtgttttttgcaaagctggatggagagcttaacaagataaaccaattctacaagaagcaagagactgagttcattgagagaggagaaatgctgagcaagcagcttaacatcttgctagaccttaagcaaattctcagcgaccgacacaagaaaaatccgtcgctaaagccttctaatactggagtttttcctcatcctccaggccaagaaagtattggcgaatcaattcatgataattcagaagtttcacaaatggatgaagtaatctcaacgttggaaagaaatggtctaagttttgcgaattcggcaatgagggtaaagacaaagaagaagggaaagcctcatatggccttaagaattgatattccagccaccactcctacggctgttacttccatgttgtgggaggatttggtgaacagtccaattaaaccagagtatggtggagagttcattaacaagagaaaaattcagtgtgctgagaagatgattagaagtgcatttgtagagctctataaaggtcttggccttctcaaaacttacagctcattgaatatggtagcattcacaaagatactcaagaaatttgacaaggtgtctaatcaaaaggcttctgcaaattatatgaaagaagtgaagagatcccatttcattagttctgacaaggttgttagactaatggacgaagtggaatccatattcacaaagcactttgccaacaatgataggaaaagagcaatgaagtttttaagaccccaacagccaaaagtttctcatacggtcaccttccttgtcgggttgtgtacaggttgttctgtatccttgttttgtgtatacgtaatcttggcgcatatgtgtggtatattctctcctagtacagaaccagcttatatggacgctgtctacccagtttccagtgtgtttgcattattaagcctgcacttgtttatgtatggatgcaacctgtacatgtggaagagtacaagaatcaaccataatttcatatttgaattctcaccaagcacaacactgaagcacagagatgcatttctgatgtgcactaccctcatgacaactgtgtttggggcaatggtggtacacctgctactaagggctggaggtttttctcctggccaagttgatgccattcctggaatcatttttttgttctttgtaggtcttctcatttgcccatttgacattttttatcgccctactcgtttttgcttcatccgggttattcgtaacatagtttgctctccattttataaggttctgctggtagacttttttatggctgaccaactaactagccagattccattgctaaggcatttggaaacaacaggttgtcacatttttgctagagttttcaagtcacaccaccctgaggcatgccattctggaaggctatacatagaaataacttaccttatctcatttttgccatattggtggcgtgcattacagtgtgcaagaaggtggtttgatgaccgtgatgtcaaccatttggctaacatggggaagtatgtgtcagcaatggttgcagcaggagctagagtcacatatagcaggcaagatagccatctatggtttgctatagtcttgatcacttctgtggtggccacattttaccaattgtattgggattttttcaaggactgggggtttttcaatcccaaatccaaaaatccttgtctcagagatgatctaattctaaagaataaatgcatatactacatgtctattgcattgaatgttgtcctaagagtggcttgggtggagactataatgcacctcaaagtggggcctgttcaaactaggctactagactttttgttggcttcactagaggttattcgacgagggcattggaatttctacaggttggagaatgagcatctaaacaacgtgggtcatttccgggcagtgaaggcagttccactaccatttcgtgacatagactcagacagctga

SEQ ID NO: 611 - DNA, 1260 bp, Glycine max var. Williams 82
atgacaatgaagctgctgcttttggtagccgttgttgaagttgcatgcttagtttctgggatcttgtcctttggatctgagacactctctgagctttctttcttagaaaacgatgtcgtctcaacagcaagaccttcctcttcatctcaacctcttatggtcgacctcactctcattcaaggagctgattctaaaggagctgtctgtttggatggaacggtgcctggataccatttggatcgtggatttggatctggtgcagatagttggctaattcatttggagggaggaggatggtgtaataccatcagaaactgtgtctatagaaaaaatactcgtcgtggatcctcgaaatacatggaaaatcaaataccattcacgggaatattgagcaacaaacctgaagaaaaccctgatttctttaactggaatagagttaaattacggtactgtgatggggcgtctttcagtggagatagtgaagatgagtctgcacagcttcaatttcgaggacaaaaaatatggctagctgcaatggaggaattaatgtccaaaggaatgcagaaagccgatcaggcacttctctctggatgctctgcgggtggtctggcatcgataatacactgtgatgagttccggagcttgtttccaaaatcttccaaagtcaaatgtttgagtgatggaggtttttttcttgacgtaatggatgtatctgggggacgcacactgaggactctttttggaggtgtggttcagttgcaggagttacaaaaaaatctgccaaaaagttgtcttgaccaactagacccaacttcgtgcttctttcctcagaatatgatcgaacatgttgagaccccattgtttctactcaacgctgcttatgatgtgtggcaggtccaagctagtttagccccaccttcagctgaccgccttggctcttggaatgaatgcaaatcgaaccatgcaaattgtagctcatctcaaatgcagttcctccaagacttcagaaatcaaatgcttagtgacattaaagacttctcgagctcatctcaaactgggctattcataaattcttgttttgctcattgtcagtctgagagacaggagacatggtttgctgatgactctccccttatcgaggacaagccaattgcagttgctattggagactggtattttgatcgagaagttgtcaaagctattgactgtgcttacccgtgtgacaacagctgccataatctggtgtttaactttaagtga

SEQ ID NO: 612 - DNA, 2092 bp, Glycine max var. Williams 82
atcgtcaatgatttgcatttgtcgattattttcatttcttcttcctctctcttcgttctcgctctcttattcctttctctcttgtcttctctccgaatccacgtcctagatctgttgttctcttcccacagttctcactgaatcaggatccattttgataccaagttgctgtttagagatctgtttccttctagacaacggtctgtggtatctgttattttagttgaatcgaagctgcaacaaaatcttcctgatctttgctttgaggttatggcatcggcgggtgtagcacctgcttctggggtaagagatgtgaatgcaagttctgttgctgttgaaaggttgcctgatgagatgaatggcatgaaaattagggatgaaagggtaaagttaaaatgtctattttatcttggtctgtttgcctttcactttgcatcacgccttcacccatttgagcaacttcctgataaatatgtagtatacttatgtagtaacctgttaaaacaaaatgcaggaaatggaagcaactgtggtagatggaaatgggactgaaacaggacatataattgttactaccattggtggtaaaaatggccagccaaagcagacaataagctacatggctgagcgagttgttggaaatggatcatttggtgtagttttccaggcaaagtgcttggagacaggggaaactgtggctataaagaaggttcttcaagacaagaggtacaagaaccgggaattgcaaaccatgcgtcttctggatcaccccaatgttgtaactttgaagcattgcttcttttcaacaactgaaaaagacgagctttatcttaatttggtacttgagtatgttcctgagactgtccaccgagttatcaggcattacaacaaaatgaatcaaagaatgcctttgatatacgtgaaactctatttttaccagatatgtagagcactagcttatattcacaactgcattggagtgtctcacagggacataaaacctcaaaatttactggtcaatcctcacactcaccagctaaagatttgtgactttgggagtgcaaaagtcttggtcaaaggcgaaccaaacatatcttatatctgttctaggtactatagagcacctgagcttatatttggtgcaactgagtacaccacggccattgatatctggtcagccggttgtgtacttggtgaactattgcttggccagcctctattccctggtgagagtggagtagatcagcttgttgaaattatcaaggttttaggaaccccgacaagggaagaaatcaagtgtatgaatcctaattacaccgagttcaaatttccacaaattaaagctcatccatggcataagatatttcacaagcgtttacctcctgaggctgtggatctcgtctcaaggctactgcaatactctccaaatcttcgatgcacagctctggaggccttggctcacccattctttgatgaactgcgtgatccaaatactcgcctaccaaatgggcgttaccttcccccactctttaacttcagagccaatgagcttaaaggagtgcctccagagatgctggtgaaactgattccatctcatgcaagaaagcagtgtgccttgtttgcgtcatagtgttgcctcgtgtaaatattatctactccgcctgtagaaatgtatgtagtctgttccaagttgttaatagtttctcccaccccgtgtcctttgttctgttaatttgtccccctcacctgaagaagaaaaagaaaaaccccaccttccaatttgatatatttcttgttgccttaagaaagctgtttgagaagaagcttcaacttgatttaattggtttcctcatcttcaaaattttaacagattgcattaagtattaatattaattagaaggaccgttgtatactcaagtagtatacttgaacactagtacgatgtaatccgggaggggatgtttttaaagcttgtttgtctgctccggcctctccttaattatgagaaattttactttggatggttatcttgctttcaaggatttgttgtttttcatattcccatattattcaatgttatggtgtaacttgc

SEQ ID NO: 613 - DNA, 372 bp, Glycine max var. Williams 82
atggataataagaagagaggggcgagggagggtgaagatgaagatgagatgaagatggagaagttttacgcgctgttgaggaacttccgcgacgcccgtgatcgccggcgaagggagttggtggagttggaaaaacacgagagcaacatctggaagaagatgatgaagggcaccgccccaactgcaacgaaggacaataaggcagaagtttctttcgaatttcaggactttaccaccgagattcaattcagaaagccacctttggtttttcctaatccagtttcatcatgtgacactagcaaagacaacaacaaaggtaacaagaagaagaaacagcaggatcttgctctcgatctcaaactcgctctctag

SEQ ID NO: 614 - DNA, 2115 bp, Glycine max var. Williams 82
atggaaactatgtgtttaaaatctgggatagttcccacgatctctattagtgggtcgctggacgcacgtgccaatccttcccaggtgagcacggtggggcgctccgcatcggataaaccgccgcagaggtcggtgttttcgagattttccttttggtaccctttggaatctctctggcctcgggggaacaacagcaggtacaaggggttggccctcgacgacgccgttttgtcggacaacaacgccgaagcgaaggccgttggagatgacggaacggaacggcagaccggaaactgggttttgaagattctgcatgtgaagtccctgtgggaggggaaacagcgcgatgaagaggagggatcggttcgtgatcaaactcaaaccaattacgaggaggaggaggaggtgtgtgaatgtgatgcttgcgatgaagtagaggaggctcaattcgatagaggctcgttttcgagaatgcttcggagggtatcgttagccgaatctagattgtacgctcagatgtcacacttggggaacttggcttacgatatacctagaatcaaaccagggaagctcttgaaacattatggtctgcgctttgtaacttcatcaatagagaagaaggaattggcagtggcagcaacagctgaaaaggatccccagaaagttcaaactgatgagaaggtagacgaaaaagaagagagaaaggatcctaagaacggtgaatacaagataagtgcaactgctgcttataatattgccgcctctgctgccacttatctgcattctcagactagaagcatatttccattgaaatcctcaaatgctgtggctggtgaaggttcacttgcagggaacaatgaaagccttgacagtgttaacatgctaaacacagaggtggcatctttgatggcaactactgattcggtgacagcagtggttgcagcaaaggaggaagtaaagcaagctgttgcagatgatctgaactcttcacattcaacaccctgtgaatggtttgtctgtgataatgaccagagtggtacaagattttttgttattcagggttctgagacattggcttcctggcaagcaaacctactttttgagccgattaaatttgagggtttagatgtacttgtgcacagaggtatatacgaggctgctaaagggatatatcaacagatgttgccagaggtacatgctcacctaaaatctcgaggctctcgtgctacttttcggttcactgggcattcccttggtggaagcttggcattacttgtgaatctcatgctgttgataaggcatgaagtgccgatctcctctctacttcctgtgataacatttggttccccatccatcatgtgtggaggtgatagtctgctagaaaagttaggtttgcctaagagccatgttcaagcaattacaatgcacagagacatagtaccacgagcattttcttgcaattaccctaatcatgttgcagaactattgaaagctgtcaatgggaacttccgtagtcatccttgtctcaataaacagaagctactatatgcaccaatgggtaatctgctgattctgcagcctgatgagaagttttcaccaagccatcatctcctgccatcaggcagtggtctatatcttttgtgttgtcctttatcagaatccaatgacacagagaagcagctccgagctgctcagatggtcttcttgaactcacctcatccacttgagatattaagtgaccgatctgcttatggatctggaggaagtgtacaaagagatcatgacatgaattcctacttaaaatctgtgagaactgtgatccgccaagaacttaaccagatccgtaaagccaagagagagcaacggcgcaaggtgtggtggcctcttttattacctcgtggagttgataccagcattgttgctgggaggtccatgatatcaatcaatgtgggtcaacgccagtcacccttctccggcgtgatacaaacagggagagaatccctgaaaaggttcagtagggttgttacatcccaacatatgcatttgtttgtgttgcttttgttccctgctcggttgttactcttgggaacatatagcgtaattaacctcaaatga

SEQ ID NO: 615 - DNA, 630 bp, Glycine max var. Williams 82
atggctccttttcctcttatgtgcttcgttattttgctcctatcctccactgtttcagtcacagccaccgccacccaaacaaccttaacagtgggaaaactcgaccaagttccacacataatgtgcaaggagtgcgagcttccacccccaccccctaaagagtgtcctccgccgccgataccactagcacctccaccaccgttaccaccatcacctccaccaccgttaccaccatcacctccaccaccgttaccaccatcacctccgccacccttaccgccacctataccgctatctcctccgccacccttaccgccatctcctccgccacccttaccgccatctccttcgccgccaaatctaccatcaccaccaccactggctccaccaccaccattaccaccacttgcaccaccaccaccaccgctacccccattgccgatcccaccaaacggacccggcgaatacctagtgccaccaccgcgcgatccgaacctgccagatcttgacgatctcaacggtgcaaagattattaatccactgctatgcttttcaaacactagttacttctcgttgcactccttcactcttctggtccttctttgcctcccctattactttttcatgtga

SEQ ID NO: 616 - DNA, 1158 bp, Glycine max var. Williams 82
atgtacatttccaactgtaagcaggaacatgagcattcaaaaaatgttaatggactcccgctatatatttatacctctctttctctctctaccatactcttcaactcttctctttcattcgtcattatcgtcggtgctggtgtatccggtatctctgcggcaaagctgttggccgagaatggcgtaaaggatcttgtaatcctggaggcttcaaactgtattggcggtaggattcggaaggaaaacttcggcggtgtgtccgtcgaactcggagctggttggattgtcggagttggcggcaaagagtccaatccaatttgggaactcgtcgctgaatatggccttcgaacatgcttctctgactacacgaatgtgccatacaacatatatgatcgcagtggaaagatattttcgagtggaatcgctgcggactcgtacaaaaaagctgtggactcggcaattcgaaacttaacgaaccaggaagaagccgatcgccaaggcaatagctccaaaacaactgaaccaccttcgtcgccattagagctagcaattgatttcatcctccatgattttgaaatggcagaggcagtaccgatatctacctttacagcgtttggcgaaagggaatttttggttgcggatgaaagaggttttgattatttggtatataaaatggctgaagattttttgttgacatctgagggtaaaatactggacactcgtctcaaactcaaccatgtggtccgggaaatagagcatcggggaagtggcgttagggtgataacagaggatgattgcatttatgaagcaaattacgtacttgtgtccgttagcattggggttctccaaagcaaccttgttgccttccatccacccttacccagatggaaattagaagccatagagaaatgtgatgtaaccgtgtacaccaaaattttcctgaagtttccatatcagttctggccaagtggacccggaaatgaattcttcatatatgctcacgatcaaagaggctactacacattttggcaggtacctgataagcagaggttcctaaaccgaaaacaaagtcaagaggaaaatcatctctgctatagttatcagcgccgagcactcccaccaccaagttcacaagtagtgctaagaaactcactatga

SEQ ID NO: 617 - DNA, 417 bp, Glycine max var. Williams 82
atggcacccacaatctataatttttcgtattctaaaaggttttcagagtcattcaattcttcaacatcaaaaaaggagtcatccagttccaacatccttgctttccactccatagctcaatggaatgctcattataaagccaccaaagaaactaacaagctgatggtacttgatttcacagccacatggtgtggaccttgcaaactcatggaccctgttatcctagagtttgctggaaattacacagatgttgagttcatcaagattgatgtggaggagttaacggaagtgtctcaagcactccaggtccaccaattgccaacattcgtactcgttcagaaaggcaaagttgctgatagagtggtgggggtgaagaaggaggagctgaaaaggtcgattgagaagcacataaaataa

SEQ ID NO: 618 - DNA, 225 bp, Glycine max var. Williams 82
atggcttcaccactcaagttcactgtgttctcagcttgtgttttggttttgtttgtggtggttactgctcaatatggagatggtggtaactatggctctgacatgcctaaggacatgcctatgggtccagcaccacattccaatgcttctcttacttatcctgcaatcataactattctctttccctttatgcttgcctttcttgcagccaaagagagaatttaa

SEQ ID NO: 619 - DNA, 2142 bp, Glycine max var. Williams 82
atgaaaacaaaacaaaacatagatagtagaatccaaaacactaaactccaacacgtacctttttccatgatccgaaacacaaacaggtcggatcgccgggtactaacctccccggtggttcacccatgcgataacatcgctctctctacccttctcccttccctcatcactctctccaacgccatttccaatttccaacacagttccttcccttgcaacaagcgaaacgcgagaatcgcgattcgcttgacccggcttctccaacccttccttcacgagatccgagaccatcattcgggtcttgcagacccggcaaccctgagcctctcggagcttcatttaaccttccagaagcttcttttccttcttgaagatctcacacgtaaaggtgccaagctttacatgttaatggaatcggatcgagtcgcaactcagtttcgggtcatatccagatccgtggccacagctttggacgtttttcctttcggttctgtggagatctctgaggaaactaaagagcatgttttgttgctgaacgagcaagcaaggagggcaaggcttgaatttgagcaagaagataaacgggttgtggtgagtgttgtgtcgggtttgacccgatttgagaaccgggttcccccgggtgagggtgatttgaagtgggttcttgagtatattggggttaaaaagtggagtgagtgcaacaaagaggttaagtttttggagggtgaaattgggtttgagtgcttgaagaatgaggagaaggggaagatggtttttttgagtagtttgatggggttcatgagttattgtagatgtgtggtgatggaggatgttgattgtgaagagagtaacaaaaaaattaatgtaagagaaagtagtgttgagagtgaggtgagtctgagtttgacttttcttaactcggatgattttagatgtccaatctctttggagttgatgagtgatcctgtgactatagagacaggtcacacttatgatcgttcttcgattctgaagtggtttagtagtgggaatttgatgtgtcccaagacgggtaaaaggcttagcagcactgaaatggttccaaatttggtgcttagaaggttgattcaacaacattgctatacgaatggcataagcattccctttgttgattcgagtcataggaatcgtaaaattactaggacagaggagccagggagtgtggcagcagagggagcaatgagaatgttggctagttttctgaatggaatgattgagaatggaagtggagaagagaagaatagaggtgcttttgagataaggcttctttccaagacaagcatttttagtagatcttgtttggtggaagctggtttggctcctcttctgttgaagttgttgtcatcgagcgattcgttgactcaagagaatgctgctgcagcccttctcaacctctcaaaatgtgcaaagagtagaagtgtgatggttgagaaatggggtttggaattgatcattgatgtcttaaggaaggggctgaagattgaagctagccagcatgttgctgctgtgttgttttaccttagtgccgagtatggaaacttgataggtgaagagccagaagcaataccatcattgataaggctaatcaaagatggctcttatcgaagcaagaaaaatgggttggttgcaattttcggccttcttaagcacccggaaaaccataggagggtgctagaaggtggagcaatttcttcgctagttgacatcttaaaagggtgtgaaaaggaagaccttatcacagactcgctcgcaattctagcaactctggcagagaggagtgaggggatgttagcaatccttcacggagaggctttgcatgtagctgttgaaattttgagttgttctacttcaagggtgggaaaggagcactgtgtggctttgttgctttctttgtcactacatggtggagaagatgtggttgcttatttagtgaagagaacttctctaatgggatctttgtattcccaactcagtgaaggcacatcgagagcaagcaagaaagccagtgctctcatcagagtcctccatgatttttatgaaaggaggtcctctggtttcaaggcttcagttattccacaagaacagttcattcatgttcggtaa

SEQ ID NO: 620 - DNA, 1380 bp, Glycine max var. Williams 82
atggcagagattcagtcaaaacaagcagcatcgtcatcaacaacatttgtcagcaatagcatatttgtctgcaaaaggatttcatacttgcttgtctttgtgagtgcaagaagtcagaaatttaagtgtaacttaatatcttcatcgtatcagagatgccgattatcggagcagatttgcagactcgctgttattctcactcgctcttcatcttcgcacccttctcttcgaatctcaagtaagaaaatgtttgcaagtgcatttaggagctgcctagaggaatttcgggacttgaggttttcttccacggatgttgcagacaattgggatggaatgcttcctctcaaaaccaccagcatcagcgataccgagatacataattatcagataaacctgaagggaagtggttcctctagaataactcgactatctccaaacataaaaaatggggaaaaaatcagtggtagtgaagtttgtatgtcttcttttgttagccttgatctcttactggtttttcttacaaatgagtgcaaccagttaccaatgtcgccatcaaatctagaacttctcaagtcaggcattgaagactatgtacttaagcttggaaataatttaagtaacaagtgtaactcttgcttccctaatttgaaacgcaaagttgggagtggggaagcttgctgcgctgataatcgactacgcactgaactggtgatggaggcagtcatagtaataagtaatatatcaatgcagaacacaacgtgcttcagggaatatgacaataaaacagaggttttgtatttcaaggacttttcaccttgtacaatctcccaatcatctgtgaaggcattgcaaagcattgactggaaaacatatggtttgaatttaggaggcgtagtggagcaagatggcgttacattactacaatgggaaaacttgcctacagatactcacattgatattttgctacactcgtatcataaacaatatccaaccatgataccagctccaaggaaaatgtctccacttgtcagaaaccttgttaagagagcagttaaactttccctagatgacttgaaggcgaatcattcccaggcttttttaagttcacgtgacgtcgagacaattgctgggatcttgtcttcctgtgacttggatttccagggagaatgcatttctcttcttggattacagtcccaaggggttggaactgaaattgtggaaaactgtattgaggaaagaattgtttcagttgtagagatggacaacaagaagccccacaattctcaagaacccgcacctttccttttcgaagaagaccctgtcgaggaattagagtttcaagaaaacgatttcagccccttgaactctttactgttttaa

SEQ ID NO: 621 - DNA, 1047 bp, Glycine max var. Williams 82
atgacgtcgatcaaatcattgagatggccgatgagaaaaaaaagtggattgtctgatgtgcgaaaatcaagtttcaagacaaaacaactgtcttttctggcagttttttgtacaataatgttcattatgtatagaattacaaagtatcaatatcaccaagaagagattgacaaaaaatcgagttcctggggagaaccaaaggtgtatcctacaacttctgggaatttgaaagggttgccacaaggtatagttcatgctaattctgatttggagttaaaaccatcatggtcgacaagtagttcaaggtcaaaggctgttttctctaaccgtaacttattggcagttccagttggtattaaacaaaagcataatgttgatgttatggtgcaaaagtttcttcaagaaaactttacaattattttattccattatgacggcgaggttgatggatggtggaatcttgactggagtagcaatgtcatacaaattgttgctcggaatcaaacaaagtggtggtttgcaaaaagatttctacatccgaatatagtctccatttatgattttatctttctttgggatgaggatctaggggtggagcatttttcaccatcaagatatattgaaattataaagcaagaaggtttggagatatctcaaccagctcttgatccacattcaacagagatacatcatagaattacaattagatctataaccaagaaatttcataggagagtctatgaacgacgcaaacgccgtgcaaggtgttcagattcaagtgaggaaccgccatgcactgggttcgtggaaggtatggctccggttttctctcgatcagcctggtactgtacttggcatcttatacagaatgaccttgtccatggatggggactggatttgaaactaggatattgtgcacagggacgtcgaactaaaaaagtgggagttgttgatagcgaatatgtttttcataagggaatacaaactttgggtgggagtggtcacagaatgacaaaggtttcaaaactacaaaagacaactatgtag

SEQ ID NO: 622 - DNA, 1215 bp, Glycine max var. Williams 82
atgagtcggaataaaaaagggttaaaactcaaaaggacaagctgtggcatatccatgaccactgaaaatggcacttttggttgcatgtaccttccttcatcccccccttttccattgttcattataaataattgctgcactttgtttctaacagcaaacacaactccaccactattatacaactataataataacggctgcatagatagcacactttcatttttctcttatctccttttctcttctataactatgtctcatctgagccacaagaccttggtttatcttcctgaaatgaggcctgaacatgaagctgaggaaggccaagccaatagtcttagttccatttcttcttggcctcatcgtttggagaatgttttccctgtttatgccatgggaacttccaaccctgtcttgaattcttcacttcacatttcggattgtcttgatcctatttgggatgttgtcagagaagaagccaagttagaggcagaaaaggagccaatattaagcagcttcttccatgccactattctatctcatgattgcttggaggaagcattggcttttgctcttgccaaccgtctccaaaagcctactcttttggctactcagcttatggatatattttctaatgtgatgaagcatgataaaggtatccaacaatcgattcgcttggatattcaggcatttaaagatcggaatcctgcttgtttgttatattgctcagcacttttatttatgaagggttaccagtctttgcaagtatatcgagtagctcacgctttgtggaggcagggacgcaaggttttggccgcagctttgcaaagtcgagttagtgaggtttttggagttgatatacatcccgctgcgaaaattggggatggaatcttagtagatcatgggacaggtgttgttattggtgaaacagttattgttggaagcagagtttcattgatgcaaggtgtaactttaggtggcacggtaaaggaaacaggtgatcggcatcccaaaatttctgaaggtgtgctaattggagctcatgcaactatacttgggaatataagaattggtgaatgtgtgatgatagctgctggctctcttgtgttacaagaggtccctcctcacagcattgtggctggtgtaccagcaaaggttattggaagagtacatgagcattatccatccttaaccatgcagcaagatactatttga

SEQ ID NO: 623 - DNA, 963 bp, Glycine max var. Williams 82
atgaaaaacatgaaattgtgttcggtgatgctatgcttatcactagcgttccttcttggggccacagcagaacaatgtggcacacaagctggtggagcgttatgcccaaatagattatgttgcagcaaatttgggtggtgtggtgacacagattcctactgtggagaaggttgccagagccaatgcaaatctgcaacaccctcaacaccaactccaacaacacctagtagtggtggagatattagcagactcattagctcttctctctttgatcaaatgcttaaataccgaaacgatggccgctgttctggccatggattctacagatatgatgctttcattgccgctgctggctctttcaatggctttggcacaaccggtgatgacaacactcgcaagaaggagattgctgctttcttggctcaaacttctcatgaaaccacaggtgggtgggcaagtgcaccagatggtccatatgcgtgggggtattgttttatcaacgaacaaaaccaggcaacttattgtgatggtgggaattggccatgtgctgctggtaaaaaatattatggccgaggaccaatccaacttacacacaactacaattacgggcaagctggcaaagcacttggtctggatttgataaacaatccggatcttgtagccacagacgcaaccgtgtcattcaagacagccctatggttttggatgactgcacagggaaacaagccatcaagccatgatgtgatcactggaagatggactccatctagtgctgacagctcagcgggtcgggctcctggctacggtgtcatcaccaacataatcaacggtggcctcgaatgcggccacggccaggataatcgggtccaagatcggatcggcttctaccgaaggtactgccagatgatgggaataagccccggagacaacttggattgtaacaatcaaaggccatttgcttaa

SEQ ID NO: 624 - DNA, 1110 bp, Glycine max var. Williams 82
atggcatcctttgccagcaataattatcctttggtgtttttctttgttctcttttcactggccatgcgcttagctcatgggactaattatgcaccaacattattcatatttggagactcaacttttgatgttggaaccaacaactttcttaattctaaagcaaaggccaacttcccctacaatggcattgatttttatcctccatttcccacaggaaggtttagtaatggcttcaacactgctgaccaaattgcgagacaattcggttataagcagagcccaccaccatttttaactttggagaaagaccaatacagcctaaagaagaacattctgaagggtgtaaattttgcttcagggggatctggaattcttagagaaacagggcactcagaatggggagaagtggttttctttgaaaggcaggtggaacaatttgcatcggttggtggaaacatcagtgagatgttgggacatgcacaagctgctaaatttgtttccaaggctttgtttctcattagcgttggaagcaacgacatcttcgattatgcacgtaacgacagtggctccattcatttgggcgcagaagaatacttagctgttgtacaactcacatattactctcatataaagaaactatatgagttgggggcaaggaaatttggcatcataagcgttgcaaccgtaggttgctgtcctgctgtaagctctctcaatggagggaagtgcgtggaaccactgaatgattttgcagttgcattttatttagctacacaagctcttctgcaaaagttgagttcagaattgaaagggttcaagtactcacttggcaactcttttgaaatgacctcgaccttgttaaagagtccatcgtccttcgggttgaagtatacacagtcagcatgctgcggaattggatatctgaatgggcaaggtggatgcataaaagcccaaaacgccaatctttgcacaaatcgcaatgagttcttgttttgggattggtttcatcccactgagatagcttctttgttggcagctaagacattatttgaaggagacaaagagtttgtaactccagtgaatttacgtcagctagcttattcctattga

SEQ ID NO: 625 - DNA, 1335 bp, Glycine max var. Williams 82
ggtaccagagattagaaactaattactcttgtgatattctctcacaagggtgtgtaattaaggcatagaaaatatggcatcctttgccagcaataattatcctttggtgtttttctttgttctcttttcactggccatgcgcttagctcatgggactaattatgcaccaacattattcatatttggagactcaacttttgatgttggaaccaacaactttcttaattctaaagcaaaggccaacttcccctacaatggcattgatttttatcctccatttcccacaggaaggtttagtaatggcttcaacactgctgaccaaattgcgagacaattcggttataagcagagcccaccaccatttttaactttggagaaagaccaatacagcctaaagaagaacattctgaagggtgtaaattttgcttcagggggatctggaattcttagagaaacagggcactcagaatggggagaagtggttttctttgaaaggcaggtggaacaatttgcatcggttggtggaaacatcagtgagatgttgggacatgcacaagctgctaaatttgtttccaaggctttgtttctcattagcgttggaagcaacgacatcttcgattatgcacgtaacgacagtggctccattcatttgggcgcagaagaatacttagctgttgtacaactcacatattactctcatataaagaaactatatgagttgggggcaaggaaatttggcatcataagcgttgcaaccgtaggttgctgtcctgctgtaagctctctcaatggagggaagtgcgtggaaccactgaatgattttgcagttgcattttatttagctacacaagctcttctgcaaaagttgagttcagaattgaaagggttcaagtactcacttggcaactcttttgaaatgacctcgaccttgttaaagagtccatcgtccttcgggttgaagtatacacagtcagcatgctgcggaattggatatctgaatgggcaaggtggatgcataaaagcccaaaacgccaatctttgcacaaatcgcaatgagttcttgttttgggattggtttcatcccactgagatagcttctttgttggcagctaagacattatttgaaggagacaaagagtttgtaactccagtgaatttacgtcagctagcttattcctattgatcatgtctaagccataacataagtaaccaattactataatttgaagtgaaataacgtagctggcatctctcactagtgccggttttaggctctttttttcttttgttgagaaaaattctcatgcataatctaatgatatgctaataagagtt

SEQ ID NO: 626 - DNA, 696 bp, Glycine max var. Williams 82
atggagtttgtgccaaatcaatgcccttggatgggttccttcgggaatttcgttgagagggtcaaaagggtgggtgccctcttcgtctctgccatcattgggaacatcttctccgcgatcttgaccttctgctttgcattagttggcactttgttgggggctatgactggagccttgataggccaagagacagagagtggtttcattcgaggggccgctataggtgccatatcaggagctgttttttccattgaagtgtttgaatcttcccttgttctttggaaatctgacgaatctggaattgggtgtgtcttatacttgattgatgttatttctagcctattgaatgggagactagtgcgtgaaaggataggtccagccatgttgagtgctgtccaaagtcagatgggtgcggttgaaataagctttgatgaggtacaaaacctctttgacattggtggcgccaaaggtttatcgagagattcagttgaaaagatcccaaagatcacaattacaagtgacaacaatgttcatgcttctggggagaaagattcatgttcagtttgcctccaggactttcagcttggggagactggtagaagtttgcctcattgtcatcacatttttcacctaccttgcattgataagtggctgatcaagcatggttcttgcccattatgcagaagggatctgtaa

SEQ ID NO: 627 - DNA, 2547 bp, Glycine max var. Williams 82
atggaaacaacctcgttttccaaattgttcttcttcttttcctttttggttttgtgttctcatgttgctcgtgcttctgttacctacgacagaaaggcccttctcatcaatggacagaggagaatcctcttctccggctccatacattaccccagaagcacccctgatatgtgggaggatctgattctgaaggccaaagaaggagggattgatgtggttgaaacctacgtcttctggaacgttcatgagccttctcctggcaattacaatttcgaagggaggtatgatctggtgagattcgtgaagacaatacagaaagcagggctctatgctcatctccgcattggaccttatgtctgtgcagaatggaatttcggtggatttcctgtttggcttaagtatgttccggggataagctttagaacagacaatgaacctttcaagagggcgatgcaagggttcactgagaagattgtgggaatgatgaagagtgagcggctatttgagtctcagggtggccccatcatactctctcagattgagaatgaatatggggcacagagtaagttgcaaggagctgctggtcaaaactatgtgaattgggctgcaaaaatggctgtggaaatgggaactggggtcccttgggtgatgtgcaaggaagacgacgcaccagatccagtgataaacacctgcaatggcttctattgtgataaatttactccaaatagaccctataagcctatgatttggacagaggcttggagtggctggtttacagaatttggaggtccaattcacaaaagacctgtccaggatttggcatttgcagctgctagatttataataagaggagggtcctttgtaaactactacatgtatcatggaggaactaattttggacgaacagctggaggccctttcatcgctaccagctatgactatgatgctccactggatgaatatggtttgattaggcaaccaaaatatggtcatcttaaagagcttcatagggctatcaagatgtgtgagcgagctttggtttcaactgacccaattgttacttcattaggggaattccagcaggctcatgtatacactacggaatctggagattgtgctgcttttctctccaactatgactcaaaatcctctgctagagtgatgttcaacaatatgcactatagcttgcctccttggtcagtcagcatcctcccagactgcagaaatgttgtcttcaacacagcaaaagttggagtgcaaacatctcagatgcaaatgttgccaacaaatactcagttgttctcatgggaaagttttgatgaagatatttattctgtggatgaaagctcagcaattactgctcctggtctcctggaacagataaatgtaacaaaggatgcaagtgattatctttggtatataactagcgttgatataggttcgtctgaatcctttctacgtggaggtgaactccccactctcattgttcagtctacaggccatgctgtgcatgtattcatcaatggtcaactttctggttctgcctttggaacaagggagtataggagattcacatatactggcaaggtaaaccttcttgctggaataaacagaatcgctctgctcagtgtagccattggacttcctaacgtgggagaacactttgagtcatggagcacaggaatccttggtccagttgcactccatggacttgacaagggaaaatgggacttgtcagggcagaaatggacttatcaggttggattgaaaggagaagccatggatcttgcctctccaaatggtatctctagtgttgcgtggatgcagtcagcaatagttgttcaaagaaatcaaccattgacatggcacaagacttattttgatgctcccgaaggagatgaaccattggcattggatatggagggtatgggcaaaggtcaaatatggatcaatggacagagtattggaagatactggactgcttttgctactggtaattgcaatgactgtaactatgctggctcatttagacctccaaagtgccaacttggttgtggtcaaccaacccagagatggtaccacgttcctcgatcttggttgaagacaactcaaaatcttttggttatctttgaggaacttggggggaatccttcaaaaatttcacttgtgaagagatcagtaagcagtgtctgtgctgatgtgtcagagtaccacccaaatattaagaactggcacattgagagctacggtaagtccgaagagttccgtccaccgaaggttcacttgcattgcagccctggccagaccatctcttccattaaatttgccagctttggaactcctttgggtacttgtgggaactatgaacaaggagcttgccattccccagcatcctatgtcatattagagaagagatgtataggaaaaccaagatgcacagtcaccgtatcaaacagcaacttcgggcaagacccgtgtccaaaggtgttgaagcggttatcagttgaagcagtttgtgctccaaccactacaaattggaggggttga

SEQ ID NO: 628 - DNA, 222 bp, Glycine max var. Williams 82
atggcatcatcttggactccacggcagaacaaattgtttgaacaagccctggctttatatgacagggaaacccctgacagatggcagaatgtggccaatgtggtgggaagatcagttgaggatgttaaaaggcactatgagatcctcaaagaagatgtcaaacgcattgaacatggccaagttccatttcctcgttacaaaaccaacaccagcaacaactaa

SEQ ID NO: 629 - DNA, 1989 bp, Glycine max var. Williams 82
tttgatactagaaggagagtcttagtgacacatgaggattgataggtgctcttgtctcttagcctatatcctttgataattgttttgggacaccaaaatattttcatattacttaaaaatcaagattaaggcggttaattaataaatagtctccgcccttaaggatgtagcaaatttgaggttgtaagatagtagaagataccatggttaataaagaaaatgaatttatatgagaccaatgcatacgacatatatcatgatatttttcaggcgtttgtacttcctggtttgattgcggcagggtaaattaaattcttggaaagtaattcaccaagtggtaaatcataaatggaaaggaattaaaactccacttgccaaagatatgaaccaaatggtagtaagaggcatctttggttaaaacgttgaaaagctagctagcttgtcttttaatcctgattctcctcctccacttgtttgtccattgtccctcttcacttgtggctcttaaggggacgggtcacgttatcttcagtgtcctcttggaagatatattcgtccaccaggttcaaaccccacaccaccacctttttctcctacttataaggagctacgttggtcacctctttcccatgccttctcttgacttataatattcattcttattgtttcttacttacccttctgccatccctcactatcccatttcttagtgacttagtacagaaaacaaaaaagaagaagaaattatcaacaaatggcatcatcttggactccacggcagaacaaattgtttgaacaagccctggctttatatgacagggaaacccctgacagatggcagaatgtggccaatgtggtgggaagatcagttgaggatgttaaaaggcactatgagatcctcaaagaagatgtcaaacgcattgaacatggccaagttccatttcctcgttacaaaaccaacaccagcaacaactaactaagccattggttcttgaagatccagtggctaccaagtactgtatgaacatccgttagcattatcaacaataaatagcgaatagtgtatttctagctgaaatcagtaaaacaatctaactgcacccctaccattattgcagcagtcttctaccctgttttcctcctttatttttatactaagttttgtttatccatgatgttgtcaaattaatattgtacttaaagcaagttaatcattgtcaagtaatgaagaattacttataattagtctaattttttatatattaataagtaattataacaactttatataaatgccaacatgagttagtacgagtgaaaggggtcatgaaaaaaaaaaaaatactatctccagtaatttatataaaaaaatatacgggagtattttttttctaatcataagaatcatactatcatagtactattaatggattattttcttttatatccttaatttattataaaatctattaataagatatccactcatttctcataaaatggatacatttattagactattaacaacataaatcatgttcgttgattgaaaaaattattttaatgaatcatattattttaaagaagtctattactactagaggtcttagataggtgattccaataacacctttcatttttttttgttgaggagggcctaagtgggatgatgagaagggaattggagtggggagcttgacaggttatacaattgggtcaaaagatgttgacgtatctcttaagcaggttgcaaatgataccctcttttttgtggacccgtccccttgtaatgtggtttgtattaaggctttgttaagctactttgagtttgaggtagacccatgttgataaattggcaagtgcatcaatgtgttccaagtagtaaaattaaaatgaaagttcgagtatcgtatctacagtgattttgtttgtacttagtagatgaatatttcattaaaaaaaggatttgtgaaggttgtagaaaaataa

SEQ ID NO: 630 - DNA, 981 bp, Glycine max var. Williams 82
atggcatcgtcactacaagcagcagctactttcatgcaacccaccaagtttttgcagctaaagtctactcaggccatatctaaggcttttggtttggaacctgctggagttaataaggtcacatgctcccttcaggctgatcttaaggacttggctcacaagtgtgttgatgctaccaaaattgcaggctttgcccttgccacctctgctctcgttgtttctggggcaagtgctgaaggagtaccaaagcggctaacctttgacgaaatccagagcaagacctacttggaagtgaaggggacaggaacagcaaaccagtgtccaacaattgatggtggattggagtcatttgccttcaagcaagggaaatacaatgccaagaagttctgccttgagccaacttcattcacagtgaaggcagagggtgtggccaagaacgctccccctgagttccaaaacacaaagctcatgacacgtttgacctacactcttgatgagattgagggaccctttgaggtgtcttctgatggcactgtgaagtttgaggagaaagatggaattgactatgcggccgtcacagtccagctaccgggaggcgaacgtgttccgttcctcttcaccatcaagcagttggtggcatcagggaagccagacagctttagtggagagtttctggtcccatcataccgtggaagctctttcttggaccccaagggaagaggtgcctctacaggttatgacaatgcagttgctttgcctgctggtggaagaggagatgaggaggaacttgccaaggaaaacaacaagagtgcctcatcatccaaggggaaaatcaccttcagtgtcaccaagaccaagcctgagaccggcgaggttatcggtgtgttccagagtcttcagccgtccgacactgatttgggagcaaaggctccaaaggatgtcaagatccagggtatctggtatgctcagcttgagtcatag

SEQ ID NO: 631 - DNA, 2043 bp, Glycine max var. Williams 82
atgtcatcggcagaaaaacccagctccaaaggacaagcatggttggatactatattactatcttccttcaagcttttcatttttaaaatttttttcctcacaatttcactctgcaggttctgcacaacgggattgccaagcgacattgtggtggaagttgatgacatgacattccatctccacaagtttcctctcatgtcaaaaagccgaaagctccaccttctaattacgcagcaagaggcggcgactcattcctctgcagcacagcagcagcaagaaaacgaagatgaagacgaaatcgtggaagagcagtgtcacgtgaccttcacgggcttcccgggaggctctgaggcgttcgagatggctgcgaaattctgttacggcgtcaagatcgacctgacgccgtccaatgtggcggcgctccggtgcgccggggagtttctcgaaatgaccgaggattactccgaggacaacctcgtttcaaagacggagaggtttctatcgcagcacgtgctcaagagcctcaaggactctgtcaagacgctaaaatcgtgtgactccttgatgcctatggcggaaaatctcggaatcacgcagaggtgcgttgattccgtggtttccagaacttcgtcttcggatcctgcattgttcggttggccggtcagcgacgcttcttctgcgtccaaacaggtcatctggaatggactcgatggtgccggaagaagaaaggcaagcgccggtgccggagagtcttggtttgaagatctggcgcttctacggttgcctctgtttaaacgattgattctggcgatgagaactgcggagctgagtcctgagattattgagacgtgtgtgatgtattatgctaagaagtacattcctggagtttcgagatcgaatcggaaaccgttaccgtcgtcatcttcttcttcatccgttgcgacggaggcggagcagaaggagattctggagacgttggtttcgaatcttccgctggagaagagttcgaaggcagcgacggcgacgaggtttcttttcggattgttgcgaacgacgaacatactgaacgcttccgaagcctgcagagacgcgctggagaagaagatagggctgcagctcgaagaagccacgcttgacgaccttctcgtgccgagctactcgtacctgaacgaaacgctttacgacgtcgattgcgtggagaggattttgagtcagttcttggaaggtttagaagcgagaaccgccgcggaaacgacggaagacgcggcggcgacgaggtcgccggcgcttatgctcgtcggaaaactcatcgacggttacctctccgagatagcttccgacgcgaatctcaagccggagaagttctacaatttcgccatctcgcttcccgacgaggccagactcttcgacgacggtctctaccgcgccgtcgatgtgtatctcaaggcacatccgtgggtttcggaagaggagagagagaaaatttgcggattgttagactgtcagaagctgacgctggaggcgtgcacgcacgcggcgcaaaacgagaggcttccgctgcgcgcggtggttcaggtgctgttcttcgagcagcttcagctacgacacgccatcgccggaacgctgatggcggcggaggcagccgcggagcctgggcggcagtcggcggcgctggaacgggaagcggagggcggcggacgagaaggattagggttagacttagagcacgtgcaggaacggaacggcacgtggcgcgtggcggtgagggagaatcaggtgctgcgcttggacatggatagcatgaggacgcgagtgcatcaactggaacgcgagtgttcctctatgaagagagtcatcgccaagtttgacaagtccgacggcggcgccgccggtggttggagggcgtcgctgggccggaaattcggttgcaagtttaagactcaggtttgtgattcgcacgagtcaacggctgttgatacccgcaaaggacgccatcaccagcagcagcagccgcagcagcagcagcatccccatcatgtatag

SEQ ID NO: 632 - DNA, 456 bp, Glycine max var. Williams 82
atggcttgcttctctttaaacctctcagctcttcacatgttcagaccatgcgtatatattcctcaaatcgttgcaaatccattgcagcatcagaatcgtaaaatcaagatcttagcttgccaagctaatcaaaatcttgaccaatcgtccacaacggaaaaatctgttgctgagcttggcaatagcaaaggaacaagttccccaaatggtgttccccctaaattcccaagcaaggatttcaagaagaaaattgccattgtttcctttttaggagctctgggacttttattatcttcaaggcttcacttctttggtgttcctatgaaggatcactgtgctcatgcattaccatccaaagaggctcggcccaatgggaagttcactgtggtggagtttaatgcagattggtgtgaagtacgtggggaattagctcctgatgtgtacgaagtagagtag

SEQ ID NO: 633 - DNA, 1158 bp, Glycine max var. Williams 82
ctctctcaatggcttgcttctctttaaacctctcagctcttcacatgttcagaccatgcgtatatattcctcaaatcgttgcaaatccattgcagcatcagaatcgtaaaatcaagatcttagcttgccaagctaatcaaaatcttgaccaatcgtccacaacggaaaaatctgttgctgagcttggcaatagcaaaggaacaagttccccaaatggtgttccccctaaattcccaagcaaggatttcaagaagaaaattgccattgtttcctttttaggagctctgggacttttattatcttcaaggcttcacttctttggtgttcctatgaaggatcactgtgctcatgcattaccatccaaagaggctcggcccaatgggaagttcactgtggtggagtttaatgcagattggtgtgaagtacgtggggaattagctcctgatgtgtacgaagtagagtagcagtataacaccaccgagtgtgtgtgaatcaactgacctgacttaacaagtggtctcgagttgaactcctaagtatgcagttgtattaaatatttgaaagaaaagtttaaccttctataataattcaatccgacttaaacaagattgtttcgactgaaggattacatgtgatttagaaaaaagagtaacagtataataatggctactattgctgtagacaaccttttgcataatttctcaaattattgaactttttgtaacttttcatgtgcaataatttactatctatcttgattccactgacatctgacaacagggaacgggagaactttgttatgttcaatgtggataacaccatgtgtgaacatgaacactttttatcctcttcccctcttgcccaatcagaaagcacgtctttggtagatggaaacaatgtgaatttttccacctcaattcacacacaagccacaactaaggacgtgtttagattacagttgcatccaacagaacccatattagactcaatttactactcacataacttttttgtttatgcattgaaatgtgtaattttcccgttcaatgtggatagaacgcctatccaaacaatcttaatgaatatgcttgatgagtagaacttattatgttctatcttctatttacttaggacactctttaggttcaaccgttcaag

SEQ ID NO: 634 - DNA, 786 bp, Glycine max var. Williams 82
atgagttcggaaaattgtttaggcaggaagcattatgtgctggtgcatggggcatgccatggagcatggtgttggtataagttgaagccacggttggaatctgaaggccacaaggtcacagtgctcaaccatgcagcttctggcatcaacatgaagaaaattgaggatgttgacactttctcagagtacactgagcctttgctgcagctattggacacaattccctcaaatgagaaggtagttctagttggtcacagccttggggggatgagcatagcaattgcaatggaaaaatttccagaaaaggtagcagttggtgttttcttagctgcttttgctccagacgttgaacaccgcccatcttacgtcttggaaaagtacaatgagaggaccccatccgaggaatggttggacacggaattttgccagtgtgggaacaaaacattaattttctttggtcccaagttcttgtcttacaagctctatcaactctgccccattgaggaccttgaattggccatgactttggcaaggccatcatcatatttcatcgaagatttgtctaaggaaaagaacttctccaaacaaagatatgggtcagttccacgtgtttatattgtttgtcctgaagaccttggaattccattgaattaccaacactggatgatccaaaatgctgggttcaatgacgttgcggagatcaacggcgcagatcatatgccaatgttttgcaagccgcaagaattatgtgattctctccagcagatagctgctaaataccaatga

SEQ ID NO: 635 - DNA, 1368 bp, Glycine max var. Williams 82
ttcaattgatgttagagtattttggttaagaaagactccgtttgaaatctgaggtgttcttcttgagagattcaactcttctaatcttaccctcactgacttaaatgaagatcctgttgaccaaagctagtagtttttttatgtctgttagagggatgttcaaatagtttcaaactattgaaggcaacctaataaggttagtactctaaacataatactctaatacacctactttctagaaaagctacatgtcttgatcgttgaagtgtttttatatatatcgtccgttttgccacgaggagagaacggaggagctatgctgttcaggaggagaagggagatcatgcatatacagtacgaggacgaatactaagtagcacaaaaagaaaagcatcatgagttcggaaaattgtttaggcaggaagcattatgtgctggtgcatggggcatgccatggagcatggtgttggtataagttgaagccacggttggaatctgaaggccacaaggtcacagtgctcaaccatgcagcttctggcatcaacatgaagaaaattgaggatgttgacactttctcagagtacactgagcctttgctgcagctattggacacaattccctcaaatgagaaggtagttctagttggtcacagccttggggggatgagcatagcaattgcaatggaaaaatttccagaaaaggtagcagttggtgttttcttagctgcttttgctccagacgttgaacaccgcccatcttacgtcttggaaaagtacaatgagaggaccccatccgaggaatggttggacacggaattttgccagtgtgggaacaaaacattaattttctttggtcccaagttcttgtcttacaagctctatcaactctgccccattgaggaccttgaattggccatgactttggcaaggccatcatcatatttcatcgaagatttgtctaaggaaaagaacttctccaaacaaagatatgggtcagttccacgtgtttatattgtttgtcctgaagaccttggaattccattgaattaccaacactggatgatccaaaatgctgggttcaatgacgttgcggagatcaacggcgcagatcatatgccaatgttttgcaagccgcaagaattatgtgattctctccagcagatagctgctaaataccaatgaaccacttgatacatcaataaagtgatgatatatattcttgcaaacatgaggcgtatatgaagttgtattctggttatgttggaatcttgttgaatttatatatatatttcgatttggtcatttgcaattcctcaaatggttatttaagcatgcaattgattcatattaatttaaccattgaactata

SEQ ID NO: 636 - DNA, 795 bp, Glycine max var. Williams 82
atgagttcaaaaaatagtatagataggaagccgaagcactatgttctggtgcatggggcttgctatggagcttggctttggtataagctcaagccacgcttggaatctgcagggcacaaggtcacagtgctcgaccttgcagcttctggaaccaacatgaagaaaattgaagatgttgacactttctcacagtacactgagcctttgttgcagctaatggccacaattcccccaaataagaaggtagttctagttggtcacagtcttggggggctcaacatagcacttgcaatggaaaagttcccagaaaaggttgcagttggtgttttcgtaacagctataattccagacattgaacacaagccatcctatgtcttggaaaagctccttgagagtaccctagcgacgaatttgttggacagtgaattctccaagagtggaaacaaaaccatagttgtttttggtcccaaattcttgtccaataaactcaatcaagcctccaccattgaggatatagaattagccaagactttaataaggccagggtccctttttattgaagacttgtcccaacaaaaaaacttttccatacagggatatgggtcagttcctcttgcttttatcgtttccactgaggaccaggaaattccattgaatttccagcattggatgattcaaaatgctggaatcaatgtcgaagttctagagatcaaaggcgcagatcatatgcttatgattagcaagccacaagaactatgtgattctctcctccaaatagctactaaatatgcatga

SEQ ID NO: 637 - DNA, 696 bp, Glycine max var. Williams 82
atgaagagcaagttcctttttgttttcctattcttgggaattcttaactgtgaagcacaatatttcaatgccaacccatacgactatttacaactagccttaaggtggcctaattcctattgcttgacacatgaaggtggttgcagggaaatagtaccacaatatttcactattagctaccttcatcccatgagaagaggaggccctgatctgcgaaattgcccctcaccatttaatatgccaaatagcactatggagacaaacaagaatgacctactcaaatactggcctgatctgagaactgataattttattgagagcaagtcattatggagggaccaatggagaatgtttggttcatgctatagtatgatgccagatgactatattgtttatgcactcaacagtagaaagagaaatgacctcaagaaaatcttgacaaatgcaggtattgttgcaagtggaaatccatatccaacacgtaggatactacaagctttcaggaaagctttaggtgtgaatgttgacatagtttgtgagccagatagaagtggaaatgtttatcttgcagaggtccatcaatgtgttgatgctgctggaacaacatctatagactgtgacaataaggcaagaggatgtgatgatgaccccatctttccctacatgggattccaaccggataaagatcccaattaa

SEQ ID NO: 638 - DNA, 741 bp, Glycine max var. Williams 82
atggctgccaacacattgatgagtactgctatctcagccttcccatctctcctttcttcctcaaaatccagatttgccaccgcagttcctctttctagctttggtgtcaccaatgcctcttcttctcgcttttctatgagtgctgactggatgccaggccagcctagacctccttaccttgatggttcagcacctggtgactttggattcgaccctcttcgtcttggtgaagtaccagagaatcttgagaggttcaaagagtcagaactcattcactgcagatgggccatgcttgctgttccagggattttggttccagaggcattgggcttaggcaactgggtaaaggctcaggaatgggcagcagttcctgggggccaagcaacctacctaggcaatccagttccatggggcaccctacccaccattctggccattgaattccttgctatttcctttgtggagcaccaaaggagcatggagaaggacccagagaagaagaaataccctggtggtgcttttgatcctttgggatactctaaggaccctaaaacattccatgaatacaaagtcaaagaacttaagaatggacgtcttgctttgttggcttttgtgggattctgtgttcaacaatcagcttatcccggcactggacctttggagaacttggctgctcacttggctgacccatggcacaacaacattggaaacatcattattccacaatcgattttgccttga

SEQ ID NO: 639 - DNA, 1236 bp, Glycine max var. Williams 82
atgaatgcactagcagccaccaacaggaactttaggctggcctctaggctccttggattggattcgaagcttgaaaaaagcttgctgattccattcagagaaatcaaggttgagtgtaccatccccaaagatgatggaagcttggccacttttgttggattcagagttcaacatgataatgccagaggccccatgaaaggagggatcagataccatcctgaggttgaaccagatgaagtgaatgctttggcacaactaatgacatggaagacagcagtagcgaatataccatatggtggagccaaaggagggatagggtgtgatcctgcaaaattaagtgtgtcagagttagaaagactcactagagtttttacccagaaaattcatgatctgattggagttcagacagatgtacccgctcctgatatgggaacgggaccacagactatggcatggattctagatgagtattccaaatttcatggccactctccagcagtagtgactgggaaacctatagaactcggtggatctctaggcagagatgcagctacaggacgaggagtcctctttgcaactgaggctttgcttaaggagcatgggatgagtctatccggacagcggcttgtcatacagggttttggaaatgtggggtcttgggctgccaaattgatcagtgagaaaggtggaaaagttgttgctgtgagtgacataactggggccatcaagaatagcaatggtcttgacataccaagcctactcaagtattctgaacaacaccagggagtcaaaggattccatggtggtgaagcaattgaccctaactcaatattggttgaagactgtgatgttcttgtcccagcagctcttggtggagtcatcaatagggaaaacgcaaatgagattaaggccaaatttgttgttgaagcagccaatcacccaactgacccggaggctgatgagattctgaaaaagaaaggggttgtgatcctcccagatatatttgctaattctggaggagtcacagtcagctactttgagtgggtgcagaacattcaagggttcatgtgggatgaggagaaggtgaacaacgagctaaagacatacatgaccaaagggttcaaagatgtgaaggaaatgtgcaaaacccataactgtgatcttcgtatgggagcattcacccttgcagttaaccgtgtggcaagggccaccacccttaggggttgggaagcttga

SEQ ID NO: 640 - DNA, 1524 bp, Glycine max var. Williams 82
atggaacaacctccttcgtcgtctcttcaggtggagacagcacaacaagcaggacctagtcctctcagaaaaatgatcgctgtctcgtcaatcgccgcgggaattcaattcgggtgggccctacagctctctcttttgacaccctacgtccagaccctgggcgtcccccacgcatgggcctccttcatttggctctgcggcccaatctctgggctgctggtgcagcccattgtagggtacagtagcgaccgatgtagatctcgtttcggtcgccgccgtcccttcatcttagccggggccgttgctgttgccatcgccgtcttcctaattggctatgcagccgatataggacacgcagctggcgacgacctcgcaaagaagacccgcccacgggctgttgcaatcttcgtggtcggcttctggatcctggacgtggccaacaacatgctccagggtccatgccgggcatttctcggcgacctcgccgccggggaccaccgcaagacgagaaccgccaacgcattcttctcgttcttcatggccatcggaaacgtcctcggctacgcagcaggctcctacgacaaactccaccgcgccttcaaattcacacaaaccgaagcgtgtgacgtcttctgtgcaaatctcaagagctgtttcttcttctcaattgtccttctcctcgttctttgtttcgttgtgctcacttgcgtggaagaccctcagtttacgccacgtggggatgaggacaattacgaaaacgacggcgtttcgcggtcgtggttttcgtgctttggtgaactctgcggtgcgtttaggggtctaaagaggccaatgtggctgctgatgttggtgaccgctattaactgggtggcgtggttcccttatgtgttgttcgacactgattggatggggcgagaggtgtacggtggtaaggtgggggacaaagcatacgattccggagtgcatgtgggggcattggggcttatgctgaactctgtggttttggcattgatgtcgttggcggtggaacccttgggtcgtttggttgggggagttaagtggctgtgggggatcgttaacgttattctcgccgtttgcatggcaatgacggtgcttatcacaaaggctgcagaacatgaacgcttaaacgccgtttcccttgttggatatccctcacttggtgtcaaagctgctgcattgactttcttctccgtccttggtgttcctcttgcgattacttacagcgtcccatttgctctggcatccatatactccaccacttcaggagcaggccaaggtttatctttgggtgtcctcaatgttgcaattgtcgtgccacagatgatagtatcggctataagtggacagtgggataaatggtttggtggtggcaacttgccggcgtttgtgctgggtgccgtggcggccgccgtgagtgccgtgctagcggttgttctgctgccaaaaccaaagccagcagatgtggccaaggtttcttccgtcactgctgggagtttccattag

SEQ ID NO: 641 - DNA, 1875 bp, Glycine max var. Williams 82
atggagagagagttgtggggttctgttttcatctattgggtgttattagctcgcccattatggttggtttctgctaacatggaaggtgacgccttacatagcctgaggacaaatttacaggatcctaacaatgttttgcaaagttgggaccctacactggtcaatccatgcacatggtttcatgtaacatgcaacaatgataatagtgtcataagagttgatctgggaaatgctgttttgtctggtcaacttgttccacagcttggtcagctcaaaaacttacagtatttagaactttacagcaataacattagtggaccaattccaaatgacctggggaatcttactaatttggtgagcttggatctgtatctaaaccgtttcagtggacctatcccagagtcattgggcaagttgtcaaaattgcgctttctccggcttaacaacaacagcctgactggtcctattcccatgccactgactaatattacagctctccaagtgctggatttgtctaacaaccaactatcaggtgtggttcccgataatggctccttctcattattcactcctatcagttttaacaacaacttggacctatgtggcccagtcactgggcatccttgtcccgggtctcctccattttctcctcctcccccttttgtcccaccatccccaatctcagctccagaaggaaatagtgccactggtgcaatagctggaggagtagctgcaggtgctgctctgttatttgctgctcctgcaattgtgtttgcttggtggcgtcgaaggaaaccacaggagtttttctttgatgtgcccgctgaagaggatcctgaagtacaccttgggcagcttaagaggttctcattacgagaactgcaagttgcaacagatactttcagcaataagaacattcttggaaggggaggatttggtaaggtttacaaaggacgtttgactgatggttcactggttgctgtgaaaagattgaaagaggagcgcacgcctggtggggagcttcagtttcagactgaagtagagatgattagcatggctgtgcaccgaaatctcctccgtttacgtgggttctgtatgactcctactgaaaggctacttgtatatccttacatggctaatggtagtgttgcctcatgcttaagagagcgtccggcacatcaacaaccccttgattggccgacaaggaaaagaatagcattgggatcagcaaggggtctttcatatttgcatgatcattgtgacccaaagattattcatcgtgatgtaaaagctgcaaacatactgttggacgaggagtttgaggctgttgttggagattttgggttggctaaactgatggactacaaggacacccatgttacaactgctgtacggggcacaattgggcacatagcaccagagtacctgtctactggtaaatcttcagagaaaacagacgtctttgggtatggtataatgcttctggagctaatcactggacaaagggcttttgacttggctcgacttgcaaatgatgatgatgttatgttgctggattgggtaaaaggacttctgaaagaaaagaagctagaaatgctggttgatcctgatctccatagcaattacatagatgctgaggtagaacagttaatccaggttgcactgctttgctcacaaggttcccctatggaccggcctaagatgtcagaagtggtgcgaatgcttgaaggtgatggcttggcagaaagatgggatgagtggcaaaaggtggaagttctgcgccaggaagtggagttggcccctcatcccaattccgattggattgttgactcaactgaaaatctacatgcagttgagttatctggtccaaggtga

SEQ ID NO: 642 - DNA, 1488 bp, Glycine max var. Williams 82
atgcttaaatttggcacctctttattatataaccgtttcattctcaatagcatctcaaagggtgtcctgagaaggaatcacacaagagaaattttgggtggatcttggcaatttaaatttggtccaaaaatagtaagaaagaaaaccatagtttatatagttttcatgtccttgctaacggtggcgcaccaaagggggtcaggtgagtttatgcggttcacggaaagtcatggcggcggtggtggcggtgacggcgatggtgaatatggttatggacatgatgatggtagaggtggtgggggtggtggttcactagggttgaattttaaccaagtgatgcaacaaggtgaggttacaacgcaaggaggtactttggtttcagggtataacaggggtgatccagatttgagagaaatggtttccgctttgacacatgtggtggtgtcttcagggtcaggccagaggagcaccgaatggatccagcaaagtggttttcctatgatgtctgcatcttctctttcatgtttgtcttctttctcttctccttcttcttctggagcctcttgggttggccacaaaagaggcagagaagaagaagagagtagctcttcccataacatgatccaacaacaacaacaaagtgctccaagactcttcagaaacattggtgacttcatggtgccttctcaaggagactcatcttcagcgacagaagaagcccccacctccacaactacaagtgtaaccgctgtggcaacaacggttactgaaaccccacccccaccgggaggtggggaaaggaggagaaagtacaggggagtgaggcagaggccatggggaaaatgggcagcagaaattcgtgatccacacaaagcagcaagagtttggcttggaacattcgacacagaagaagcagcagcaagagcatatgatgaagctgcattgaggttcagaggcaacagagcaaagcttaacttccctgaaaatgtaagagcagttccacccattcaaccttttcaagccaccactaggctaaccgtttctgattccaccacctctcaattccggccactcgtcacggagacgccgcccttcattcagcagccacagattcagggctcctctgacttgatcagagattacttgcaatactctcagcttctacagagtgattttcaacagcaacaaatacaacaacaatcaccttctagtttgcttcagcagttgtactataatgcacaattggcttcacttcaatcaccttcagtgctatcatcatctccttcattttcttcttccgtgtcaccaacaccattcccattgttctcaacctctgctcagttttcctctgcttctttccccatgttttcaagtcaacaaatgggctatttccagctgccggaaagctgccctcccgctggcggcgtgccagagtttccgccgtccacatggtcgggtaccagtggccagccaccaccttctggttga

SEQ ID NO: 643 - DNA, 2356 bp, Glycine max var. Williams 82
agaacagggcataggaaatatcatatatactatatattatagtttagtttgcactattttaatggtggccgactaccttaattccacatgcttaaatttggcacctctttattatataaccgtttcattctcaatagcatctcaaagggtgtcctgagaaggaatcacacaagagaaattttgggtggatcttggcaatttaaatttggtccaaaaatagtaagaaagaaaaccatagtttatatagttttcatgtccttgctaacggtggcgcaccaaagggggtcaggtgagtttatgcggttcacggaaagtcatggcggcggtggtggcggtgacggcgatggtgaatatggttatggacatgatgatggtagaggtggtgggggtggtggttcactagggttgaattttaaccaagtgatgcaacaaggtgaggttacaacgcaaggaggtactttggtttcagggtataacaggggtgatccagatttgagagaaatggtttccgctttgacacatgtggtggtgtcttcagggtcaggccagaggagcaccgaatggatccagcaaagtggttttcctatgatgtctgcatcttctctttcatgtttgtcttctttctcttctccttcttcttctggagcctcttgggttggccacaaaagaggcagagaagaagaagagagtagctcttcccataacatgatccaacaacaacaacaaagtgctccaagactcttcagaaacattggtgacttcatggtgccttctcaaggagactcatcttcagcgacagaagaagcccccacctccacaactacaagtgtaaccgctgtggcaacaacggttactgaaaccccacccccaccgggaggtggggaaaggaggagaaagtacaggggagtgaggcagaggccatggggaaaatgggcagcagaaattcgtgatccacacaaagcagcaagagtttggcttggaacattcgacacagaagaagcagcagcaagagcatatgatgaagctgcattgaggttcagaggcaacagagcaaagcttaacttccctgaaaatgtaagagcagttccacccattcaaccttttcaagccaccactaggctaaccgtttctgattccaccacctctcaattccggccactcgtcacggagacgccgcccttcattcagcagccacagattcagggctcctctgacttgatcagagattacttgcaatactctcagcttctacagagtgattttcaacagcaacaaatacaacaacaatcaccttctagtttgcttcagcagttgtactataatgcacaattggcttcacttcaatcaccttcagtgctatcatcatctccttcattttcttcttccgtgtcaccaacaccattcccattgttctcaacctctgctcagttttcctctgcttctttccccatgttttcaagtcaacaaatgggctatttccagctgccggaaagctgccctcccgctggcggcgtgccagagtttccgccgtccacatggtcgggtaccagtggccagccaccaccttctggttgatacagtgtctcagtttccttcatattttccttttttctctttctttcatacttacgataaaaaaatgatttgttttacttatttccttttttaaggctgaaacttagatagtttttaaaatatttttggtactattctcgtatcaaaacaaatttagagtttcacttcagtaatttatgtttatgttgatatttaatataaatttttattgtaaattaccaagtgaaactctaattctttattattattatatatatatatatatatatatatatatatatatatatatatatataccaaaaagatctaactaactgtatttaagttttgtaccttttctaaatgatggtaaattccttgaacatgtagttttggagttaactattgttttgttcctattcatgtaaagaagattatttgaaaacagaaaaggtgggagtgattgaaggttgatgatggatgagaaagagtggcaggtaaagacaaagcagaatttaggttttagggttagtttatttccaattctcaatggatttgatgttaacattccctcagttatccgtggaaaggcgtagaaacccatagcttttacataccctctgtctgctatctgctatacagccacagattttatcaaaatgttcctatactttagttcatttttaataatattttgtgaagatttagtcatcatgattatggttctttatcttttgggttattttggatgtgctcatttattccaatcttaatgagcacgagtaataaatatattgaatgc

SEQ ID NO: 644 - DNA, 750 bp, Glycine max var. Williams 82
atggctgcttcaacaatggctctctcttcatcatcattggctggtcaagcaatgaagcttgccccctccacccctgagcttggtgttggaagagaagcccatggtatggcccagaccgtgtcaagtacttgggcccattttccggtgaagctccctcctaccttactggtgaattcccatgggctttctgctgatccagagacttttgccaaaaaccgagaactcgaagtcatccactccagatgggccatgttgggagccctgggctgtgttttccccgaactcttggcccgcaatggtgtcaagtttggagaggccgtatggttcaaggccgggtctcagatattcagtgagggtgggcttgactacttgggcaacccaagcctgatccatgcacaaagcattcttgccatctgggccacccaagttatcttgatgggtgccgttgagggttaccgtattgcaggtgggcctcttggtgaggtgactgacccaatctacccaggtggcagctttggcccattgggccttgctgatgacccagaggctttggccgagttaaaggtgaaagagctcaagaatggtaggttggctatgttttccatgtttggattctttgttcaggctattgtgactggaaagggacccttagagaacttggccgaccaccttgctgatccagtaaacaacaatgcctgggcctatgccacaaactttgtcctggaaagtgagaaaaaaataaaaaaataa

SEQ ID NO: 645 - DNA, 3237 bp, Glycine max var. Williams 82
atggacaccaaagggagattagttgctgggtctcataacaggaatgagtttgttcttatcaatgctgatgaaactgcaagagtagctgtcacagaattaagtggtcaaatttgtcagatctgtggggatgagctggaggttactgtgaatggggagccatttgttgcttgcaatgaatgtgcgttccctgtgtgcagaccttgctatgagtatgaaagaagagagggtaaccaagtttgtcctcagtgtaaaaccagatataagcgcatcaaaggtagtcctagagttgagggtgatgaagaagaggatgatagtgatgatttggaaagtgagtttgatattgggagcgtgttctctgctcgccttaactatggttcacaggtgaatggttcggtgatccatgcaccatcggagtttgatgcagcttccgtggcttctgagatccctctcttgacatatggtcaagaggatgttggcatttctgctgataaacatgctcttattcttcctccattcacggccagagggaaacgagttcatcccatgccttttcctgattcatctgtacctgttcaaccaagacctatggatcctaaaaaggatattgcagtttatggatatggaagtgttgcatggaaggaacggatggaggattggaagaaaaaacaaagtgaaaaacttcaggttgttagacatgaagggggtaaagatagtgatgagctggatgatcctgacttaccaaaaatggatgaaggcagacaaccactttggagaaagttgccaattagttcaagcaggataaatccatacagaatcataatagtacttcggattgcaattctttgcctcttttttcattatagaatcctccatccagtcaatgatgcatacgcattgtggctcacctcagtaatatgtgaaatctggtttgctgtctcatggatttttgatcagttcccaaaatggagcccaattcttagagaaacataccttgatcgtttatctctaagatatgaaaaagaaggaaagccatctctgttagctgatatagacgtgttcgttagtacagtggaccctatgaaggaacctccactcattactgcaaacacagttctgtctatccttgctgtggattatccagtggacaaggttgcatgctatgtttcagatgatggagctgccatgcttacatttgaagcactttccgagacttctgagtttgcaaggaaatgggttccattctgcaagaagttctgcattgaaccacgggctcctgaatggtattttgctcagaaggttgactacttgaaggataaagtggatgcaacatttataagagaacgtcgtgccattaagagggagtatgaagagttcaaagtgaggattaatgcattggtggctttggcacaaaaggttcctgaggatggttggacaatgcaggatggtactccatggcctgggaacaatgtcagagatcatcccggaatgatacaagttttccttggtcaaaatggtgttcgtgacatcgaaggaaatgaattacctcgtcttgtctatgtgtctcgtgagaaaagacctggatatgatcaccacaaaaaagctggagctatgaatgctttggtgagagtctcggcaataatcaccaatgctccttatgtactgaatgttgattgtgatcactacataaataacagtaaggcccttcgtgaagccatgtgcttcatgatggatcctacatcagggaaaaaaatatgctacgtacagtttcctcaaagatttgatgggattgatcgtcatgatagatactcgaatcgcaatgttgtattctttgatatcaatatgaaaggtttagatggcatccaaggaccaatatatgtgggaactgggtgtgtcttcaggagacaggcattctatggatatgatgcccctacatcgaagaaagcaccaagaaagacatgtaactgttggcctaaatggtgctgctgtctgtgttgtggatctaagaagaaaaagattaaagcaaagtcaagtgtgaaaaagaagataaagaataaggatgatataaagcaaatgcatgcactagaaaatattgaagagggaattgaaggaattgacaatgagaagtcatcactaatgtctcaatcgaagtttgagaagaagtttgggcaatcatctgttttcatagcttcgacactcttggaagatgggggtgttccaaaagcagcaagttctgctacactcttgaaagaggccatccatgtaattagttgtggttatgaagataagacagaatgggggaaagaggttgggtggatatatggctcagttaccgaagatattttaacaggtttcaagatgcattgtcatggttggagatctgtatactgcatgccaaaaaggcctgcttttaaaggttcagctcctataaatctctcggatcgtctgcatcaagttcttcggtgggctcttggatctgttgagatctttttcagtaggcattgtcccatatggtatggctatggtggcggcttgaaatcgctggaacgattctcttacataaactcagttgtttatcctctgacttcaattcccttaattgcctattgtgcattgccagctgtctgtctgctcactgggaagttcattgtccccgagataagtaactatgccagtatcattttcatggccctcttcatctctatagctgcaactggcatcctggaaatgcagtggggaggtgtcggtatacatgactggtggaggaacgagcagttctgggtcattggtggtgcctcctcacatctctttgctctctttcagggtttgctcaaagttctggcgggagtcaacacaaacttcacagtcacatccaaggcagcagatgatggagagtttgctgacctctacatcttcaagtggacatccttgttgatccctcccttgaccctactaatcataaacatcatcggagtcattgtcggtgtctcggatgctataaacaatggatatgattcatggggtcctttgtttgggaggctattttttgccctttgggtcattgtacacctttaccctttcctcaagggtgtcatgggaaaacaagaaggtgttcctaccatcattttggtctgggctattctcctgtcttcaatcttaaccctactttgggtgagaatcaacccattcttggccaaaagtgatgtggtgttggaaatttgtggattgaattgtgactaa

SEQ ID NO: 646 - DNA, 2727 bp, Glycine max var. Williams 82
attccatgggatttcgtagtctaacttcgttgttatgtgtcagacactgagtgaaataacttccttctctcacataactaccacttcaatcccattaaattatactagtactttctcaatctttcttttctttttttcatttttcttcttaattgtctaattttccattggagttgaagctgcggcaatggcacaattggtgtgaagtgaagggtgagcaaggtgattgtgattctttgctgtttcaatttcctcttcacaattttgagctgtgaagcttttctgggcacttccactactcttgttttgggttttctcagctatagctttgaagcttgagattgttcttgagctcaacgtgaattgtgggttgatacttcaactgggtccagttagggttccaaaaaggtttgaactttatgcttaccaaactttctttatccttaaatgactggtgggtcgtgcagtgctagctgtccaagtatggtcttttcaaaagctttcaattattaggtgattatttggtcttcttcggcccacttcccatgtgtttatgaagaattaaaaaggagaaaatggttcaagttcttttgagcttagcagggtttgattgctattttttttttatgtgattctgggatggtcagtaatgggattgaatatttgtctaacttccatggaatcattagaaggttttgattgcaaacgaaagaaagatcttagtcaaatgagcaatgatgagttggtgacacttgacaacatatcccaagacgagcttgaatcaacttcatctgagaaggaagagaattggagggaaaatttggagcagaaatcatcagaggttaattctacagctggagtaggtttggaccatttcatcctagagcctactggaacagagaggaacctgcttgttgctgaccatgagattatattttctagatcaatgatggagaaatgtgattctccaaggcaagacttaatattggacaggctgtcagagtgtgaaaagcaaaagctgtttaacctagtgaagatacaaagtgacgggactgttaaagttgatctagaaaaagatgcacctcttgcatcagaattgttgaagttccaatcttttgaagagtcaacaatgagtggaactattatttctgaatcaaaaaaatcagctccctggttacaaattgtcatacttgtggttggaactagaggcgatgtacaacctttcctggccattgcaaaaaaacttcaggagtatggacattgtgttaggctggcaactcatgctgattttgacacatttgtaaagtctgctggtgtcaatttctatccgttgggtggcgatcctcgagctttggcagaatatatggcgaggaataaagcatgcatatcacctgatttggaaactggtgttccgtttagagctcaggctattatttccaatcctactgcatgtggacatacacacgttgctgaagctcttggggtgccccttcacatcttcttcacaatgccttggacgccaacatatgagttctcacaccctttggcacgtgttcctcaaagtgctggttattggctctcatatataattgtggatctactgatttggtgggggatacgaggaattatcaatgacttcaggaaaagaaaattgaagcttgctcctattgcatacttcagtatgtacagtggatcaatatctcatttaccaactggctatatgtggagtcctcatgttgttccaaaaccaagtgactggggccctttagttgatgttgttggttattgtttcttgaaccttggatcaaagtatcaaccacaagaagattttgttcgatggattcaaaaaggaccaaaacctttatattttgggtttgggagcatgcctcttgatgatcctaaaagaactactgatgttatagtggaggcactaaaggatacgggacaacggggaattattgacaggggctggggaaatctagggaacttggcagaagttcctgacaatgttttcgtgctagaggaatgccctcatgactggctgtttccccaatgttctgccttggtgcatcatggtggtgctggaacaacggctacaggactaaaggctgggtgtccaacaaccattgttccattctttggagatcagttcttttggggagatagaataaatcagaaagggctaggaccagctccaattccaatatctcagctcagtcttgagaatttatcaaattccattaaattcatgctccagccagaggtaaaatcacgggcaatggaagtggcaaagttgatcgagaatgaagatggtgttactgctgcagttgattcatttcaccgtcatctacctcctgaactaccactaccaattccatctgcagtggtggatgaccatgcaaatcctttgcagtggttttttctccaactagcaaagttttgcactttaccttgtgggggtgtatagtttttttttttttttgctttgagtaaattcttttttttcttttattgattgcataattatagtttatagagctttccattttttggtaatggtagcagtgttaagcttaatattccattcatttcagtcaaagtctcttttgtgagggtttgattaatagtaaattagtaatattgaagtttctcttgtcatttctcgttgtatgagatctcatagatcatagatatctatgttagagtgattataagagggattctatt

SEQ ID NO: 647 - DNA, 1304 bp, Glycine max var. Williams 82
gccattcagaggtagcacacaaaaatgaagagttttttgttggggtgtgtggccactgtggagaaaaatagaccctattttgcaatgttgtttattcagtttatgtatgctggaatggccttgttgtccaaggctgcaatttcaaagggaatgagcccttatgtgtttgttgtttatagacaagcctttgcatctgttgctctatctccatttgctttctttgacagcaagcaatcagctcctttgtcatgcagcttgttgtgcaaattgtttctagtttcccttgttgggttaacggcgagttcaaacctttactgtgtttcaatcaactacacctctgcaacatttgctgcagccgccacaaacactgtccctgccattactttcatcatggctgctttaattagggtggaaagcatttccataaaacgtgtgcatggattggccaagattttggggtctgttctaagccttgctggggcaattacatttgctttagtcaaaggaccttccctgggttttatgaaatggtatccagaaaatcaaaaccatagttctcacctattaacaacggttcactccaaagtcgatatagttagaggctctcttatgatgctctcagcaaacactgcatggtccttgtggcttatcttgcagggatttgttgtgaagcagtacccagcaaaatttcgcctcactgctatacaatgcttgtttagcttcatgcagtctactgttgtggctgtagcagtagagaggaataatccttcagcatggaggcttggatgggatattcatcttctttctgtggcttactgtggtgtaattgtaacaggcatttgttattggctgcaagtatgcacaatagagacgaaaggcccagttttcacagcaatgttcacccctctagctcttgtaatcacagcaatattctcagcaattttgtggaaagaaacactttacttgggaagtgttgctggcactattttactagtggttggactctacagtgttctgtgggggaagagcaaggatggtgtaaaaggagaaaacctagaagctgaacaaacaaaagaggaaaccagattggagtgccttgtacaacattgattagactaaaactctgcataagattgtatgaccgcacttaaaatttagcaaaagatgtccttgaatgttgaatgtcttttttcttatgcatctttgcattatgtgtatatcttgttatcttttaatcggatactctttttttcttagagaatattggtaaatatcttattacatataatgctttattttgtcgt

SEQ ID NO: 648 - DNA, 1428 bp, Glycine max var. Williams 82
atggagctgatcatgttgctgctctcgttggtcctttccttgttagtgttgtctgttatcttgttgttgtatgttactcgttctcctaaagcaatggaaggcatccctggaagccttggttggcctattgtgggagagagtttctcattcctctctgacttttcaagtccctctggaatctttagcttcatgaacaagaggcaaaagagatatggaaaggttttcaagagctttgtcctggggaggttcactgtcttcatgactgggagagaagcaagcaaaattttgttaaccggaaaagatgggattgtgagtttgaatctgttttacactggccagcaagttctgggccccaccagtttgctgcaaaccactggagaggcacacaaaaggctaagaagactgattggtgaacctttatcaattgatggcctgaaaaaatatttccattttatcaatactcaggcaatggaaacattagatcaatgggatggaaggaaagtcctggttcttgaggaggcttctacatttactctaaaagtgattggacatatgatcatgagtttagagccttctggggaggaacaggagaagtttaggtcaaattttaagattatttcttcctcatttgcttcattgccattcaaacttccagggacagcattccaccgtggtatcaaggctcgagataggatgtatgagatgctggattctacaatttcgcggaggagaagtggccaagaatttcaacaggatttcttaggatccttagttatgaaacacagcaaagaagatggagaagaagatgaaaataaactcacagataaacaactgaaggataatatattaactctgctggttgccggccatgataccacaactgctgctcttacatggctcatcaaatttcttggtgaaaatccacttgttttggaacaattgagagaggaacacagacaaattgtcgccaacagaaagagtggaacggatcttacttgggctgaagttaataacatgccttacacagccaaagtgatcagtgaaactcttcgaagagccacgatactaccttggttttcaagaaaggcatcccaggattttgaaattgatggttataaaattaagaaaggttggtctgtcaacctagatgttgtttctattcaccacgacccagaagttttccaagatcctgaaaagtttgatccctctagatttgatgaaacattgaggcctttcagttttcttggatttggtagtggaccacgtatgtgtcctggaatgaaccttgccaagcttgaaatttgtgtcttcatccatcaccttgtcaacagatacaagtggagacatctggagaaagacaattctgtccagccgacgcttgtaaggatgccaaagaacaagtatcctattatagttgaggcactataa

SEQ ID NO: 649 - DNA, 2003 bp, Glycine max var. Williams 82
aagaacaaagaatcccctgagattctaccaaggaaaaatgttgtatttatcgcttcaaaatgttcacaatacatgtcgtcaccttttcaaagtaacatattggcctgcggtttaattgataatattattataacaacatgatataaatataaacatcttgtttgtgtccaggcttaaatctatcacaaatgtcctgagctcaaggtgctaaagaaagagatacaattaataattgtagcttatactatagatataggatacatttctttgattaattaactactagtgctatttggtgcttgcggtaagagggaatggagctgatcatgttgctgctctcgttggtcctttccttgttagtgttgtctgttatcttgttgttgtatgttactcgttctcctaaagcaatggaaggcatccctggaagccttggttggcctattgtgggagagagtttctcattcctctctgacttttcaagtccctctggaatctttagcttcatgaacaagaggcaaaagagatatggaaaggttttcaagagctttgtcctggggaggttcactgtcttcatgactgggagagaagcaagcaaaattttgttaaccggaaaagatgggattgtgagtttgaatctgttttacactggccagcaagttctgggccccaccagtttgctgcaaaccactggagaggcacacaaaaggctaagaagactgattggtgaacctttatcaattgatggcctgaaaaaatatttccattttatcaatactcaggcaatggaaacattagatcaatgggatggaaggaaagtcctggttcttgaggaggcttctacatttactctaaaagtgattggacatatgatcatgagtttagagccttctggggaggaacaggagaagtttaggtcaaattttaagattatttcttcctcatttgcttcattgccattcaaacttccagggacagcattccaccgtggtatcaaggctcgagataggatgtatgagatgctggattctacaatttcgcggaggagaagtggccaagaatttcaacaggatttcttaggatccttagttatgaaacacagcaaagaagatggagaagaagatgaaaataaactcacagataaacaactgaaggataatatattaactctgctggttgccggccatgataccacaactgctgctcttacatggctcatcaaatttcttggtgaaaatccacttgttttggaacaattgagagaggaacacagacaaattgtcgccaacagaaagagtggaacggatcttacttgggctgaagttaataacatgccttacacagccaaagtgatcagtgaaactcttcgaagagccacgatactaccttggttttcaagaaaggcatcccaggattttgaaattgatggttataaaattaagaaaggttggtctgtcaacctagatgttgtttctattcaccacgacccagaagttttccaagatcctgaaaagtttgatccctctagatttgatgaaacattgaggcctttcagttttcttggatttggtagtggaccacgtatgtgtcctggaatgaaccttgccaagcttgaaatttgtgtcttcatccatcaccttgtcaacagatacaagtggagacatctggagaaagacaattctgtccagccgacgcttgtaaggatgccaaagaacaagtatcctattatagttgaggcactataacacgattccttctgaaactacaaacaaacaacagaagacgatatggcaatgcagaaatcttgtatatgaacagaatcattgtctcttttctgttattgtatggagagaactcacgttccaaatcatgctttattacttgtgaggaaagaaactaatcctcaataaataatttgcatttcctttttcagtaggtaggtaatgctagtacagaaagaaactacaaataattaagatcattttcaaattgataaattcctgttg

SEQ ID NO: 650 - DNA, 1077 bp, Glycine max var. Williams 82
atgtggtgctgggaagtaattaaaattaacgctttaaccaaggtcgacgaaaccaaggtcggagtcaaaggtttgatcgattcgggaatcagaaccatcccccctttcttcgtccatccgcccgaaaccctagcggacctcaagcggggtgccgaacccggatctgtgcaggagatccccacggtggacctcgccggcgtggaggacttccgcgccggcgtggtggagaaggtccggctggcggcgagcaccgtggggttcttccaggtggtcaaccacggcatcccggaggaactcctccggcggacactggcggcggtgaaggcattccacgagcagcccgcggaggagagggcgcgggtgtaccgtagggatatagggaagggcgtgtcgtatatttctaacgtggacctcttccaatcaaaagccgccagctggcgcgacacaatccagattaggatggggccaaccgtagtggattccagcgagattccagaagtgtgtaggaaagaggtgatggagtgggataaggaggtggtgcgtgtggcacgtgtgttgtatgctttactcagtgaggggctgggattgggtgcggagaggctcacggagatgggtctggtggaaggaagagttatggtggggcactattaccccttttgccctcagcctgatctgacggtggggcttaactcgcatgcggatccaggggctcttacggtgttgctgcaggaccatattggggggttgcaggttgagaccaaacagggttggattcatgtcaggcctcagcctaacgctttggttattaacattggagattttcttcagataatttctaatgaaacatacaagagtgctcatcatagggtgttagctaattactctaatgagccacgagtctctgttgctgttttcctcaacccaagtgatagggtgagactttttggaccattgccagagttaacatcaacagagaaaccagctctttataggaacttcactttcgatgaatttatgaaaaggttcttcacgaaagagttggacggtaaatcattgacaaatttcttcaggcagtga

SEQ ID NO: 651 - DNA, 1875 bp, Glycine max var. Williams 82
atggcatccagatcgagaaaatcgaagcgcaagctcgagccggagccacatccgctcgtcatcaccaagaagctccggcagaagctccctcgccggcgccgtcaaaacatctcgccagtgctcctcgtcggcatctccgcccagaatcctcgtttctccgtcgattccagctccgtctccgacttcgccgtaggcgaagcctcgtgcaactccagcagagcctccgtcgccggcaagggaaacataaactcgagaaacgaattctcgaccgattcaacgagaaatcggagattcgagaagcggaacgagaacgaagttgaggtgtcggagtcttcgtgcgttgactctgcttcgttcgcgagcgaacgtaacagaagcttgattctgaagtttaaaagagaagataagaatctaaacgaaaacgacgacgtttcggaagcgtgcacgaaatctgagattactactgttctgaagttcaaaagcggaagcgagactaagaatgcaaaagaagacgacgacgtttggtgcgcgaagtcagagattacttgtagcgaggaacagttcaattcaaactcaaagtcctccggtaacggtaacggaaacataaaagtctcttcggattcaaacgcaaacgacttcgtgtcgtttagttccggtgttcgcgcgtcgtcgtttcatgaggaagcgaacagaaacaaggaaaacactaaaaacagagcatcggaatctgaatactctgaagtttctagaagcctccacgtggaagagaattgcgctgatttaatagcgcaatcgatgacgaaggaggattcggatgtatacgacgtcgttgcggatctcgcttgctctgaggatctgcgtttctcgtactgcaacgacgacgacgacgacaacgaatcggagtactgttcgagtcagggaaccgtgttatccgaatttcattccgagcttttcggcgaatgctcgcagaatgagctttcggattactgtccgtcgtcgctgttcgtggattccggaagccagttttcggaaggatccgtcggagaaactccttcgccgacgcatttgttgttccttcagtacagcaaggagttcgcagagctagtttctgctcctccgttgaagaacgcttcaaacgttgaagatgttgtcaattttgtgagatttgaagatttggatgacgaagacagctaccagatgctgaggaagagggagaggaggcaaggctatgtgttgaattatggtgatggatatttctctaccactgaattcggagacaccgtgattgagcaacgtgcgcaaatggttcactggatcattgagcaatcttgtcgaagacagcttcggcaagagactctgtttcttggagtcaacctacttgatcgtttcctaagcaaaggatacttcaaagccaaaagaaaccttctaattgttggaatagcttgcctcacgttagcgaccaggatcgaagaaaatcagcaatacaacagagtggggcaaaaaaatttctacataggaagcaatgtgtacagtagaagcgaggtggtagctatggaatgggtggtgcaggaggtgctcaagtttcagtgctttctgcctaccatctacaatttcttgtggtattacctaaaagcagctaatgctgatgcagtcgttgagaagagggtcaagtatctggcagtgctggcactgtcaggtcatgagcaactgtgctactggccttcaacagttgctgcagcacttgtaatcctggcttgtcttgaattcaatcaaatttcatcccacaaagtcatagggattcacgttagatcaaaagatgagaatttgtacgaatgcatagagagcctggagtgggtgttacgctttcctggatag

SEQ ID NO: 652 - DNA, 1011 bp, Glycine max var. Williams 82
atgtctcttcattggtgttgctttgtgtgtctctttctcttggtgggattgagagcagaggtagctaatgctcagttttatagaaatgttggaaataaacatttaccttactggtcaatagtggtggatcaatcagggcatggaaacttctctaccatacaatctgccattgattcagtgccttctaataacaggtattgggtttctatcaaggtgaaggcaggtacatacagagaaaaagtgaagattccttacgataagcctttcatcatactaaaaggggagggaaagaggagaactttagttgagtgggatgatcacaatgatatttctcagagccctacgtttgcagccatggctgacaatcttgttgtcaaatgcatgagctttaggaactcatacaacaatccaataaataataaacacgagaatgtgcctgctgtggctgcgatggtaagtggcgacaaggcttattttttcagagttggtttctttggtgtacaagacactttatgggatgttgcaggaagacattactacatgctttgtaccatgcaaggtgctgttgattttatctttggtgctgcccaatctttatttgagaggtgttccatatctgttattggtggggccctagctccgggcctctcgggttttattacagcacaaggcagagaaaattcacaagatgcaaatgggtttgttttcaaagactgccatgtgttcggaagtgggtcgagttacttggggaggccttggagaagttatgccagggttttgttctacaacaccaccatgaccaacgttgtacaacctagtggttggacttcatcggattttgctggatatgagggtcgcataacatttgcagagtatggaaattttgggccaggttctgacccttctaagcgagtgagttggaccaagaagttggatttgaaaacaattgagaacatggcaagcctcaagttcattgacactgaaggttggcttcaaaaccaacagttctaa

SEQ ID NO: 653 - DNA, 789 bp, Glycine max var. Williams 82
atggtttcaatttctgatcatgaactggttttgatctttggtctcctaggtaacattgtgtcattcatggtgttcttagcacccttgccaaccttctatacaatttacaagaagaaatcatcagaaggatttcaatcaattccatatgcggttgcacttcttagcgcactgttgcttctatattatggcttcataaagaccaatgctactttgattatcaccatcaactgtattggatgtgttatagaagtttcatacctaacaatgtacattatatatgctcccaggaaacagaagatatccactttggtaatgatactcattgccgacattggaggttttggcttaaccatgttaatcaccacctttgctgtgaagggcattaaccgtgtccatgctgtgggatggatttgtgccatttttaacattgcagtgtttgctgctcccttaagcataatgaggagggtcataaaaaccaaaagtgtagagttcatgccattttcattgtccttatttcttacgctctgcgccaccatgtggtttttctatggtttcttcgacaaggatgacttcattatgtttccaaatgtgttaggatttatttttggcatctctcaaatgattttatacatgatatacaagaattctaagaagaatggagaaaccaattgtacagagcagcaagaaagtgagggcacagtgaactccaaacagcacagctgcgatggaaataaactcgattttccttcactggtggaaatgaaagagaatcaactcaatcaagtttga

SEQ ID NO: 654 - DNA, 1428 bp, Glycine max var. Williams 82
atggaagaaagttcgacaggaaagtggggatggatgaaaatgagggaagagctgaagaaggtgggtactatagcagctccaatggcggtttcaagtgtgttacaataccttttgccagtggtgtccttagtaatggttggccatcttaaccagctctctctttcaagtgttgctattgcaacctctctcaccaatgtttctgggtttagtgttttgtcagggatggctggtggattggaaactttatgtggccaagctttcggggcagggcaatatgaaaaatttggactatatacttacactgccataatatccctttctttggtttgtttcccgatcacaattctatggattttcaatgacaaaatattaactctattaggccaagacccaacaatatcccttgaagttcgtaaatatgccatttggctaatacctgctctatttggttccgcaattctcaaacctctaacacgatttttccagacccagagtttgatttctcccatgattctaacctccgctatagctttgtgcttccacgtagtaacatgttggacccttgtttttaaactggggttgggacatgttggtgccgcaatctccttcagcctttgcgtttggtttaatgtgataatgcttttgtcctttgtgaggtattcctctgcttgtgagaaaacacgcatctctttctccaagaatgctttggttggtgttggagagttctttcgctttgctgtcccagcagcagtcatggtttgtcttaagtggtgggcctgcgagatacttgttttgttagctggactttttccaaacccaaagttggagacatcagtcctatctatatgcttaacaatctctacgttgcatttcaccataccttatgggtttggggctgctgctagcactagagtttcgaatgaattaggagctgggaatccacaagcagttcatgtggctgtttctgcaacgatgttccttgcagtcacagagggtttcattgtaagtgcaacactattcggctgcagacatatcttgggttatgcctatagtgatgaccgtatggttgttcattatgtggctgttatgatccctctgctctgtctctctatttttactgacagcttacaaggagttctttcaggggttgctagaggaagtgggtggcaacatctaggagcctatgtcaatctgggagcgttttatctggtaggaattcctgtgggtatcctacttggctttgttgcacatttcagagcaaagggcctctggattggaattgtcactggctccattgtccaatcgattctcctttcccttattactgctcttaccaactggaaaaaacaggcaattatggcaagggaaagagtatttgatgctaaaccaccagacgtaaatggatcatatcacatgacgagtgcttaa

SEQ ID NO: 655 - DNA, 2542 bp, Glycine max var. Williams 82
attatatttttttaatccatacaattcgaatcaaaattttaatttaaagagattaatcattcaatatcagataaatcactcagatatatatatgtatgtatatgtatatatatcaaatctcaatgaagcatctgcagattgatcccgtctatgatttagtttttaataatatatatgtatagttgcgtgggtgactgaaaaagataacgcaaagttgtgtttagttgtgatgatacaaaagaggacaaaggtagaggcagagccaaagaaggataagatcgacatatagaagaaaagggtgcagtgatggaagaaagttcgacaggaaagtggggatggatgaaaatgagggaagagctgaagaaggtgggtactatagcagctccaatggcggtttcaagtgtgttacaataccttttgccagtggtgtccttagtaatggttggccatcttaaccagctctctctttcaagtgttgctattgcaacctctctcaccaatgtttctgggtttagtgttttgtcagggatggctggtggattggaaactttatgtggccaagctttcggggcagggcaatatgaaaaatttggactatatacttacactgccataatatccctttctttggtttgtttcccgatcacaattctatggattttcaatgacaaaatattaactctattaggccaagacccaacaatatcccttgaagttcgtaaatatgccatttggctaatacctgctctatttggttccgcaattctcaaacctctaacacgatttttccagacccagagtttgatttctcccatgattctaacctccgctatagctttgtgcttccacgtagtaacatgttggacccttgtttttaaactggggttgggacatgttggtgccgcaatctccttcagcctttgcgtttggtttaatgtgataatgcttttgtcctttgtgaggtattcctctgcttgtgagaaaacacgcatctctttctccaagaatgctttggttggtgttggagagttctttcgctttgctgtcccagcagcagtcatggtttgtcttaagtggtgggcctgcgagatacttgttttgttagctggactttttccaaacccaaagttggagacatcagtcctatctatatgcttaacaatctctacgttgcatttcaccataccttatgggtttggggctgctgctagcactagagtttcgaatgaattaggagctgggaatccacaagcagttcatgtggctgtttctgcaacgatgttccttgcagtcacagagggtttcattgtaagtgcaacactattcggctgcagacatatcttgggttatgcctatagtgatgaccgtatggttgttcattatgtggctgttatgatccctctgctctgtctctctatttttactgacagcttacaaggagttctttcaggggttgctagaggaagtgggtggcaacatctaggagcctatgtcaatctgggagcgttttatctggtaggaattcctgtgggtatcctacttggctttgttgcacatttcagagcaaagggcctctggattggaattgtcactggctccattgtccaatcgattctcctttcccttattactgctcttaccaactggaaaaaacaggcaattatggcaagggaaagagtatttgatgctaaaccaccagacgtaaatggatcatatcacatgacgagtgcttaaagctagtttggtcagctgtgtctcacatagacatagatatataattttgattttccgtaggaaataagtcaccaaactatggtttcgcaaagaaatgttacgagacacctacgtcaacatctagagagccaaagaaataaatgaaagcaaagaaataagtaacagataatataaatgttacaagaaaaataatggagtgtttgtaataatggagtgtccatgcatgactgttttattatattattctaatttggtcaaaatgctggatcaactccaattagagattattaaaactatgggcgcaagttcacattggttaattatatgtctgctatatgatacccagtaggaatggcgaccgatcttatccatagtaagctattttaactcgtgaaacatgattggactcatccaaataaattatggaagatggtggcatttctaaatccaactcatcagaggtattgaacctaaccaaagcatatgttgaagggctaggagaaggtggttttggataagtttttaaggggtggatcaatgagaattcattgactgctaccaaacttggcactagcattgttattgctattaaaagactcaatcaagatggtatccagggtcatagggagtgatccgtaagtttaatctaatcctctagctttgttcacacttcatactaattaagaaataaatgttacatgtgttacaccatagtaagcacaatgcatggttaatgagtacactgctagctaaaatattcacaaactatgctagtcaatttagactctgcttaccatctgtgtcggag

SEQ ID NO: 656 - DNA, 684 bp, Glycine max var. Williams 82
atgggagagaaagagaagagaaacaagaacaagaagcaaaagcaccaacaccccaatgaccaaaccacaaagcagaactccgatttctccttcaagccaagctcagaggtaaagggtatcaaatttggaggccagttcatagtgaagtccttcacaatcagaagagcaagacccttagagcttctcaaggttctttctttcccaccaaccaacaacaccaacaaaccaaaggacaagcttcctttcccttccaccacagcattcttgcccacaaacttcacaatcttggcacaccatgcttggcacaccctcacccttggccttggaaccaagaagtccaaggtggttctctttgtgtttgaaactgaggccatgaaggcctcagtggacagaatttggccaccagagatagcacttggtgatgtcaacaagaggctcataaggggcctcaatggatgtgagatggcaaggttcaagttcagaaaagggtgcataactttctatgtctatgctgttaggcaacttggaagctttggcttttcctgtgctgaggatctaagaaccattcttcagtctgtggtggagcttaaggatttcttggatcacactgtcatgctttccatgccaaaccaaagaagcatcagtttctcacagtcacaaccccaggtagccatggctcattag

SEQ ID NO: 657 - DNA, 513 bp, Glycine max var. Williams 82
atggaaaacactactaccacacactcaaaaatttctaccttttcatttactgtcctccttttgagggtcttaacctttatcttccttgttatggcgctcattttcatttccatagacacgctaccaatagaaacaagtgattacgcagtttatgaagaaatcaacttcaattatgtctatgcttatcgatatatgctctctacgatagttattgggtttgcgtataacctcctgcaaatgggcttttcaatcttcactgtggtctcagggaagcgtgtattaagcagttatggtggctatctatttgatttctttggtgaccagatcatatcataccttctgatttctggttcagctgctgaatttggttacgacgtacaacggcgtagagttacaaactccttcactgaaaaggcaaatgtttcggccagccttcttctagttgggtttttgttcactgccacagcatcaattttcacttcctttgctttgccaaagaaagctatcaattaa

SEQ ID NO: 658 - DNA, 940 bp, Glycine max var. Williams 82
gattgccggccaatttaaatgaaccttgtccttaagtactccttatacctagctagtaaacgaggaatattattagagcatcttctggccagaaactgcaccaaatctgtttgtataaacattaattaggagaagcctgcgatggaaaacactactaccacacactcaaaaatttctaccttttcatttactgtcctccttttgagggtcttaacctttatcttccttgttatggcgctcattttcatttccatagacacgctaccaatagaaacaagtgattacgcagtttatgaagaaatcaacttcaattatgtctatgcttatcgatatatgctctctacgatagttattgggtttgcgtataacctcctgcaaatgggcttttcaatcttcactgtggtctcagggaagcgtgtattaagcagttatggtggctatctatttgatttctttggtgaccagatcatatcataccttctgatttctggttcagctgctgaatttggttacgacgtacaacggcgtagagttacaaactccttcactgaaaaggcaaatgtttcggccagccttcttctagttgggtttttgttcactgccacagcatcaattttcacttcctttgctttgccaaagaaagctatcaattaatgagttgtattattcatacatcaactttctacaacaatacctattttctctttctcattgtcgtaaaacttgttgtacaaaaaatatttctcttaattaattagcttgacgtataaaataatgaatatggatcatgatagtagttttttttaattcccttctctagttaatttggtttagttcatcaatttctttggtggtcaatcgattgtagtggatttgtatgttgtcatctttgtgtatcagtgtaaggtatatgcacttttccttcttcaataattacacc

SEQ ID NO: 659 - DNA, 696 bp, Glycine max var. Williams 82
atgttttgttggaaaaggccatcatcatcttctttgaggcaaacaagtttcactcctcctgagttttgttcttcaatgagaattggtgacacccttgttcatgacccagaacaagttcagtctcaaagtggaaaggaatttgttttcaaaccctttggagaagatggcaccgatgcagaatacatgaggcaacaggacctgttactgttaggccctccaagattcttgttcaccatagtagaagaatcaaaagaagatttagaatctgatgatggcaaatccaagtgtgacaagagtggaaaaggttcaaggggtagaagcttgggtgatttactagttgtggagacaccatatatgacacctacaacttctccacctttcttcactcctcctttcactactcctatcagtccctataaccaacgtggattcaaccctctatttgaaacagcaactgatgctgagttcaacaaattaaagtcctcacctcctccaaaattcaagttcttacaggaagcagaagagaagcttagaagaaaactacaagaagacgaaaataagggaaatggagatgaggttgatggttctttcatcacaatagtagttgacaagaaaacagaaagagaggttaatcaccagcctcgtccaccacagtatcattcaagcacttcacaggtacttcccttagcttcttga

SEQ ID NO: 660 - DNA, 543 bp, Glycine max var. Williams 82
atgaagagagaaagagaggttgatagcttaaccatggcaaattgtttgatgttgctttctcgtggaggtgatcaatttgaggccacctactcatcaagcacttcaatgaacaaccgtgtctttgagtgcaaaacatgtaataggcaattcccttcatttcaggcacttggtggccacagggctagtcataaaaagcctaggttgatggctggagataatattgaaggccaattgcttcatgattcacccccaaagcctaagactcatgagtgttccatttgtgggttggagtttgctatagggcaagccttgggaggccacatgaggaggcatagagctgcgaatttgaatggaaacaacgtgtacaattctgctacggctacgagtagtagtagtggcggtagtagttttgattcatcacccaagaagaaagctgacaacaagagagttttggttttggatttgaatctgacaccctttgagaatgatttggagtttttgaagattggaaagccaactacttttgttgattatttgtattga

SEQ ID NO: 661 - DNA, 1155 bp, Glycine max var. Williams 82
atgggaaaggatctgtttagtaatttaccagacgaaattctaggtcgcatagtttcatttctaccaaatgaatcatcgctagaaaccagccttctttctacaaggtggagggacctgtggaatgaagctcttgtcaaacatggaactcaagaggatatcataggtgttgttgctggttttatcacacgttttgaggagtttgatccattgaagcatcctagaaagcttcaatttcactttgctgaagacagtgtagtctcagcaaccgttgcaaataataacaagcttatgcttcatttttccccttggaaagaagagattcaaatggggtatgagttggagttcaagcaaactaagcaacacaagccacctaccatcaaaaccctctatttgaaatcggtgagttgtttcacaagtaatattgctgcctccatcgtttcaaatttggagcatcttcagaatttggtggtcattgactgcaaagggttggaatctttgagtgttgactccacctctgagcttcacatgttaaccatcttggattgcttagagttgaagactctccatctcaaaacttctaggctcaagtcttttcggtatcgtgggcctcttcctttgcttaggccagaatatcatttcaacctgcgtgatgccatgcttgatttcagattaggactaagctgcagtggtttaaagaccaaggattttgatgcaacccttttaacaataaagaactgtgaagttcttactctgtgtaaatggacttttgaggaattaatatggccatcgatttctcctctatctgggagcttcatattctataaattaagagagttatggtggattgacaactatcatgaggatgaatacaacacagatgccttgttctccttcttgaaattatgcccttccttggagcatctttttgtgactattgatcctgaaagttattcggctggagggtccaattcatgcttaatgaaagggactaaatgcacagaactggaacatcttaaactgataaagtttatgggattttcaagtcgaaaagatgaaatctcattggctaaatgtttaattcatctaatcaagggaaagcctccaaagataaagacttcagatgggaattgcttggatgcagtgtttgtgcagtga

SEQ ID NO: 662 - DNA, 2109 bp, Glycine max var. Williams 82
atggagataacctacgcatcgccaagtttctcagacctccgcgccgccgctacctcctcctccatgccgtcgtcagcgcgtcccgtcaggatcattcctctccagcacccgaccgccacgacgtcgtcgtcatcgccgccgaacgctgcgttctcgcgctggacggcgaagctccggcgaatgacgtggatggagtggatcgagttcttcctcccttgcctccgctggattcgcatctacaaatggcgcgagtatttccaggtcgatctcatggccggaatcaccgtcggtgtcatgctcgttcctcagtcgatgtcctatgcaaaattggctggacttcaaccgatatatggactctactctggttttgtgcccctatttgtatatgccatatttgggtcttctcgccagcttgcagtaggtccggtggcattggtttctctcttggtctctaatgtgctaggtaacatagctgattcatccactgagttatacacagagctggcaatattactgtcccttatggttgggataatggagtgcataatgggactcttgaggcttggatggcttattcgtttcattagccattcagtgatatctggctttacaaccgcttcagctattgtcattggtttatctcaagcaaaatacttcttggggtatgatatagatgggagtagcaagatcattccagtagttaagagtataatagctggagcagataagttttcatggcccccctttgtgatgggatccattatgcttgcgatactacttgtcatgaaacacctgggaaagtcgaggaagtacttgcgattcttgagagctgccggtcctcttacagcagtagttctggggacagtttttgcaaaaatatttcatccatcatcaatttctttggtgggtgatatacctcaaggcctaccaaaattttctgttccaaaatcttttgagtatgcacagtccttaattccaactgctcttctcataactggtgtggctatactggaatcagtgggaattgccaaggcattagcagcgaaaaatggatacgagttggattcaaatcaagagttgttcggtcttggtgtttccaatgttcttggttcatttttttcagcataccccacaacaggatccttttcaaggtcagctgtaaatcatgaaagcggtgcaaaatctggtgtatctgggatagttttaggaattataatgacctgtgcacttttgtttctaacaccattatttgagtacatacctcagtgcacccttgctgccattgtgatctctgctgtgataggtctggtagattatgatgaggccatttttttgtggcgtgtagataagaaagattttcttctttggaccattactagcactacaacattgttccttggtattgagattggcgtccttgttggggttggggtttcacttgcttttgtcattcatgagtcagcaaatccacatattgctgttttgggtcgtttgccagggacaactgtttataggaatgttaaacagtaccctgaagcatatacatataatggaattgtaatcgttcgtgttgatgctccaatttattttgcaaacacaagttacataaaggacaggttgcgtgaatacgaagttgatgttgattgttctaaaagacatggacctgaggttgaaagaatttattttgtgattctagagatggcacctgtgacctacatagattctagtgctgttcaggctttgaaagacttgtatcaggagtacaaattacgggacattcagattgcaatatccaatccaagtccagaagttctgcttaccttgtctagatccggtctggtggagttgataggcaaagaatggtactttgtgagagtacatgatgctgttcaagtttgcttgcaacatgttcaaagcttgaaagggggatctaacagtccacaagcaccattctcttcattagaagacaaaccaagtttgtttgcccgattatcaaaagagagaggggagaagctttcaattaccgacttggagtctggtaatggcaggccaccactccccaaggagagagattcccaattggagccattgttgtctaaagatcattga

SEQ ID NO: 663 - DNA, 342 bp, Glycine max var. Williams 82
atgggagagtcttctaattcttctgcttcatacattcatatggtgcagcacatgattgagaagtgtttgatctttcacatgtcaaaggaagaatgcatggaagctctctccaagcatgcaaatattaagcctgtcataacatccactgtgtggaacgagctagagaaagaaaacaaggagttttttgaggagtatgccaaagccaagagtaaggacgaacgaatgtcggaggaagagacaagccaaatgatacagaagatgatctcagattcctctaaagtaacgttctcatacggaaggagcacggagactagacaacaagagtggtccactacctcatga

SEQ ID NO: 664 - DNA, 1017 bp, Glycine max var. Williams 82
atggttgagcctggctaccacaaagcaccctctaaggtggtttctatccctgttcacttcgtgggtttaaagtgcactggaaccgaatttgccacaaagatccagagggtgttgagagattttctggtgaggaacaccttgaggaagatcgctgccatgagggtggagttggagcgtgtaacatcccatttttccgaggttcgggtgaaagtgatgaaattgaagagggaacaaagggagaggatgaggctctacgagaccatcatgaacttgcttctcaagttggattttgttaaggtgttgttacactactctggcctcagagagtgcagaaagtctctcatcaacaaagctattgcccttcaagaatttcttgatcaagtgactattctccattttgaagagaaggagggtgagtgtgtgggagaagagaattgtttggtggaggaagagaaaagtagtggagtggaaactttcaagagtggggagggtgaatgtgttggagaagataattgtttggttaaggaagaggaagatgatggaatagaaactttgaggaatggggaggtagaaaaggagaagggtaggtgcatggaagaagaaagtattgggttgggaacaagattggtagaggaagaggagggtgaaaatagatgtgaggagcaagaggaagaagatgaggaaattgaagctttgaataatgaagacgtggaagaggaggatagtgagggaggaaggggttttgttggggagaaatatttggtgaaagagaaggatggagaaggaaagaagagggagttgttgttggagaagatggtggaggataaccagaagatgatggagatgatggtgcaactctttcagaggaatgagatgcagactacacttcttgcatctctcaaacaaagggtggagccgcttgagagagccttggcttgtgacaagttgaggaggaaaaaaaagagaaaggatgatgccaaaaataaacaaaatcatcctaaaaatggctttatctaa

SEQ ID NO: 665 - DNA, 3024 bp, Glycine max var. Williams 82
atgagcagttttcagtttcacttgagagttttgagtttgctgatttcagtttcatacttgctgacgtgtttggggaacaatgacatacctgtccagttgaatgatgatgttcttggcctaattgtgttcaaatcagaccttgatgacccttcttcttatcttgcttcatggaatgaagatgatgccaatccatgttcatggcagttcgtgcagtgcaatcctgagagtggaagagtttctgaggtctcattggatggcttaggactatctgggaagattggaagaggtcttgagaagttacagcatctaacggtattatccctttctcacaacagcttgagtgggagtattagcccatcacttactctttccaatagtcttgagaggctgaaccttagtcacaatgctctttctggttccattcctacttcttttgtgaatatgaattcaataagatttcttgatctttcagagaattcattctcaggaccagtccctgagagtttttttgagagctgttcttcccttcaccacatttctctagctaggaacatatttgatggaccaattcctggctcactgtctagatgttcctcattgaatagcattaatctttccaataaccgtttctccggtaatgtagacttcagtgggatttggtcattgaacaggcttaggactttggatctatccaacaatgccttatcagggtctttacctaatggaatttcatccatacataactttaaagagatcttattacaaggtaaccagttttcaggtccattatccactgatattggattctgcctgcatctgagtaggttggatttcagtgataatcagttgagtggagaactacctgagtcactagggatgctaagttctttgagctatttcaaggcatcaaacaatcatttcaacagtgaattccctcaatggattggtaacatgaccaatctggagtacctagagctctcaaacaatcagttcactggaagcatcccacagtcaataggggaactgagatcactgactcacctgagcatttcaaataacaagcttgttggaactattccatcatcattgagttcctgcacaaagttatctgtggtccagctcagaggtaatggtttcaatggcaccattccagaggctttgtttggcctaggattggaggacatagacttgtcccataatggattgagtggctcaattccaccaggatcaagcaggctcttggaaactctcaccaacttggatctttcagataaccatctccaagggaatatccctgcagaaactggtcttctttcaaaactaagatatttgaatctgtcttggaatgatcttcattctcagatgcctccagaattcggcctccttcagaacctgacggttttggatcttcgcaacagtgccttgcacggttcaattccagcagatatatgtgactcaggcaatttagctgtcctccaacttgatggaaattcatttgaagggaatattccgtccgagattggaaattgtagctctctttacttgctgagttcgtctcacaataatttgacaggttcaattccaaagtccatggcaaagctaaacaagctcaaaatcctcaagctggaatttaatgagcttagtggagagataccaatggagcttggaatgctgcagagtcttcttgctgtgaacatatcctacaacaggctcacaggcaggcttcctacaagtagcatatttcaaaacttggacaaaagttcattggagggaaacctgggtctttgctcacccttgttgaagggtccatgtaagatgaatgtccccaaaccactagtgcttgacccaaatgcctataacaaccaaataagtcctcaaaggcaaagaaacgaatcatccgagtctggccaggtccatcgccacaggttccttagtgtatctgctattgtagcaatatctgcatcctttgtcattgttttaggagtgattgctgttagcctacttaatgtttctgtaaggagaaggctaacatttgtggataatgctttggaaagcatgtgctcaagctcctcaagatcaggaagtccagccacaggaaagcttatcctgttcgattcccattcctcacctgattggatcagcaatcctgagtccttgctcaacaaggcatctgagattggagaaggagtctttggaacactctacaaggttccattgggatcacaaggtagaatggtagcaatcaagaagcttatatcctcaaacataatccaatatccagaagactttgatagggaagttagaatcctagggaaagcaaggcacccaaatctaattgcattgaaaggatactattggactcctcaattacagcttttagtgaccgagtttgccccaaatggtagcttgcaagccaagctacatgaaaggcttccttcaagtcctcctctttcttgggctataaggttcaaaatcttgcttggaacagcaaaggggcttgctcatttgcaccactctttccgtccgccgatcatccactacaacataaagccaagtaacattttgcttgacgaaaattacaatgccaagatctcggatttcgggttggctcggcttctgacaaagctggacaggcatgtgatgagcaacaggtttcagagtgcattaggatatgtggcaccagaattagcatgccagagcttaagggtcaatgagaaatgtgatgtctacggttttggagtgatgatccttgagctggtgacaggtaggaggccagtggagtatggagaagacaatgtgctgatactgaatgaccatgtgagggtgttgcttgagcatggtaatgtgttggagtgtgtggatcaaagcatgagtgagtatccagaagatgaggtgttgcctgttctgaagctagcaatggtatgcacctctcaaattccttctagcaggcctactatggctgaagtggtgcaaatactgcaggtcattaaaaccccggttcctcaaaggatggaagtgttttga

SEQ ID NO: 666 - DNA, 3574 bp, Glycine max var. Williams 82
ccacgtttgttggaccgaaactgtttgatcacggactacactaacaataccatattcaccccattattggctttctcaatgacccatctctcaccccatttgggtaaaatattctcttctcttgagcacacatgatgtagtatcgttttcgcttaaagtagtgtaactaacatctgccagtcattacagttttcacatactatgttatccctaaagaaaaaaaagaagccatagttaactactaactaaagtctaaagatagaaatataactccatcaacctcagcaagagggagagaaagaagaagaagaagaatgagcagttttcagtttcacttgagagttttgagtttgctgatttcagtttcatacttgctgacgtgtttggggaacaatgacatacctgtccagttgaatgatgatgttcttggcctaattgtgttcaaatcagaccttgatgacccttcttcttatcttgcttcatggaatgaagatgatgccaatccatgttcatggcagttcgtgcagtgcaatcctgagagtggaagagtttctgaggtctcattggatggcttaggactatctgggaagattggaagaggtcttgagaagttacagcatctaacggtattatccctttctcacaacagcttgagtgggagtattagcccatcacttactctttccaatagtcttgagaggctgaaccttagtcacaatgctctttctggttccattcctacttcttttgtgaatatgaattcaataagatttcttgatctttcagagaattcattctcaggaccagtccctgagagtttttttgagagctgttcttcccttcaccacatttctctagctaggaacatatttgatggaccaattcctggctcactgtctagatgttcctcattgaatagcattaatctttccaataaccgtttctccggtaatgtagacttcagtgggatttggtcattgaacaggcttaggactttggatctatccaacaatgccttatcagggtctttacctaatggaatttcatccatacataactttaaagagatcttattacaaggtaaccagttttcaggtccattatccactgatattggattctgcctgcatctgagtaggttggatttcagtgataatcagttgagtggagaactacctgagtcactagggatgctaagttctttgagctatttcaaggcatcaaacaatcatttcaacagtgaattccctcaatggattggtaacatgaccaatctggagtacctagagctctcaaacaatcagttcactggaagcatcccacagtcaataggggaactgagatcactgactcacctgagcatttcaaataacaagcttgttggaactattccatcatcattgagttcctgcacaaagttatctgtggtccagctcagaggtaatggtttcaatggcaccattccagaggctttgtttggcctaggattggaggacatagacttgtcccataatggattgagtggctcaattccaccaggatcaagcaggctcttggaaactctcaccaacttggatctttcagataaccatctccaagggaatatccctgcagaaactggtcttctttcaaaactaagatatttgaatctgtcttggaatgatcttcattctcagatgcctccagaattcggcctccttcagaacctgacggttttggatcttcgcaacagtgccttgcacggttcaattccagcagatatatgtgactcaggcaatttagctgtcctccaacttgatggaaattcatttgaagggaatattccgtccgagattggaaattgtagctctctttacttgctgagttcgtctcacaataatttgacaggttcaattccaaagtccatggcaaagctaaacaagctcaaaatcctcaagctggaatttaatgagcttagtggagagataccaatggagcttggaatgctgcagagtcttcttgctgtgaacatatcctacaacaggctcacaggcaggcttcctacaagtagcatatttcaaaacttggacaaaagttcattggagggaaacctgggtctttgctcacccttgttgaagggtccatgtaagatgaatgtccccaaaccactagtgcttgacccaaatgcctataacaaccaaataagtcctcaaaggcaaagaaacgaatcatccgagtctggccaggtccatcgccacaggttccttagtgtatctgctattgtagcaatatctgcatcctttgtcattgttttaggagtgattgctgttagcctacttaatgtttctgtaaggagaaggctaacatttgtggataatgctttggaaagcatgtgctcaagctcctcaagatcaggaagtccagccacaggaaagcttatcctgttcgattcccattcctcacctgattggatcagcaatcctgagtccttgctcaacaaggcatctgagattggagaaggagtctttggaacactctacaaggttccattgggatcacaaggtagaatggtagcaatcaagaagcttatatcctcaaacataatccaatatccagaagactttgatagggaagttagaatcctagggaaagcaaggcacccaaatctaattgcattgaaaggatactattggactcctcaattacagcttttagtgaccgagtttgccccaaatggtagcttgcaagccaagctacatgaaaggcttccttcaagtcctcctctttcttgggctataaggttcaaaatcttgcttggaacagcaaaggggcttgctcatttgcaccactctttccgtccgccgatcatccactacaacataaagccaagtaacattttgcttgacgaaaattacaatgccaagatctcggatttcgggttggctcggcttctgacaaagctggacaggcatgtgatgagcaacaggtttcagagtgcattaggatatgtggcaccagaattagcatgccagagcttaagggtcaatgagaaatgtgatgtctacggttttggagtgatgatccttgagctggtgacaggtaggaggccagtggagtatggagaagacaatgtgctgatactgaatgaccatgtgagggtgttgcttgagcatggtaatgtgttggagtgtgtggatcaaagcatgagtgagtatccagaagatgaggtgttgcctgttctgaagctagcaatggtatgcacctctcaaattccttctagcaggcctactatggctgaagtggtgcaaatactgcaggtcattaaaaccccggttcctcaaaggatggaagtgttttgatgagatatgcttctctgttgaactagcttgacatatagaaaatctgtgactattgagatttttttttcttctttttcctttatgttctgtatcctttttaatttccttggccatttggtttgtgtggactgttcttttatgtacaagcagattttcctcgtacaaatggaaatcactatcatataaatccgtatttcgcaactcttgttttctcttttactgatttcagtttatgc

SEQ ID NO: 667 - DNA, 1116 bp, Glycine max var. Williams 82
atgcaatttgctgagaaaatgcaacccttgaaaatggggttccgtgagtacatcgaagctttggaggaagaaaggaaaaaaatccaagttttccctaaagagcttcctttgtcattagagcttgtcacacaagcaattgaggcgtgtagacagcaattgtgtggaacggttgcggagtacaatttgaatgcccaatcggagtgttcggagcagacatcaacggatggacctgtttttgaggagttcattattcctataaagaaaaaggcatctcaagcatctgttgaagaagatgatgatgaagaacattctcataaacacacaaaaaccaccactgataaaaagaaatcagattggctcagatccgttcagttgtggaatcccaatccacctcctaccaaagaggatgttgtgcctaggaaaactaatgttgtggaagtgaagagaaacggtggtggagcttttcaaccattccaaagagaggaaaaaagtggtgtttcaaaggctaataataataatgaagcatcggcaattggtaaagcgccctcttcaccaccagtgcctgctacaagttatacagggccagtgagagtagacagcaaaaaagaggagaaaggagacgctcagagaaagcaacgcaggtgctggtcacaagaattgcacaagagattcttgcatgcacttcaacaacttgggggtgcagattctgccacgcccaaacaaatcagggaattaatgaaggttgatggcctcaccaatgatgaagtcaaaagtcatttacagaaatttcgtcttcacactagaagaagccccataatccacaacagtgcaagttcacaagcaggctctttatttcttgtggggaacatttttgtgcagccaccagaatatgctacctcatcagcatctggaggggaattgaccacagctacccctgctgctccaactggaatatatgcacctgtggctgcacaccttccagctggcacccacacatcaccaattatgaagcattcacattcaccttctgaggaaaagaataatcatagtgttcattcaaactcaccggcctcatcatcctccacacacaccatcacaacttcaccacctgcctaa

SEQ ID NO: 668 - DNA, 2145 bp, Glycine max var. Williams 82
atgtgtgtcttacttccttccttcctcttttcagaatcaatggttacctctctggctatcataattcttgtgctgctattccaacaaacttgccttgccaagcagcaccaccaccacccaccctgttattcttcatgtggcgaaattcacaacataacgtatccatttcgactaaaaggcgacccaatcggctgcggcgatcaagattacgaattagattgcgttgaaaacgtgacagtaatgactctattttcagggaaattccacgtgcaggaaataaattacaagaggtacgagatccggttgaccgatgctggtgtggtggaggacattgcttgctcaattcctcgttatttctttaatctctacaatttcacttacatcggtggtcttaactattctgcatatggtccgttaagtttctcggggtatcctcagtatgcggtgtttctaaactgcactaccccagtcaccgatgatcctcgatacgtagctgtgaaggtcaacggtaattgtgattcgagttccgtaggccatatctatgccattctggtcacagacgatgatgatcgctttgggtttacactgacggacatcaaggttgggtgccgattgaaggttgctacatttgcaaactggaaatataataacagggaggttaacgtttcttattctgatatcaacaagtggctgcaccacggaatttggatgtcttggttctttccagttatttgtagggaccgatgcggaaagggtgtgagttgctacatcgatcaaaccacgcgagaaactcgatgtgcagatagctactgccaaatctttggcattcaaacatacaagtgcggaattcgtaatcagattcttgaatatatgcggcaaattcttggctacacagtaggttatcttaaaagcgttataatgggatatgtaaatagaataagatatcgtgagcaactaacaagctgggatagtgaagcagaattctttgaacaaaatgctatagcaatattcctggcaaccagattgctatttggaatcacacttttactaatgctatatatctatatgtggcgacgtagacattattcaatgtatgaaaacattgaaatttttttgctagatagcaatctaaatcctattaggtatgaatacagagaaataaaaaaaatgaccaaagatttcaaagtgaaattgggtgaaggaggtttcggctctgtatacaaaggaaaacttcgaagcgggctagatgtggcaataaagatgttgaccaaatccaaaactagaggacaagattttatcagtgaagtggctacaattggaagaatacatcacgtgaatgtggtgcgtcttattggatattgtgctgaaggagaaaagcatgctctagtttatgaattcatgcctaatggttcattggataaatacattttctctaaagaagaaagtgtctccttaagttatgacaaaacatatgaaatatgtcttggcatagctcgtgggattgcttatttgcatcaagattgtgatgtgcaaattctacattttgatatcaagcctcataatattcttctagatgataacttcattccaaaggtttcggattttggacttgcaaagctatatcctatcaaagataagtcaattattttaactggactaagaggaacttttggttacatggctccagaattattctacaaaaatattggtggagtgtcatataaggcagacgtctatagctttggaatgcttttgatggaaatgggaagtagaaggaggaactcaaatcctcacacagagcactcaagccaacatttcttccccttttggatctatgatcattttatggaagaaaaggatattcacatggaagaggtctcggaagaggataagattctagtgaaaaagatgttcatagtttccctttggtgtatacaattaaaaccaaatgatcgtccttcaatgaagaaggttgtagagatgcttgaaggaaaggttgaaaatattgatatgcctccaaagcctgttttttatccccatgaaacaacaatcgactctgatcaagcatcatggagtgattcaactagttcttgcaagaacattgacaaaaccaagtccaatttttcactggagaacaactcttga

SEQ ID NO: 669 - DNA, 966 bp, Glycine max var. Williams 82
atggagttttcttgcaaggacttcaaggtgggaaaatgtgagggagaaaaagtagtagatggtgaaaccatgcccttggtgctacaacctccagtgcctaacaagagtgacttggaatccttgctattggctctgaagaacaacaaagaatggtttgagcaaatgatcatcaagaacagtgctgttctgcttagaggctttgatgtcaagaatgctgaggacttcaatgagattgtagaaacctttgagtgggaagacattcgttatgttggaccagcacctcgcacacatattcacaaaagggtgtggactgccaatgaaggacccctctcagagttcatctactatcaccatgaaatggttttgatcaaggaatatcccaagaaagtgatactcttttgtgagatacctccccctgaaggtggagagaccccttttgttccaagcttcaaagtgacagaaaagatgatggaggagttcccagaagaggtgaaggaaattgaagagaaagggttgaagtatacatttacagctcctagtgctaataatgtctcctccatgagaggtagagggtgggaagatacctttgggacctcagatcgcaaagaagccgagaaaagggcaaaagctctaggaatggacgtggagtggcttccaaatggtgggatcaagacaatacttggaccacgatgtttaaccaaggtatttgaaggaaggaaaggaagaaaaatgtggttcaacacagtagtagggatgcatggaaaagagattagctcggccataatggcagatggaacagagattccagaacatgtagtgaaaaggtgtgaagagatcattgaagaagagagcatacagttcaagtgggagaaaggggatgttctcttctttgataactatgctttgcttcatggcagaaggccttcacttcctccaaggaaagtccttgttgctacatgcaagtga

SEQ ID NO: 670 - DNA, 1104 bp, Glycine max var. Williams 82
atggagttttcttgcaaggacttcaaggtgggaaaatgtgagggagaaaaagtagtagatggtgaaaccatgcccttggtgctacaacctccagtgcctaacaagagtgacttggaatccttgctattggctctgaagaacaacaaagaatggtttgagcaaatgatcatcaagaacagtgctgttctgcttagaggctttgatgtcaagaatgctgaggacttcaatgagattgtagaaacctttgagtgggaagacattcgttatgttggaccagcacctcgcacacatattcacaaaagggtgtggactgccaatgaaggacccctctcagagttcatctactatcaccatgaaatggttttgatcaaggaatatcccaagaaagtgatactcttttgtgagatacctccccctgaaggtggagagaccccttttgttccaagcttcaaagtgacagaaaagatgatggaggagttcccagaagaggtgaaggaaattgaagagaaagggttgaagtatacatttacagctcctagtgctaataatgtctcctccatgagaggtagagggtgggaagatacctttgggacctcagatcgcaaagaagccgagaaaagggcaaaagctctaggaatggacgtggagtggcttccaaatggtgggatcaagacaatacttggaccacgatgtttaaccaaggtatttgaaggaaggaaaggaagaaaaatgtggttcaacacagtagtagggatgcatggaaaagagattagctcggccataatggcagatggaacagagattccagaacatgtagtgaaaaggtgtgaagagatcattgaagaagagagcatacagttcaagtgggagaaaggggatgttctcttctttgataactatgctttgcttcatggcagaaggccttcacttcctccaaggaaagtccttgttgctacatgcaagtgagtgatttgagatgatactattcaaattatatatactaagagagaaagggtattgaggatatatctataaaagctatttctgaataagtgtgtcatttcaccattatatgacaaggaaaaggcaatgtattgtcacttt

SEQ ID NO: 671 - DNA, 2019 bp, Glycine max var. Williams 82
atgctctgctggcttgaatctttggtgggattgttggcttttcttggaatacagcttcctgtcataatggctgattgccctttgaattttactggttcaaacttcacactggcttcctccctatgctctaaccatggtgacaggggaaaatgttgtcgctacattaacactaacgttgcaatttctgttgctcgttttgctaatgcaacaggcaacctaggggtccctcaaaatgcatctgacatctgcctccaaaccatatttcaaaccttggaacttaatggagttgcacaaaatgcaacagctttttgtggttttgggacaaaaattcccgttaattatgaatgcaaggggagaactagtgttgtccaaatgctgcaatcccccagatttacggaggtcacaaaaaattgcaaagcgccactaggagaggaaagtaaatgtaagaagtgcttaaatgccggctttggttatctgcatcatatcggaattgaagataatataacactaagtacatgtcgtgatgccacttttgctgcactagcaagccaagttgatgagacatctattattgacattgcaatttgcttcttcggggttcaaggacttctcatacctcctgtttcagagtcatccccacccttgcctgctcctaaggcttctccaagccccccacgggttgctgatggtccaagtcatccattgttaagtgcgcctttaaagggaaaccaccattcatatcatttgacattagttccaggtattgctattgcagttacagctgttgctgttatcacactcatagtcttgatagttctaattcgccagaaaagcagagagctagacgagcctgataattttggtaaatcctgttcgaaaaccttacctccttgtgcaacatggaaatttcaggaaggttcttcgtctatgtttcgaaaattcagctacagggagataaaaaaggcaacaaacgattttagcactgtcattggccaagggggatttggaactgtgtataaagctcaattttctgatggactgatcgtagcagtaaaaaggatgaacagaatatctgagcagggggaggatgagttctgcagagaaattgaacttcttgctcggctgcaccatcggcatcttgttgctttaagaggcttttgcattaaaaaatgtgagaggtttctgatgtatgaatacatgggaaatggaagcttgaaagatcatcttcattcccctggtaaaacacctttaagttggcgaactagaatccaaattgccattgatgtcgccaatgcactggagtacctccatttctattgcgatcctcctctgtgtcacagagatattaaatccagcaacactttactggatgagaacttcgttgctaagatagctgattttggccttgcacaagcttcaaaagatggctcagtatgctttgaacctgtaaacaccgaaatccggggaactccaggttatatggatcctgaatatattgttactcaagagctcacggagaaaagcgatatatacagttttggggtgttactacttgaaattgtgacaggaagacgagccattcaagataataagaatttggtagaatgggctcaaccatacatggaatcagacacaagattattggagctagtagatcccaatgtgagggagtcttttgacttggatcagctccaaacagtaatctctatagtagtatggtgcacacagagagaaggaagggcaaggccttcgataaaacaggtacttaggcttctgtatgagacatcagaaccaatgcacagtgagtttctacaagcagttgaagatgaagaaggtcagggaagtcagcatagaggcagaagaagcaaggggaaaatgctcagaaatgaggcattgtttcacagcggagatggaagatatcttgcttcatcttcaagtacgtctcggtcgtattgcagtagaacctttttacttgagagtggctctccacagtctccgccaaatatgttctctctctga

SEQ ID NO: 672 - DNA, 1008 bp, Glycine max var. Williams 82
atggagaactaccttctcattgctactttgatcagcacaagtctcgtatttgcttgttacattattctcatggtaggagatacatgttctcgagccactaatgattgtgagttgggatcacaatgcctcgagtgcaattcgcaaaatcgctgtacacgaattcaaactataagtcctatttcaagggtgaaagatctcccatttaatcaatactcatggcttacaacccataattcatttgcatggagaggagtgaactcaagtattggttttccaattttgggcatcatgaaccaagaagactccattacggatcaactcaaaaatggtgtaagaggattaacgttggatatgaatgattacaaagatgacatttggttatgtcaaggaccatgctctaaatatacagcttttctaccagcaatctatgttctaagagaggtcagggcattccttaaaacacatccaacacaaatcatcaccattttcattgaggatcatgtaacatcacgaaatggtgtgaataaggtgtttaatggagcagggttgaggagattttggtttccagcatctaaaatgcctaaatatggcggtgactggccaaccgtcaaagaaatgatacgtaggaatcataggctaattgtgttcacttcaaatgctactaaggaggctcgtgaaggaattgcatacgtgtggaattatgtcgtagaaaatcaatatgggcatgatgggatgaagggaggttcttgttcaaatcgtgttgaatcattgccaatgaacacaaccacaaagtcactagtcttaatgaactactttcgaaatgtacaaaattcgaaagaagtttgtagggataactcatctccattgattagcatgatgaatatgtgcttcatggttgcgggtaatcgatggcctaactacgttgctgttgacttttacaagagaagcgatggtgggggggctccagacgcattggatatggcaaataaaaacttgcttgagacgtaa

SEQ ID NO: 673 - DNA, 1570 bp, Glycine max var. Williams 82
attagtagcttgtctatgtaattcgtaatttggtgttaaaccaaaataggagatggagaactaccttctcattgctactttgatcagcacaagtctcgtatttgcttgttacattattctcatggtaggagatacatgttctcgagccactaatgattgtgagttgggatcacaatgcctcgagtgcaattcgcaaaatcgctgtacacgaattcaaactataagtcctatttcaagggtgaaagatctcccatttaatcaatactcatggcttacaacccataattcatttgcatggagaggagtgaactcaagtattggttttccaattttgggcatcatgaaccaagaagactccattacggatcaactcaaaaatggtgtaagaggattaacgttggatatgaatgattacaaagatgacatttggttatgtcaaggaccatgctctaaatatacagcttttctaccagcaatctatgttctaagagaggtcagggcattccttaaaacacatccaacacaaatcatcaccattttcattgaggatcatgtaacatcacgaaatggtgtgaataaggtgtttaatggagcagggttgaggagattttggtttccagcatctaaaatgcctaaatatggcggtgactggccaaccgtcaaagaaatgatacgtaggaatcataggctaattgtgttcacttcaaatgctactaaggaggctcgtgaaggaattgcatacgtgtggaattatgtcgtagaaaatcaatatgggcatgatgggatgaagggaggttcttgttcaaatcgtgttgaatcattgccaatgaacacaaccacaaagtcactagtcttaatgaactactttcgaaatgtacaaaattcgaaagaagtttgtagggataactcatctccattgattagcatgatgaatatgtgcttcatggttgcgggtaatcgatggcctaactacgttgctgttgacttttacaagagaagcgatggtgggggggctccagacgcattggatatggcaaataaaaacttgcttgagacgtaagaaatgcaacgaatgacttgtataattatttttgttatataaagatgaaggattacgtactgaagaatatgtgttccaattatatgttgaacacaactttctctctcttttaagcatgttatcccctgcatgcatggttcctaatttctttccctggccccactagctctcatggtatagtagcaacataactttttccccttgttttttcttttcaaatcaatttggcctttggcacacatatgcagctttactatttaaccatagtatgaacttgatttttccccttgctattactaaacaagcaagttgggttcatattttcaattttgttgagttaaaaaaattcagattaatggtttcaaaatgttatgcaaactttggattgtcatttataatgcaaatgttactgagctgcttaatgcaaacttggcttcctcattctgtaaaagtgagatgtcgctcgatggagcaaaaggcaatgtttttgctcctcagaagacattgaag

SEQ ID NO: 674 - DNA, 2159 bp, Glycine max var. Williams 82
accacacgtgtgggaggagtcagataaggggcagagagaggggcggtggcaggcccagtcccctctctgtgcctgttgggtatgttcctctgttccatctcatatataagagaaagcaaagcgtgacatagctaaagagaatttgcagagccttcagatttagctacctctattattattattactcattactcatttctcgtaccaaacacaacacaacacaacacatcacactcttctctcttctcttctttcttatcccattacaatgcccggtagtttagaaccgttggatttgggtgttcacataccctaccacttcagatgcccaatctcgctcgaactcatgcgagacccagtaaccgtctgcaccggtcaaacctacgaccgcgccagcatcgaggcatgggtcagcaccggcaacagcacgtgtccggtcacacgcgccactctcacagacttcaccctaatcccgaaccacacccttcgccgccttatccaagagtggtgcgtcgctaaccgcgcttttggcgtcgagcgaatccccactcccaaacagcccgcagaccctgccttagttcgctctctcctcaaccaagcttcttccggttctgcccctgctcacctccgcctttcttccattcgccgactcagacaactcgctcgcgactcggacaagaatcgttccctcattgcctctcacaacgttcgccagatccttctccctatcgttttcaacaacggttcggatgagttgaaaaacgaatcgctcgcgctactcgttatgtttccgcttggtgagtcggaatgtgcttcgctcgcatctgattctgtgaagattggctatctatcgcggatgttgacgcataactcgttcgacgtccgagtcaactcggccgcgttgatcgagatcgtcgtcgccgggacgcactcgccggagctacgcgcggaggtgagcagtgtcgacgaaatctacgacggagtggtggatctgctccggagcccgatctcgcacccgcgcgcgctcaagatcgggatcaaggccttgttcgcgctttgtttggtgaagaatacgcggcagaaggcggtggacgccggcacgccggcggttctagtcgaccggctcgcggacttcgagaagtgcgacgcggagagggcgctggccacggtggagctgctctgccggattccggcgggatgcgaggcgttcgccggacacgcgctgacggtgccgatgctggtgaagataattctgaaaatctccgaccgtgcgacggagtacgccgccggagcgctgctctcgctgtgttcggaatcggagcggtgccagcgcgaggcggtggcggcgggcgtgctgactcagcttctgcttctcgtgcagagcgattgcacggagagagcgaagaggaaggcgcagatgctgctgaagcttcttcgggattcgtggccgcaagattccatcggaaataattctgacgattttgcatgcagccaggtcgttgtggttcccttttgaccgttttttaatttttctcctccagtaataattatagtggaaaaaaatgtttagatttcgagaaaaagaaagcttaattagagagtcttttttgtttgtttagattggtaaataaataggtctgtaatgtaattctgtatttaattatttttctttcttctctttgtttttgtatgtaacgattattgtgaagaacgaaagcaagcaaaaatgtttcatcagggagttgtaatttttgtaagatggaaaagaaaaatcaaaatagagagaaagtgtatcaaaaaaacaatattgacagaacagaacacgataaaaaaaatatgtgaaagtgaaactacagttgctgctgcattccaatggaagggctatctgtatgggccataactatcaacttgtagccgaatagcgtactggtctatgactacgaagtttgagcaagaacaaaacagagagaacagaaggggttgcacggatttgaaacgtctttgaatgaaaaggaaaagagtgtgcacatgtgagggaacatggtgggccccagagggtcctactacaaggagtgggaaaaaatgatttatgtggcttacagatacactttttttttttataacgaaaaatttaggtatgctgcattttgagagattca

SEQ ID NO: 675 - DNA, 1428 bp, Glycine max var. Williams 82
atgggtaatgagaatcgcgagcttcacgtattattcttccccttcccagctaatgggcacataataccaagcattgacttagccagagtctttgcttcaagaggaatcaaaaccaccgtagtcaccactcccctcaacgttccactcatttcaagaaccataggaaaagccaacatcaaaatcaaaacaatcaagtttccttctcatgaggaaactgggttgcccgaaggttgtgaaaattccgattctgccctctcctctgacttgatcatgacgttcctgaaggccaccgtgctcctgcgggacccactggagaatctgatgcaacaagaacatcctgactgtgtaattgccgacatgttctacccctgggcgacagactctgccgccaaattcggcattccgagggtcgtgttccatgggatggggttctttccgacatgcgtgtcggcgtgcgtgcggacatacaagccccaggacaacgtctcctcgtggtccgaacccttcgcggttccggagcttccgggggagatcaccatcaccaagatgcagctcccccagacaccgaaacacgacgaggttttcacaaagcttctagacgaggtcaacgcttcggagctcaagagccacggcgtgatcgccaatagcttctacgagctcgagccggtttacgccgatttttaccggaaggagctcgggagaagagcgtggcatttgggaccggtttgtttgagcaatagggacgccgaggaaaaagcatgcagaggaagagaagctgctattgatgaacacgagtgtctgaagtggcttgactcaaaggaaccaaattcagttgtgtatttgtgtttcggtagcatgacagcgttctccgacgcgcaactcaaagaaatcgctttaggtttggaggcttcagggcagaatttcatatgggttgtcaaaaaagggttgaatgaaaaattggaatggttaccagaagggtttgaggagagaattttaggtcaaggaaagggtttgatcataagaggttgggcaccccaagtgatgattttggaccatgaatccgttggagggtttgtgacacattgtgggtggaactcagtattggagggggtgtgtgcaggggtgccaatggtgacatggccaatgtacgcagagcaattttacaatgctaagtttttgacggacatagttaagattggggtgagtgtaggcgttcaaacgtggattgggatgatgggaagggaccctgtgaagaaggaaccggttgagaaggctgtgaggaggatcatggttggagaggaggcagaggaaatgaggaacagagcaaaagagcttgctcgaatggcaaagcgtgctgtggaggaaggaggatcttcttacaacgatttcaactcattgatcgaggatttgaggtcgcgtgcctgttga

SEQ ID NO: 676 - DNA, 2256 bp, Glycine max var. Williams 82
atgacatttaagaaagactttaaacaacaaatggtgcctgagtgggagaaagagtacatggactatgaaggcctcaaaagaatattgaaagagataaaaaacagcaagcaagctacacacaataggtccttgcatcacaggctcagacttgaaagggcattcagtggaatacacttgcaaggtagcaatcatcagagagagggggatattgaggaccaagttatagaagtaaaaacattagaacaagatggttccagacagttatataagaccaactttcagaagttcgatgaagaaggaggagaggttgaggcaagactctttcagaagcttgatgaagagctcaacaaggtcaatgcattttacaaggatcaggtggaagcagcccagcatgaagtaacccttttgagtaaacaaatggaggccttggttgcactaagggtaaaggtgaaaagtccagatacaggattgaaacagattatctcctcacctgaagagactatggatgaaagtcatcagcaaaaagattctatggttggacctgaagataatcctcttcaacaggccaatagaaatactcatcatgaggagcaagcagaagcaaacaataattacatcacaaaagatcccttggaaatcctagagcacgtaaaggttgataatgttcctcaatctccaatatcaacaattaaaaaagcttttactgattccagtgataatgaattgagcttcagcaaagaagagctgagaaaagttgaagagcaactgagacttgtgtttgttgagttctatcagaaactcctccatctcaaagattacagttttatgaacctctcagcattttccaagatcatgaagaagtacgaaaagcatacatcaagggcagcatctgcagcatacatgacagtagtggataactcctatgtgggcagttctgatgaggttaactttctattggagaaagtggagtctaccttcatcagaaactttacacactcaaatcacaaaaaggggaggaagctattaaggcaaaaaacaaaaacagaaaggcacagcacaacatttttcacaggtttcttttctggttgctttgttgctctatttgttgctactatattaagaataacatctcaacaattcataaagaagaaggaagggacattttacatggaaaacattttcccactatacagtctttttggatatatcactctgcatatgcttatgtatgctgcaaacacattttattggaagtattatcgggtcaattatccattcttatttggcttcaggcctggaactgaattggactacagagaaattttccttctaaccgctggtcatgcagtggttgcactactatgcttcttaataaatttgcagatcgggatgaacccaaggagtcgacactataagacagctaatgaacttgttcctctgagcttagttgttcttgttcttttgattaccttttgccctctgaacatcatataccgctcaagtcgtttcttctttatccggtgcttatttcgctgtatatgtgttaggcttccagatttcttcttggctgatcagcttaccagccagttccaaaccttcaggagctttgagctttacatatgctattatggtcttggagaacactcaatgagacaaaagaaatgtcacagtcatggtttctataacgtacagtatttcatcgttggcatcattccttattggtttcgcctagcacagtgcatgcgtcaattctatgaagagggagacatcaaccgtgcattcaatggcttaaactatctctcaacaattgttgccatgatctttagaactacctttgaactaaagaagggattgagttggaaggtgttggcacttgtaacttcagcactagcagtacttcagaacacatattgggacattgtcagggactgggggctccttcgaaggcattcgaagaacccctatttgagagatcaactcatacttccacacaaaagtttctacttcatagccatggtcctggacatagttcttagaatttcatggatgcagttggtgtttgaaatggattggagcccccttcataaagtggcaatgatcacagttacttcctgccttgagattattcgccgtggcatttggaacttctttaggttggagaatgagcacttgaacaacgttggaaactaccgtgccttcaagtcagtccctcatccttttagttactatgatgataaaaatgacaaggatgcttag

SEQ ID NO: 677 - DNA, 219 bp, Glycine max var. Williams 82
atggaaatggtcctatggggcagctttgaagagaatatggttggaggtgtaggtcatgaggaccccatgagtttcattaatatggagccaccaaaggacaaggacatatctatttatgggttttggtctgtttctgagatgggtgttgcttgcttaattggatgcattttcggtgtaaaacgtgggtcgcaaaattctgatcaactaggtcatatatag

SEQ ID NO: 678 - DNA, 1722 bp, Glycine max var. Williams 82
atggcgtgtctttcttttccccagtttctcttacttcataggtaccacatgacttggtcctattgtttcacttcttttaacacagtacaacttgggaaactcggtcctgggtgtaaatggggtcatgtggcaatggctaggaaaaaggcctctctagactctgctatagaagaagagcttagtgacaatgaatccttggtagaaaagaagacaactaggtcatctaaaactaagaaggagacgactaggacaaggaagaaaacaaaagatgagtctcctggagatacagatagcgcctccattgaaggaagcacagctgcctctagtgataattccaagaaaactcaaaggactcggaaaaaggatgcatctagttctgctggcttggaagaaaagaaggaagtcaaggaagagaaaaaggttagaagacgaaagaaaactgaagaggagaaattaattgtagaggataaaggtagtgaagctgaaatcagtgaccaagatgagccttcatttcttgaaaatgtggaggatgatagtgacagtggcttggaactgataaaagatgatggagaggacattagctttacttatggatggcctcctcttgtttgttgctttggagctgcgcagcatgcttttgtgccttctgggagacctgccaataggcttataaatcatgaaatccatgaaagcatgaaggatgccttatggagccctgaaaattttgttagggcacctgggagctctgctggtagtgtggccattgcgcttgctacattgggtggcaaggttgctttcatgggaaaacttgcggatgatgattatggtcaagcaatgctgtactatatgaatgcaaataatgtccaaacccgatcagtgcgtattgatagtaaaagggcaacagctgcatcgatgatgaaggttggtaaaaggaatcgacttaaaatgagttgtgtaaaaccctgtgctgaagatagtttgacgaagtcggagctaaatattgatgtgctgaaagaggcaaaaatgttctacttcaatacacattccctgcttgaccgtaacatgaggtcaactacattacaagccatcaagatttcaaagcattttggaggggttgttttctatgatctaaaccttcctatgccactatggcactctagggaagaaactatgatgttcattcagcgagtgtggaatctagcagacattattgaggtcacgaagcaagaactagagttcttatgtgggatcacaccatttgaagaatttgacaccaaaaataatgctaggtcgaagtttgtacattatgaacctgaagtggttgccccactttggcatgaaaatctaaaggttttatttgtgactaatggaacttccaagatacattactacacaaaagagctcaatggtgctgttcttgggatggaggatgccccaattaccccattcactcgtgacatgtcagcaactggagatggcattgttgcagctctcatgcgaatgttgacagttcaacctgatttgttaaccgataaaggatacctggaacattccataaagtatggaatcgattgcggggttatcgatcaatggatattcggccgcgtacggggctttcctccatgtgaagatatggaggaggacataattcctgacccaaatggcattagatcaatttcagaaactgaataccgcacagcagtagggtctgctagtgagtaa

SEQ ID NO: 679 - DNA, 900 bp, Glycine max var. Williams 82
atggagaagaaaacaagtgtccaagagtcacgtaaattcaaccaattatttttccccaagcaacacaacaaagtgtacccaattaggctacagagaagctcttcaacttcatccttgtcttcattatcatcatcattgtcacaaaagtcagatgactcttctctaacagattccttgaatctagcagatgagagttttcaatttgcactgaatttgatttcgccgcgttgtcaaagaagagaaccagaaattattaatgatgcacaccaacaacaaattccacagactgctgaggctggtgaattgaaaaggtgcaactggatcactaagaactgtgatgaggcttacattcaatttcacgatgagtgctggggagtcccagcttacgatgacaaaaaattgtttgagctgcttacactatcaggattgctgatagattacaactggaccgaaattctaaaaagaaaggaaattcttagaaaagtttttgctggatttgatcctaatactgtggccaaaatggaggagaaagaaatcatggaaatagcatcaaacaaagaagttttgttagccgattgcagagttaggtgcatagtagacaatgccaaatgcataatgaagattgtgagggaatgtggatcattcagctgctatatatggggctatgtgaatcacaaaccagtgattaacagatacagatacccaagagatgtccctctaaggactacaaaagcagataccatcagcaaggacttgataaagcgtggctttcaatttttgggtccagtgatagtttattcttttatgcaagctgcaggattggcaattgatcatcttgtggattgttataggcacaatgaatgtgtaaggctcgcagaaaggccttggagacatttgtaa

SEQ ID NO: 680 - DNA, 1068 bp, Glycine max var. Williams 82
atggccatggcggtttccgcaattggttttgaaggtttcgagaaaaggttggaaatatcctttttccagccgggactttttgctgaccctgaaggaaggggtctaagggctcttacaaaatcccagttgggtgagattctaacaccagctgcttgcaccattgtttcttcgctcaaaaacgataatgtcgactcctatgttctatctgagtccagcctctttgtttatgcctacaagatcatcatcaaaacctgtggtactactaagctattgcttgcaatcccacccatattgaagttcgctgaaatgctttcccttaatgttaagtctgtgaattacaccaggggaagtttcattttccccagtgctcagccatatccccatcgcaacttttctgaggaagttgctattcttgatggctactttggcaaacttggtgcaggaagcaatgcttatattttgggtggccaagacaaagcacagaactggcatgtctactctgcttctgcagattctgtaactcaatgtgacaatgtttacactcttgagatgtgcatgactggcctggatagagagaaagcacaggttttctacaaagaacaatctgcttcagctgccatgatgactgttaattccggcattagaaaaattcttccagattccgagatttgtgactttgactttgaaccatgtggttattcaatgaactctgttgaaggcgctgctgtttctacgattcatgttaccccagaagatggtttcagttatgcaagcttcgaaactgttggttatgacttcaaagcggtgaatctgaacgaaatggttcagagggtattggcatgtttcctcccaactgagttttctgttgcagttcatgtggatggtgcaagcaagtcgtttgagcagacctgctttctggatgttaagggatactgtcgtgaagagaggagccacgaagggcttggaatgggtggttctgttgtctaccaaaaattcgggaagactagtgactgtggttcacctagatcaactctaaagtgctggaatgaggaagatgaggaagagtag

SEQ ID NO: 681 - DNA, 1251 bp, Glycine max var. Williams 82
atgagggagagaaacaaaggtgtggaagatcaggcttacaccaatgacatggattgctactactactccacctctgaactcccatgtaagaaacacccttcttcttcttctgttggaatatgtgcttactgtctcaaggaccgtttggtcaagcttgtgtgttctgattgtggggagcaaaggctttcttcgtgttcttgctctgatgagatggtctcttcccatcgcaactcatgcactgttgaggtggggggtgttgggagggtctcattcctcattgagaatgagaagaacaatgagagtaccccagtggttcttcagcatttgaatcacaataaggccaataaggaggaggaggaggatgaggttctggggctgaggaggagtagcagcagctgtgttgagatcaagaggcatcatcatggtggtggtggtgggttttggaagattgggaagctttttaggaagaaaaaagagaagggttgtgggagaagtgttgttgggtttgatgagagaaacaatgagatgtggatggtggatcatcaagggggtgtgtctaggtcaaggtcactatgcagcttcaggggtggagggatatttggatctgaggatggtggtgattcagtgttgtcaggtgctagaagctcaatttctgcagctaggagttctggggttaatatgttggaatctgggaggagaagtggatacagtgaagctgagccaagaaggagtggttttgatggagtagagaggagggatttcttgtttgataacaataattatgaaagtggaagtgatctcaagggtggtgtgaaaaagggtggtggactaatggatggtgttggtgatggtggtggattctatggtggggtaaataggcgtgtgttttcactcagagagagtgatttcaaaggcatggatgagtctagcttcattgacttgaagcttgattactcatcagaatcaaagcatgagttttctgctgcaaaaatgagcaacaacatggggggtgataccttctcttctttcagaggtgggaatttcatgccacatgatggcggtggaggttcttatggagggttggtaggagatggagttttaaccaatggagggtcatgtagaatcactgtgaatgacagaggaatcaagaggggaaggaaaagcatgaagggttggaggtggattttcagataccattcaaattggggaagctcaaggaaaagagatgaagactttatgttcaaagcatga

SEQ ID NO: 682 - DNA, 1191 bp, Glycine max var. Williams 82
atgtatgtgactaggcctttgtctctgtataagaaatctgcagatgctctctcattgcctccacctgagggccccaattctggtattttggtgatccaagatgaagatttggtgccaacctcttgttttgggttgggagagttccatgaagtgaaggagttgcctttccctcaaaatctaaaccttgagttgttctatagatcaggcatttcactgaatagaaccactcactaccaccatgttgccttcattccagttcttaaccagcccttgtcttccaacaaatactatgtgataaatctcagtgggaaaaaaagaggggaggcatacattaactcaaagggggaagatttggacacattctgtttctacaatgctgtatctgatgtaccactacatccaatagttatcaatgacacatatcaagagtttgagatatttcctagaagaagcaaagttactttcaggagtggtttttcagctaaatctgttgccccagatggataccctccaagatttttgagtacaaggtggaaagtgagtgcttcaacttcaagtgattctagcctaggagaagcatcaggtgtgaatgaaaccctccgtgccagcaagccagagttccaattctccttagcaaaaaagagttcagatagtgttgttgtgggaaaatggtattgccccttcatgtttatcaaggagggaactcacaaaacattgaaggaagaaatgagaaagtcaatgttttatgagatgacactggagcagaaatgggagcaaatcttttcatgtgagaatgagtatggaatgggaaacactgtgaatgtggatgttgtggttcaaaaggaagtggttgtaattgctggctgggaagcagtgattaatgagatggatattgctgaaggttttgtgtggtttaatagtgtcaacaatgttggagaaaagagtagtgtgggattgagcactgcagtagttgagagaatgaagtgggagcaggaaagggtagggtggaatggaggaatagagaagcaaattagagttaagaaagtggaagaatttgaaggcacaaatgggtggaagaaatttggatgttttgtgttggttgagacttttatactaaaaacattggacggaagcatagtactaacccatgctttcaaacaccatgatcaactcaggagtaaatgggaatga

SEQ ID NO: 683 - DNA, 3597 bp, Glycine max var. Williams 82
atggtggacttggggaggagaagaatgaggggtgagaggagaaggaagttgcatcttagcaagatctattcatttgcatgtgggaaacaatcactcaaggaggatcattcacatattggagggagagggtattctagggtggtgttttgcaatgagccagagagctttgaggccgggataaggagttatgctgataattatgtgagctccacaaagtatactcttgcttctttcttgcctaagtcactttttgagcagtttaggagggtggctaatttctattttttggtaactggcatcttggccttcacaaaacttgctccttatacagctgtcagtgctatccttcctctgattattattgttggggcaactatgatcaaagaggggattgaagatttccaaaggaaaaagcaggatattgaggtgaatagtagaagagttaaagtgcataaagggcatggaacttttgaatatattgagtggaagaatctgaaggtggggcatatagtgaagataatgaaggatgaattcttccctgcagacctcctactgctttcatccagttatgaggatgcattctgctatgttgagaccatgaacttggatggggagacaaatttgaagttaaaacaagggttggaagtaatttcttccttacatgaggactttcatttcggtgattttaaggctacagtcaaatgtgaagacccaaatgcaaatttatattcatttgttgggagcatggagtatgaagaacaacaatatcccctttctcctctgcaacttcttctcagagactctaaacttcgtaacacagactacgtattcggtgctgtcatcttcactggtcatgacacgaaggtcattcaaaattccactgatgccccttcaaagagaagcaaggttgagaagaagatggatagggttatctacttcttgttttgtattttgtttctaatggcatttgttggatctattttctttggcattgcaactgaagatgacttggacaatggattgatgaaaaggtggtaccttagaccagatgattctacaattttctttgatcctaaaagagcacctgctgctgctatatttcattttttgacagccttaatgttatatggtttcttcattcccatctcattgtatgtttcaatagaaattgtcaaagtccttcagagcatcttcatcaatcaagatatccacatgtactatgaagatgctgacaaaccagcccatgcccgtacttcaaacttgaatgaggaacttggccaagttgacacaatactttctgataagactggaactctgacctgcaactcgatggagttcatcaaatgttccattgctggggtagcttatggccgtggtgttacagaggttgagagggcaatgaatagaaaaaatggttatcctttgattgatgacacaaggagctctcctgtcagaaatgctcccataaaaggatttaacttttcagatgaaaggataatgaatggaaattgggttaatgagccttatgctaatgttatccagaatttttttcgcttattagcaatctgccatacagccattccagaagttgatgaagacacagggaatatctcatatgaaactgaatctccagatgaagcagcatttgtgatagcagctagagaaattggttttgaattctttaaaaggactcagactagtttatcaatgtatgaattggatccagtttctggtgacaaaactgaaaggatgtacaaacttcttaatattttagaattcaatagctcaaggaagcgaatgtcagtgatagtgaaagatgaagaagggagaattttcctactctgtaaaggtgctgacagtgtcatgtttgagaggcttgccaaggatgggagagagtttgaagagaaaaccatggaacatgtgcatgaatatgctgatgcaggtctaaggaccttgatcctagcatttcgtgaacttgatgaaaaccaatacaaggagtttgacaacaaaatttcacaggcgaagaattcgattagcgaagatcgggaaacactgattgaggaagtatcagataagattgagaggaatctaatccttcttggtgccactgctgtagaggacaagctccaagatggggttcctgattgcattgacaagcttgcccaagctggaattaagatatgggtattgactggggataaaatggagactgctatcaatattgggttttcttgtagtttacttagacaaggaatgaagcagattatcattcatttggaaactccagatattaaaacattggagaaggctggagacaagggtgctattgtcaaggcttcaagagaaagtatccgccatcaaatatctgaagctgctcaacagcttactgcctccagaggaacctctcagcaagcatttgctctaattattgatggaaaatcacttacttatgcgctagaggatactatgaagaacatgtttctagaccttgcaattcgttgtgcatctgttatttgctgccgttcctcaccgaagcagaaggcactggtcactagactagtcaaatctggtactggtaaaactacattagctattggtgatggagctaatgatgtgggaatgcttcaagaagcagatatagggattggaatcagtggcgttgaaggaatgcaggcggttatgtctagtgatattgctattgcacagtttcgttatttagaaagattacttcttgtacatggacattggtgttaccgaaggatctcatcaatgatatgctatttcttctacaaaaacatcacatttggctttactctattcttatatgaggtgtacgcatcattctctgggcaacctgcatacaatgactggtttttgtcactctataatgtcttcttttcgtcacttcccgtgattgctcttggggtctttgaccaggatgtgtcttctaggtactgtcaaaggtttcctatgttatatcaagaaggtgtgcaaaatgtcctctttagctggcgtcgaattttcagctggatgcttaatggctttattagtgccataataattttcttcttctgcacaaaggcaatggagattcaagcctttgatgagaagggaagaaccgctgggagggacatactcggagcaacgatgtatacttgtgtggtttgggttgtgaacttgcaaatggctgtttctataagttacttcaccttgattcaacatattttcatctggggctccattgctctatggtaccttttcctcctggcatatggagcattatctcccagcttttctggaaatgcttacaaagtcttcattgaaactcttgcaccatctccttccttttggattgtgacattgtttgtttccatctcaacacttatcccatacttctcttactcagcaatacagatgaggttctttcccatgtatcatgatatggtacaatggataaggtacgagggaaagacaaatgaccctgaattcgtcgctatggtgcggcaaggatcattgcggccaacaaccgtcggttcaacagctcgcttagcggctaaggataatgattttagagtcagtgacactaaccatagatag

SEQ ID NO: 684 - DNA, 1568 bp, Glycine max var. Williams 82
aactttgtatatatatccaaccttccaaaccagtgtatatataatatatagcatcgatctccatcatcatatcatagccttttctttcatagctactacactactttatcactttcattctttaattgggttcaaagaagcttaattaattggttgcagagattgaaaattaggaaaatggtgagtgttgaagagattcgtaaggcacaacgtgcggaaggccctgccaccgtgatggctattggcacggccactcctcccaactgcgtagaccagagtacctatcctgactattatttcagaatcaccaacagtgatcacatgaccgagctcaaagaaaagttcaagcgcatgtgtgataagtcaatgattaagaaacgatacatgtacttaaatgaagagatcctgaaggagaatccgagtgttggtgcctatatggctccttcattggatgcaaggcaagacatggttgttgtggaggtaccaaagttgggaaaagaggctgcaacaaaggcaatcaaggaatggggtcaatccaagtccaagattactcatctcatcttctgcacaaccagtggtgtggacatgcctggtgctgattatcagctcacaaaactactaggacttcgtccatcggtgaagcgttacatgatgtaccaacaaggctgttttgctggtggcacggtgcttcgtctggcaaaagacttggctgaaaacaacaaaggtgctcgtgtgcttgtggtgtgttcggagatcacagcagtcacatttcgtggcccgagtgacacacatcttgacagccttgtggggcaagccttgtttggagatggtgcagctgctgtcattgttggatcagatcctctgccagctgaaaagcctttgtttgagcttgtgtggactgcacaaacaatccttccagacagcgaaggcgctattgatggccaccttcgccaagtaggactcactttccatctcctcaaggatgttcctggactcatctccaagaacatcgaaaaggccttggttgaagccttcaaacccttagaaattgatgattacaactctatcttttggattgcacaccctggtggaccagcaattttggaccaagttgaggctaagttaggattgaagcatgaaaaaatggaagctactagacacgtgcttagcgagtatggtaacatgtcaagtgcatgtgtgctgttcatcttggatcaaatgaggaagaagtcaatagaaaatggacttggcacaactggtgaaggacttgaatggggtgtgttatttggttttggccctggactcactgttgagactgttgtgctacgcagtgtcactgtctaattatattctttctcatgtcttgtaagttctgtttgaaaaatgtattccttctcttttgcttcattttgtataccagtaaataagaacatgtcatgttattaatgcaattaagcttaacacataaattatctatgtatacatttgcaaagtgaatagcttttgtccaatggcttcattaaaacattctttgtggctcactataaattagatttgtaggacttcat

SEQ ID NO: 685 - DNA, 171 bp, Glycine max var. Williams 82
atggcatcactcaaagctgagaaacctgttgaatctcagtcatcagggcaggttaagaaagaacctgcaaaacccagtggtagcactccaaaagctccttcttccaagccagctccaaagaaaactcagaaaaggtctcgtcctaaacagaaggcaagcagcaataaataa

SEQ ID NO: 686 - DNA, 650 bp, Glycine max var. Williams 82
tttttagcaaactaaacacacttctcttagaagataattgtaaaatggcatcactcaaagctgagaaacctgttgaatctcagtcatcagggcaggttaagaaagaacctgcaaaacccagtggtagcactccaaaagctccttcttccaagccagctccaaagaaaactcagaaaaggtctcgtcctaaacagaaggcaagcagcaataaataagatatattagtagaatgatgaataagaaaaatagttgttggaatcttgtgaagagtttgtaagcatgctgtcgtgtagggctcttcaacaaaatttgataccagtactttacctcttgcttctgttgcttactagtcatctgcatgtaacttattacaaggctaagctaaaataaataaaagatacttatttattagttatgagaacatgagatcattaaaataggttcttgattacacattgtgtatgtatttgcaaattcacctgcagaatgtgcttgacatatttctcgactctcttttagtacaagattgataaattctggcaaggtttctttgttcctaatttaagcctctctttcagacctacctctacacgtttattgaaattgtcaacacaccacccttgatagcattttgaaacttctttatactc

SEQ ID NO: 687 - DNA, 288 bp, Glycine max var. Williams 82
atggcaaattaccattcttctaaatccttgcatcttccatgcaaaaccttatctctagttgttctgctttttgtttacttgctacttattggttcttgtgatgcaataagaatgggccaaactatgaagctgaatgaaagaagagagattctcaagggaaagcacaataaccaacatggttttccatacaaaagcatggttttcaacttctttcccaaagggtcggtgccaccttcgggtccttcaaagaggcataacgcagtggtggattcaacacctaataattga

SEQ ID NO: 688 - DNA, 1396 bp, Glycine max var. Williams 82
ccattaaaaaagttagacaaaaagagtaaacaaaaaggccaaagaaaaagaaagaagacaaagtcaataatgactcacaacttctcatccttggtgtttttgttatttttatttgttgcatcctcttatgcaatccaaggtgcagagctggatgcaatttgcaagcaaagtaagaatcctacattttgttttaatcttcttaattcaataccgggtggagcaactgatgcaaaccttgttgaccttgtccaatatgcccttgatgtaacacgtgtcaatctaaccaccacaaccaaactaatcaagaggttgatacgaagaaatcctaatgacattgaggcaagagatcattacacattatgtttgaaccgaattcatcagggtgctttcgatgcagttaagtccactgaagcgatactaaaatcaagagaattctatatcttaaattcgattgcctgtggaatccgaacacaaattgatctatgtattgatggagagtcaccatctgatactccctataatgatacttccttgctcccagcatacgcgagtgttatctcggaggtagtcgaaattattgttatcatatctaatcttttggataagtaattatgagacaaatgtaaaaacttatttaaagttataaaaataattgttataatttctttttttagttatttccataagtttcatgagtgtttaatttaaaaaagaatatttgtttcaataacttaccttttatgatgttatgaataaattctccttttctagggacttatcaaagaaatccttagttaattgtatttttattccttatatgtatggctaaatctgcttcaagtctttcatttttttttaaaaaataatcttcataagtagtttatgatattttttatccgtgtttattagttacatgacatgacattcatcaagtaatatgtgtcaacgaccattttaaggtgacacatggtataacatgtctaaatgcatgctattaaataattacaaagataatttaattttaaaattataaaattacgataaaacaaatagttatcgaaggcatttatattgttggggtattttaaaagtcacaacctaaggttaaccttggacattgtgcagaggtacgatggctaaacatcaatgaacaaaaatggggctaaattaatttcaaatgttcactatatttgtacaatggtttttttcaatattgttttcataagtagattataaaaaaatcatttttcatttttctctctctagaaattaaattgggataagtaatttgggaacattttacttagtcattcatttttttccatgttattcataaactcattttaaatgaatttcaacaaacattgacatattaatatgtaatgggtatgataaa

SEQ ID NO: 689 - DNA, 1677 bp, Glycine max var. Williams 82
atgtttgggttaatcggaagaaaggcctctttgttgggaggatcaggaagaagaagaagatggttgagcttcgcagcagcagcagcagcaacaaccactaccaatggtggggccatggaggagttgctttcacagctccaatctcatgtccagaaggctcttgctggtggaggacccgaggcagtgaagaggaacacgagtaggaacaagtttctgccccgtgaaagaatcgatcgcctccttgatcccggttcttccttcctcgagctttcacagcttgcaggacattacttgtatgaagaacctttgccttctggaggggttgttactgggataggtcctgtgcatgggagactgtgtatgtttgtggcgaatgatcccactgttaagggaggtacttattatcccattactgttaagaagcacctcagggcacaggagattgctgctcagtgcaaattgccctgcatatatcttgtcgacagtggaggagcttttcttcccaagcaagccgaagtgtttccggacagagagaactttggcagaatattctacaatcaggctgtaatgtctgctcaaggaattcctcaaattgcattggtgttggggtcttgcactgctggtggcgcttatattcctgctatggctgatgaaagtgtgatggtcaagggaaatggtaccatttttttagcagggccacctcttgttaaggctgccactggagaagaagtctcagcagaagatttgggaggtgcgactgtgcactgcaagacatcaggggtttctgattattttgctcaagatgaactccatgcacttgcgcttgggaggaatataattaagaatttgcatatggctgggaaagatgtcttggcaaatggattgcaaaatataaattatgaatataaagagccattgtatgatgtcaatgaacttcgttctattgcccccactgatcttaagcaacagtttgatattcgatcagttattgatcgcattgttgatggaagtgaatttgatgaattcaagaaattgtatggcactacacttgtgacaggatttgctagaatttttggacagcctgttggaattattggaaacaatgggattttattcaatgaatctgcactgaaaggggcccatttcattgaattatgcactcaacgtaacattcccttggtcttccttcagaacatcactggattcatggttggctcaagatctgaggcaaatggcatagcaaagtctggtgcaaaaatggtgatggctgtttcttgtgcaaaggtacctaaagtcactataatggttggaggaagctttggtgcaggaaactatgcaatgtgcggtcgtgcctatagtcccaatttcttgttcctttggcctaatgctagaatttctgtgatgggtggtgctcaggctgctggtgtgctggcccaaatagagaaaggcaacaagaaaaggcaaggaattcagtggagcaaggaagaagaggataagtttaaagggaaagtagtggaggcttatgagagagaagcaagtccttattactcaacagctaggctttgggatgatggaatcattgatccagcggatacaagaaaagtcattggtctatccatctctgcctccttgaaccgtgacattcaaaacacaaaatatggtgtatttagaatgtaa

SEQ ID NO: 690 - DNA, 1996 bp, Glycine max var. Williams 82
ttgtctgtgtgaataacatcataaaccttaagtaacaatcaaagacttcacaacacaccacgcttcattcaacttggttccatttttattttgttcaagtccaaatggagcagtacgaaattctagaacagattggaagaggttcctttgcctctgctctacttgtcaggcacaaacacgaaaacaaaaagtatgttcttaagaagatccgtcttgcccgccagactgacagaactcgtagatctgctcaccaggagatggagcttatctctaaagttcgaaatccatttattgtagagtataaagattcctgggtggaaaagggttgctttgtatgtatcgtcattggctattgtgaaggaggagatatgacggaagcaattaaaaaggccaatggcgttcattttcctgaagagaggctctgtaagttgctggttcaactgctgatggcacttgattacttgcatgcaaatcatattcttcatcgtgatgtcaagtgttcaaatatattcttgactaaagatcaagatatacgtctaggtgactttggtcttgctaaaatgttgacatgcgatgatcttgcgtcttcagtagtggggactccaagttatatgtgcccagagcttcttgctgatataccctatggctctaagtcagatatctggtctttgggatgctgtgtgtatgaaatggctgctcacaagccagcttttaaagctcttgatatgcaagcactgattaacaaaataaacaagtcgttagtggctccactaccaacagtgtattctggttcttttcgagggcttgttaagagtatgctgcggaagaatccagagcttcggcctagtgctgcggagttactaaatcatccgcatcttcaaccttacattcttaaaattcacttgaaattaaataaccccagaagaagtacttatccattcccgtggtctgactcaaactatgtaaggaggactcagtttgtcgagccaggatctgtttctactctgtctgacagaggcaaacgattctcattcagcaatgacagggccttgaatcctagtatttctggaactgagctaggttctgtgtgttctactcaaagagcactaggattctctacttgttcaaaagagaagcactatgaactatctgttggccgtgtccacaaagaatgcaattctaacaaatcaagagacacaaagtcctcaactgttgataggatgccaagattgagaacagctaaggaatatgccactccccgatggcagactataccatcaaagatatcccatactggttccaagcgtgagttacttccatccactccaggttgtaaattcaccctaccaactagaagagcttcccttccactgcctaccagaaccacgggcatgatcacctcttatagagctaatgttggtcttcttcgaggtgtggactctcctgatatttctgtcaatgcaccgcgaattgacaagattgctgaattccctctggcttcttgtgaggattctctctttcctgtttgtggaacttcatcaacctcagctcagtgctcttctggttcgccaaagagtgctgactgcttaatcacacaggacaagtgtacaatccaagttgtggacaaggccagtgtcccttccagtggcagtgatgcttgtcctgctgctccagtttcacatggcaatgaatgctctgaacatgctatttcaagccactcctctgctgagtctcgtaagcacagatttgacacctcatcttaccaacaacgcgcaaaggcattggagggtttgcttgagttttctgcacgactcctacagcaacagaggtttgaagaacttggggtgttgttgaagccattcggtcctgagaaggtttcccctagagaaactgctatttggttggccaagagcttcaaggaaactgtggcctaaggtgtaaatttataggtaattttaccagtagcttagctagttagcttataattattgttcta

SEQ ID NO: 691 - DNA, 2208 bp, Glycine max var. Williams 82
atggcttctctggcgttgctccgcagaaagcttatcatcaccagaaccacactctcctactcgcacgtgcgcgcacgagccttctccgcgggaaacaacaaacaccgcatcgagaagattctagtagccaaccgcggcgaaatcgcttgcaggatcacgcggaccgcgcggaggctcggcattcaaaccgtcgccgtttacagcgacgccgacagggattcgctccacgtggcaaccgccgacgaggccattcgaatcggaccgccgccggcgcggctcagttacttgaacggagcctccatcgtcgacgccgcaattcgctccggcgcgcaggctattcaccctgggtatggattcttgtcggagagtgctgacttcgccaagctctgtgaggagagtggtctcacttttatagggcctcctgcgtctgctattcgagatatgggtgacaagagtgcatcgaagagaataatgggagctgcaggtgtgcctcttgtacctggatatcacggatatgatcaagatattgaaaaaatgaagttggaagctgatagaattggatatccagtcctaattaagccaactcatggtggaggtggaaagggtatgaggattgtacacactccagatgagtttgttgaatccttcttagctgcacaacgggaagcagctgcttcttttggcgtcaacacaatattgttggagaagtatattacacggccaagacacatagaagtccagatatttggggataagcatgggaatgttctgcatttgtatgagcgagattgcagtgttcagagaagacaccaaaaaataattgaagaagctccagctccaaacatttctgctgactttcgtgcacaattgggtgtagccgctgtttcagctgcaaaggcagttaattattacaatgctgggactgtggagtttatagttgatacagtctctgatgaattttactttatggagatgaatacacgtcttcaggttgagcatcctgttacagaaatgattgttggtcaggatcttgttgaatggcaaatccttgttgccaatggagaagctcttccattgagtcaatcacaagtacccttatcaggtcatgcttttgaagctcgaatctatgctgaaaatgttcaaaaagggtttcttccagcaactggagttctacaccattatcatgttccagtctcatctgcagtccgagtggagactggagttaaagaaggagacaaagttagcatgcactatgatcctatgattgctaagcttgtggtgtggggagaaaatcgtgctgctgccttggtcaaactcaaggatagtctgtcaaagtttcaggttgcaggtctgccaaccaatgtcaactttcttcaaaagcttgctaatcacagggcatttgcaaatggcaatgtggagactcattttattgataactacaaagaagacctctttgttgatgctaacaattcagtgtctgtgaaagaagcatatgaagctgctagacttaatgcatccctggtggccgcatgcctcattgaaaaagagcatttcatattggctagaaatccacctgggggcagcagcttgctccctatatggtattcttctccacctttcagaatccatcatcaagctaagcgtagaatggaacttgagtgggataatgaatatggtagtggtagctcaaagatcatgaagcttaccatcacttatcagcctgatgggagatacctaattgagacagaacaaaatggatctcctgttttagaagtgaaatcaacatatgtaaaagataactattttagagttgaagctgctggtgtaatcaatgatgttaatgtagctgtttattcaaaggatcaaataaggcatattcatatttggcaagggtcctgtcatcattatttcagagagaaactaggcctggagctgtctgaggatgaagaatcccaacataaacccaaagttgaaacatcagccaaccctcaagggacagttgtagcacccatggcaggcttggtagttaaggttctagtggagaacaagacaagagtggaggaaggacaacctgtgttagtattggaagcaatgaagatggagcatgttgtaaaggcaccttcttctggctatgtgcatgggcttcaacttatggtgggtgaacaggtttcagatggcagtgttcttttcagtgtaaaggttcgttaa

SEQ ID NO: 692 - DNA, 1152 bp, Glycine max var. Williams 82
atgttctttgacagtcacaggattattgttatggcagttgcacctgttgagagtataacctcgctgagtagtgatctcttctatgacatattacgacgtcttgatggcccaacgctggctagtgcagcttgcacttgtgcatcattttcttccatctctaaagaagagagtttatgggaaaatgtgtgttcttctgtgtggccttcaaccaatagggaagatgtcaaaagtttaatatcttctatcggtggatacagaaaattctatgcagattgttttcctcttattgtaaacaaggaggtaggagagtatcaatggaacaacaatcttcagtaccctgatgattggactgaggccgaatattatggggacatgattgaatttgaaagcatctctccatcagattttgtttccattgtggatatcaggtttaaggagaaaccaatctgctccaaagttctatggggaattccgaatgcaaatggctatgatgagtggttctttaactgtcctttccggattgatcttctcagttgtgcagatagagatgataataatgatggtgtggttaccctttcagtatctgatggattgccaccaattacatccatggaaagggaaaagaaagatgggaaactatggcaggagcttcgtgatggtctcttgcttagttggatcatagtaaacaagaaaataaagcaatctgctaatcttgcaagctggagccctttagatggacaaaggcattggcctacagacaaggattttgtctttcgttttggatctgttctctctgccaagggcattcttccttctgaagcagtgcagtgcatcctcattatgaagtttagagtggttcacattgaagaagagggtgttcaaacaaatcttaaggcaacagagctgagtatgcagttggaagacatggaatgtgctcatgttaatgggaggaacagtttgcttattcttaaggaagcacttagctgccgaaggagcaacaattttagtgaagtacttgaatcctgtcttatgtactcaaaagtgcaaaataagttgaaagaggagaagattaaaaacgaaagtaggttggacacactttgcattttaagtggcattgttgctgtaatgacattttggtactatgttttgtga

SEQ ID NO: 693 - DNA, 1308 bp, Glycine max var. Williams 82
atggataattccaaccttcaacgtctcttcactctcttccttttttccctaattgcaccctctttggctcaacaatccttcagacccagagccctcgttgtcccagttaaaaaagacgcttccaccctccaatatattactcaaatcaaacaaagaacaccactcgtcccagaaaacctagtacttgacatcggtggccaattcctgtgggtcgattgcgacaacaactacgtctcctccacttaccgccccgcacggtgtggctccgcccagtgctccctcgccagatccgacagctgcggaaactgcttctccgccccaaaacccggctgcaacaacaacacgtgcggcgtcacgccagacaacaccgtcaccggcaccgccaccagcggcgagctcgcgcaagacgtcgtctccctccaatccaccaacggtttcaaccctatacaaaacgccaccgtttcgcgcttcttattctcctgcgctccaaccttcttactccaaggcctcgccaccggtgtcagcggcatggccggtctcggcagaactagaattgctctcccctcgcagctcgcttccgctttcagcttccgtagaaaattcgccgtctgcctctcatcttcaaacggcgtcgctttcttcggtgacggaccctacgttcttctccccaacgtcgacgcttctcagctactcaccttcacgccgttattaattaaccccgttagcaccgcctctgctttctcccagggagagccttccgccgagtatttcatcggcgtgaaatcgattaaaatcgacgaaaagacagtgccgttaaacaccactttgttgtccataaacagcaaaggcgttggtggaaccaagattagttccgttaacccttacactgttttggaggattctatcttcaaagcggtgacggaggctttcgtgaaagcttcttctgctaggaacataacgagggtggcttctgtggcgccgtttgaggtgtgcttcagtagggagaacgtgctcgccacgcggttgggggcggcggtgccaactattgagcttgtgctgcagaaccagaagacggtttggaggatttttggagcgaactcgatggttagtgtgagcgatgataaggtgctatgccttgggtttgtgaatggaggtgagaatccgaggacttcgatagtgattggaggatatcagctggaggataatcttttgcagttcgatttggctacttcaagattgggattcagctctttgctctatggaagccgaactacgtgtgctaacttcaactttacctccgctgcgtag

SEQ ID NO: 694 - DNA, 1676 bp, Glycine max var. Williams 82
atacaatacttgtcataagtcacaaccatggataattccaaccttcaacgtctcttcactctcttccttttttccctaattgcaccctctttggctcaacaatccttcagacccagagccctcgttgtcccagttaaaaaagacgcttccaccctccaatatattactcaaatcaaacaaagaacaccactcgtcccagaaaacctagtacttgacatcggtggccaattcctgtgggtcgattgcgacaacaactacgtctcctccacttaccgccccgcacggtgtggctccgcccagtgctccctcgccagatccgacagctgcggaaactgcttctccgccccaaaacccggctgcaacaacaacacgtgcggcgtcacgccagacaacaccgtcaccggcaccgccaccagcggcgagctcgcgcaagacgtcgtctccctccaatccaccaacggtttcaaccctatacaaaacgccaccgtttcgcgcttcttattctcctgcgctccaaccttcttactccaaggcctcgccaccggtgtcagcggcatggccggtctcggcagaactagaattgctctcccctcgcagctcgcttccgctttcagcttccgtagaaaattcgccgtctgcctctcatcttcaaacggcgtcgctttcttcggtgacggaccctacgttcttctccccaacgtcgacgcttctcagctactcaccttcacgccgttattaattaaccccgttagcaccgcctctgctttctcccagggagagccttccgccgagtatttcatcggcgtgaaatcgattaaaatcgacgaaaagacagtgccgttaaacaccactttgttgtccataaacagcaaaggcgttggtggaaccaagattagttccgttaacccttacactgttttggaggattctatcttcaaagcggtgacggaggctttcgtgaaagcttcttctgctaggaacataacgagggtggcttctgtggcgccgtttgaggtgtgcttcagtagggagaacgtgctcgccacgcggttgggggcggcggtgccaactattgagcttgtgctgcagaaccagaagacggtttggaggatttttggagcgaactcgatggttagtgtgagcgatgataaggtgctatgccttgggtttgtgaatggaggtgagaatccgaggacttcgatagtgattggaggatatcagctggaggataatcttttgcagttcgatttggctacttcaagattgggattcagctctttgctctatggaagccgaactacgtgtgctaacttcaactttacctccgctgcgtagaaggaaaacgtttcaataattagcattatctcattctctcattcataataaatgccgcctgcggaatttaggttgagcttcgcaactacgagtttcaaataaactgttaaacacaagtattttctatttccttttgatacatacagggttcatgttttttaatttggataagcccctacatggttcatgtatcttataagtttgaatatttgttcagagacaaacgtaatccaagtgtgggacaccttcattgctctttgtcttgcattatatacacatttaaatgcatattttttattaataaatattaatgcttagtattgctaattttttttgttagc

SEQ ID NO: 695 - DNA, 984 bp, Glycine max var. Williams 82
atgaccatctcactgtttatgtgcagagtaacacaacccataataaatgttccttgcagtgggaaaaaactgatcgtgaggcaaattgagaaagagaaagtagtggttgtaatgggagccaccggagcagggaagtcaaggctttcaattgacctagcaacatgttttccatcagaaatcataaacgccgacaaaatccaagtcttcgaaggtctagacatagtcacaaacaaaatctccaaggaagagcaacgcggggttccgcaccacttactaggaacaataaagcccaacatggatttcagcgtcaacgatttctgtgacacgtcatcagaggccattgactcaatcacgaggtgccagaagcttccaatcgtcgttggaggctcaaactcgtatctggaggccctcatggacgacgacgattacaagttccgatcgcgctacgatattctctgcctctgggttgacgtggaaatgtccgtgcttaagtcctacgtggcagaccgtgtcgaccacatgttttataaaggaatggtcgatgagctgagaccgttttatagtcccaacggggattactcgcgaggggtgaaaagggcaattggggtgcccgagttccacgagtattttgggagggaagaggttgctgacgaggagacaaaacagaggttgttggaacaagcggttaaggaaatcaaactgaacacgtgcaagctagcgatgaagcagttggggaagattcgtaggctcaggaacgttaagagatggcatattcatcgattggatgctacgcccgtcttccgaatgcgtggggaagaagccaacgatgcttggaagaggctggtggcaaagcctagtgctttgatcgttgctcgctttctctataataacaactccaaaaataatgccaacgttgtttctggttctggacttagagtgcaaccagctgcttcagagagtgttctcgctgccgcaacttgctag

SEQ ID NO: 696 - DNA, 306 bp, Glycine max var. Williams 82
atggaaaaggttatgaggttggcaactgaaaagggggtggtggttttcaccaagagctcttgttgcctctgctatgcagtcaacattctcttccaagagcttggagtgatccctgtggttcatgaaattgacaaagaccctgagggaaaggaaatggagaaagctataacaaggttggggagtcctacacctgttcctgcagtgttcatcggagggaagctggtggggtccaccaatgaagtcatgtccctccaccttagtggttcactcactcaactgctgaaaccatatcgagctttgtcttaa

SEQ ID NO: 697 - DNA, 823 bp, Glycine max var. Williams 82
ctagcataccacttcatttcgaattaccctcaaccctcatcatagttttctcctccttagagccattagatcgaattcgatcatttcggatttgatctgatggttttggacttctaattactagtctaaggtaatctaaagtcatatctctctctctctctctctctcatatttttacattcttttttctgtacttttgtctctggaaaagaattttctataccactatatatcaagatggaaaaggttatgaggttggcaactgaaaagggggtggtggttttcaccaagagctcttgttgcctctgctatgcagtcaacattctcttccaagagcttggagtgatccctgtggttcatgaaattgacaaagaccctgagggaaaggaaatggagaaagctataacaaggttggggagtcctacacctgttcctgcagtgttcatcggagggaagctggtggggtccaccaatgaagtcatgtccctccaccttagtggttcactcactcaactgctgaaaccatatcgagctttgtcttaaagaggagtgcacatgcaaattaaaaagcgttcctgctaccttattggaagaataaacacatgcagtatagtagtaactactaagtcgatctaatataattggatatatggtctatgcagtgatgcatgtgtgaagtagttaatttctagcatttgattattagctatatataattaatgtaatgtgttataattattcttaatgaagttttatttgtattgatgatgtacgtccaagtaaatcatgttattgaaagtttaatttatatatagtcacgtac

SEQ ID NO: 698 - DNA, 309 bp, Glycine max var. Williams 82
atggacctaatcaccagcatggtagctgaaaggcccgtggtgatcttcagcaagagcacatgttgcttgagccactccatgaccacactgatacgtagctttggtgcaaaccctactatttatgagcttgatgaaatgacaaatgggcaacagattgaaagtgcactgcttcaaatggggtgccagccaagtgtacctgctgtctttataggacaacaattcattggtggatctaagagagttatgagcctgcaccttaggaatgagttagtaccaaagctcataaatgctagagcaatatggatttga

SEQ ID NO: 699 - DNA, 1308 bp, Glycine max var. Williams 82
atggcaacaaatagattcgtctgtgagatctgcaacaaagggtttcagagggaccaaaaccttcagttgcaccgcagaggtcacaatcttccatggaaactgaggcagagaggaagcaatgaagtgaagaaaagggtttacgtgtgccctgagccatcatgcatccaccataacccagctcgtgcattaggagacctcactggcatcaaaaaacattacagcagaaaacatggtgaaaagaaatggaaatgtgacaagtgctctaaaagatatgcagtccagtctgattggaaggcccaccagaaaacatgtggcaccagggaatacaaatgtgactgtggaactatattttccagaagagacagttttatcacacacagagccttttgtgacgcattaactgaagaaaatagccgagtaaaccacttattaacgagtggcatggcaccaacaacaaccctggaaaatgaattgccggatcttattgccactacaatgcctctaagcgctagttccaacaacagtactgtatccgaattcaacaacaactacgacactaagagcccactccaagagcatattgtcccaatgccattcaagtccactagcatgggtggtggcatgttctccaacaccactttttcagctggtacactctttggtggtccaaaaaacatgtctcatccctcttcttccactcttcaactcagctccaacaactccactgctttcaattacttccaagacagcaaaaacgcttctgcctcatctcacatgtctgccacagctttattgcagaaagcaacacaaatgggtgccactgcaagcaataacaatagcattattaactctccaaccatgatgcagaaaagctttattagtgccatgactggtcctgaccacaaccatatttcttcctatgaccacttccatcatccaaaccctgatgatcaatctcacaatatggctgggattagtaacgccggagccttcaccaacctgttttttcacaagggacaacaagaaatgtcactgatatttgattccaacactagtgatatgggaatgttcggcccaatactgatgaagaacgtggagcaagagattggtactggttcgagtttggttcatgacttcttgggcgttggggatgcaacttcaagggtgtatgaaccacagaaacaacaacagcaaagattggagttagaagcattaacccaccagaggttgcagattatgaatcactttcaccaccaccttccacatggggattctgctactatggagaaatccatttgggacatttga

SEQ ID NO: 700 - DNA, 210 bp, Glycine max var. Williams 82
atgaaacctcacatctccggtgaaagctctctgggcaatgaattgaggagatctgtcagcgagaagcttcatcacgttgatgatgctaacgctgccaagcaaggtagggttctaaagtatatacaaactgagaagcgacggaggaggagccaccgtgcagaagaccccataagaaccttgatgttcttaggctctatgaatcacacatga

SEQ ID NO: 701 - DNA, 177 bp, Glycine max var. Williams 82
atgttatgccatgtggccaaggaagagatggatgcaaaaattcacataaactctgcatttgatcttttcaacaaaataaagaatatgctttgcaaatcccttaacctaatcaataaatttcaatctgcgggagtactgggagcaaaggcttcagatggagagggtagagagggttaa

SEQ ID NO: 702 - DNA, 1020 bp, Glycine max var. Williams 82
atgggttctaagtccgaaaccgtttgcgttactggggcttctggttacatcggatcatggcttgtcatgagactcatcgagcgtggctataccgttcgagccaccgtactcgacccagctgatatgagggaggtgaagcatttgctggatctgccaggtgcagagagcaagctgtctctgtggaaggcagaacttacagaagagggaagctttgatgaagccattaaagggtgcacaggtgttttccacttggccacccccgttgactttaagtccaaagacccagagaatgaaatgataaagcctacaattcaaggagtactaaacatcatgaaagcatgcctgaaggcaaaaactgtccgaaggctagtattcacgtcctcagccggaactaccaacattactgagcaccaaaagcctatcattgacgaaacctgctggactgatgttgagttctgccggagattaaatatgactggttggatgtatttcgtttctaaaacacttgcggagaaagaagcttggaaatttgcgaaagagcacggcatggacttcatcgctatccttccagctcttgtcattggtccctttctactgccaacaataccttctagcgtgatcagtgctctttcacctattaacggaattgaggcacattattcaatcataaagcaagctcaattcgtccacatagaagatatctgtcttgctcacatatttctgtttgaacagccaaaagcagaagggaggtatatatgcagtgcatgtgacgttactatccatgacattgtaaaattaattaacgaaaaatacccagagtacaaggttcccaccaagtttcagaacattccagatcaattggagcccgtgagattttcttccaagaaaatcacagacttgggattccaatttaaatacagcttagaggatatgtacactggagcaattgatacatgcatagagaaagggcttcttcctaaacctgcagaaattccagcgaatggcatcgagcataaataa

SEQ ID NO: 703 - DNA, 1431 bp, Glycine max var. Williams 82
ttctcccccactccaacatgtttctcattccttttctaagtcgattaatatttacagagtgaagattttatttttctttctttctttggaagataaagaatgggttctaagtccgaaaccgtttgcgttactggggcttctggttacatcggatcatggcttgtcatgagactcatcgagcgtggctataccgttcgagccaccgtactcgacccagctgatatgagggaggtgaagcatttgctggatctgccaggtgcagagagcaagctgtctctgtggaaggcagaacttacagaagagggaagctttgatgaagccattaaagggtgcacaggtgttttccacttggccacccccgttgactttaagtccaaagacccagagaatgaaatgataaagcctacaattcaaggagtactaaacatcatgaaagcatgcctgaaggcaaaaactgtccgaaggctagtattcacgtcctcagccggaactaccaacattactgagcaccaaaagcctatcattgacgaaacctgctggactgatgttgagttctgccggagattaaatatgactggttggatgtatttcgtttctaaaacacttgcggagaaagaagcttggaaatttgcgaaagagcacggcatggacttcatcgctatccttccagctcttgtcattggtccctttctactgccaacaataccttctagcgtgatcagtgctctttcacctattaacggaattgaggcacattattcaatcataaagcaagctcaattcgtccacatagaagatatctgtcttgctcacatatttctgtttgaacagccaaaagcagaagggaggtatatatgcagtgcatgtgacgttactatccatgacattgtaaaattaattaacgaaaaatacccagagtacaaggttcccaccaagtttcagaacattccagatcaattggagcccgtgagattttcttccaagaaaatcacagacttgggattccaatttaaatacagcttagaggatatgtacactggagcaattgatacatgcatagagaaagggcttcttcctaaacctgcagaaattccagcgaatggcatcgagcataaataaatataggttttcatatctttgcctcggtgatggctatgaatgttgcttttcttgttcagtttctttaatgatgtttccgttttgtgaattcgtagtcaaaattgtaagtggtttgtaagaccaaattagttatctacaaattgtttaatattatcacaagacattttttacggtaagtcaatatctcagagctcgaggcaatttaaaatatatataatatgccgccattgaattctcattatataagctcatacattagagattcctggatttgattaagtcaaaaatggtgtatataaatgcggataattg

SEQ ID NO: 704 - DNA, 1770 bp, Glycine max var. Williams 82
atggcatcttcaaaaccgcatggtgtagaaaacgttggaagttgtttgagaaacaccaaaggcttcaccctccaagtccttaccggttgttggttcatggagttctcctcattcatgatcatgtcagtgtcaggagcaagctacatgtttagtctttactcaagggatatcaagtcagttttggggtatgaccaatccaccctcaatttcttaagcttcttcaaagacttggggtccaacataggcatcatttcaggcctaatcaacgaggtaacacccccttgggtggtcctaacaattggtggggttctcaatttttttgggtatttcataatttggcttgcagtggccagaaaaattgctaagccccaagtttggaacatgtgcttgtacatcttcattggagccaattctcactgttccaccaacactggagtcattgtcaccagtgtaaagaacttccctggcacaaggggcattgtaattggcctcttgagtgggtatcttggcttgagtgcagctatcatcactcagatatactatgccttctatggaaatgattccaagtttctaattttgctcatggcatggctaccaactgctgtaactttcgttttcttaccagttatcaggcaccacaggggagttcaacagccaaatgattccaaggctttctataatttcctctacaccactcttgtccttgcagggttcctcatggtggtgatcatattgcaaaaaagtttcacctttacaaagagtgagtattatatcactactagtcttatgcttctcttgctcatcctgccacttgctgttgttatggttgaagaaaaaaagatatggaagaggaaacaagaacatatcaacagtgaaaaccctcttaaggctttgaatataaccacagagatgccaaatctggagaagtctacacaggctccacaaaagcaagcttcctgttggaaaagcatgttcaggccaccaagtagaggtgatgattacacaatacttcaagcccttttcagccttgacatggtgattcttttcttagccacaatttgtggacttggtggtaccctcactgtgtcaaataacttaagccagattggcacatctttagggtattcggcacatagtataaccacatttgtgtcccttatggccatttggatctatatgggtaagattgtacagggagtggtctcagaaattatcatagcaaaattcaaagtccctaggcctatgatattcacattaattcttgtattaccttgtgctggttaccttctaattgctttcgatgtcccaaatggtctctatgcggcctcaattataattgggttctgctttggggctaactggccactactatttaccatcatatctgaactttttggtcttaaattttactcaactttgtacaatgttgggtcagtggcaagtccaattgggtcataccttttcagtgtaaggcttgcagggtatttgtatgacaaggaagccactaggcaaatggcagcattaggactaaagaggaggcctggggaggagttgaattgcaatgggagtgagtgttacaaaatggctttcattataatcactgcagttagcttgtttggggcacttgtgtctctcatcctggtgttaaggactagagagttctataaaggtgatatatacaagaagttcagagaggaagctagaactgctgaagctgaattttgtccaactcagaacaagaatggacaaactgctgcatatgaaggctag

SEQ ID NO: 705 - DNA, 642 bp, Glycine max var. Williams 82
atggataatcattcatggtgttatccagcttgcgttcaatgtcatagaaaaattgacatcgaaataggaccattcacatggggatgtggcaaagataatgatcagcctgttctaaggtataaagttgaagtaatggttagccaaaacaatgacagtagcaagtttttgctctgggaccgtgaatgtgttgaattgattggtcaaatagctgatgaagtgaatagggtcaagattgaagatggtgatattgatttgaatgcttctcctcaagcacttgataggctgttgggttatgtccttgcttttaaggtcaggattcaatcaaaattcaggaatgtcgttgttcttagatactcaaatgaattagatttgatcaatgttgtgctcgacatgctggctgacactgaggcatgttccaaaatagatacttcgaacgttgattgcaataatgctacgcatcctgaatgtcaatctctgtctgtgacagcggaccatgatccagttgcaggattccctttaacgcccaaaaaacggctatcatctgatgaagttgatgatgagctaggaagctcccagatttccccagcccaactatcgtctaacaaattaacaagacattcttataagagtgaatttagctga

SEQ ID NO: 706 - DNA, 885 bp, Glycine max var. Williams 82
atgaaagaacaacaaaaacaacagatatttcaaagaagcacaagtgcatgcaccgccacaacaagaaacagccgaagaatcctcccttcaaacctaacccacttccgctccttcgaatccgatgatgtctccgacaaactcctcgtgcggcgaggatcctcgccttcggtctcaaacttgtaccaacagcagcaacagcaacaccacgcaccaaagctaacgcaacaaaacaagatatcatcactcatacgctcgttcttgaacatcttcacgttcccaacgatgatcccaacatgcaagtggctcactattccttcgcagctctccgtgactccttccctcggcaggaaggtcaccggaaccctctttgggcaccgccgcggacacatctcttttgctgtgcagctccacccccgcgccgagcccgtcctcctcctggagctagcaatgtccacctcctcgctcgtcaaggagatgtcctctagcctcgtgcgcatcgcactcgagtgccagaaagtgtctgtcaccgctgctgttgcacacaacaacagcggtggtggcagacgcaggctctttcaggagcctgcctggaccatgtattgcaacgggaggaactgcggctacgccgtgtcccgcacgtgtggggacctcgacttgcacgtgctgagcacagtgcagagcgtgtcggtcggcgccggagtgatccctctcctggaggatggaaaagggggtggcagtggcaacggcgggtcggagggcgagttgatgtacatgagggcgaggttcgagcgagtcgtggggagccgtgactcggaggcgttttacatgttgaatcctgatggtaatgggggacctgagcttagtatttttctattgagaatataa

SEQ ID NO: 707 - DNA, 1377 bp, Glycine max var. Williams 82
atggcttccaatggaaaaacccttcatcaaacccaagtggttctgatacctttccctgcacaaggccatctaaatcagcttctgcacctctcacgccatattttatcacacaacatcccagttcattatgttggcactgccacacacattcgtcaggccacagttcgagaccacaactccatttctaacattcatttccatcactttgaagttccaccctttgtatcccctcctcccaaccccaacaatccagaaactgatttcccatgtcatctacttccttcctttgaggcctcttcgcatcttcgcgagcctgtgaggaaccttcttcagtccctgtcgtcacaagccaaaagggtcattgtcatccatgactcattaatggcatcagtggcacaagatgccacaaacatgccaaatgttgagaattacacttttcacagcacatgtgcctttaccaccttcgtttattattgggaggtaatgggaaggccctcggttgaaggcttccaagtctcagaaatcccttctctggaaggatgcttcccaccccagttcattgatttcattactgcacaatacgaattccatcaattcaacgatggcaacatttacaacacaagcagggccattgaaggtccttacattgagtttctggagcgcattggtggaagcaagaagatttgtgcattggggccattcaaccctttagccattgagaagaaggattcaaaaacaaggcacacatgcttggagtggcttcataaacaagagccaaattcagtcatgtatgtgtcttttgggaccacaacaagtttgacagtggaacaaattgaagagattgcaactgggttggaacaaagcaagcaaaagttcatctgggtgctgagagatgctgataaaggagacatctttgatggaaatggaacaaaatggtatgagcttccaaatgggtttgaggaaagagttaaaggcatagggctaattgtgagagattgggcaccccaattggagattctgagccacacttcaacaggggggtttatgagtcattgtggatggaactcttgcttagagagcataaccatgggggtgccaatattagcatggcctgtgcactctgatcagccaagaaactccgttttgatcacagaggtgctcaaggttgggttggttgtgaaggattgggcacaaaggaatgtgttggttagtgcttcagttgttgagaatgccgtgagaaggttgatgaaaacaaaggaaggtgatgatatgcgagacagagcagtgaggcttaaaaatgcaattcacaggtccaaagatgaaggtggagtttctcgcatggaaatgagttctttcattgatcacattatcaattga

SEQ ID NO: 708 - DNA, 2418 bp, Glycine max var. Williams 82
atggatcatataagtaacgaggctagtgttgacccttttgcgattggcccttctagcattcttggtagaacaattgctttcagggttctcttctgcaagtctatctcacaattgaggtatcatatactttttgtgctgtcgaatatcttcaaaagatttaggggattttgggcacccattgtgtcatggttgcatccgagaaaccagggcatattggcaatgatgacaatgattgctttcttgttgaaacggtacaccagtgtgaaagtgagggccaatatcgcatataagcggaaattttggagaaatatggtgagagctgcattgacctatgaggagtgggctcatgcagccaagatgcttgatagagagacacaaaagatgaatgaatcagatctttatgatgtggagttggtgagtaacaagcttgaagaacttcgccatcgccggcaagaggggtctcttagagatataatattttgtatgcgtgcagatcttattaggaatctaggtaatatgtgtaaccctgagctccacaaagctaggcttcagatgccaagactaatcaaggagtatattgacgaggtatcaactcagttgagaatggtctgcaactctgattcggaggagcttgcattggaagaaaagctttctttcatgcatgaaacgagacatgcatttgggaggactgctttgttgttaagtgggggtgcttcccttggagcttttcatgttggtgtggttaaaacactggttgaacataaacttttgcctaggataattgctggttcaagtgtaggatccattatgtgttctattgttgccactaggtcttggcctgagcttcaaagcttttttgaggattcattgcactcactacagttttttgatcaaatgggtgggatttttacagttgtgaagagggttacaacatatggcgcagttcatgagatcagacaattgcagatgttgttgaggcatctaacaagcaatcttacatttcaagaagcatatgacatgacaggtcgaattcttgggattacagtttgttccccaagaaagcatgaaccacctagatgtcttaactacttgacttcacctcatgttgtaatatggagcgcagttactgcttcttgtgcctttcctggccttttcgaggctcaggaattgatggcaaaggatagaagtggagagattgttccttaccatcctccatttaatttgggtcctgaaaagggttccacttcagtgcgccgttggagggatggtagcttggagaatgatttacctatgatgcagttgaaagagttgttcaacgtcaatcactttatagttagtcaggccaatcctcatattgcaccattattgagattgaaagaatttgtacgagcttatggaggtaattttgcagcaaagcttgctcatctagcagagatggaggtgaaacatagatgtaatcaggtactggaactcggctttcccttaggtggacttgccaaactgtttgctcaagattgggaaggtgatgtaacagttgttatgcctgcaactcttgctcagtacttaaaaatcatacagaacccttcttatgtagagcttcaaaaggcagctaaccaagggagaagatgcacctgggagaagctttcggccataaaagcaaattgtggaattgagcttgctcttgatgagtctgttgcaattctaaatcatatgaggcgactcaaaagaaatgctgagagagttgctactgcttctcatggtcttcccagtactgtcaaattcagtggttcaagaagaattccatcgtggaacatcattgcacgagagaattctacaggttccctagaagaccttcatgctgatgctgcttcctcattgcatcaaggtgttattagtcccagtggagcaactggtaaaaactggaagtcccatcgtatcattcatgatgcaagtgacagtgaatctgaaactgctgacttgaattcttggaccagatccggtgggcctttgatgagaactacttcagcagatatgttcattgactttgtccaggacttagaatttcataaagttaataccgaactaaatagaggcaaggtgactcacactagtcctcatgattttcagcatcacagttcaaggcacacaacagttaataggtggtctgagagcacagaaaacgatcagaaagaaaatggcaacaggattgtcatgaatgaatctaacataatggtaactgaaggtgatcttttacagcctgaaaggatccataatgggattgtgtttaatgttgtcaagaaagaaaacttgacaccaaataggaatcatgattataatagttataacaatgaagttgctgaatgtgtacaaattgactttccagggaaggaggtggatgctgctagttcagcttcctaa

SEQ ID NO: 709 - DNA, 327 bp, Glycine max var. Williams 82
atgaaaaatcccattatcgggctgccgttgatcatccaatttatcgctgccttcaacaacgacaaaaacatcatacaacttccaacgttctaccatacacaatgggcaccacagtatcacgagtctgttcacctgagatatgatggagtcatttacgaaatacagtgcgtatttgacatacacttcataccaccattggagcggcaaacttgtgacaggcagaggcattcatctagaaagcatatctcgactgttcggtttactcaggaaatgctcaatgctcctgaacccctgaagttcctcttaaagcttgtggtcaccacataa

SEQ ID NO: 710 - DNA, 1827 bp, Glycine max var. Williams 82
atggatgtgagtaggagaagagttggagttagatgcagtgtggttgcagggtcagtgtgggagagcagaatgaagagtgatgaagttggtggtggagttaaggtcttcagtggagaacaaagtgctgaagaaggaggcaatgatggcaccagattgaagagaggccaaattgggagtgtggttgcttctggaaagagaaaaacttggaaatctgaagggttagaaaataacctaattcaaatagccagaggaaaagcagaaccccagaagaatggtagtaatagtagtagtagtcaacaatgtaaggatctcaacatttcttctgattcagtcaagaagagcccaattccggccaggaagaaaaggtctgaggtaggtgaaccttttgaaaagaatgttgggaagctcagaaagaacaaatcagattctgttaagaatgtcgatgatggaaatggggggaatgcaatacagcctaggaaggacaaaccagagttggatcatgttttgaatgaatcaaggaatgatggattggctggtgggtctggcagaaatgttattgacaatggtaagaatgacagtgatggaaattgcaaggattttggtgtgtgcctagagaaagtaatttccagcaattcagataatgttggcatgatcaagtgttcaccagtgcatgttgatggagactttgatgatgttgttgttgatgatgaagaagaagatgaggagattgatgttgagatggagaaggggagctttgatgttaaggaaatcagtgtgccagaatccaaggttgtgaatgaaccagaaaggaaggaggttgtgaatgtaccagcaaaacagaagattgtgaatgaaccggaacctaaaaaggttgtgactaccaacagacaatttcatcaaaaaaatgaaaggccagtgtcaatccctatagctgtgaagccatctcctccaattagaaagctttccacaattcaccaaaatttctccaaggctgattcaattccaaaggcagaagagtactattgctttccacaaagccagaacaaactgcagagtttagttgatttaatcatgtggagagaggtctcaagatcagcatttatcttcgggattggaacattcactatagtttcatcttcttatgcaaaagatatcaatctgagtcttatttctgtaatgtcctatattggccttgtctatctagctgttatcttcctctatcgatcactaatatgcaggggggtcatagatgtagacgacacaaactatgtactaggagaagaagaagcaatttgggtgctaagattgatccttccttatttgaatgagttcctgtcaaaacttagagccatgttttctggagatcctggtaccacaataaagttggcagttttgctctttgttcttgccagatgtggcagttccataaccatttggaagatggccaaatttggcttctttggagtttttaccgggccaaaaatttgctcctcatattctgcacagttaactgcattcgcaaacttttggattcgtcgattccgggatgcttgggtttcttgctctcacaaaaaggccgttgctcttggcatttttggccttgtttggaatttgtcttcagttgttgctcgcatttggtcagtgtttgttctatttgtggccttcagatactatcaacaacattatttggtgagagatggatgggtggaggatgtggcaggatgtgatgaaacatggcaagaacctgttggagttaaagttggaatgcagagacaacaatccacatacaaaatctttgaaactcagaaagtaaagaaagtattctga

SEQ ID NO: 711 - DNA, 606 bp, Glycine max var. Williams 82
atggcttcctgtttaccaaataacgcatctccatttttgtttatgctctcaatgtggctcttaatttccatctctgaagctgcaaagtatgtggttggaggcagtgaaacctggaagtttcctctctcaaaaccagattcactcagccactgggccagctctcaccgattcaaaatcggcgacactctcatatttaaatacgatgagagaacagagtcagtgcacgaagtgaatgagacggattatgaacaatgcaacacggtggggaaagaacacgttctgttcaacgatggcaacaccaaggtgatgcttaccaaatctggattcagacacttcattagtggaaatcagagtcattgccaaatggggttaaagctaatggtagttgtcatgtcaaacaacaccaaaaagaaactaattcattcaccatcaccatcaccttcaccatcaccatcaccatcaccttcaccttcaccctcaccttcaccttcattatcatcgccatcaccttcaccacttccaaataatcaaggtgttactcgtagttcaggcgctgaattcattggagttatgatgtggttgggggtgatgatgttattgctttaa

SEQ ID NO: 712 - DNA, 759 bp, Glycine max var. Williams 82
atggaaaggagcaaaatacaagtgctttatgatgctagccatgccgtgttttctcaagaggggcttccaacctttcaacaaatccactatctaaaaactttgctagacaaaattgaagctattgatgtaggagtcgacgagtccgggttgtgtgattctccaacatcagacgcaaccgttgatagcagcagcagcagcagcaacagcaagggtttgctttgtggacacggattctctgagataacatacattcacattcatgaatgtgactatttctctatgggtgtattctgtcttccagcaggaaaagtgtttccacttcatgatcacccgggaatgacagtgttgagtaagctcttgtatggctctacctgtgtcaaagcttatgactggatcgcattggattgtgctggaagccaaacaataggattggctgggagggtagtggatgaagtaatcaaagcaccacaggaaccatccatattatttccaagaagtggtggcaatattcattctttcacagcgttgacgccatgtgcaatactagacgtgctatctccaccatactctgaagagtttggaaggccttccacttacttctcagatatccctatcccttctcttaatggttatgccatacttgaagagaaaccaatgcctagtaacctagttgttcaaggagcaccataccttggaccttcaattgtaaccgttgaccattacaacttcggtcaaatcgattttgataatcacgtgtaa

SEQ ID NO: 713 - DNA, 1020 bp, Glycine max var. Williams 82
ccaaggtttgttttacgttattattcacaatccttttttctcccttcttcactgtcccttccatttaatgccatcaaccaaaccataataatcttatagtgatgctttaaatttggttggctacataaccagctaaggttaattattactaagctttactaccccaaaacaatggaaaggagcaaaatacaagtgctttatgatgctagccatgccgtgttttctcaagaggggcttccaacctttcaacaaatccactatctaaaaactttgctagacaaaattgaagctattgatgtaggagtcgacgagtccgggttgtgtgattctccaacatcagacgcaaccgttgatagcagcagcagcagcagcaacagcaagggtttgctttgtggacacggattctctgagataacatacattcacattcatgaatgtgactatttctctatgggtgtattctgtcttccagcaggaaaagtgtttccacttcatgatcacccgggaatgacagtgttgagtaagctcttgtatggctctacctgtgtcaaagcttatgactggatcgcattggattgtgctggaagccaaacaataggattggctgggagggtagtggatgaagtaatcaaagcaccacaggaaccatccatattatttccaagaagtggtggcaatattcattctttcacagcgttgacgccatgtgcaatactagacgtgctatctccaccatactctgaagagtttggaaggccttccacttacttctcagatatccctatcccttctcttaatggttatgccatacttgaagagaaaccaatgcctagtaacctagttgttcaaggagcaccataccttggaccttcaattgtaaccgttgaccattacaacttcggtcaaatcgattttgataatcacgtgtaaattgagtgtcttttttgaacagtacaaattaaatagaataatacaaaatactattcatatatcatatttaactaattcaactaaattctt

SEQ ID NO: 714 - DNA, 318 bp, Glycine max var. Williams 82
atggacaaatgcagcttatgtagagtgtgcacatgcaattccaaaatggcaaggtcttctaccaaaatctggagagatgttcctaggaacttcaaattatttgaagagtttgagagaggtgagaagggaattggagatggaactattagctatggaatggatgatgctgatgatatctacatgcaatcctggactggactattattggcccccctggtaactttgcaaggcattcaaattatacaagctgccgttggggctgggaggacaatgttgggaagctttatgcatttggtgctggagacaaaggacaactag

SEQ ID NO: 715 - DNA, 408 bp, Glycine max var. Williams 82
atgttcttgattcaagaggctcttttgtggagaggcaagcagtggtctctagaaataattatgagtgacaatggtgaagaagctggagaaaatcgtctagttccccgtttgaatgaaaggattctttcatcattgtcaaggagatcagtagctgcccatccttggcatgatctagaaattggacctgaggctcctcagattttcaattgtgttgtggagatcactaaaggaagcaaggttaagtatgaacttgacaaaaagactggattgattaaggttgatcgggttttgtattcatcagttgtttatccacataactatggttttatccctcgcacactgtgtgaagacaatgatccaattgacaaaattcattctaagacaaaaagaatgagcacaaggaggtag

SEQ ID NO: 716 - DNA, 645 bp, Glycine max var. Williams 82
atgatggcaaatacaatctttactcaaacgattacttgcttagccgtagggaaatatccagcttcaaatgttgatcatcccaatattcatccccttcgattcaactccaaactcaaagaaaataatcgcttttcagttcctgaaaagaacctagccttgagatttcaaaatggttccacaagaaagatgaatatggctgtctacgctagcataataccaggagaccctattgatccttctcctggttctcctggttcttggaaaatttggattattggcacaatattcacgatacttgtatcctttacgaggggcaaatggggacccttgctacaattgaaagagaaagttgaaacaacaatagacgaagcacaacgagtagtagacattatagaggacgtggctgagggggtagataaggtggcagaagaggctgtgaagcatcttcccgatggaaaatttcgtgatgctgttgaatttgttgaaaaagtagctgaagatatagataagcgtgcagaacgtgcagaagatgcattagaaaaggtggagaacatggaaaaggagtttgagtccttcattgaatcaaccactcatcatcaggaaaattccgtcacaacgaccgcagaagcaaaggaacagaagtag

SEQ ID NO: 717 - DNA, 1146 bp, Glycine max var. Williams 82
atggctagcaaacacagaaaactcttccctgatgaaacaacaacaaccacaaaccaaacccaagattgctatggcttttgtgaccctgcatgcccttacaattgttacaataaccctgattacttcttctctccaccaccaccttctatttcacattcaagccaagttaatcacatatcctcctacttgatcattcttgttactctattcacggtcatttttgttgtggttggtttctacgtgatcaaagtgaagtgctatgctgcatggtgcgggtggagattcaacaacggttccgttccctctcaatcagacactgctgaggagtttctcaatgagaaccaagttgatcaccccgtgtggctcattgccactgtggggttgcaacaatcgatcatcaactccatcacggtttgcaagtacaagaagaatgaaaggttggttgaaggaaccgagtgttcggtgtgtttgaacgagtttcaggaagaagagactttaagactcttgccaaagtgcaaccatgcttttcatgttccttgtattgacacttggttgagatcacacacaaattgtcctctttgtcgggctggtattgtttctagtagtgtcaactctgaagcacaagcacctgtgtcgaattcggagcaagaaaatgcaaatttggagaggaatcaagatacccttttggagaattcaaggaataatgaatgtgatttaagcagcaacatggttgcaggggaatcaagtgaagcacttgatgaatcaaattctaaggatagggtaaatgatcaaactcagaacgatgtggttctgaatatcgagattctaacagagacgggatctgtttcaactacagaatctgaaagtgaaagccatcgtgttgttgatgatcacaaacaacatgatgacacaatgttgaacacggttgatcaacggaagcaagagcaagatggtgagtactactgctcaaaaacgtgtaaagcaatgcgtcgttcatctattgaagagtgtttgcatttaaacccggtatctatgaaaaggtcgttctcctcctgcaatagaaggattctaacttcgagagtttatatgagtctaaactctaaactcaattcatccctattagagttttcattttatgaaagatga

SEQ ID NO: 718 - DNA, 960 bp, Glycine max var. Williams 82
atggtttggccaattaggtccagaataagttctcttctctgttctaaggcacctttagttggttcatacatctatgactcatgtgggtgcttacgcttttctgctccaaccagctcctccataacaaggcattggccaaaaattatggattgggtacaaatggaccgttgccgtgcagcagcatcgttaccttcgatcaaagagaaacaaccagaaagtcatagtaatcgtgtcagactcggtcaagaaatcaaaggtcttgatgaagggaatatggctgaaattgatagctatcaaaacttgtttggtttgatgaaacagaggtttctgagtttcaagagccaaaaatatataaaagagttggagcattttgaagctcttgctgaagctcaatttcctaagtttatggtgattgcttgtgcagactctagggtatgcccctctaacatattaggattccaacctggagaagtctttatgatacgtaacattgccaatcttgttcctgtgatgaagaatggaccatcagaatgtaatgctgctcttcagtttgcagtaactactcttcaggttgagaatatattagtcattggtcatagtagctgcgctggaattgaagctttgatgaatatgcaagaagatgcagaatcaagaaacttcatacacaagtgggttgccaatggaaaacttgccaaacaaaggacaaaagctgccacagctcatcttagctttgatcagcaatgcaaattctgtgagaaggaatctattaaccaatcattattgaacttgctcagctatccttggatacaagatagagtgagaaaagagttgctttctctacatggaggatattataatttctctaattgctcttttgagaaatggacccttgattttaaacaatgcaatgttgaagaaggaagcagttatgttgtcaaagaacaagaattctggtgctga

SEQ ID NO: 719 - DNA, 918 bp, Glycine max var. Williams 82
atgactctccgcaaccaccaagagctcttggttgctcttgcaattctatattttcttgccacctcactcccttcagtttcagctcatggcccatatgcatgggatggggaggccacatataaattcactacttaccaccctggccaaaactacaaaggtttatccaatgtcaaaaactacttccaccatctcggctacatccccaatgcaccacacttcgacgacaacttcgatgacaccctcgtatctgccatcaaaacctaccaaaagaattacaacctcaacgtcaccggcaagttcgacatcaacactcttaaacaaatcatgacaccccggtgtggcgtccccgacataataatcaacacaaacaaaaccacatcgtttggcatgatctcggactataccttcttcaaagacatgccgcggtggcaagctggaaccacacaactcacctacgctttctccccggagccaagacttgatgacactttcaaaagcgcgattgcaagggccttcagcaagtggaccccagtggtgaacatcgcgttccaggagacgacgtcgtatgaaacagccaacattaagattcttttcgcgagtaagaaccacggtgatccgtatccttttgatggtccaggtgggatattgggccatgcattcgctcccactgatgggaggtgccactttgacgccgacgaatattgggtggcgtctggcgatgtcaccaaatcgccggtgacaagtgcgtttgaccttgaatctgtggcagtgcacgagatcgggcacttgctcggattaggccactcgtcggacctaagagccatcatgtatccttctataccacctcgaactaggaaggtgaatctagcgcaagatgatatagacgggattcgaaagctctatggtatcaacccctaa

SEQ ID NO: 720 - DNA, 1225 bp, Glycine max var. Williams 82
accacccttccaactttatcttttctctatagctccgtccaaacatgactctccgcaaccaccaagagctcttggttgctcttgcaattctatattttcttgccacctcactcccttcagtttcagctcatggcccatatgcatgggatggggaggccacatataaattcactacttaccaccctggccaaaactacaaaggtttatccaatgtcaaaaactacttccaccatctcggctacatccccaatgcaccacacttcgacgacaacttcgatgacaccctcgtatctgccatcaaaacctaccaaaagaattacaacctcaacgtcaccggcaagttcgacatcaacactcttaaacaaatcatgacaccccggtgtggcgtccccgacataataatcaacacaaacaaaaccacatcgtttggcatgatctcggactataccttcttcaaagacatgccgcggtggcaagctggaaccacacaactcacctacgctttctccccggagccaagacttgatgacactttcaaaagcgcgattgcaagggccttcagcaagtggaccccagtggtgaacatcgcgttccaggagacgacgtcgtatgaaacagccaacattaagattcttttcgcgagtaagaaccacggtgatccgtatccttttgatggtccaggtgggatattgggccatgcattcgctcccactgatgggaggtgccactttgacgccgacgaatattgggtggcgtctggcgatgtcaccaaatcgccggtgacaagtgcgtttgaccttgaatctgtggcagtgcacgagatcgggcacttgctcggattaggccactcgtcggacctaagagccatcatgtatccttctataccacctcgaactaggaaggtgaatctagcgcaagatgatatagacgggattcgaaagctctatggtatcaacccctaattattatagctaggtgttgtttgtactagaactagagttttatttcggtaatttgcattaaaggattttgaaagttatcgaggtgaaattattctaattcaagaacaacaaaaatagcatgtaagatattgtattttagttttctcttaattaagaataaaccagctgatactaggtgatgcatatatgataatgaataaatgtgacaaatttaccttaatttatctaatctatataatgttttagcatttacattaacaatt

SEQ ID NO: 721 - DNA, 273 bp, Glycine max var. Williams 82
atgggagacatggattcttcatcttcaacaactttgtcaaatcacaagaagacctcgtcggtgtctcgtttgaggaagggttgtttgtctttcgcagcttcattacagaaaggttttcgatatgtaaaagcgttttttgtgggtcaggtgaagactattactgcaaggaatgagaaggaagcaagtgaagctgaacttgaggctaccaagatgcaagttgaggctacggatgctgctgaagatataaagaacagactcaataaatctgcataa

SEQ ID NO: 722 - DNA, 252 bp, Glycine max var. Williams 82
atggagaaaagttcatcaactcgtagaacaagcttgctttcgtgttgggggtgtctcaaattgaagcttccttggacaaggagaacaagcacttacaaacccgttggtggttttgggtatgaccctttaagctatgctcaaaacttcgatgagggttgcatggacgacgaggaagacgaacctacttcgcgtcgtagattctctgatagatttgctgcccccgtatcaagttcaactaaaactctcaaataa

SEQ ID NO: 723 - DNA, 1362 bp, Glycine max var. Williams 82
gccacctgagtttacactgtagagatgtaatataaaaccatactttttttcttgaacaagtaaagaacttgtgcttttaagttctaaggtatggatgctgctgcaagtcaaagtctctatccattgcaccgttgcaaaactgttcacctggttaggcatgcgcaaggagttcataatgtagcaggagagaaaaaccatgatgcatacaattcttatgagttttttgatgcacacctaacctctctcggctgggaacaggttaataatctgcgaaagcacgtgaaggcaagtggactttccaaaaatattgaacttgttgtcatttcccccttattaaggaccatgcaaacagcagttggagtctttggtggtgaagcatacactgatgggattggtgagccacctctgatgacggaaaatgtcggacacagtgatcatcctgcagtttctagtatgaactgccctccattcatagctgtggagctttgccgagagcaaataggagttcatccttgtgataagagaagaaccattagcgagtaccggaatatgtttccagcaattgatttttcacttattgaaagtgacgaggacattttatgggaatctgatgtcagagagaagacagatgaagtttctgctaggggcctgaagtttttggaatggttgtggacacgtgaagagaaggagatagcagttgttacccacagcagttttctgtttaatacgctccgtgcttttggaaatgattgccacccagatataaagagtgaaatatgcacacactttgctaattgtgagctgcgttcaatcgtcatcattgatagaggtatgattggatcaagtgaatcaactaccaactatcctggcaagattcctcgtggccccgatgttcccagtgaagctgctgactaaaaccattcagggattatccttaccaaataatagctcctctttgtgatcattggtcgtatattggaattttcattggtataatagggttatttcttaattgcatttacaggcaagtgttcaatattttgttttacccgaacaaactaatccgtaggagcagtttcaaaattcctttttagtggcttaaagtagattggtaacatatgtaggtgccaatttttaagatgataaaaaggatgtcaacaatgattataccaagtttagctacttccacattcatgtatgaacaattgacactgtctttccattttatccaagtatattataagcatgtacttcctatgtttgccagagtaatggtagagtgaattaaatcaaattgatcctggctaggagctgtgatgagaatgaacagaataagagttcaatatcactttcatcttctcc

SEQ ID NO: 724 - DNA, 2228 bp, Glycine max var. Williams 82
tcaaattgcttttttatgatgttatgatatgatgcatctagaataattatattaccaaaccgatttattcggattcctaattccaatattctagtctatccgttccgatttcagagattcacagcgttcctttgcgcttttacacgcacggagcagaatcgccttttaagtttatccgtttattccttgagtttgcagattttcttcaaaatccacctcgttaatttaatttaatttttttatcttatccttttttattgcaaagaactctaccggaggcactactgaaaagtgtaaatcgcatggttttatgatttaaattatcatcaaaaggacattagaataaattcttaaaaggatctctgataatatccacgagaatttcatttttaatgcagtttaatagctgaatgtggtatgcatagccgacttcttttgttcttattctcttacttatagacatgtgtcggcacctaacagcttaaatttttctaaataattgtttggtgagatggttttcaatttgaactttcttgcttccattcttttatatttttttttaaaagcaaaaggttaactttcaacatatatggccattgtccacgcctttttgagtccaaaaagccacctgagtttacactgtagagatgtaatataaaaccatactttttttcttgaacaagtaaagaacttgtgcttttaagttctaaggtccttcccccctgtatactattgtgtttgcttgcaacttttgggtatatagttttgcaagtttcaactgttagctcttcctagcttttgctacaaacgctgattgaccacttttctatgcttgatttgtgtgattgttttgtctatttagcttgtctattattaaataacacaagggtatggatgctgctgcaagtcaaagtctctatccattgcaccgttgcaaaactgttcacctggttaggcatgcgcaaggagttcataatgtagcaggagagaaaaaccatgatgcatacaattcttatgagttttttgatgcacacctaacctctctcggctgggaacaggttaataatctgcgaaagcacgtgaaggcaagtggactttccaaaaatattgaacttgttgtcatttcccccttattaaggaccatgcaaacagcagttggagtctttggtggtgaagcatacactgatgggattggtgagccacctctgatgacggaaaatgtcggacacagtgatcatcctgcagtttctagtatgaactgccctccattcatagctgtggagctttgccgagagcaaataggagttcatccttgtgataagagaagaaccattagcgagtaccggaatatgtttccagcaattgatttttcacttattgaaagtgacgaggacattttatgggaatctgatgtcagagagaagacagatgaagtttctgctaggggcctgaagtttttggaatggttgtggacacgtgaagagaaggagatagcagttgttacccacagcagttttctgtttaatacgctccgtgcttttggaaatgattgccacccagatataaagagtgaaatatgcacacactttgctaattgtgagctgcgttcaatcgtcatcattgatagaggtatgattggatcaagtgaatcaactaccaactatcctggcaagattcctcgtggccccgatgttcccagtgaagctgctgactaaaaccattcagggattatccttaccaaataatagctcctctttgtgatcattggtcgtatattggaattttcattggtataatagggttatttcttaattgcatttacaggcaagtgttcaatattttgttttacccgaacaaactaatccgtaggagcagtttcaaaattcctttttagtggcttaaagtagattggtaacatatgtaggtgccaatttttaagatgataaaaaggatgtcaacaatgattataccaagtttagctacttccacattcatgtatgaacaattgacactgtctttccattttatccaagtatattataagcatgtacttcctatgtttgccagagtaatggtagagtgaattaaatcaaattgatcctggctaggagctgtgatgagaatgaacagaataagagttcaatatcactttcatcttctccacgtatctttatttattgatgcaggctgagtagctgcccttggcattgtctggctttgatgctttg

SEQ ID NO: 725 - DNA, 1629 bp, Glycine max var. Williams 82
atggctgtttcaacaagtttccctggtgcaaagttggaggctttgttgctgaaatgtggctcctccaatgctgccactgccactgccaccaccaccacccatttgtcatgtttttgcaaaaccagaaagacacttgttcagagtcagagagggcctattcgctgtgaggcttcttctgcttctgatgttgtggctgatgccactaagaaagctgctagtgtctctgctcttgaacagcttaagacctctgcagctgataggtatacaaaggaaaggagcagcgtcatggttattggactgagtgtgcatagtacgcctgtggaaatgcgtgaaaagcttgccataccagaagcagaatggcctcgagccattgcggagctttgtagtctgaatcacattgaggaagcagctgttctgagcacctgcaacagaatggaaatatatgttgttgctctgtccaagcaccgtggtgttaaagaagtcactgaatggatgtccaaaacaagtgggattccagttgcagatctttgccagcatcagtttctgctatacaacaaagatgccacacaacacctttttgaagtatctgcaggtcttgattctctagtgttgggagaaggtcaaatccttgcccaggtgaagcaggttgtcaaagttggacaaggagtgaatggctttgggaggaacattagtggactattcaagcatgcaatcactgtggggaagagggttagaactgagacaaacattgctgctggtgcagtttctgttagctcagcagctgttgaactggccctgatgaagctacctgaagcctcacatgccaatgcaaggatgttggtcattggagctgggaagatgggaaagcttgtgatcaagcatttggtggcaaaagggtgcacaaagatggtggttgtcaatagaagtgaggagagagttgccgcgatccatgaagaaatcaaggatgttgagataatctacaagccactctcggagatgctcacatgcattggtgaggcagatgtggttttcaccagcacagcatcagagaatccactgttcttgaaggatgatgtcaaggaacttcctcccgccaccgatgaagtcggcggccgtcgccttttcgtcgatatatctgttcctaggaatgttggatcatgtctctcagaccttgagtctgtgagagtgtacaatgttgatgaccttaaggaggttgtggcagccaacaaagaggataggctaagaaaagccatggaggctcaagcaatcattggtgaagaatcaaaacaatttgaggcttggagagactcattggaaactgttcctaccattaaaaagttgagggcatatgctgaaagaataaggcttgctgagcttgagaagtgcctaggtaagatgggtgatgatatcaacaagaagacacaaagagctgtggatgatcttagcaggggtatagtgaataagttgcttcatgggccaatgcaacacttgaggtgtgatggcagtgacagcaggactctaagtgagacccttgagaacatgcatgctttgaatagaatgttcaaccttgagactgaaatatctgttttggagcagaagattcgagccaaggtggagcaaaagccatag

SEQ ID NO: 726 - DNA, 2032 bp, Glycine max var. Williams 82
ttttgttcttcataataattttattttattccattggaacaaaattgtctttccggctttcacatagaacacatatggttagtacaaaaaaagaattggattccatgacagcttgtgataggacttactgaggtcgaatcctgtgttcaagactggaatatgtgcaatggaatattgtctgcatcagagaaggaaatcatgcagcttatgatcatgccaagtatgggcaaggcaaggcatgccttatttttctaggattttcttttaaccttttatatcttttgcttattccctataccatttctgattttatcttcaactccaattttctctcacacaattacacagaacaccacataccaaatacatagccacaccaccaaattcaactcctccaattttctaaatggtttccaatggagatgaagaatcaggcacacaagtccaactacctgaaaccacaacaaaaaattcaccttcaccctttttcaggtacaactcaccactagttcaagtgattctcattggtgtgatctgcttttgttgccccggcatgttcaacgccctctcaggaatgggtggtggaggccaagtggaccacactgcctccaacaactccctcactgccctctacaccaccttcgccatattcggcatcctcggcggcggcatctacaacatcctcggaccccacctcacccttctcgcaggttgttcctcctatgtcctctacacatcctccttcctctactacaatcaccaccaccaccaagccttcgtcattctcgccggcgctctcctcggcgtaggagcaggcctcttgtgggctgcacaaggtgcaataatgacatcttaccctccaaccaatagaaaaggcacttacatatctattttttggagtatcttcaacatgggtggagtcattggtggtttgattcctttcatcttgaactaccatcgtagtgaggctgcttcagtcaacgatggaacctacataggcttcatgtgcttcatgtcactggggacccttttgtcattagccatcttgcctgcatgcaaggttgttcgtgatgatggtagcaggtgcaccaacatgttttacaccgatgtttccaccgagtgtgtggaggttctcaagttgttttccaattggaaggtgcttcttatggttccagcagcttggtccagcaattgtttttacccttaccagttcaatgatgtgaatggggctctgttcaatttgaggactagagggttgaacagtgtgttctactggggggctcagatgctaggctcggttgggattggttatattatggattttagttttaagaggagaagagttaggggaatggttggggttatagtggttggtgttcttgggactgtgatttgggggggtggacttgttaatcagcttaggtattcttccaatgatttgcctgaaaaattggattttgagcagtcagggtctcactttgctgggccttttgtcttgtactttagttttgggttgctagatgccatgttccaaagcttggtctattgggttattggagccctggctgatgattctcagattcttagcaggtacagtgggttctttaaaggaatacaaagtgctggtgctgcggttgcttggcaagtagatgaacacaaggtgtctttcatgtcccaattgattgtgaattgggtgctcacaacaataagctatccattactgtttgttttggtcatgttggctgtgaaagatcaatgacaataaggttggatatataataacaatattcctgttgtaagggaaagtcaatatatagaaagtttgttgatgtcttcttgttgccttgtactttccctagtcactaatgttcaggctttgaaacaaactgaaatttccatatgaatgtgttcatgacattgtggaactcgttttgtatcaggaaaatgttccttcacaccgcagggattgtttacatgtacacataaagaaatagaagagacactagtgatatatatgtaatagatcgaccgt

SEQ ID NO: 727 - DNA, 927 bp, Glycine max var. Williams 82
atgaagtgggaaagtataaccctctcttctcctacaccttgcactccaaactccaacaccaattggttggtgatggaggataataatagcaggagcacaaaatggacctctgaagagaacaagctctttgaaaatgctcttgcagtgcatgataaggacaccccggatcggtggcacagagtggctgagatgattcctggaaagacagtggttgatgtgataaggcagtacaaggagttggaagtagatgttagcaatatagaagctgggttgattccagttcctggctatagtagcactgctacctcacccttcaccttagattgggtgaacactcctggctatgatgggtttaaaggatgtggaaagagatcttcctcagtgagaccgattgagcatgaaaggaagaaaggagtgccttggactgaagacgaacataaattgtttctattgggtctgaagaagtatgggaaaggtgattggagaaatatatctcgcaattttgttattacaagaactccaacacaggttgctagtcatgctcagaagtacttcataaggcagctttcaggaggcaaagacaagaggagggctagcatacatgacataacaacagtgaatctcacagaaaccataacaacttcttcagaagacaccaatggatcctcttcaccacatgtgctctcacagcaacaacagccaaattctactcctactacaccaagaactcgttttcagtggagtaatcagtctaacacaggagtagctatgactctcaaccctgctcatgaaagagtcttcatgtctcattatggtgctaactcctttggggttaaaattgagggacagaatcttcatgagtcttcttacttgcgacctcagacacagaacatggttttccaaatgcaacagtcctctcaacactag

SEQ ID NO: 728 - DNA, 2875 bp, Glycine max var. Williams 82
tcagagtcaaactccgacaccctgtcttcgctgtcggtcgatgttctgaggaagaatcccaggatcctggaagtgcataggagctgctcgatgtgctgcgcgaacgatcggacccaggacgagagttcccatgatgtggggtcggtgttgtgtcggaagttggagaggttgaggtagtttctgccgcctgcggaggggtacacggagagctggtcctggaggatgaagctaccgtggtggacggcaatcaggcacttcaggaccacggcggcgttgttggtctcctgaaggcggtccatcaggacctccacagcgaccaaggcggtcgtgagccgtcgccagaggagaggagcgtggctgagtgcttcagcgtggggggcgtggaggaatcatggcccgtgacgccggcaggccctcgacggcggacttggaggccggcgggtgccgtagcggttaggggagaattgaattttttaaataataaaaaattatgtaatatgtgttggtgattaaacgatgacaggtgttcaagtgaaacatagataaatgtcggatacatagatgagaaaaatgaattttagataataaaataaaaataatctatttttcagaaaacaatatttaactcattaattattattgatactaaaaaagtgaaagggaataaattcacatattaaaaaaattaatgctgagaaagctctggttgacttgaagtcttgaaggtagtaaagttagtttgtatagggttccatttgggcgtcaaatctgcatgacagaggagagaagcagtttgagaggtacattgcatttacaatacatggattgtctctacatgaatcctcaggaatccattgaagcacgtgtgaaacaccttctttctcttatgactttgaatgaaaagattggtcaaatgacacaaattgaacgctcagttgctaccccttctgccatcaaacacttctccattgggagtgtgttcagtgctccacacaatggacgttttgagaaggtactgtcatctgattcggctgatatggtggatgggtttcagaagttggcacttgagtctcggttagccataccaatcatttatggggttgatgctattcatggtaataatagtgtctatggtgctactatatttcctcacaatgttggcctaggagctaccagggatcaagatttagttcaaagaattggagctgcaacatcacttgaactcagagcaagtggaattcactatacttttgctccttgtgtggcagtatgcaaagatcccagatggggaagatgctatgagagttacagcgaaaacactgaaatagtcagagagatgacttcttttgttttaggcttgcagggcaatcctccagaaagacacccaaggggctacccatttgtggctgggaggaacaatgttgttgcctgtgccaagcattttgttggagatggaggtacagagaaaggtgtaaatgagggtaataccatactatcatatgaagatttggagaggatccacatggccccttacgtggactgcatagctaagggagtttctaccatcatggtctcatattccagctggaatggaaacaaactccatggtcaccattttctgcttaatgaaattttgaaagaaaagctaggcttcaagggatttgtgatttctgactgggagggaattgatgaattatgccaaccttatgggtcagattatcgtcattgcatctccactgccattaatgctggaattgacatggtgatggttccttttagatatgaaatatttgttgaagagttgatgtctctagttcaatcaggggaaataccaatagcaagaattgatgatgccgttgagcgcattttgagagtgaagtttgctgctgaactttttgagtttcctttaactgacagatctttgctagatgtagttggtggcaagctacatagagatctggcacatgaagcggttcgaaagtccttggttctgttgaaaaatgggaaggatcctagtaaaccctttcttccattgaacaggaatgctaagagaatccttgttgctggaactcatgctgatgatattgggtatcaatgtggaggatggacaggtaccaagtatggatctagtggccggatcacaatcggcacaactatcttggatgctgttaaggaagctgtgggaaatgaaacagaagttatttatgagcagtgtccatcaacagacatcatagaatgtagcgaagtttcctttgccgtagttgtggtcggagaaggtccctacgccgagtgtgggggtgacaattcagagcttgtaatcccatttaatggagctggaatcatagacttggttgctgataaaatcccaacacttgtgattcttatatctggaagacctttgctcttagaacagtgcctattggaaaagatagatgctcttgttgctgcatggttgccaggtactgaagcacagggaatcacagatgtcatatttggagatcatgacttcaaaggtcaactaccaatgacttggttcagaagagttgaacagcttgatcaaccagttggagttagttcatgtgagcccttattccctcttggctatggactaacatatgataaggagaatttgcatgactaagtacatgaatatccaaaaagttgttcatagattcaatatctggagtttgtgaacaatcccttggcactaatcttttatcctaccatgtaccattcatgcatgtatgatactgtcagttaccctatttgaaatttgtatgtccatgacatttacactaactaatgaactttgaggatggccataattgaatgtatgtattgaatattttcaagcttcttgactgacctagcagat

SEQ ID NO: 729 - DNA, 369 bp, Glycine max var. Williams 82
atgagtcaaagtggctacatcagtgagaaaccaggcttgtccttgagacagaattccaataggaaatcaaccagaaatgggcaagtgaagagctgcatgttcagaattccttggcagtctgagacctctcccattgaacttgtgaaggatcttgcagaaagagtcacgaatgctctacgcttgatctctccaaagagatttttacaccgaggttcgtcttccttaacaagatcaaaatcagcagggtcctctgttgattcccatagaactgctgctgttgaggactgcattgagttcatccactcttccttttccagatcaaattcctcaactgcagcaccacgccaagattctatacaagctccttga

SEQ ID NO: 730 - DNA, 1644 bp, Glycine max var. Williams 82
atgagttttgaagattcctcgaagaaacatcagtcagttggaccatggggaggcaatggagggtcccgttgggatgatgggatatactcaggagtaaggcaattggtgatagttcatggaacaggcattgactccatccaaattgaatatgataagaaaggaagctctatttggtcagagaagcacggtggaagcggaggccgtaaaaccgacaaggtgaagcttgattgtccaaatgagttcctaactaaaattcatggatactatggcagctctaatcaaagagggccaaactttgttcggtcactgagttttgagagtaacaagaaaacttatggaccatttggtgttgaactagggacatatttttcagtcccattgactggtgcaaaaattgttgggttccatggcaggtgtgggtggtatgtagatgccattggagtctatctgaagtcctcgaaacaacccaatccatccaaaactttggctcattcccagagctccattactaacatttctgagaattttggttattctgtgatacaaggaactttgaacgaaaactacgatattgttcttgctctgaaacaaaaagatgatttcaataagccttcagcaaagaatgtatccgggaagatatcttttgtcaaagaatccaacaatattgaacacaaagaaaagatggctcatgtggaaaagtcaagcccaaaggttggagatgtagtcacacatggaccttggggtggcattggtggatatgtatttgatgatggaacctatacaggaatcaggcaaatcaatttgtctcgcaatgttggaattgtatggattagagttttctatgattatcatggggagactatatggggatccaaacaaggtggaacaggaggatataaaaatgataagatagtctttgattttccatatgaagccttgacacatatatctggctactatggacctttgatgtacatggggccatctgttataaggtcactgactttccacaccaccaaaaggaagtatggaccatatggggaagaacaaggaacttatttcaccacaaaagtgaaagaaggtaaaattgttggcattcatgggaggaaaggtttgttcctagatgcttttggagtacatgtagtggaagggaaagtgatagtgcctgtggcaacacctcccaaggaaatcacttctagagaatcaagtattggtgaaataggaagtgctcaatggccaacaaaactagtacttgctaaaccatcagcagctgaagaggtttcttgtggtgtggtgaaagaaccagctccctgtggaccaggaccatggggtggggatggaggtagatcctgggatgatggtgtcttttctgggattaagcagatttatttgaccaaagtatcagaaggcatctgctccattcaaattgagtatgatcgaaacaggcaatctgtgtggtctgtaaaacatggtggcagtggaggagacaccatgcataggatacaactggagtatccaaatgaggtgctgacttgcatatctggctattacgggccaattgctaaggatgagcagcatataatcatgaagtcactgactttcaacaccagtcgtggaagtatggtccatttggtgaagaagtag

SEQ ID NO: 731 - DNA, 1749 bp, Glycine max var. Williams 82
atgtgtggtattcttgctgttcttggttgttctgatgactctcgagccaaaagggtccgcgtgcttgagctctctcgcagattgaagcaccgtggccctgactggagtgggctccatcaacatggtgactgctttttagcacatcaacggttagccatagttgatcctgcttctggggatcaacctctctttaacgaggacaaatccgtcattgtcacggtgaatggagagatttacaaccatgaagagctcaggaaacagctgcctaatcacaagttccgtactggatgtgattgtgatgttattgcacacctgtacgaggaacatggagaagactttgtggacatgctggatggtatcttctcatttgttctactggacacccgtgacaacagttttatagtggctcgggatgctattggggtcacttccttgtacattggatggggattagatggctctgtttggatttcatcagaaatgaaaggcctgaatgatgattgtgaacactttgagtgttttccacctggtcacttgtactctagcaaagaaagagggtttcgcagatggtacaatcctccttggttctctgaggctactccatccaccccttatgatcctctcgttttaagacacacctttgagcaggcagtcataaaaagattgatgactgatgtgccttttggtgttctactctctggaggtttggactcttcattggttgcatccgtcacttctcgctacttggccaacacaaaggctgctgagcagtggggatcaaagttacattcattctgtgtaggccttgagggctcaccagatttgaaggctgcaaaagaagttgctgactatctaggcactgtccaccatgagtttaccttcactgttcaggatggaatagatgccattgaagatgttatctaccatgttgaaacatatgatgtgactacaattagagctagcacacccatgtttctcatgtctcggaagattaaatcacttggtgtcaaatgggttatctccggagaaggatctgatgagatctttggagggtatctgtacttccacaaggcacccaacaaggaggagtttcacagagaaacatgccgcaagatcaaagcactccaccaatatgattgcttgcgagccaataaatcaacatttgcttggggtctagaagcccgtgtaccatttttggacaaggcatttatcaatactgcaatgagtattgaccctgagtcgaaaatgataaaaagagatgaaggacgaattgagaagtggattctgaggagagcctttgatgatgaagagcatccttatctgccaaagcacattttatacaggcagaaagagcaattcagtgatggagttggctatagctggattgatggccttaaggcccatgctgcaaaacatgtgactgacaaaatgatgcttaatgctggtaacatctaccctcacaacaccccaacaaccaaggaagcatattactacagaatgatctttgagaggttcttccctcagaactcagctaggctcaccgttcctggaggagcaagtgttgcatgtagcacagccaaagctgttgagtgggatgctgcttggtctaacaaccttgatccttctggtagagcagcacttggagtgcacatttcagcctatgaaaaccagaacaacaacaagggtgtagaaattgagaagattatacctatggatgctgctcctcttggtgttgcaatccagggataa

SEQ ID NO: 732 - DNA, 1401 bp, Glycine max var. Williams 82
atggtttcgtgggtgagaggcaagtgcgtcggtaacggcgcgtttggggttgtgaacgtggcgatttcgaaaagagataatcgcgttttcgcggtgaagtccgtggattgtggaagggggctttctggtcatcaggtggaggcgttggagaacgagattgggattctgaagcgggtggcttcgccgcacgtggtggcttatctcggagacgatgtcacgtgcgaaggaacggcgtcgttcaggaatcttcatctggagtacatgccaggtggcaccgtcgctgacttggaccgcgctgacgtggacgagcggttagtgaggcgcttcgcgtggtgcctcgtgtccgcgctgcgtgacgttcacgcgcaaggcttcgtccactgcgacgtgaaagggaggaacgtgcttctctccggcgacggcgaaatcgtgaagctcgccgattttggcacggcggtggaaattgaatcctcgccggcggagatgttattgttgtcgcgggggagtccgatgtggatggcgccggaggtggttcgccggcagaggcaggggccggagtccgacgtgtggtcgctcggatgcacggtgatcgagattgtcaccgggaaaccggcgtgggaggatcgcggcgtcgacacgctgactcgaatcggttactcagacgagttgccggaatttccaaagcagttgtcggagctagggaaggattttctcgagaagtgtctcagaagagaacatagtgaacggtggagctgcgatcagctgctgcagcatccatttttgcttccctactacgcggttgctgaatcgtcgcctcgctgcgttctcgactgggttgactcggagctcaactccgagtcagattgtaacgaccgtgatcatcaagaagacgtgtttataaaatttaccaacagcgaagaaaaatcagttattaaaaatagaattagtaaatttgcgacagagtcgagggtaaattgggaaacgcagggttggatagtggtgagggaaattgagtccaacggaaaaccaacgacaacgggaacagaaacagaaatagaggaaggagcatgtacgtgtgagtgtgatggtgttggttcgagcaaagaaggggtaaattgggagtttcacaatgtggcggggactggtatggaatattcggattctgtaggggtaaatcggggaataggaaagttgggtgggagtaacaccgctggagggggtggtggttggagctgtcggtatgggtgtgggtgggaaaagttgggtaggaatagaggaatattcagcatttacagcttgtattgtaaaaatttcatgttgtgtaatttaatattcttaatgtatatcaatatatattatgcttttggattattgatgttgtttaccttttactacacgtga

SEQ ID NO: 733 - DNA, 1506 bp, Glycine max var. Williams 82
caacactttcgagttcgaactaagaaaaaaaaaaaggaaaacaaaatggtttcgtgggtgagaggcaagtgcgtcggtaacggcgcgtttggggttgtgaacgtggcgatttcgaaaagagataatcgcgttttcgcggtgaagtccgtggattgtggaagggggctttctggtcatcaggtggaggcgttggagaacgagattgggattctgaagcgggtggcttcgccgcacgtggtggcttatctcggagacgatgtcacgtgcgaaggaacggcgtcgttcaggaatcttcatctggagtacatgccaggtggcaccgtcgctgacttggaccgcgctgacgtggacgagcggttagtgaggcgcttcgcgtggtgcctcgtgtccgcgctgcgtgacgttcacgcgcaaggcttcgtccactgcgacgtgaaagggaggaacgtgcttctctccggcgacggcgaaatcgtgaagctcgccgattttggcacggcggtggaaattgaatcctcgccggcggagatgttattgttgtcgcgggggagtccgatgtggatggcgccggaggtggttcgccggcagaggcaggggccggagtccgacgtgtggtcgctcggatgcacggtgatcgagattgtcaccgggaaaccggcgtgggaggatcgcggcgtcgacacgctgactcgaatcggttactcagacgagttgccggaatttccaaagcagttgtcggagctagggaaggattttctcgagaagtgtctcagaagagaacatagtgaacggtggagctgcgatcagctgctgcagcatccatttttgcttccctactacgcggttgctgaatcgtcgcctcgctgcgttctcgactgggttgactcggagctcaactccgagtcagattgtaacgaccgtgatcatcaagaagacgtgtttataaaatttaccaacagcgaagaaaaatcagttattaaaaatagaattagtaaatttgcgacagagtcgagggtaaattgggaaacgcagggttggatagtggtgagggaaattgagtccaacggaaaaccaacgacaacgggaacagaaacagaaatagaggaaggagcatgtacgtgtgagtgtgatggtgttggttcgagcaaagaaggggtaaattgggagtttcacaatgtggcggggactggtatggaatattcggattctgtaggggtaaatcggggaataggaaagttgggtgggagtaacaccgctggagggggtggtggttggagctgtcggtatgggtgtgggtgggaaaagttgggtaggaatagaggaatattcagcatttacagcttgtattgtaaaaatttcatgttgtgtaatttaatattcttaatgtatatcaatatatattatgcttttggattattgatgttgtttaccttttactacacgtgactgaaaagtgggctatgtgaaaaaattaattggaaaagaaaggtgtttgcaattgagagc

SEQ ID NO: 734 - DNA, 2174 bp, Glycine max var. Williams 82
tcaaaattatttttaaaataaaataaatctactcaagtaattaagaagaggtagtttttattcttaaaaatcctttgacttgattgggtccttgttgaattgttgggggcattctactcagagctgtgaagtgcgaagatggctacatggtgtatgcgagccccactgtttcctttgctaaaaaaagctccctttattacagggaagagaaggagaaggacatggttccattgttgctcttctccgcaggcatggcaaccttctcgtaagaaaaaagtcgctatgcttgtcgcctatgttggcaccaattaccgaggtctccaaatgcagcacgatgaacattcactctcaactattgaaaaagaactagaaactgccatattcaaggctggtgggattcgtgaaagtaattttggggatctgcagaagattggatgggctagaagcagccggactgacaaaggagttcactctcttgctacaattatatcctttaaaatggaaatcccggaaaatgcgtggaacggagacccttatggctttggccttgcaaattatgttaactcctatcttccctttgatattaaagttattagcattttgccctcacaaaggagctttgatcccaggaaggaatgtattttgcggaagtattcctacctcctccctgctgaaattattggtattcaaagccatttcagcgatgaagttgattaccacatatcagagttcaatgatattcttaatgtatttgaggggatacatcctttccataattatacggctaggtccaagtacaggaaacaatttcctaataggcagtcatcatcaaagagtggcacatcagcaagggagagtttgtcatatgagtctgaatgtgagtacagtgacggggaagaaaactctgaaactgatgaggcatatacagaaaatatagtgtgccaaagccagaagttttcagaaactcatcattttgctgaacctgttgttggctctagcaataagaatggaaatggtttgcatgaccaagactctagattggttgctcgtgcaagatggttatatgaacctgatgaagcagacagattaagtgcttcccatttcagaaaagtttttcagtgttcctgtggaaaactggaaacatcactgggatataattacatagagatctccatccagggagagtccttcatgttacatcagataagaaaaatggttgggacagctgtggcagtaaaacgcaaggcactgccaaaagatattataaagctgtcactgacaaggttctcgcggattattctaccccttgcaccttcagaagctctgatattaaggggaaacagattctcaataagaacacgaccaggaaacataacaaggcctgagatgcagacaatagttaaatcagaagaaattaagaaggcagttgatgatttttacacatcagttatgctacctcaagtttcaaaattattggacccatcaagatctccttgggatgaatggattgagaagctggatgctcacacaagcataccaaatgatcagttggatgaggtcaggaaggcttggaatttgtttaaagaaaaatttgaaactacaactagcactcatccatgataaagtgaaggaaaaaagggtaaacagaatttggaatttattcagcctacctagtctacaatggacaatcatgcttgctcaatacttggtagttatggaagaatttggcttgaaagatgtgttttaattattaattaattggcttgaatggccagcaaacatgattcctcaagaattcaacaaattcaacatccaagcaggatagtacaacttcagaggctgacaaaatttcactagtcaacaatacctcagcttcagcttccacaaacagctacaatattgaataatatttccaaattgggttagaatgttagagatgggggtaggcttctgagttgctacatgcaatcatttaccctctgaaactgaaacggatgtatactttccatatcacactgtcattcttacattatgcttaaaatataccatagatatgtcatattgtcattcttaaaatattttattcttaaaatgtatgcatcttgttagtacaagttacaaattaattcttttaagtcatctttaactgtataatcttatacatacacaacttc

SEQ ID NO: 735 - DNA, 2442 bp, Glycine max var. Williams 82
atgcagaagcatgactcccctgttggctatgtgtcagacctgaaaatcctgtttatagtgaaggtttcttctcttatcagccttgcttatagtaggagttggtcttctgcttcttcaagtggtgttatggagatatctttgttaaaggtgctatctgatgcgatatcctcattttcgcatttatcattttctgaaagaatgaagtcagaacctgtatcaaagtattaccaaaaggcagagaagatgcttaagttgttgaagccgattattgatactactgttttttctgatttagcttctaacaaattgcttagtaagctatttgaggaacttagtctagctgttgatgagttgagggagcttagtctgaactggcatccattatctagtaaattttactttgttattcaagttgatcccttaatatcaacaattcaggatttgggactcagcattttacaacagctgaaggcttcacctcaaagtctccttgataatttacgagatgaagcatcatcaaccattaaaaaagctattatggaacaactggaaggtgtagggcccagtacagaggtcctggaaaacatcgccgagaatctgggtctaaggtctaatcaagaggccctgatagaggctgtagcccttgataagttgaaggagaatgctgaacaacttgaaaatgctgtagaagttgaatttattgatcaaatgatctcagttgtaaatcgtatgcatgagcatcttgttatgcttaagcaagctcagagctctatcccggtgttagtacctgctgatttttgctgtcctctctctttagaattgatgatggatccagtcattgtggcatcagggcaaacatatgagcgggctttcatcaagaactggattgatcttggacttactgtttgtcccaagacacgtcagactctggttcacaccaatctaatacctaactacactgtcaaggcactaattgctaactggtgtgaatcaaatgatgtgaagctcgttgatcccatgaagtccaaaagcttaaatcagtcatctccttttcatgggtctatggagtctggtttgatcaaggatttgcctgaaatccaccaagaacgaacatcaacattgcattcctcttcaactccaagtggttccttaaatggcatggttaatgagcagcatgtgaatcttgaaagaatatcatccacaggttcggatgacgagtctgccagctcagatgaagggagtgtggattcagttgaccaatcattaatgtcaccatctacaagggaatcctccaatgccttaagctcagaacaatctcaaactgatgttagaactacttctcataacaatactcctctgctatcaaccagttcagtccacagtcaagatgcttctggagaattgaattcagggccagatgctgttgccatgccaactcgtcatagagaacctgagttttcaccccaattggcggtgccaaggtctcgaagccaaactttatggcaaaggtcatctgagtggcttgttcctagggtagtgtctaatcctatcgaaacaagagctgatctttctgctgctgaaacccaggttcggaaattattggagcagttaaagagcgattctgttgattctaagagagaggcaacagcagaactccgccttcttgctaaggaaaatatggataaccgaattgtgatctcaaattgtggagccattagcttaatagttgatttactgcaatcaaccgatactaggatccaggaaaattctgttacaacactccttaacttatcaatcaatgataacaacaaagctgctattgcaaattctggtgcaattgaacctttgattcatgtccttcagacagggagtccagaagccaaggagaattcagctgccactcttttcagcctatcagttactgaggaaaacaagatcaggataggcaggtctggggcaattcgaccactggtcgatttattagggaacggaacgcctagagggaagaaagatgctgccactgctttgtttaacttgtcattatttcatgaaaacaaggatcgaattgtgcaagccggtgctgtgaaaaaccttgtagagttaatggacccggcagccggaatggttgataaggcagtggctgttctagcaaatcttgctacgataccagaagggaaaacagcaattggtcagcaaggtggcattcctgttttggttgaagttatcgagttgggttctgcgagaggaaaggagaatgcagcagcggctcttctacatctatgctcagacaatcacagatacttaaacatggtgctccaagaaggagctgtaccccctttagtagcattgtcacaatcaggcaccccaagggccaaagaaaaggccttggctctccttaatcaatttagaagccaaagacatgggagcgctgggagagcttga

SEQ ID NO: 736 - DNA, 1527 bp, Glycine max var. Williams 82
atggagcatcaattgatcacattcttgtcctttcttctatattcactaagtttcatcctttttcttttccagattttgaaagtgggaaagagatccaaagtgaaaacaatgaaccttcccccagggccatggaagttacctatcattggaagcatacaccacatgattggctttctaccccatcaccgtttgagagagctagccctaaaacatggccctctcatgcacctaaaacttggtgaggtaccagccattgtggtttcttctccagaagttgccaaagaagtgatgaaaacctatgattccatctttgctcaaagaccccatcaagttggtgcagacatcatgtgctatggttccactgatattgccactgcaccattaggaggctattggaagcagcttagaagaatatgctcacaagagcttcttagcaacaaacgtgtgaggtcatatcaatcaataagagaagaagaagtgctgaatttgatgagacttgttgatgccaacactagatcttgtgtgaaccttagtgagaaagtgtcttgcatgacaagtgccatcactgctagggcaactttcggtgaaaaatgcaaggaccaagaagatttcatttcccttgtcaagaaacttctgaaacttgtcgaacgtttatttgtttttgacattttcccttctcacaagtggcttcatgtgatcagtggggagatatctaaactggaggagttgcagagagaatatgatatgatcattggaaacatcattagaaaggcagaaaaaaagactggtgaagtagaagtggatagtctcctctctgttcttctaaatattaaaaatcatgatgtccttgaatatcctttgacaatcgacaacatcaaagctgtaatgttgaacatgtttggtgctggaactgatacatcatcagcagttatagaatggaccatgtcagagatgctgaaaaaccctagagtaatgaccaaagctcaagaagaagttagaagagtatttggtagcaaaggatacaccaacgaagcagcacttgaagacctaaagtttctgaaagcagtaatcaaagaaacacttagattgcaccctcctttccctcttcttcttccaagagaatgtagagaaacttgtgaggtcaaagggtacacaatacctgctgggaccaaagtgatagtgaatgcatgggctattgcaagagaccctaagtattggtctgaagcagaaaagttttatccagagagattcatggattctccaattgattataaaggttccaatcatgaactcataccctttggtgctggaaggagaatatgtcctggcatttcttttggtgtatctagtgttgaactttgtcttgcacagctactttactattttaattgggaactgccaaatggaaacaaggaaaacgacttggaaatgactgaagctttgggggcctcttcaagaaggaaaacggatctggtcttagttcccatttcttacaatcatgttcctgtttcatatataagaccttaa

SEQ ID NO: 737 - DNA, 1527 bp, Glycine max var. Williams 82; identical to SEQ ID NO: 736

SEQ ID NO: 738 - DNA, 1827 bp, Glycine max var. Williams 82
atgggagaaaattgttatgtggaaaccgacccaactggtcggtatggcaggtttggagatgttcttggaaaaggggcaatgaagacagtgtacaaagcaatcgatgaggtgcttggaattgaggtagcatggaaccaggtcagactcaacgaggcgcttcgcacgccggacgatttgcagcggctttactcagaggttcatctcctcagtaccctcaagcatcagtccatcataagattctacacttcttggattgatattgataacagggccttcaactttatcacagaattgttcacatctgggtcactgagagaatacaggaagaattataaacgtgtcaacatacaagctataaagaattgggcttgccaaatcttgcaaggtcttgtttatctacattgccatgatccaccagtgatccatagggacctcaaatgtgataacatatttgtcaatggtcatcttggacaagtaaaaattggtgatctgggactggctgcaattcttcgcggttcccaattagcacatagtgttataggcactcctgagttcatggcaccagaattgtatgaggaagaatacaatgaacttgctgatgtatattcatttggcatgtgtgttctggaaatgctcacatctgaatatccatatagtgaatgttctaatccagcacaaatctacaagaaagtgacatcgggaaaactaccaatggcttttttccggattgaagacatggaagcacaaagatttattggaagatgcttggtacctgcagaaaagagaccatcagcaaaagaattgttgcttgacccttttcttgtgtctgatgatccatcatcaacaaagaaatttgcaattcagaaaccatttttgaatgtcaatgagatggagaaactgcaattaagtgatgatcttcctaggactggaatgaaagtgatagggaagctgaaccctgaagatgacactatctttctcaaagtgcaaatttctgataaggatggttctgctagaaatgtattttttccctttgacatattatctgacacacctattgatgttgcaaccgagatggtgaaagagttggagattgcagattgggagccttttgagattgcaaatatgattgacagagagatatctgctctgctacctcacagaaggcaaagtagttgttcagatgccttccacacattcaattatctggatgatgattgtgatgatgatgaacctcatcatcatttccgctcgttctcttctagttcatcgttccaagaatcaatgtcagatttagtcagcaaagctgaggaaatatcaagtggatattattggctccatgatgatttgcatgatgataccagttcacgatgctcttcacaagggacatattccaacttgaattactattctctggatgatcatcatcaagagtacaacgtgccatctttgagaaaagataaacttcccatcacaaagagtcacaacaagggcaaaaaggtttcctcaggcgaagacttgagcaatttcaaccaatataaactcatggtaggatcacaggttcctctcactagtaaaagcaagatgatgatgaacaatcatcatagattaacaaggaacaggtcattgattgatataaggagccaactattgcaccgttcactggttgaagaggtgaacaaaagaaggttattcaagacagttggtgctgtggagaatattggatttcaggcaccttgtgatgtttccacaaaaaggtcacagcatgtatgtgttgctccaaatgagaactctccaaggagtggcaagggaggaaaaattaagagatga

SEQ ID NO: 739 - DNA, 1014 bp, Glycine max var. Williams 82
atgtggagtagatggtggtgtggtggtggtggtggtgctgcatcattgaggcaaagggtgtcttttgttttcaatggaagccatggttgtgtgggaaaggttcatccttttgatcctttgaggggttttggaggggaacattgtggaggggtggcgtttgtgttgaagcagatgaagaggggtgtgtgttcttcaactttactttcatgccctgctggtggtggtggtggcaacaagtccaattcaagtgggagtgggagtgataataataataataatagtggaactgaagggtctatatcattcagtgaggctaagaagcttatgagattggtgaatgtggaatcgctcaagatgaagcttggtatggatgggaaagaggttattccatatgttgagcttcttcaagagtgtaagagcatgggtgttgcaaggagttctgaggaggcttcggcattcgccaaggttcttgatgaggctggggttattctcctcttccgagacaaggtctatctgcatcctgacaaggtggtggatctggtcagaagtgcagttccactagcactaacagctgaggatgatcctatgagggaggagttaaagaagcttgtggagaagaaggaagaaatcgactcgttggcgcacaagcaggtgcgtcacatcctgtggtctggactaggattcggtgtgatcactgttggactattcttcaggctaacattctgggaattctcatgggatgtaatggaacctatcacatattttaccacttccactggcctagtggtaggctatgcctacttcttgttcacttcaagagaccccacttaccaagacttcatgaagaggctctttttctccaggcagaggaagctgcacatgaggtacaattttgatgttgacagattcaaggagcttcaatgtaagtgcaaaacacccttaaatgccaaaaccattttgaagaatcgcaaagggttggaactggatttggaggatgctttgaacaaagattaa

SEQ ID NO: 740 - DNA, 1071 bp, Glycine max var. Williams 82
atgtcgttactctccgatcttatcaaccttaacctctccgacatcaccgataaggtgatcgccgagtacatatgggttggtggatctggcatggatatgaggagcaaagcaaggactctctcgggactggttaatgacccttccaagcttcccaagtggaactatgatggttccagcactggtcaagctcctggacaagatagtgaagtgatcttatatccacaagcaatttttcgggatccattcaggaggggtaacaatatcctggttatgtgtgatgcttacactcctgctggggaacccattcctaccaacaagagaaataaagctgcaaagatattcagtaatccggatgttgctgctgaagaaccctggtatggtcttgagcaggaatatacattattgcagaaagatgtccaatggcctcttggatggcctcttggtgggtttcctgggccccagggaccatactattgtggaactggtgctaacaaggcttttgggcgtgatattgttgactcacattacaaagcatgtatttatgcgggaattaacataagtggaatcaatggagaagtgatgcccggtcagtgggaattccaagttggtccatcggttggcatctctgctgctgacgagttgtgggttgctcgttacattttggagaggatcaccgagattgctggagtggtgctttcctttgaccctaaaccaattcagggtgattggaatggtgctggtgctcacacaaattacagtaccaagttgatgagaaacgatggtggctatgaaatcatcaaaaaagcaattgctaagttggaaaagaggcacaaagagcacattgctgcttacggagaaggcaatgaacgtcgtttgaccggacgacacgagacggctgacatgaacacctttttatggggtgttgcaaaccgtggtgcttctattagggtagggagagacactgaaaaggcagggaagggatactttgaagataggaggcctgcctctaacatggacccttatgtggtcacttccatgattgctgagacaactattctttggaaaccataa

SEQ ID NO: 741 - DNA, 294 bp, Glycine max var. Williams 82
atggcagcacgttcctacagccccatcatggttgccctctctttgcttcttttggtcacattctctaatgtagctgaggcttatacacgcagtggaacacttcgtccttcagattgtaaaccaaagtgtacttaccgttgctctgcaacttcacacaagaagccatgcatgtttttctgccagaagtgttgtgctaaatgcctatgcgttcctcctggtacatatggcaacaagcaaatttgcccttgctacaacagctggaagaccaaggaaggaggacccaaatgcccttaa

SEQ ID NO: 742 - DNA, 772 bp, Glycine max var. Williams 82
aaataacaaacacttattatatattcatctttctcttttttagcttttcttttcctctaaaagtgagtccttccttcttcgatcacttgttaaattcacatatcatagcaatggcagcacgttcctacagccccatcatggttgccctctctttgcttcttttggtcacattctctaatgtagctgaggcttatacacgcagtggaacacttcgtccttcagattgtaaaccaaagtgtacttaccgttgctctgcaacttcacacaagaagccatgcatgtttttctgccagaagtgttgtgctaaatgcctatgcgttcctcctggtacatatggcaacaagcaaatttgcccttgctacaacagctggaagaccaaggaaggaggacccaaatgcccttaaaccccttaattgcctaatatataaataatttaataagcaatgtaatcctatatgactcttcatgagcaattttctatctctacatagataagcaatgctgttttaattgtttagttgatagcacctggggacacatttagttatgttcccttcagttttcagagggaaaactatatttttagcaaattgtattttgtgttgctatatattatatatatagtctatattttttaattgactttggcatccgggcatttgagactgagaagagcatgcttccctttgacaaacatcttgaaaagtgtgtctaatgtgtgtttggattgtaagtgggaaagtttcaaccgcaggttgaaaaaagtttgaaa

SEQ ID NO: 743 - DNA, 462 bp, Glycine max var. Williams 82
atgtctatcatcccaaacttgttcggtggtcgacgaagcaacgtcttcgacccagtttctctggacgtgtgggacccattggaagggtttccgttttccacagccaacgctggcgaaagtagtgccatagccaacactcgcgtggactggaaggagacaccgcaggctcacgtgttcagcgttgaccttcccgggttgaagaaggaggatgtcaaggtcgaagttgaagacggaagggtgctgcagattagtggtgagaaaaccaaagaacaagaacagaaagatgataggtggcaccgcattgaaagaagcactgggaagttcatgaggaggttcaggcttcccgagaatgctaaaatggatcaggtcaaagctgctatggagaatggggtgctgactgttactgtgcccaaggaagaacagaagaagcctcaagtcaagtctattcaaatctctggttaa

SEQ ID NO: 744 - DNA, 1437 bp, Glycine max var. Williams 82
atgccttctcctgtacccaccttgctctccaaatgcaccgtcttcccagaccaaaagtccactctcggaaacctcaaactctccgtttcggaccttcccatgttgtcctgccactacatccaaaagggatgcctcttcacccaccccaatctcccactccactctttgatccctctccttaaatcctcactctctcgcactctttctctctttccacctctcgccggccgtttaatcaccgattccgacagttacgtctatatcgcttgcaacgacgccggcgtcgatttcattcacgccaatgccactgcccttcgcatctgtgacttactctcccaactcgatgttcctgaatcttttaaggaattcttcgccttcgataggaaagtcagctacaccggtcacttctctccgattctcgccgttcaggtcaccgaactcgccgacggcgttttcatcggctgcgccgtcaatcacgccgtcaccgacggcacctccttctggaatttcttcaacaccttcgctcagctctctagaggagccagcaactgcatccgcaatataccggatttccaccgcgagtcggttctcatctccgacgccgttctccgtttgccggagggcggtcctcaggtcacgttcgacgccaacgcgcctctgcgcgagagaatattcagcttcagccgcgaagcgattcagaaactcaaagccatagcgaacaaccgccggtggccggaaaacaacaacttcgccggcgagttgttacggaagaaaagcaacgataatctactaaaggagaacaaggcgacgacaattcttgagaactggttcaaggtgaattcaaattcgatttcgaaaccgcaaacggtggaaatttcgtcgtttcaatcagtgtgcgcgcttctgtggcgcggggtgacgcgagcgaggaaatttccttcgtccaaaacgacgacgtttagaatggcggttaactgtcgccaccggttagaacccaaactggaagcgtattacttcgggaacgcgattcagagcgtgcctacttatgcttccgcgggtgaggtgttatccagggatctacggtggtgcgcggagcagctgaacaaaaacgtgaaggcgcacgacgacactatggtgcggcgcttcgtagaggattgggagcgcaacccgaggtgcttcccacttgggaaccctgacggtgcatccatcacaatgggtagttctccgaggtttccaatgtacgataacaatttcgggtggggaagaccactcgcggtgcgaagcggaagagcgaacaaatttgacggtaagatctcagcgtttcccggaagagatggaacagggaccgttgatttggaggttgttctagcgcccgaaaccatggaggcgctagagtctgatcccgaattcatgaaatatgcaacgtgtcaattatga

SEQ ID NO: 745 - DNA, 1440 bp, Glycine max var. Williams 82
atggcatctttcatcttcacacctgtactctttcttcttatcatctccgccgtccttctcttcctccaccgccgatcccgctgccggcgcttccgcctaccgcctggtacactcgggctccccttcgtcggcgaaaccttacagctcatatcagcttacaagagtgacaacccggaacccttcatggaccagcgcgtgaaacggtacggtccaatcttcaccacccatgtgttcggcgaacccaccgtgttctcgaccgacccagaaacgaaccggttcattttgctcaacgaagggaagctcttcgaatgcagctaccccggttcgatatcgaacctccttgggaaacactctctgctcctcatgaaaggttctcttcacaagagaatgcactccctcactatgagcttcgccaactcctccatcatcaaggaccatttattggtcgacatagaccgcctcatccggctcaacttggattcctggtccgaccgggttcttctcatggaagaagccaagaagataacgtttgagttgacagtgaagcagctgatgagctttgatccaggtgaatggactgagacactaaggaaagagtacgtgcttgtgattgaaggatttttctcagttcccttgcctctcttctcaagtacctaccgtagagccatcaaggctaggacgaaggtggcagaggcattaacactggtagtgagggatagaagaaaagaaagcgtaacggaggagaaaaagaatgacatgctaggggcattgttggcctccggctaccacttttccgacgaggaaatagtcgattttatgttggctttgctcgtcgccggctatgaaaccacctctacaataatgactcttgccatcaagttcctcaccgagactcccttagcactggcacaactcaaggaagagcatgatcaaatcagagccaagaagagttgcccagaggcaccactggagtggacagattataagtcaatggcatttactcaatgtgttgtgaatgagactttaagggtggcaaacataattggtgcgatatttaggagagcaatgacagacatcaacataaaaggttacactattccaaagggatggagggtcgttgcttcatttcgtgcggtacatctaaaccctgaccatttcaaagatgcccgcaccttcaatccatggagatggcagagtaactcagaagcaagtagccctgggaatgtatataccccatttggaggagggccacgtctgtgtcctgggtatgagcttgccagagtggtgctctctgtcttccttcatcgcattgtcacccgttatagttggtttcctgcagaagaagataagttggtgttttttccaacgactaggacgcagaagaggtatcctatcatagtgaagcgtagagaggagtccaaactaagtaaatcgccatga

SEQ ID NO: 746 - DNA, 216 bp, Glycine max var. Williams 82
atggcactagtggtgagaaaaatgccattgcaattcatgtggggtcagtggagattcattttcaacggtttgatgatgttttatgtcatcatgggtataagatatggttttgaggacgaggatctcgttgtttctggtagagaattcaccagtggaggaagattaggcgtacatgggaaagccaggcatttcttcttcaccctctcatcaacttaa

SEQ ID NO: 747 - DNA, 450 bp, Glycine max var. Williams 82
atggagattatgcatgtcctaataaataaatttttaaatgcaggcatgggtatttggagtgtaagaaattctaaaattctatcattaggaaaagaagtatccgtgcctggtctccaattacaacatttgatgattcaacggcacccaaaaatgaagcttgcatccgtgtccaacataacccatgccaggttgttgcaccgctgctgccgccggactgccaacagaagtacttgccggaagatcatcagacgacaccccaagatttgtgtcacatacttgttggccgtggcaatcccaaacatatggtatttttttcagttcttgggatccataaccattgtttgtttcttattcatcttccctgctgcaatcgttctaaggtattgctacctatttctcttctctctatatatttgtttttttaaaaaaagaatacttacaatacattga

SEQ ID NO: 748 - DNA, 870 bp, Glycine max var. Williams 82
atgggcgatcatttggccagggccgaggattttgagaacaaggcagagaagaaactcagcagttggggcttgtttggctccaaattcgaggacgctgctgatctcttcgacaaatccgccaattcctataagctcgctaaatcatgggacaaagcaggatccacctacatcaaattagcgagttgtcatttgaagttggaaagcaagcatgaagctgcacaagcttatgttgacgctgcgcgttgctataaaaaaactaatataaatgagtctgtatcttgcttagacaatgctgtaaatattttctgtgagattggaagactctctatggctgctagatatttgaaggaaattgctgagttgtacgagtctgaacagaatatctcgcaggccgttgcttactatgaaaaatcagcggatttttttgaaaatgaagaagtgaacacttcagcaaaccagtgcaagcaaaaagttgctcaattctctgcccagcttgaacaatatcagagatcaattgagatttatgaagatattgctcgccagtctctcagcaatactttgctgaagtatggagttaaagggcatcttcttaatgctggcatttgcgaactttgtaaaggggatgttattgctattaccaatgcattggagcgatatcaggacttggatccaacattttctggaacacgtgaatatagacttctggcagatattgctgctgcaattgatgaggaagatgttggaaagtttactgaagttatcaaggaatttgatagtttgactcctttggattcttggaagacaacacttcttttgagggtgaaagataaactcaaagccaaagaaatcgaggaggatgatcttacttga

SEQ ID NO: 749 - DNA, 753 bp, Glycine max var. Williams 82
atgcttctccgaaccgccgcctccgccgcttctgcttcgtccctctccctcttcagccctacctccgaacctctccgttcggttcccgctcgtggattggtggttcgcgccgcgaaaggatccacgaaccaccgcgccctaaccggcgtgatctttgaaccgttcgaagaggtgaagaaggagctcgatctcgttcccaccgttccacaagcttctctcgcccgccaaaaatacgttgacgaatccgaagccgccgttaacgaacaaatcaatgtggagtataacgtttcctacgtttaccatgctatgtttgcgtactttgatagggacaacgttgcgctgagaggtcttgctaagttttttaaggaatcgagtgaagaagaaagagagcatgctgagaaattgatggagtatcagaacaaacgtggtggaagagtgaagttgcagtcaattgtgatgccgctttctgagtttgatcatgcagataagggagatgcgctgcacgcaatggaactcgctctctcattagagaagctaacgaacgaaaagctccttaacttgcacagtgttgccacaaaaaatggtgacgtgcagttggctgactttgtggaaactgagtatctgggtgaacaggtggaagcaatcaaaagaatatccgagtatgttgctcagctcagaagagttggcaaaggacatggtaagaatttcaaattctgctacgcatctttttttctccccaggtttttactctga

SEQ ID NO: 750 - DNA, 330 bp, Glycine max var. Williams 82
atgggttcgaagatggctatagtgatcgtagccttgttcgccatgctccttttcatctcccctgaggtggcatgcaggaatttcaaagaggagctaggtgaggttgtcaaagagactaatgaggagagtgatgccagattagccggtagtagtggtggtgaccttgataagtcttattgtcctgtccacttgcccttgatggagtatagaaagtggataggaaattgccgttgtggctgttgtcagtggaccacagagccggaagtttgcctatattgctgtccagaaagtcacgttcctgatctcccgagccgaccgcgagcttattaa

SEQ ID NO: 751 - DNA, 1941 bp, Glycine max var. Williams 82
atggccacaatccagtgcgccacaaccaccctaatactgttactcctcctcctcctcatcataccaagatccaattcccaacaagagtacgtaaacaacaagcaactagactgcaacaacgaatacaactccacaaagggtaacctctgcaacagtctcccgtcatgcacctcctacctcaccttcaagtcctccccgccggaatacaccacccccgccgccatctccttcctcctcaactccactccggccctcatcgccgccgccaacaacatcaccgacgtccagaccctcccggccgacaccctcgtcaccgtccccgtcaactgctcctgctccggcccctactaccagcacaacgcctcctacaccatcaaagtccaaggcgaaacctacttctccatcgccaacaacacctaccaggccctcaccacgtgtcaggccctcgagcttcaaaacaccgtcggcatgcgcgacctcctcaagggtcagaacctccacgtgcctctcaggtgcgcgtgtcccacgcagaagcagcgcgaggcagggttcaagtacttgctcacttacttggtttctcaaggagaatcggtttccgccattggagatatcttcggtgtcgacgaacagagcattctcgacgccaacgagctttctacttcttccgttattttctacttcacgccgatttcggttcctttgaaaacagagccaccggttacaataccgagagcagcgattcccccggaggattccccgtcgccgccgctgccgcctgctccggcgggggacggagattccgactcttccaagaaatgggtcattgtcggaatcgtggttggggttgttgtgttgcttattttaggtgctgctctgttttacctctcgaaagctttttcgggctctaccaccacgaaggcgactattccgacgacgcagtcgtggtctctttcctcggaaggggttcgttacgcgattgaatcgttgagtgtgtacaagttcgaggagttgcagaaggctacggggttcttcggcgaagagaacaagatcaagggttctgtttatagggcttctttcaagggtgattatgccgcggtgaagattctcaaaggtgatgtgtcgggtgagattaaccttctcaggaggattaaccacttcaacattataaggttgtcgggtttctgtgtctacaaaggtgacacctatcttgtgtacgagttcgcggagaatgattctcttgaggattggcttcacagtggtagcaagaagtacgagaattctacatctctgagttgggtgcagagggttcatattgctcatgatgttgctgacgcacttaactaccttcataactatactagtcctcctcacgtacacaagaatttgaagagtgggaacgtgcttttggatggcaattttagggctaaagtttcgaatttgggattggcaagagctgtggaggatcacggggatgatggggggtttcaattgacaaggcatgtggtggggactcatgggtacatggcacctgagtacattgagaatggtttgattactccaaagatggatgtttttgcgtttggggttgtgcttttggagcttctttcggggagagaagctgttgttggtggagaccagaatggatctggggagaagatgctgtcggcaactgtgaatcacgtgcttgaaggagagaatgttagagagaaacttagaggtttcatggatccaaatttgagagatgaatatcccttggaactggcttattccatggccgaacttgccaaactctgtgttgctcgtgacctcaatgcaaggccacagatttctgaagctttcatgattttgtctaagattcaatcctccacgttggattgggatccgtctgacgagcttgaacggtctagatctgttggccaaatctctgatagcagcagatag

SEQ ID NO: 752 - DNA, 1836 bp, Glycine max var. Williams 82
atggaactcaaaaaagggttacttgtgttctttttgctgctggagtgtgtttgttacaatgtggaatccaagtgtgtgaagggatgtgatgtagctttcgcttcctactatgtcagtccggatttaagcttagaaaatatagcgcggttgatggaatcaagcattgaagttataatcagcttcaatgaagacaatatatcgaatggttatccgctatccttttacagactcaatattccattcccctgtgactgtattggtggtgagtttctggggcatgtgtttgagtactcagcttctgcaggtgacacctatgattcgattgcgaaagtgacatacgccaatctcaccaccgttgagcttttgcggaggttcaatggctatgatcaaaatggtatacctgcaaatgccagggttaatgtcacggtcaattgttcttgtgggaacagccaggtttcaaaagattatgggatgtttattacctatccactcaggcctgggaataatttgcatgatattgccaatgaggctcgtcttgatgcacagttgctgcagcgttacaatcctggtgtcaatttcagcaaagagagtgggactgttttcattccaggaagagatcaacatggagactatgttcccttgtacccgagaaaaacaggtcttgctaggggtgctgcagttggaatatctatagcaggaatatgcagttttctattattagtaatttgcttatatggcaagtacttccagaagaaggaaggagagaaaactaaattgccaacagaaaattctatggcgttttcaactcaagatgtctctggaagtgcagaatatgaaacttcaggatccagtgggactgctagtgctactggcctcacaggcattatggtggcaaaatcaatggagttctcatatcaagaactagccaaggctacaaataactttagcttggagaataaaattggtcaaggtggatttggagctgtctattatgcagaactgagaggcgagaaaactgcaattaagaagatggatgtgcaagcatcgacagaatttctttgcgagttgaaggtcttaactcacgttcatcactttaatctggtgcgcttgattggatattgtgttgagggatcccttttccttgtatatgaatatattgacaatggaaacttaggccaatatttgcatggtacagggaaagatcctttgccatggtctggtcgagtgcaaattgcgctagattcagcaagaggccttgaatatattcacgagcacactgtgcctgtgtatatccatcgtgatgtaaaatcagcaaatatattaatagacaagaacatccgtggaaaggttgcagattttggcttgaccaaacttattgaagttggaggctccacacttcacactcgtcttgtgggaacatttggatacatgccaccagaatatgctcaatatggtgacatttctccaaaagtagatgtatatgcttttggagtggttctttatgaacttatttctgcaaagaatgctgttctaaagacaggtgaatctgttgctgaatcaaagggccttgtagctttgtttgaagaagcacttaatcagagtaatccttcagaaagtattcgcaaactggtggatcctaggcttggcgaaaactatccaattgattcagttctcaagattgctcaacttgggagagcttgtacaagagataacccactactacgcccgagtatgaggtctatagttgttgctctcatgacactttcatcacctactgaggattgcgacacttcctacgaaaatcagactctcataaatctactgtctgtgagatga

SEQ ID NO: 753 - DNA, 840 bp, Glycine max var. Williams 82
atgaggaagaagctagatactcgtttccctgcggctaggattaagaaaattatgcaagctgacgaggatgtagggaagattgcaatggccgtgcctcttctagtttctaaagcactagagctatttctgcaagatttgtgtgatcgaacatatgatataactttgaggagaggggcaaagactatgaatgcttttcatttaaaacagtgtgtgcagacttttaatgtctttgattttctgaaagatattgtcagcaaggttcctgatttaggtggttctgttgcaactggtgatgaccatgctgtcactaagaggaggaaagttgctggagatgatgataatgacagcgatgaggagctcaagagaaataagaagccagagcctggacatagcagtggcagaggaaggggtagaggcagaggtaggggtcttggcggtggaattagaactgtagatcaagagatgagttcacatgccaagtgtgaagatgattctgatgtcttgaagcagaatgacaaccacactcagagtaatgaaagcatggaaaatgtgctggaacctgaagaagttaagcagagttttccagtaagcgaactggccgaagtgtctgttcgaaattttgacttaaatttggacccagatgagaatatggattctttagacacaccaacttctgtcccaactagttcatctgcaaaatcagtgtcagaagagaagcatgaggaataccctggatggtccttgtctgagatggaaaaaatgatcattgatcccattcaactagctaacttaaatggaaggattgatgaagatgaagaggattatgatgaagaaatgtag

SEQ ID NO: 754 - DNA, 1323 bp, Glycine max var. Williams 82
atggccgccagattggaacaacagcaacaacaacaacaacccatcaatgttggtgaggttaagcagaagaacatgggtggtgaaggcagaaacaacagaagggtgcttcaggatattgggaatctcgtgggtaaacaaggccatggaaatggaattaacttgtctaagcctgtcacaaggaactttcgtgctcaattattggccaatgcacaagagaagaacaagaaatcaagcactgaagcgaacaatggagcagtggtagcaactgatggggatggtgttgggaattttgttcctgctagaaaggtagaagcagctaagaagacaaaagaagaacctgaagtgattgtcattagctctgatgatgaatcagaagaaaagccagctgcgaagggaaaaaaggaaagggaaaaatctgctaggaagaatgccaaagccttcagttcagtcctctctgctagaagcaaggctgcttgtggacttccaagggatttgttggtgagcattgatgcaactgacatggacaatgaattggcggcagccgagtacatcgatgatatctacaaattttacaaagagactgaagaagagggttgtgtgcatgactacatgggttcgcagccagatattaatgccaagatgagatcaatccttgtggactggttgatagaagtgcataggaagtttgagctcatgccagaaactctatatttgaccttgaacattgtcgatcgattcctatctgtgaaggctgtgcctaggagggagcttcagctggttggcatcagctcaatgctgatagcctcgaaatatgaagagatatgggcaccggaggttaatgactttgagtgcatatcagacaatgcttatgttagtcaacaagtgttgatgatggagaaaacaatccttaggaagcttgaatggtacttaacagttccaacaccctatcacttcttggttaggtatatcaaagcttccactccatcggacaaagagatggagaacatggtgttttttcttgctgaacttggattgatgcattatcctactgcaatcctgtatcgcccttctctgatcgctgctgctgccgtgtttgcggctcgatgtacccttggaaggagccctttctggacaagcactttgaagcactacacaggctactctgaggagcaactgagggattgcgccaaaatcatggtcaaccttcatgctgccgctccaggaagtaagcttagggcagtttacaagaaattctgtaactcggatctttctgctgttgctcttctttctccagcaaaggagaactgtcttgaacaagcttag

SEQ ID NO: 755 - DNA, 417 bp, Glycine max var. Williams 82
atgaagaaagtgtttgtcacatttttagctgtgctagttgtatttgttcttacagcgaaagcttcagaggcacgactaccagttaaaacaaattcagcatcaaatgactacaattgttcacaagtctataacctgttagtttcgtgcgtagattacatgattggtggagatgatggtgccccttcaggtgtttgttgccaaagtgttaatgcagtgaaagcatcagcaccaacacaaattcaacgaatggctgcatgtaagtgctttttcgacgtagcaactcgccttccttccttgctcgaaaacaaggccaattcacttcctaaattatgtggtgttgatttgggttttatcatgagcaagcagaacaccaattgtaacaatgttcctgtaagctcaaggcaagggagagattag

SEQ ID NO: 756 - DNA, 615 bp, Glycine max var. Williams 82
cattcatccccatcaaaacacaagcaaatcctaaaaagttgattgagatatatagaaactagcttcaatttcacaaaatgaagaaagtgtttgtcacatttttagctgtgctagttgtatttgttcttacagcgaaagcttcagaggcacgactaccagttaaaacaaattcagcatcaaatgactacaattgttcacaagtctataacctgttagtttcgtgcgtagattacatgattggtggagatgatggtgccccttcaggtgtttgttgccaaagtgttaatgcagtgaaagcatcagcaccaacacaaattcaacgaatggctgcatgtaagtgctttttcgacgtagcaactcgccttccttccttgctcgaaaacaaggccaattcacttcctaaattatgtggtgttgatttgggttttatcatgagcaagcagaacaccaattgtaacaatgttcctgtaagctcaaggcaagggagagattagtacaataaaattgatgcatgtttggaagtttctttcttcttgaaaaaagaaaataaaatggtttgttgaatatacaagcgtttcatgttggaaataataatgagtggatattttctaaatg

SEQ ID NO: 757 - DNA, 1200 bp, Glycine max var. Williams 82
atgtctggtgttcttctttgggtgagttctggacccaaagagaacatcaactccttggtgagtttttcatgcaggagtggtggtggtggtgaaagaacacaaaagaggttttctggaatcagttttgcaagtggtgcctctgctttttcaagtgcagtggcagctgagactttaagatcctcagaggagagggtctatgaagtggtgctgaagcaagcagctctggtaaaagaaaacaaaaggggtacaaagatagctctagatttggacaaagacgttgaaggtgatttcaccaatgtggatctgttgaatgcagcttatgatcggtgtggtgaagtctgtgctgagtatgccaagacattttacttaggcacacaattgatgactgcagagcgccgaaaagctatttgggcaatttatgtgtggtgcagaagaactgatgagctagtggatggcccaaatgcttcgcacatcacccccggggccttggacaggtgggagcaacgactgagtgatgtttttgaaggtcgaccctatgatatgtatgatgctgccctctcacatactgtctcaaagtacccagttgatattcagccattcaaggacatgatcgaagggatgaggatggacctgagaaagtcaagatacgataactttgatgagctctacctttattgctactatgttgctgggacagtaggccttatgagtgtcccagtaatggggatagcaccagaagcaaatgcttcaacagagagcatttataatgctgcattggctctaggcattgcaaatcaacttactaacatactcagagatgttggagaggatgctagaagaggaagagtatatctcccacaagatgaattggcactagctggcctttcagatgaagacattttcagcggaagagttacagacaaatggcggaaattcatgaagggacaaataaagagggcgaggatgttttttgatgaagcagagaggggagttgcagacctcaactcagctagcaggtggcctgtgtgggcatcattgttgttgtataggcaaatattagattccattgaagccaatgattataataacttcacaaaaagggcatatgtaggaaaagtaaagaagctattatcactacctactgcctatggtttttcacttctaggccctcagaagtttgccaaaatggttaggagataa

SEQ ID NO: 758 - DNA, 1416 bp, Glycine max var. Williams 82
atgagttttaaggttggagaaggagaattcattgtgagtgtgagcaaggaggaggtggtggtaccagagattccaatgcatgagcactggctgccactatctaaccttgatctactcattcccccaatggatgttagtgtattcttctgctacaaaaaacctttgcctgaaaaatattattgcttcggaaccatggtggggtcactgaaaaatgccctagcacaggcactggtttactattacccttttgcaggtgaaatggtggccaacaccatgggtgagcctgagctcttttgcagtaatcgtggggcggattttgttgaagctgtggcagaggttgaactccagtgcctcaacttgtacaaccctgatgacactgttcaagggaagtttgtaccaaggaagaagcatggtttgcttgctgttcaggcaactgagcttaagtgtgggagtttagtagtggcatgcactttcgaccatcgcatagcagatgcctactctgcaaacatgttcctggtgtcatgggccgagatagcccagtccaacaagcccataatctcaatccagccctcttttgctcggtcccttttcatcccacgaaatccaccttccttccattcttcacttcacgacttgtacgtctccatctcggcgttacctcgaccgtcagatccaaaacccgggttccaatctgagccactcattaaccgcatatactacgtcacaggtgaaaacctcaaccttatgcaggaactggcaagctcaaacggtgtgaagcgcacaaagctcgagtctttctctgctttcttgtggaagatggttgctgaagctgcagcggctaaggttaagggtaagaaaaacctcgttgcgaagatgggtgttgtggttgatggaaggaagaggttaagtaacggtgacaagaacaaagaagcaatcatgggttcgtattttggtaacgtagtttctattccctatggtgggaaaccggtggaggagcttatggaaaagccattgagttgggtggcggagaaagttcatgagtttttggagattggtctgacagaagagcattttttgggacttgttgattgggttgaggtacatcgaccagctcctggtttgtctaggatttattgtgggcatggcaaggaagaaggaccaagttttgtggtttcttctggtcaaaggtttccggagtcaaaggttgattttgggtgggggaagcccgtgtttgcatcgtaccattttccttggggtggagattctggctatgtcatgccaatgccttcttctactgggaatggtgattggttggtctacatgcaccttctcgaggctcatttgaatttcatggaggttagggctcctcaaattttttggccattctctcgggattatcatttcaatcgtcattga

SEQ ID NO: 759 - DNA, 1686 bp, Glycine max var. Williams 82
atgattttgaaggtttctctcattgtggttctcctagtgatatgctcctgtgttgtggaagccatttctaggaatcacaatcaaaatcccaaccacaacaatatcaacaaaaatggatcttctctggctgcaataaagtttcctgattatccaagtttcaatgatgtctcttcttcaggggacgattgcagcttctcaaattctgagcaactcggacattctggacctaccatgacatcgggtgaagaaactgatgaagagagtgaagcttttccagcacaaaaaccacaccagaatttggtgaaattccacttgaaacacaggtcagggagcaaagatgctgagccgaaacaatctgtggttgatttcacactaagtgatttgaccagaattcagaaccttcacagaagggtcatagagaagaagaatcaaaacaccatttcaaggctgcagaagtcacagaaggagcaaccaaagcagtcctacaagccggtggttgctgctccggcagcttcacggacaacaagtccagtttccgggcagcttgtggcaaccttggaatccggggtgagtcttggctctggagagtacttcatggatgtgtttgtggggacacccccaaagcatttttctctgatacttgatactggtagtgaccttaattggattcaatgtgttccatgcattgcatgttttgagcaaagtgggccatattatgaccccaaagattctagctcttttaggaatataagctgtcatgatccccggtgccaattggtttcagcccccgatccacctaagccttgcaaggctgagaatcagagttgtccatacttttattggtatggtgatggttccaacacaactggggattttgcattggaaactttcactgttaatctcaccactcctaatgggacttccgagttgaagcatgtggagaatgtgatgtttggatgtggtcattggaatagaggcctatttcatggtgctgctggtttgttaggattagggaaaggaccattgtcatttgcttctcagatgcaatctctctatggtcaatccttttcctattgtcttgtggataggaatagcaatgcaagtgttagcagcaaattgatttttggtgaggacaaggagctgctcagccaccccaatttgaatttcacttcttttggtggtgggaaagatggttcagttgacacattttactatgtccagataaagtctgttatggttgatgatgaggtgctgaagatacctgaggagacttggcatttgtcttcagaaggtgctggtggtaccataattgattctggcaccacattaacatattttgcagagcctgcttatgagattatcaaggaggcttttgtgaggaaaattaagggctatcagcttgttgaaggccttcctcctctaaagccatgttacaatgtgtctggaattgaaaagatggagctacctgactttggaatcttgtttgctgatgaagcagtgtggaattttccagtggagaattattttatctggattgatcctgaggttgtttgtttggctattttggggaatcctcgatctgccctttcaataattggaaactatcagcagcagaatttccacatactgtatgatatgaagaaatccagacttggctatgcaccaatgaagtgtgctgatgtttaa

SEQ ID NO: 760 - DNA, 234 bp, Glycine max var. Williams 82
atgatggaggacaagaacaagaagaagaagaagaagaggagcaagttgtggttgaagaaggtgtcgtggccgtttcggtggaaacgactggatcttcaaacgaccatcatggacaccgtcgttttcaaggttggaatgaataatttgaagagcataaactatgaattctggagaacaaatttccctaccattacattttttgtctcttcctcgtacttttctttcccattgtaa

SEQ ID NO: 761 - DNA, 1569 bp, Glycine max var. Williams 82
atgaagttctatgtatctgccaaagacgcccgaaaaggatccgtcaagacaactgttcctgccgacaccgtcgccgctcgccggatttccagccggacggtgctggtcctcggaatcgtcttcctgctcagctttgtgagagtggcggttttggtgctggaatcttctgcggtgtgctccacctttgattgcgtgggatcgacatttttcggcggaggtgacgccgatctgaaactcagagatgagctgaccagagcgctaatagaagcaaaggttatcgatggcaatgctaacgaaggaggagcaataatgtcatttaacgagcttgtgaaagtgttggcgtcaaaacaagacctcaaggcatttgctttcaagaccaaagccatgctgttacggatggagcgtgaggtgcaatcagctagaaagcaggagtcactttattggcatatagcttcacacggtgttcctcaaagtctgcattgtctttgtttgaagttggctgaagaatacgctgtaaatgccattgcacgatctcgtctacctcttcctgaacatgtctctcgcctcgttgaccccacttttcaccacattgttctcctaaccgacaacgtccttgcggcttctgttgttgtaacctccactgttgaaaattcagccaaccctgaaagattagtctttcacgttgttactgacaagaagactttcactccaatgcatacttggtttgccatcaactctattaactcagcagttgttgaagttagggggttacaccactatgattggtctaaagaagtgaacgctggtgttaaggatatgcaggaaactaataacttaatttggaagcactactacagcaactataaacaaaaggagcttgaccatagtgaagaccataacagatatttggaagctttgaggcctagcagcctttccttgttgaatcatctccgcatctatatccctgagctctttccagatctaaacaaggtagtattgctggatgatgatgtggtagtacaacatgacctatcttctttgtgggaactagatcttaatggcaaagtcagtggttcagtgttcaagtcatggtgtgagaacagttgctgccctggaaacaaatacgtcaacttcttgaacttttcacatcctatcatatcatccaactttgacggtgataagtgtgcatggctctttggcgtggatatatttgatcttgaagcttggagaaaatcagatattactaagacctatcatcaatggctgaaacttaacgtccagtctgggttgacattatggaatccaggaatgctcccagctgccttgattgcttttgagggtcaagtgcaccccatagatacatcatggctcgtcactgatttaggttatcgccatcgatcagaagaaataggcaacagcatagagagagtggaaactgctgctgttgttcatttcaatggcccagcaaagccgtggcttgaaattggtttacctgaggttcgaagtttatggactagatatgtaaatttctccgataagtttattagcaaatgtaggattatagtgtga

SEQ ID NO: 762 - DNA, 435 bp, Glycine max var. Williams 82
atgggtgtccttggaacaatggtaagacatttggacacaataatagggcctgtagtgatgcttctttatcctcttcaatgtgatgatcaacagtggctaacgtattgggttttatactccttcatgaccctctttgagctttccactcatgagatccttgcttggtttcccatttggggatacctgaagcttatgttttgcatctggttggtaatgccaatgttcaatggagcggcttacataaatgagaattatgtgaggcaatatataaagaatattggaagaagttccaattattctgaggagtacaagaaggtccttcacatgatgaccttcgatgcaaggaaagcagttgaacgctatatcggtagatatggccctgatgcctttgagagagtagtgagagcggctgaaaaagaatcaaagaagagctga

SEQ ID NO: 763 - DNA, 1539 bp, Glycine max var. Williams 82
atgtcaagcaattcagatgcagcagcagcgacggtgcatgctcatggccgtttggccatgctcgccgctcacctcctcccctctcaactcactcatcacggcgccctccaccctctccatctctcctcccagttgccgccgccgcccaacctcgccggcactttgaccgtcgtcgacgaaaggaccggcaagaagtaccagcttcatgtctccaaagaaggcactgtcaaagcttctgaattcaagaagatattgacagggaagaatgacaagggactcaagctttatgatcctggctatttgaacacggctcctgttcgatcaacaattagttatattgatggagatgaggggattcttagatatagaggttaccctattgaggagttggcagataaaagcactttcacggaagtgtcctatctcataatgtatggaagtttgccttctgaaagtcagttagcagaatgggagtttgctatatctcagcattcggctgttccacaaggagttttggatatgatacaatctatgccccatgatgcacatcccatgggtgtgcttgttaatgccatgagtgctctttctgtttttcatcctgatgcaaatcccgctctcagaggtcttgatatttatgactcaaagcaaataagagacaaacagataacacgggttattggaaagataacaacaattgctgctgcagtttatcttagaatggcaggaaggccacccgtgcttccatccaacctcctttcttacacagagaacttcctatacatgctagattcttttggcaatcggtcatataaacccaatcctcagctaactcgtgcgctggacattatcttcatcctgcatgcagaacatgaaatgaattgttctacatctgctgttcgacaccttgcatcaagtggcgttgatgtatacactgctattgccggggctgttggagctctttatggaccacttcatggtggagctaatgaggctgtcctcaaaatgctgagtgaaattggaactgttcagaacattccagagttcattgaaggtgtcaaagccaggaaacgaaagctctctggttttggacaccgagtgtacaaaaactatgatcccagggcaaaggtcttaagaaaactggcagaggaagtgttttccattgttggccgggatcctcttattgaggtggccgtttccttggagaagattgcactatctgatgaatatttcatcaagaggaagctatatccaaatgttgacttctactctggattaatttatagggccatgggatttccaccagagtatttcactgttttatttgctattcctcgaatggctgggtacttggctcattggagagagtccttggatgatcctgatacaaagattttgagacctcaacaggtttacgttggggaatggttacgacattatacacaagtcaatgtaagaactacatcaagtgatgctgacaagcttggtgaggtggccatatcaaacgcctcaaagcggcggcttgccggatccggggtatag

SEQ ID NO: 764 - DNA, 1188 bp, Glycine max var. Williams 82
atgatttgcaccgtgaaacaacccgccatatcgatcagagtttctgatattttcctacgtaagaagggtttaccttcaaccccagttcagtcatgttccattgtttcaccttcttccctcccgagggaaaaaaactctctgagatcattggtgtcagtgcaaaagccactgcacctttctcgagttggttttggagattttgttgggtctctggtaaggcgtgagcgtggtgatttcgtgacatgtgatgcttatgaggctgatagatcagaggttggaggggctccatcaaaggctgctaagaaggtgaagattgggatatactttgcaacatggtgggttctgaatgtggtgttcaatatttataacaagaaggttctgaatgcattcccatacccttggcttacctcaactctctcccttgcatgtggctctctcataatgttgttctgttgggccaccaagatagttgagcctcctaagactgatcttcagttctggaaggatttgttccctgttgctgttttacatacaataggacatgtagcggcaactgttagcatgtcaaaagttgccgtatcattcacccatattattaagagtgctgagcctgctttcagtgtaatggtttccagactactgggcgaggaattcccagcaccagtctacctgtctttgattccaattattggtggatgtggacttgcagctgtgactgagctcaatttcaacatgattggttttatgggggctatgatatcgaatttggcattcgtactccgtaatatctattcaaaaaagggcatgaagggaaaggatattagtggaatgaattactacgcttgtttatctatgttgtcccttgtaattctcacaccatttgcgattgctgtggagggaccacagatgtgggcagctggatggcaaacagcactctctcaaattggaccccaagttatatggtgggtggcagctcaaagcatattttatcatctgtacaatcaagtgtcgtacatgtctctggatgagatctctcccttgacatttagcattggaaacaccatgaaacgtatatctgttatagtttcttcaatcattatattccacacaccagttcagcctattaatgctctaggagctgctattgccatctttggaaccttcttgtattcacaggcaaatcagtag

SEQ ID NO: 765 - DNA, 849 bp, Glycine max var. Williams 82
atggcgaagaagatcattcacgacaccactaggaagatgtcgcagctgtgccagaaaatcgttaaggtcgacgtccggtggggtgtcctcaaaagggtatctttcgttggacactttttccgcttcatttggaacagacttcttgtttgctccgtcgccggaaggccatctcagtaccggaaactacccgtccgggacccctcttcttcgccgccgtcctacgctgacgacgtcttcttttccgctacaaccaccactggcggctatgactccgattccgatttggtgaacctcaagatcagcttgttgggtgattgccatattggaaaaactacttttgtgatcaagtatgtggggaatgagcaagaaaagaggagcttacagatggaaggattgaatctaatggacaaaactttgtctgttcaaggagctcgtatttcatttagaatatgggatgttgcaggtgataaaaggtccctggatcaaattcccatggcttgtaaagattcggttgcgattttgattatgttcgatctcaccagtcgttgtacactaaatagtgttgttggatggtatagtgaagcaagaaagtggaatcagactgcaattccaattctaatagggaccaagtttgatgattttgttagacttcccccagatgtgcaatggacaattgtaacacaggcaagggcatatgcaagggcgatgaaggcaacccttttcttttcaagtgcaacccacaacataaatgtcaacaaaattttcaagtttatcatggccaagctctttaacttaccatggacagtggaacgaaatttgagagttggagaacccataattgacttctaa

SEQ ID NO: 766 - DNA, 336 bp, Glycine max var. Williams 82
atgaagtgcctccagctccaatcttcactgcttcccttgcatgcaaaactcaaacctcagccaaatcatacaagccacaccagccaaatcatacgtgcccagcatttccctttagcaagtgatccattaactaccaaggcacttccacattcaatggttgttgccccagcccaatccggtgacttatccacctttctcccaataagtgctgtgcttctatcggcatacttcatagcaaattttgtcgtgccaggttttcttaccaactctttcggatacgataagtcaaacgaagagcagaaggttgacgattcaaatgaaatagaagatgaatag

SEQ ID NO: 767 - DNA, 432 bp, Glycine max var. Williams 82
atgaacagattcaacaaatctgaacttctagtgctctttgtccttcctctctcaggcctacctacctttacttcatctttaacgttctcatcattgcacttggaaccgaagctgctcttctcacagattttgctaagcctttctgtcacacagaaacctctaattcccccagaactgtatgaacctgaggaaagggtggaagtagaagcctcagaacatgatgaaaagaagcctaaggttgttgcaaagtctgcttctgatgagaacattgttggtcacactgaggtgaaaaagtgtccttcaatcccaaatcttttgctcatagggtgtggagaaagtgaaggagatgtgattgaagcagaagatgaggctaggggagttaatgggcaagagttgtttgcaaaagctgaggccttcattgggaacttctag

SEQ ID NO: 768 - DNA, 1626 bp, Glycine max var. Williams 82
atggattctccctacacaagaatagtctttgagaaaattcagaaatttgagccagagcatgctagaaaaataattggctatctcttctttcaaggtcatggagaacaagaaatggctaaattggcttcatgccccgactattttatctgtgaagtggtagttcaggccaaaaaggaactccaaaggttggctgctaaaccagatatgctcccgatttctcgtactgtcaaccctcaacaaggtttaagtgatttatcagtaatctcccctagaactcctacttcaccaaactttcagatgcctcctccctattgggatccacaatctgctgcaaacatcaatccagactttatgggaatgaattacttggattctattgtagaacttcagaagcagacacagatgctcactttggagaatcaaatagatgctgtaaaaactgggactggaggaatcgccaacgatcactatggcttagacgcttctgctgccaatttgggtgggagaaggttttctgaatttccaatgaagatgtgtcactatttcaacaaaggattctgtaagcatggaactagctgcagattctatcatgggcaagttgtccctgagaatttctctcagatgcatgcaaatgatgctattggtgaggatcaggtgatttccccagggtcactggctcagttagagtctgaaattattgagctcctaagagcaaaaggcggtccaatgtcaattgcttccctgccaatggcatactacgataaatataaaaaggtactgcaagcagatggttatttaactgagagtcagaggcatggtaagtctggctatagtttgacaaagcttcttgcacgactgaaaaatagtattcagctaataggcagacctcatgggcagcattcagtggttctggcagaagattctcccacacaaatgcaaaagggagattttgctcgaaatatcagtgcttcataccaaatatatctgacgttcccagctgacagcactttcacagaggatgatgtctcaaactacttcaacacttttggacctgttgcagatgtcagaattccaaaccagcagagaaggatgtttggatttgtgacatttgttcattcagaaactgtcaaaagtgttttggataaggggaatccccattgtgttcggggttctcgggtgcttgtgaaaccttaccgggagaaggcaaaggttaatgaaaggaagtacacagatagaattgagcaccctatttgttattcaccacactatgtagatatggacgctgaacttaactcaattccaagaagttttgggagccatggatccattaggagacacctacaactaattgaacaggaagagcaggagcaagctcttgaacgtcagagaagtcttgcacagctgcattttgcccaaaaatctttcttcagttcacctcattttggcttctccatggatgagtcaaggatttcagatgatcacttcaatttccagccagcagaagaatctttcagttttccactgcatgtcaaatccaggcatacagactccaattactctgatgaggacagcaatgaaggactcaatctcccggacagtccatttgcatttccactagatagatag

SEQ ID NO: 769 - DNA, 1014 bp, Glycine max var. Williams 82
atgaattctaggtgcttccttgttcatccacaacaagagtatagcatggttccattttcttcaaattctgccacagaagatagagtggctagtgctcgaaacaggcctccgcgtgtcacccctccttcctttttggttaggatagccatgagaatatctagagcaagatggtttacctttttaagaagagtttttcattaccaaaatggatcaaggtccaaccttggctccaaccctttcaattctagcacttggatgatgttggagtttattgccttgattctccaaataaccattacaacattcactttggccatttccaagagggagagacctatttggcctatgaggatttgggtttctggttatgatattggctgtgttcttaatctgcttctactttatggacgctaccgtcaaatttatctaactcaaggagattctctcagcctttccgatatagagcagcagagaaacaatgaagaaaccaggatgtcacacttgatgaataaatgccggacttcgcttgagcttttcttcgccatatggtttgtgatgggcaatgtttgggtttttgactcacgttttggatcttttcatcatgctccaaagctccatgtgctctgcatcattctccttgcttggaatgcaatgtgctactctttcccttttctgctgtttgtgttgttatgctgctgtgtgccactaattagcaccctcctcggctacaacatgaacatggcctcttccaataaaggagcttctaatgatcaaatttcacaacttccaagttggagacataaagaagctggagccaagttagagcttggcaatgcctctgaaggcagtgaaaaattgatcaatgaagacccagaatgttgtatctgcttggccaagtacaaagacgaagaggaagttagacaattgccatgttcccatatgttccacctaaaatgtgtggatcaatggctaaaaattatatcatgttgccctatttgcaaacaaggattatag

SEQ ID NO: 770 - DNA, 1783 bp, Glycine max var. Williams 82
aattgctttctgagcttggcttcatataaaaataaagcctagaggaagttggccaacggttaagttccctccaaaccttgtgattcccttcgaatcaaagcaaaacttagcagtttgatttttggtcaccctctgagacacaacctcacctttctgacatatccttcacaccaatcttcccttccccctcttctatataaacttcatcagctccatctcctcttcatatatattttttctccaattaacctttatgtacagtatgtggttgctgaaaggatcatgttgttgaagctttttgtgatatagtctgattatgttgctaggagttaaagctggtgcagacccagaaaagatcttccaatcaaggtactagttccatccatcaacaaagttgtcaattgggatgcttcaatttcaaggttcttttgatgcaaacctgtgcttctaaaaaattcaattacttgatctctcgtacacgtcttggacaaattctcaacacaaagaggcaaaaagagaacatttaaaatgaattctaggtgcttccttgttcatccacaacaagagtatagcatggttccattttcttcaaattctgccacagaagatagagtggctagtgctcgaaacaggcctccgcgtgtcacccctccttcctttttggttaggatagccatgagaatatctagagcaagatggtttacctttttaagaagagtttttcattaccaaaatggatcaaggtccaaccttggctccaaccctttcaattctagcacttggatgatgttggagtttattgccttgattctccaaataaccattacaacattcactttggccatttccaagagggagagacctatttggcctatgaggatttgggtttctggttatgatattggctgtgttcttaatctgcttctactttatggacgctaccgtcaaatttatctaactcaaggagattctctcagcctttccgatatagagcagcagagaaacaatgaagaaaccaggatgtcacacttgatgaataaatgccggacttcgcttgagcttttcttcgccatatggtttgtgatgggcaatgtttgggtttttgactcacgttttggatcttttcatcatgctccaaagctccatgtgctctgcatcattctccttgcttggaatgcaatgtgctactctttcccttttctgctgtttgtgttgttatgctgctgtgtgccactaattagcaccctcctcggctacaacatgaacatggcctcttccaataaaggagcttctaatgatcaaatttcacaacttccaagttggagacataaagaagctggagccaagttagagcttggcaatgcctctgaaggcagtgaaaaattgatcaatgaagacccagaatgttgtatctgcttggccaagtacaaagacgaagaggaagttagacaattgccatgttcccatatgttccacctaaaatgtgtggatcaatggctaaaaattatatcatgttgccctatttgcaaacaaggattatagaggtagaaatagctgaaacaacagtcaaaaggattaatcttattttgtcatactcatatgtatagtcttgatactaccctcagtttttttccttctttcccccccttaaattttggtttaatatactttagatgtgtcacttgagtgagtttgtatatgtacagaatagctcaccagtgaccaaaactattactatgtaattggttgtaaggaatatatcccataacctttcaaattaatg

SEQ ID NO: 771 - DNA, 3243 bp, Glycine max var. Williams 82
atgtctgtcatcttatggaatctgtcactttctcccaaaatcttcttcctcaccatgcttctcttattaaagtctcttttgtttccatgctgttactcccttaatgagcaaggccaggctctattagcatggaagaacagtttaaacagtactttagatgcactagcatcttggaatccttccaagccaagcccatgcaattggtttggggtgcactgcaacttacaaggagaggtggttgagataaacctcaagtcagtgaacttgcaaggttcactaccttcaaattttcaacctctcaggtccttgaagactcttgtcctctcaacagccaacatcacaggcaggattccaaaggaaattggagactataaggagctcattgttattgatctcagtggcaattctctcttgggtgaaatcccacaggaaatttgcaggctgagcaaactgcagactttagctctgcatgccaactttcttgaaggaaacattccatccaacataggaagtttatcaagtcttgtgaacttgacactctatgacaacaaactgagtggtgaaattccaaagagtattggctcattaactgcgctccaagtgttgagagcaggagggaacacaaaccttaagggtgaggtgccatgggacattggaaactgcaccaacttggtggtgttaggccttgcagaaaccagcatttctgggagtcttccttcttcaatagggaagctgaaaagaattcaaaccatagccatttacacaactcttctttcaggccctatcccagaagagatagggaagtgcagtgagttgcagaacctgtacttgtatcagaactcaatctctggttcaatcccaagtcaaattggagagctcagcaagcttcagaatcttctactgtggcaaaacaatatagtaggtacaatcccagaagagcttggaagctgcacacagattgaagtcatagatttgtccgaaaatcttctcacaggtagcataccaaccagttttggtaagctatcaaatctgcaagggcttcaactgagtgtcaataagctttcaggcattatacctcctgaaatcacaaattgcacttccctgactcaactggaagttgacaacaatgacatatctggggagattcctcctcttattggcaacttgagaagcttgactctcttctttgcatggcagaacaagctcacaggaaaaatcccagacagtctttcacggtgccaagaccttcaggaatttgatctctcttacaacaatttaactggtttaatacccaaacaactttttgggctgaggaacctcactaaactgctgcttctttccaatgatttgtcaggctttataccacctgagataggtaactgcacaagcctctataggttgaggctaaatcacaatagacttgcaggtaccattccaactgagatcaccaacttgaagaatttgaactttctggatgtgagcagcaatcatcttgtaggggagattcctccaacactatccagatgccaaaatcttgagtttcttgacctccactcaaatagtctcattggctcaattccagacaatctgcccaaaaacctgcagttaattgacctcacagacaacaggctaacaggtgaactaagtcattccattggttcattaactgaattaaccaaactcagcttgggaaagaatcaactcagtggaagcatcccggcagagatcctatcttgctccaagttacaacttctggacttgggaagcaatagtttctctggacaaattcccgaggaagttgctcaaattccttcactagaaatctttctcaaccttagttgtaaccagttttccggtgaaatcccatctcagttctccagtcttaaaaaacttggagtgcttgacctctcccacaacaagctctcagggaacttagatgctctctctgaccttcagaaccttgtttcactgaatgtttccttcaataacttctctggagaattgcctaacacaccattcttccggagactccctctcaacgatctcacaggaaatgatggtgtctacattgttggtggtgttgcaactccagctgacagaaaggaagccaagggtcatgccagattggctatgaagattataatgtccattctcttatgcaccactgcagtactagtacttctcacaatccatgtcttgatccgtgctcatgttgctagcaaaatactcaatggaaacaacaattgggtgataactttgtatcagaagtttgagttctctattgatgacattgtccggaacttgacatcatccaatgtgattggcaccggaagctctggagttgtgtacaaggtcacagttccaaatggacaaacactggcagttaaaaagatgtggtcaacagcagagtcaggagcatttacttctgaaattcaagcactgggttcaattaggcacaagaacatcatcaagcttctgggttggggatccagcaagaacatgaaactgctgttttatgagtacctccctaatggaagcctgagctcattaatccatggttcaggaaagggaaaatcagaatgggagaccagatatgatgttatgttaggagtggctcatgcacttgcatatttgcacaatgattgtgtgccttccatattgcatggagatgtcaaagccatgaatgttttgttaggtcctggctatcagccttaccttgctgattttggcctagcaacaattgcaagtgaaaatggtgattatactaattccaagtcagttcaaagaacctaccttgctggatcctatggatacatggctccagaacatgcatctatgcaacggatcactgagaagagtgatgtgtacagttttggtgtggtcctacttgaggtcctgacaggaaggcaccccctagacccaacacttccagggggtgcacacttggttcagtgggttaggaaccacttagctagcaaaggagacccttatgacattcttgacccaaagctgagagggagaactgattctactgtgcatgaaatgctacaaactctagccgtgtcatttctatgtgtcagcaaccgagctgaggaccgtccaacaatgaaggacattgttggaatgctcaaggaaattcgacctgttgagtccgcaaccacaaatccagatgtgtcaaaggaagttttaacagtgcatacttctccagcacctcctatgaatggtgtttcacatggaacttaa

SEQ ID NO: 772 - DNA, 1074 bp, Glycine max var. Williams 82
atgtctgcctttgttggaaagtacgcagatgagcttatcaagaatgccaagtacatagccacaccagggaaggggatcctggcagcagatgagagcacgggcaccatcgggaagcgcctagcgagcattaacgttgagaacattgaggccaaccgccaagcccttcgcgagcttctcttcaccgctccaaatgccctccaatacctctctggtgtcatcctctttgaggaaactctttaccagaagacctctgatgggaagcctttcgttgaggtccttcaagagaacaatgtcatcccaggcatcaaagtggacaagggtgttgttgagttggctggcacaaacggtgaaaccaccactcagggcttcgactctctcggagctcggtgccagcagtactacaaggctggtgcacgctttgcaaagtggcgtgcagttctcaaaattggcccaactgagccctctcagttgtccatccagcaaaatgcacagggcttggcacgctatgccatcatttgccaggagaatggccttgtgcccattgttgagcctgagattttgactgatggggctcatgacatcgccaaatgtgctgctgttactgaaactgtgcttgcagctgtttacaaggcactcaatgagcagcatgtccttcttgaaggaactcttctcaagcccaacatggttactcccggctctgatagcccaaaggtaccacctgaggtgattgctgagtacacagttcaagcactccgcaggactgtcccagctgcggtgccaggggttgtgtttctgtctggtgggcaaagtgaagaagaagctaccctcaacctgaatgcaatgaacaagtcggagctgttgaagccatggactctctcattctcattcgggcgagcactgcaacaaagcacactcaagacatggggtggaaagaaggagaatgttgccaaagctcaagaggcatttctggcaagatgcaaggccaattctgatgctactctgggaaagtatgttggtggaagcggaagtggcttgacttctgagagtttgtatgtcaagaactacaattattaa

SEQ ID NO: 773 - DNA, 1705 bp, Glycine max var. Williams 82
aatggatgagctgccacttggccaagggaagaatcactcgttgctttatccaagattgataaccttcgttaggctaatcactggacacgtggctcctttgcatgggttgggtagataccactcggtatattcctttgagatttatctatatatctttggcctggctaagctcgtttttcgtgctgtcgtgtgttatctgtttcccgccatatatccaataagctttaaccatgtctgcctttgttggaaagtacgcagatgagcttatcaagaatgccaagtacatagccacaccagggaaggggatcctggcagcagatgagagcacgggcaccatcgggaagcgcctagcgagcattaacgttgagaacattgaggccaaccgccaagcccttcgcgagcttctcttcaccgctccaaatgccctccaatacctctctggtgtcatcctctttgaggaaactctttaccagaagacctctgatgggaagcctttcgttgaggtccttcaagagaacaatgtcatcccaggcatcaaagtggacaagggtgttgttgagttggctggcacaaacggtgaaaccaccactcagggcttcgactctctcggagctcggtgccagcagtactacaaggctggtgcacgctttgcaaagtggcgtgcagttctcaaaattggcccaactgagccctctcagttgtccatccagcaaaatgcacagggcttggcacgctatgccatcatttgccaggagaatggccttgtgcccattgttgagcctgagattttgactgatggggctcatgacatcgccaaatgtgctgctgttactgaaactgtgcttgcagctgtttacaaggcactcaatgagcagcatgtccttcttgaaggaactcttctcaagcccaacatggttactcccggctctgatagcccaaaggtaccacctgaggtgattgctgagtacacagttcaagcactccgcaggactgtcccagctgcggtgccaggggttgtgtttctgtctggtgggcaaagtgaagaagaagctaccctcaacctgaatgcaatgaacaagtcggagctgttgaagccatggactctctcattctcattcgggcgagcactgcaacaaagcacactcaagacatggggtggaaagaaggagaatgttgccaaagctcaagaggcatttctggcaagatgcaaggccaattctgatgctactctgggaaagtatgttggtggaagcggaagtggcttgacttctgagagtttgtatgtcaagaactacaattattaaacttctaagagtgtgtttgtttctccttttaaaatccatttaaacgtcaatccatgcttttggttcagtcacgttgaggtgcataagaaagcgtgacaagggagaaacaaacatactctaaatggacttggggactgatttgggctaagtgcattgtggcagatgtatgatacagcctaaggatttgcttctgattaacatgcttatttttgggttacatattttttacaaacatcagttattatgttataggagccaattttaatgtcaaatggtgatagcgtaccactcaaataattgttagagggaggctggtatatattgtcagaaacagtaatatactttataaaatgtgtaattacttaacacaggatgatggagagcagtcaattattagtcca

SEQ ID NO: 774 - DNA, 1548 bp, Glycine max var. Williams 82
atggcatccatggcggctataggttctctgaatgttccttgttctgcttcttcgcgttcatcgaatgtgggaagaaaaagctttccacgcagcctttcattctctgcatcacaactttgtggagacaagattcacacagattcagtttcattcgcaccaaaaatcggtcgcaatcctgtaattgttacccctaaagcagtttctgattcccaaaactcccaaacctgtcttgatcccgatgctagcagaagtgtgcttggcattatacttggaggtggtgctgggactcgtctttatccactgaccaagaagagggcaaagccagctgttcctcttggagctaactataggctaattgacattcctgttagcaactgcttgaatagcaacgtctccaagatctatgttctcactcaattcaattccgcctcgttaaaccgacacctttctcgtgcttatgcaagcaacatgggtggctacaaaaatgagggatttgttgaggttcttgctgctcagcagagtcctgagaatcctaattggttccagggtactgcagatgctgtcaggcagtatttgtggctttttgaagagcacaatgttttggaattcttggttctggctggtgaccatttgtatcgaatggattacgagaaatttatccaagcgcatagggaaactgatgctgatatcactgtggctgcattgccaatggatgaaaagcgtgccactgcatttggcctgatgaagattgatgaagaggggcgtataattgaattcgccgaaaagccaaaaggagaacagttgaaagctatgaaggttgatactacaattttgggtcttgatgacgagagagcaaaggaattgccttatattgctagcatgggtatatatgttgttagcaaaaacgtgatgttagacctgctccgtgagaagtttcctggtgcaaatgactttgggagtgaagtgattcctggtgctacttctattggaatgagggtgcaagcttacttgtatgatggctactgggaagacattggtacaattgaggctttctataatgcaaatctgggaatcaccaaaaagcctgtgcctgacttcagtttctatgatcgttcatctccaatctacacccaaccacgatatttgcctccctctaagatgcttgatgctgatgtcactgatagtgttattggtgaaggatgtgtgattaagaactgcaaaattcaccattctgtggttgggctgcgatcttgcatatcagaaggtgcaattattgaagacacgttattaatgggggcagattattacgagacggaggctgataagaggtttctggctgctaaaggcagtgttccaattggtataggcaggaactctcatatcaaaagggcaattatcgacaagaatgctcgaattggggaaaatgtcaagattattaacagtgacaatgtccaagaagctgcaagggaaacagatgggtatttcataaaaagtgggattgtcacagtaatcaaggatgctttaattcctagtggaacagtcatctaa

SEQ ID NO: 775 - DNA, 798 bp, Glycine max var. Williams 82
atggccacctctgctattcagcaatcagcattcgcaggtcaaactgctctgaagcagctcaatgagttggtccgcaagaccggtggcgccggcaaaggtcgcaccaacatgcgccgtaccgtcaagagtgctcctcagagcatttggtatggccctgatcgtcccaagtacctgggtccattctcagagcagattccgtcatacctgaccggagaattccccggtgactacggatgggacactgctggactatcagctgacccggaaaccttcgccaggaaccgggagctggaggtgattcacagcagatgggccatgcttggtgcacttggctgcaccttcccagagatccttgagaagaatggtgtgaaattcggcgaggccgtgtggttcaaggctggttcacagatcttctcggagggaggacttgactacttgggcaacccaaacctgatccatgctcaaagcatccttgccatctgggctgttcaggttgtgctcatgggttttgttgaaggttacagagttggtggaggaccccttggtgaaggacttgaccctatctaccctggtggtgcatttgaccctcttggtctggctgatgaccctgatgcattcgctgagttgaaggtcaaggaactcaagaacggtcgcttggctatgttctccatgtttggtttctttgttcaggccattgtcactggcaagggccctattcagaacctttacgaccatgttgctgatcctgttgccaacaatgcttgggcttatgccactaactttgtccctggacaatga

SEQ ID NO: 776 - DNA, 1204 bp, Glycine max var. Williams 82
tataagttctggatttcaaatgtgatttctctatttgcgaagatgaggtggcacattgtgttgttgaggtggcagaagaagagccactatatcagaaggagaatccacatccaaatggatgaccaatgaggtgttgctgagttgtgcatatcctgatccgcaatatcataggatcttctataaacctttgtagtagccttgttcattctcaacaaaacaaccatcatcatggccacctctgctattcagcaatcagcattcgcaggtcaaactgctctgaagcagctcaatgagttggtccgcaagaccggtggcgccggcaaaggtcgcaccaacatgcgccgtaccgtcaagagtgctcctcagagcatttggtatggccctgatcgtcccaagtacctgggtccattctcagagcagattccgtcatacctgaccggagaattccccggtgactacggatgggacactgctggactatcagctgacccggaaaccttcgccaggaaccgggagctggaggtgattcacagcagatgggccatgcttggtgcacttggctgcaccttcccagagatccttgagaagaatggtgtgaaattcggcgaggccgtgtggttcaaggctggttcacagatcttctcggagggaggacttgactacttgggcaacccaaacctgatccatgctcaaagcatccttgccatctgggctgttcaggttgtgctcatgggttttgttgaaggttacagagttggtggaggaccccttggtgaaggacttgaccctatctaccctggtggtgcatttgaccctcttggtctggctgatgaccctgatgcattcgctgagttgaaggtcaaggaactcaagaacggtcgcttggctatgttctccatgtttggtttctttgttcaggccattgtcactggcaagggccctattcagaacctttacgaccatgttgctgatcctgttgccaacaatgcttgggcttatgccactaactttgtccctggacaatgagcattgcaattcaatgcaatcttctgctcccattttctctaatgtaactacacctgtgtaccagaagaatctgtatgagaaccattatattatatatattagaaatttctgtccctaaaaaatatcaactcttacgcttcaattcataatattgattgttttgtgttgttgttatata

SEQ ID NO: 777 - DNA, 228 bp, Glycine max var. Williams 82
atggggatggttgtggtgatttctcttcctttcataatcttctgctttcttctgggttttggatgttacttctttggaagagccagaggaaggaaagaggttcaaaccaacccacaagtttatgggatgccaagtccacccccaggtgcagttgcttcaaacaccttcttcccttcacctcctgcaccccactcccactccaagccagacaacactgataatgtttga

SEQ ID NO: 778 - DNA, 2058 bp, Glycine max var. Williams 82
atgacagaaacaatggcaatgcaaggttgttattgtcacgtctatacgaagttggcaactcaaagaagaacactggacaatcttagtttttcaggctcaatttcggttaaaaaattgtcaaagaatgaaaggaccacagggaacaatcaatttcataggttactcgtgaaaatgcgacagacagaaatgcctgccgcctcagagtatggaacaaatgagttagtgaaaagaaagacaatgttagagaagacagtgaataatggttcagcaacttcaaaggtagtgagaaaaaatggtatcccagccttgagcaagacaatgaaatctagaagctcattggaagagctaaaggttttagccacagatgaaggtttcagttgggccaatgaaaattacagttcctggcagagatctattgatgtttggtcttttgtggcttctttgcgtattcggattctgttggacaatgcaaaatgggcatatttgagaggtttcacagaggcaaagcagaaaagcagaaggcggaaaactgcctcatggttaagagagcgtgtattgcagcttggtccaactttcattaaacttggccagttatcatcaacaaggtcagatctatttccacgtgaatttgtggatgagctcgcaaaattgcaggacatggttcctgccttctctcctaagaaagcaagaaaattcattgagagtgaattgggagctcccattaacatattatttgaggagtttgaagatcggccaattgctgctgctagtctcggtcaggttcatcgtgctattctgcataatggagaaaaagtagtcatcaaagttcaaaggcctggtctgaagaagctgttcgacattgatttgaaaaacttaaagttgattgctgagtattttcagagaagtgaaacttttggtggtccacttagagattggattggaatatatgaagaatgtaaaactattttgtatcaagaaattgattatataaatgaaggaaagaatgctgacaggttccgccgagattttagaaacataaagtgggttcggatacctctggtatattgggattatactgcattaaaggtgttgaccatggagtatgtaccaggtatcaaaatagactatgtggataccttaacttcgcgtggttatgatcgattacgtatctcatcacgtgctactgaggcatacctgattcagatattgaaaacaggtttctttcatgccgatcctcatcctggaaatcttgctattgatgtggacgaagcgattatttattatgactttggcatgatgggagagatcaaatcttttacccgggagagactgcttgaacttttctatgctatgtatgaaaaagatgccaaaaaggttatgcaacgccttatagagctcggagccctccaacctactggggacctgtcatcagtgaggagatctgtgcagtttttcctggaccacttgctaagccaggcaccagatcaggagcagaccctttctgcaatcggggaggatttatttgcaatagcacaagaccaaccattccgttttccatccacctttgcctttgttctaagggcgttttcaacacttgaaggcataggttacacactcaatccaaatttctcctttgctaagattgctacaccctacgcacaggagcttttagagataaggcaaaagcagcgcactgcgccacagcttgtggaggagataagaaagcaagcagatgatgctacaacctataccatgtctatgccatacagagttcaaagaatagaagagtttacaaagcaacttgaggcaggggatctgaaacttcgggtacgagtgcttgagtctgaaagagctgctcggaaagcaacggctttacaaatggcaactatgtataccgtattaggagcaactctgctaaatcttggtatcactctgagcagccaaggcaacataactattgcgaatggatctttcattggtgcaggtatttttatgacactatttgtcagatccatgcaaagggtaaaaatgcttgataagtttgagaaaatgatataa

SEQ ID NO: 779 - DNA, 1221 bp, Glycine max var. Williams 82
atgaacaacctcttctttctcttcttcttcctcttcttagcctccgccgccgccagcgtccccgcccacaacatcacccgcatgcttgccaaacaccccggcttctccaccttcaaccactatctctccctcacccacctcgccgaagagatcaaccgccgccagaccatcaccgtcctggccctcgacaatgccgccatgtcctccctcctcgacaagcacctctccctccccaccatcaaaaacgtcctctccctccacgtcctcgtcgactacttcggcgccaaaaagctccaccagatcaacaacagcaccaccctcgtctcctccatgttccaggccaccggctcagcctccggcaccgccggctacgtcaacatcaccaacctcaaggccggcaaggtcggcttcgccgccgaagacaacgacggctccctccactccttctacgtcaaatccgtccaggaaatgccctactacatctccgtcctccaaatcagcgccgccataagctccgccgacgccgaggcccccaccgccgcaccctccgccatcgatctgatctccattatgtccaaacaaggctgcaaggcattcgcggaccttttaagaggctccaaagcgcttccggctttcaaggaaaacgttgacgggggcttaacggttttctgccccaccgacagcgccatcagcggtttcgcgccaaagtacaagaacctcacagaagctcagaaggtttcgcttctgttgtaccacgcgactcccgtatacgagtccctgcagatgctgaaatcgagcaacggaatcatgaacactctggccacagagggagcgaacaagtacgacttcacagtgaagagtgaaggggaagacgtgagtctgaagactaaagtcaacaccgcaagcatagtagggacattgatagatcaagatccattcgtggcatataagataaacagggtgttgatgccgagagagttgttcaaggccagcgacgccctagaccaagcacctgcggaatcccctaagcctgccaagaagaagaagaatgctaagaagggaagcgaagattccgatgcggcggatgcaccggcggacggaccatccgacgactcggaagatcagaaggctgccgatcaggacagcaacggagtcagcggattgcacgtgagattggtcatggtcttgttcggtttaattatgggttttttggttctatga

SEQ ID NO: 780 - DNA, 861 bp, Glycine max var. Williams 82
atggtgatgggaagtaacagcagaggaaaggatggtgaaggcacttcaggagttaaaaaggatgagtacgaacaagacatcaaatttctgccacctgaagcgctttatggcaataccaatggattcacagatcctttggttcagttaactccacctggacctggaccatatgagccaccacctcccttgctcatacaaccccaggtccctgtggctgccatgcaaagaccagcagcgatagcgcaacccctgccacaaaatggatatgtagaatctgttattcatgaaaggttgaaaaatgtgaggatcacatggaatcatgcagccacgaatgttgctattgcaggatcatgggacaactgggagaccacggagcccttgctgagagtagatcaaaattttgtcattgttaaaacactccctataggtatctatcattaccgtttcattgtagatggctacttgacacatgctccagagttcccatcggcttctgatgattcaggttatggctacaatatattggatttgcaggattatatcccagaaatagttgcaagcttatccgattttgaagatcctccatcaccgccatcaagttatgataacacaaacttaaatgaagaggagttcagcaaacccccaccagaattaccacaacaactaccagtggcaataagaaatgaggcttcatccgcaagtggtagtcatcatgtccctaggcccacgcatttggaactgaatcatctatacatccacaaaactgatagggatcaatttgtggcactacgatcaacttataagtttcaacacaaatatattactgcggaactgtacaagaccctgcgcagggaaagatga

SEQ ID NO: 781 - DNA, 1485 bp, Glycine max var. Williams 82
atggagggggatctgaagcagaagctgttgagaagaagaaaggaagaggaagaagaagaagaagaagagttatcattggccaagagggtgtggaatgagagcaaggttatgtggatagtggcggcaccagccatattcacaaggttttccacctttggaatcagtgttataagccaagcttttgttggccatattggttctaaggaattggccgcttatgctctcgttttcaccgttctcattaggttcgccaatggtgttctgttaggaatggcgagtgcgttgtcaacactttgtggacaagcatatggggcaaaagaatatggcatgatgggagtgtatcttcaaagatcatggatagttttgttcttaactgcagtctgtcttcttcctgtgttcatcttcacaagccccattttgttgctcttgggccaagatgagagcatagcacaagtggcaggaaacattgctctttggtcaatccctgtcatgtttgctttcattgtctcgttcacttgccagacgttcctgcaatctcaaagcaagaacatcatcattgcgttcttggcggctttttcgatagtcattcacgtgtttctctcctggcttttgacaatgaagttcaagtttgggattcctggtgctatgatttcagcaggcttggcatactggattcctaatattggtcaactcatatttgtcacatgtggttggtgctctgatacatggaaaggtttcacatttttggcattcaaagacctctggcctgttgtcaagatgtccctttcagctggtgccatgttatgtcttgagctctggtacaacacaatattggttcttttgacgggtaacatgaaaaacgcggaggttgaaattgatgctctatccatatgtctcaacatcaatggatgggaaatgatgatatcacttggtttcatggctgcagcaagtgttcgagtggcaaatgaacttggaagaggaagtgccaaagctgcaaagttctctattattgtgtcagtgctcacatcattggccatcggattccttctgttcatattcttcttattttttagagaaagacttgcatatatatttacctcaaataaagaggtggcctttgctgttggggatttgtcacctttgttgtcggtctctatattactgaacagtgttcaacctgtactctcaggagtggctataggagcagggtggcaaagcattgtagcatatgtgaatatggggtgttattatgccataggtattcctgtaggtattgtacttggtaacgttctggatttgcaagtcaagggaatctggattggaatgttgtttggaacgttgattcaaactatagtgctaattgtaatcacctacaaaactaattgggacgagcaggttaccattgctcagaagcgtattagcaggtggtcgaaggtggacagtcctgatcatgaaaatgaagtagaaagaaaaaacgttagctaa

SEQ ID NO: 782 - DNA, 213 bp, Glycine max var. Williams 82
atgttctcatcattgagaagcaaatttggacttccttgcttctctatggttacgcatttttgctggaaaaccatctcattcctcttccaccaaaatttgtttaaacaagactccaatgtgaactatcagtgcatacggtgtttcacaagtttctacttagccaatcatgaacagtggagtaccttgatgtcagaaaaaaaaagtgtaaaataa

SEQ ID NO: 783 - DNA, 939 bp, Glycine max var. Williams 82
atgaagatcaaaatcctctacttttacttcatacttcttcccttggcattcgcggacttgaaggttggattttatgcatcctcgtgcccaaaagctgagtccattgtgaagaaagtggtgcagaatcgattcaatcgtgacaaatccattactgcagccttgcttcgcatgcatttccatgactgtgctgtcagaggttgtgatgcatccatactcataaactctaccaaggccaacacggcggagaaagaagccggagccaacggcagcgtccggggctacgacctcatcgacgaagcgaagaaaaccctagaggcagcatgtccttcaaccgtgtcctgtgcagacatcataaccctagccacccgagacgccgtggccttatccggaggaccccaatacgacgttccgacgggaagacgcgacggattagtctccaacatcgacgacgtcaacattccaggacccaacactcccgtgtccgtgacatcacagtttttcgcgagcaaaggcataacaacacaggaaatggtgacccttttcggagcacacaccgttggtgtcgcacattgtagtttctttgatggtagactctcgggggcgaaacctgaccctactatggaccctgcgttgaatgctaagttggtgaagttgtgcagctccagaggggatcctgctacacctttggatcagaagagttcttttgttttcgataatgagttttatgagcagattcttgccaagaaaggggtgctgctgattgatcagcagcttgcgttggatgcgactaccaaagggtttgtgtcggattttgctgcgaatggggataagtttcaaaagggtttcgcaaatgcgattgtaaagatgggggagattgatgtcctggttggaaatcaaggtgaaatccgcaggaaatgctcggttttcaaccgcaactag

SEQ ID NO: 784 - DNA, 1834 bp, Glycine max var. Williams 82
ccattattcgcttcaagattctctagaccagctgtagatcctcagtacaaggatttaaggcattttcagtggcattgggaaaagggggagcctgtcattgtcagcaatgtgcttgaatgtacatctggtttaagctgggaaccgcttgtcatgtggcgtgcattacgtcatgtaactaataccaagcatggccaacatttggcggagaaaacaattgattgcttagattggactgagggattggcttgcttggccacagatattgaaattaaaagattggcctccttctaatttatttgaggaacaattgcctgtcatttgctgagttcatatcttccttacccttcaaggaatatactgatcctcacaaaggttctcttaaccttgctgtgaagttgcctaatggttctctaaagccagacctggggccaaaaacatatattgcttatggatttcctcaggagcttggacgtggtgattcagtgactaagctccattgtgatatgtctgatgcagtaaatgtgttgactcatattgctgaagtgaaactggattctgatcaacttactgtcattgagaagttgaagcaaaagcatctcgagcaagagaaaagggagctacttggtgatgatcaggatggagaaactaatgttgacatgcttaataattcaccttctacaataaatgctttggacaggcaaagtagtgttgaagtcatggaacaagaaggtggattatgtgatgggaaagaagttgatcagtttcatcaaccgtctggtagtaatgaggttgccattgctaatgaggatggtatttcatatggatcagaggtcatagaggttgacaaagtaaaaataaatcaaggtgatttgttgtttgggggggatgcttcagatggtgctctctgggatatttttcggagacaggatgtccctaagttgcaggaatatctgaagaagcatttcagagagtttaggcatgtccattgctgtcctttaaagcagttggatcatgccaatgaattatcaaactccctgaaagaaagttccaatattaacactgttcgggcatcgcttattgttgaagaatgcacaagacttggtttgatgtatttgtgtattgctcctggatctagaccttcccctgttgctgttgctgctgcaagtcacaaattaatcacatgtatttcatgcttcaatgagcgttcacttgcatatcatgctgttggatatggaagaggatctcacattccagcagtagccattacatcatcaggcactgcagtttccaaccttcttcctgctgtatgtttcattaatattgcttgttttacatggatgtccttattttcatgaatttattttagggtaaaatacatttttggtccccctataatgctcaatctgcaattttggtctcctagatacttttatttttcactcaatgtttgaccatggataatcaattaacggtcaactaacagaagaaccaaaatcgctgattttgaaaaatagggggactgaatgtcttgatttggaaatagggggaccaaaattgcggattgagcattataggggaccaatagtgtattttagcctttattttattttgaatgtgtgatgatttattaatttcattcctgtgacttggtttgttgtcattctgtatgctgttgctaatacatgcattattggagttcaattggttgctttgctggctctttttttgcacttagtttttacttttatttccatcaacttgatttgtagttttctcttagagtttaattcccctcaaggtttgaattgtatttgcttttagagtttaattcaaa

SEQ ID NO: 785 - DNA, 900 bp, Glycine max var. Williams 82
atgggagaagcaacagaaagatatgcagttgtgacgggtgcaaataaaggaattggattagagatagttagacagttagcttcagctggaatcaaagtgttgctcacagcaagaaatgagaagaagggtctccaagcactggaaacactcaaagactcaggtctatcccaccttgtactgtttcatcaggtggatgtggctgatgcaacaaatgtagcttctttggcagattttgtcaaatccaaatttgggaaacttgatattctgattaacaatgcagggattggtggagttgtaattgatgacactgatttaatcactacagccatcatgaatcgtggggctataccagaagataatgggacaaagggaataactcatacatacgagttagctgaagaatgcttgcaaataaattactatggcgctaaaaaaactacagaatcccttatgcctctcctccaattatctgattcaccaagaattgtgaatgtatcatccactctggggcagttagagagtttgccaaaagaatcatgggccagaggagtcttcaatgatgttgataaccttactgaagagatagtggatgaaatattgaacaagtttctcagagatttcaaagaaggttcactggaaagtaaaggctggcctaagtatctgagtgcctacattgtctctaaagctgctatgaatgcctacactagaatcctttctaagaaatacccttcattctgcatcaatagtgtttgccctggttatgtcaagacagatatgactgccaacaccggcttcttaacagttgaagaaggtgctgctagtcctgtgaggctagcactgcttcccattggtagtccatcaggcttcttctattacaggagtgatgtggcttccttttga

SEQ ID NO: 786 - DNA, 621 bp, Glycine max var. Williams 82
atgtcatcttttgttgctcttcagggcctgcatggctctcttctcagctcccagttcctaggccaagacaccctcactcatttccaccctcgcaacaaggcttcttccaccattcaaaacaagccaacaacagcacaacaaccaagtgccaaatttgacatgctgcaaatcgtaggaggaagaggactatgcaatggagaagcaggcctaaaacaagagctgaagaagcaagttggtgttgatgaaaaaggacaaacttcagcaacaagtggcaaagagcaagaagaggaggaggaatcaacaagtgttgttgctactgaagatggttttgagaaggagctgatggggctaacaggggggtttccagggggtgaagaagttcattcaggaaaaccctcctcctctaaaacgaagtcaagcaaaaacctgaaactagcattgtccaagaagcctaagccaccagaattgcctctgttgctgccagggatgattgccattgtgaagaacccaaataacccgttttacatgtactgtaagattgtgcaaagaatcactgatggtccccgcatgaagaaccccaagtctgcggtactcaaaccgtttcttgaaaagaaatcatag

SEQ ID NO: 787 - DNA, 558 bp, Glycine max var. Williams 82
atggcaaccaaaccaaaaactctggagctcacgattttgtccgcggagggtctccacgtaaggggaaagcccacgcccaacatcaaagtgttcgcggtggttcgcgcggagtcaataacgagccacaccacggccatggtgacgacgacaacgaccaacgggagcgacaacggcttccagtacttgtggaacgagaagttctgggtggagcttgggcctcgcgcaaggtgcgtgacgattgaagtgaagtgcaggacggaaacgggagtggtgagagacgtcggcgtggcgagaattgcggtttcggattttcttggagggtcgtcggtgcctgatcattgcttgcagtctttgtgttacaggttgagggattgggatggcagagaaaacggagtcgttaatttctccgttagggtggcgccgcctcctactccgccgccacctccgccgccgccgccgccggcggaaggtgctgaaatttattgttcgtcgtctacttcgggtactggagttgttactggcattccggttcattggaacaattcgatcgacaagtag

SEQ ID NO: 788 - DNA, 1551 bp, Glycine max var. Williams 82
atggactaccttctacttcttccactaataatcaccatagtatggataaacattcatgtattcatctctagcttcaaaccactcaaatcctctaaaaatcccccgggtcctcgcccttttccaatcataggaaacatcttggagcttggcaaccagcctcaccaagcacttgccaagctttctcaaatttatggtcctataatgagtctcaagcttggtaagactaccaccattgtcatttcctctccacaagttgccaaagaagtgctacaaaaacatgatcaaatttttgctaataggacagtccctgatactctccgagcacttgatcatcacatactttctgtggtgtggatgccacctttagcacaatggaggacccttaggcgagtttgtgctaccaaagtgttctcttctcagcagcttgattctacacaggtttttcgtcaaaggaaggttcaagatcttatggattatgtgaaggaaagatgtgagaaaggtgaagctttggatattggtgaggcttcctttacaactgtgcttaattccatatcaaacactttcttctcaatggatttggcttattacacttctgataagtctcaagagttcaaggacatcgtttggggtatcatggaagaagctgggaggcctaatgttgtggactttttcccaatctttcgcctgcttgatccacaaggtgtgcggagaagaatgaatggttattttggaaagttaattgcgttttttgatggtctcattgaggaaaggttgcgtttaagggcatcagaaaatgaatccaaagcatgcaatgatgtgttagatactgtgctggaactcatgcttgaagagaattcacaagtgacccgccctcatgttttgcatttgtttcttgatttatttgtggctggaatagacacaacatcaagcacgatagaatgggcaatggctgagttgctacgcaaccctgaaaaactagaaatagttagaaaagagcttcaacaagtccttgccaaaggtgaacaactagaagaatcacatatctcgaaccttgcttacctacaagcagtggtgaaagaaacttttcgcttgcatccacccatcccaatgttagtgccacacaagtcagaagttgatgttgaactatgtggcttcatggtgcctaaaagtgcccaaattctagtcaatgtatgggccacaggaagagattcaagtatttggacaaacccaaatcaatttacacctgaaagattcttggaaagtgacattgattttaaaggccaagattttgagctaataccctttggagctggaagaaggatttgtcctgggttgccattggcttctagaactgtgcacattgtgttggcctctcttctatacaactataattggaagctcacggatggacaaaagccagaagacatggatatgtctgagaaatatgggattactttgcataaggcacaacctctcctagtcattcccatccaagcatattaccaaggaagattgcatgcatgcaatcaaattcttaataagttgtcgtaa

SEQ ID NO: 789 - DNA, 1053 bp, Glycine max var. Williams 82
atgagtttccttcgttcttttgcaagaaacaaggatatatcaaaagtaggacgcagaggtatccattgcatgcagaaactatgtgcagaaaaaatatctcctgattcactagagaaggcccaaaatcgtgtgatagatgctgcactcacacttgttcgagaaaatacaaggcttaagaaagaacttgtgcatagtttgggaggtgctgtagcaacttcaactcttcttggagttcctttgggtcataattcatcgtttcttgaagggcctgcatttgcacctcctttcattagggaaggtatttggtgtggtagcgcaaactccacaactgaagaaggaaaggatttaaaggacttgcgaataatggttgatgttggtgatatccctattcaagaaatgcgagattgtgggataggagatgagagactcatgaaagttgttagtgattctgtcaaactagtgatggaagaggatccattacgtcccttaattttggctggtgatcactcaatctcatatccagttgtcagagccatatctgagaagcttgggggaccagttgatgttcttcattttgatgcacatcctgatctctatgatgaatttgaaggaaattattattcgcacgcttcttcttttgctcgaatcatggagggtggttatgctcgtcgactcttgcaggtcggtataagatcaataaacaaagaagggcgtgaacaagccaaaaagttcggggtagagcagtttgaaatgcgacatttttcgaaagatcgtccatttttggaaaacctgaatctaggagaaggtgctaaaggagtatacatttcaatcgatgtggattgtcttgatccagggtatgctgtaggagtgtcccactatgaatcaggaggtctttctttcagggatgttatgaacatgctgcaaaatctcaaaggtgacattgttggtggagacgtggttgaatacaacccacaacgtgacactcctgatcgtatgactgccatggtagctgctaagtttgtgagagaactcgctgcaaagatgtcaaaatga

SEQ ID NO: 790 - DNA, 513 bp, Glycine max var. Williams 82
atgcaattcagactcggcaagcgcgttgtaagggttgctaaatgtgtcttccgtcggatcagggtcagaacccgacccggatactaccaccgtctcggtggttcgacgacccattctaagaatcccataacaacaaggcttctcacgtgggggcaaaaactgaagagaggagcgaagaccctatgcgggaaaaatgggtcgggttaccttccaatagggtcggatccgctttgtgacagggctccggcggtgccgaaggggcacttggcggtgtacgttggggaggaggacggcggtttccggcgcgtattgattccggtgatctactgtaaccaccctctgttcagcgatttgctgagggaagcggaaaaagagttcgggtttgaacaccccggtgggatcacgataccgtgccgacttaccgagtttgaacgggttaagacccgtatcgcgtccgggtcgggtcaacgcgggaggacccggagattgggttggccgctacaacattattga

SEQ ID NO: 791 - DNA, 789 bp, Glycine max var. Williams 82
atgaagtttgggaagagactcaagcaacaaattcaggagtcgttgccggagtggagggacaagtatttgtcgtacaaggaattgaagaagctcgtacggctcatatcggcggcgccgccaacgttgttgaatggatcgttggaatatggcaagacggagactgagtttgtgtatttgttgaataatgaaatagacaagttcaatgggttcttcatggagaaagaggaggacttcattattcgacatatggaagtacaacagagaatcaagagagtagttgacgtgtggggaccaagtggaagtcaaccttcagaagaagattatagagaggagatggctaaaatcagaaaaactattgttgatttccacggtgaaatggttctcttagtcaactacagcaacatcaattacacagggttggcaaaaattctgaagaaatacgacaagaggacaggggggcttctgcgtttgccattcatccagaaagtgttggagcagccatttttcacaacagatttgatctcaaagctggtgaaggagtgtgagagcataatcgatgcagtgttcccggcagaggaagaagctgagagagcaaaggaagcaaaagatgcaataactgtggcaggagaagggattttcagaaacacagttgcggctttgcttacaatgcaagaaatccgaaaaggtagttccacagagagccctttctctctgccaccactcaacttgctagactctgatctcatccaatcaatacaactcaatgctgctgttcccattgtcaagtga

SEQ ID NO: 792 - DNA, 1258 bp, Glycine max var. Williams 82
tattctagcaaaccttcgctactaaattcccttcttaaccccttttttttttgtaccttcatcatcatcatcatatatttcatatcacaccaacccattttaatttgcatttgatcttcttcatagacatatacacactatcatattattattattttcttccccaaattttggttgtttttgatgttatgaagtttgggaagagactcaagcaacaaattcaggagtcgttgccggagtggagggacaagtatttgtcgtacaaggaattgaagaagctcgtacggctcatatcggcggcgccgccaacgttgttgaatggatcgttggaatatggcaagacggagactgagtttgtgtatttgttgaataatgaaatagacaagttcaatgggttcttcatggagaaagaggaggacttcattattcgacatatggaagtacaacagagaatcaagagagtagttgacgtgtggggaccaagtggaagtcaaccttcagaagaagattatagagaggagatggctaaaatcagaaaaactattgttgatttccacggtgaaatggttctcttagtcaactacagcaacatcaattacacagggttggcaaaaattctgaagaaatacgacaagaggacaggggggcttctgcgtttgccattcatccagaaagtgttggagcagccatttttcacaacagatttgatctcaaagctggtgaaggagtgtgagagcataatcgatgcagtgttcccggcagaggaagaagctgagagagcaaaggaagcaaaagatgcaataactgtggcaggagaagggattttcagaaacacagttgcggctttgcttacaatgcaagaaatccgaaaaggtagttccacagagagccctttctctctgccaccactcaacttgctagactctgatctcatccaatcaatacaactcaatgctgctgttcccattgtcaagtgaaactagatgaaaaatacttattcaaacacatccatagtgttacaatgttacaatgtactagtaattagtgagtgatctcaatatatatccttttgatgaagtaacacctcagttacatataaaagagtagctagcaatttagccatttcaaggttattttagtaattattggttagggtatttaaatttcatttcagggtgatatggtcaacatactgggttctctatgaattagaaaggaaataataataatataaaaaacagttctcttatgtccattc

SEQ ID NO: 793 - DNA, 2085 bp, Glycine max var. Williams 82
atggcgctttctccggaaacgtttacaacccgaaaacgacgcccccgagggtcgtcgtttacgtccccgaaggtaaacgaccttaacgtgttgagctctttgcttcaactaacggatcagatatgttccctaaatctcacagccaccctcttaaaccgtgtttcctcttccaccatccgcaaaacgcagctcctcggcgtcgttttcgaggagctcttccgcgtttcgaatctgaactccgattccgttctgttcctctgcctcgaggaaatgtacatcgttctccacaagctcaaaaccctaatccaagatttctccaacggaagcaagttcaatttgctcatgcagatcgataccgtcgcggagagcttccacaggctcaccggagaactctccacgctcctcgacgtgttccctctccaagacctcgacctcaacgacgacgttagggaactcgttctcctcgtcagaaaacagtgctctgaagcgaaggcgttcatcggagccgaacatgtcagcctccgcaacgacgtcgttttggtcctcgaccggatcaagaacgagatcgtccccgaccaagcgcatctcgcttcaatcttcgagaaattggagattcgcgacgcgtcgagctgcagagcggagattgagagcctcgaggaagagattcacaaccgttgcgaagagcaaccgaaaacagatctcgtcgcgttaatcggcctcgtccgtttcgcgaagtgcgttctctacggcgcgtcaacgccgtcgcagaaaaccgtcactctgcggcggaaccagtcgtcggagctggcgattccggcggattaccggtgtccgataagcctagagctcatgcgcgatcccgtcgtggtggcaacaggacaaacatacgatcgtgtatcaatcaagctctggatggattctggacacaacacgtgtccaaaaacgggtcaaacgttatcacacagcgacctaatccccaatcgcgtcctgcggaacatgataacagcgtggtgccgcgagcagagaatccccttcgaagcagaaacggatacagggaaactcaacggtggagttaccaacaaagccgcattagaagccacgcgaatgacggtgtcgtttttgatcaacaagctcaagggaagggaaaatgataacgttaacgttcctttgagtgttgaagacacaaacggcgtcgtttacgagcttcgggtgttggcaaagacagattcggatagccgagcttgtatagccgaagcgggagcgattccggttttggttcggttccttaatgcggagaatccgagcctgcaggttaacgccgtcacgacgattttgaacatgtcaatattggaagcgaataagactaagataatggagactgatggcgcgttaaacggcatcgccgaggttttgatatcgggtgcccacgccaaggcgaacgcggcagcgacggtgtttagtttgtcaggtgtggcggcgcacagaaagaagctggggaggaagacacgtgtcgtgagcgggttggtgggtttggccaagagtgggcccgagggggcgaggagggacgctctggcggcgatattgaacttggcggcggatagggagacggtggcgaggttggtggaggggggtgtggtggggatcgcggccgaggtgatggcggcgatgccggaggagggggtgacgattctggaggcagtggtgaagaggggtgggttggtggcggtggcggcggcgtacgccgggattaagaggctgggggctgtgctgagggaggggtcggagagggcgagggagagcgcggcggcgacgctggtgacaatgtgtcggaaaggggggtcggaggttgtggcggagatggcggcggtgcccggcgtggagaggatcatttgggagcttatggcggtgggaagtgtcagggggcggcggaaggcggcgacgctgttgaggattctgcggcggtgggcggcggggctcgacggtggcgaaaatgaagggttcccgacaactaccaccatggttgcttcctcaaccactactgtggttgttccaaccaccaccaccaccacttcgttagcacagtaa

SEQ ID NO: 794 - DNA, 369 bp, Glycine max var. Williams 82
atgatgactagctttaaggttgcatgtgtggttgcgatgatgtgcatggttgtggccatgagtgttacacccatggcacaggccgcaatcacgtgcgggcaggtcgccggcgacgtgtctccgtgcctcagttatcttcgaagcggcggaaaaccatcggacgcctgctgcaacggagtgaagtcactcagcggtgcggcaaagaccaccgccgaccgccaggcagcgtgcaattgcctgaaaaaccttgccaataatatgggacagagtttgaatgccggcaacgcagcctctctccctggcaaatgtggcgtcaacatcccttacaagatcagcacctccaccaactgcgccaccatcaagttctga

SEQ ID NO: 795 - DNA, 441 bp, Glycine max var. Williams 82
atgcataacaaggcaactgtggaagcactctacaaggcccttttagggcaaggccaaatggacacggttgcaacaaacatgctagcaagtgacctcgagtggtggttccatggcccccctcagtgccagcacatgatgagggtgctcaccggagagaccaccctcgacaacaacgggttccggttcgagccaaggagcgtcaccgccatcggcgattgcgtgatcgccgaggggtgggaaggcaaggcctactgggtgcatgtttggaccgtgaggaatggccttatcacgcagtttagagagtacttcaacacatggcttgtggtccgggacttgaggtctcaaaggtgggaaaacaagcttgacaacatgacattgtggcaaagccagccgcgtgatctatatcgtcggtccctgccaggacttgtgctagccatttag

SEQ ID NO: 796 - DNA, 1128 bp, Glycine max var. Williams 82
atgtcaactaattatttaatggcaacagagcgagtgcttcacatgaaggatggcttgagagaaacaagctatgcaaaaaactccttacttcagagaaaagtggcaatgaaagtgaaaatcatacttgaagagaatgtgaagcggatgatgtccaacataaatattgaaagctgctgtaagatagcagatttaggttgttcttcaggacccaatgcactgataactatgtcaaatatcttgaacatcatgtataatgctagcctgagcttaaacaagcgtgtgccacgtgtattccaaatttacctcaatgatctattcggaaatgatttcaattccatcatcaaattaattccagacttctaccaaagtatacatcaagaaaaaagaggcaattttggaacatgctttattcatgcaacaccggggagcttttatgggaggctttttcctgataattacatccacttctttcattcttcttacagtctccattggctatctcaggcaccaaaaacttcgagcaacatagctataccactcaacaagggaaatgtttatataacaagtacaagctcttcttcagtctatgaagcatacttcaagcaatttgaaaaggatttcaaactttttctaaagtcacgctcggaggaactaagatcgggtggtattatggtacttactttcattggcagagataaaactcgaaaaattaataatcctgcagaggtaattggtatggtactcaacggtatggtccaagagggtctggttgaagaggaaaaattggacttctttgatttacctatatatggtcctacagcagaagaagttggacaagtgattgaaagagaaggatcttttacccttcaaacattaaaaactatcaaaataggttgggatgcaaaccttgaagaggaagttgatgatggtattcttgatagcaaaataagaggggagtttatagctaagtctatcagagctgttttggaacctatcttgtcagctgagtttagcgaagatatcatggatgagttgttctcaagatacgcaactctggttgcccaactcattgaggtggagacgttggagtatactaatgtagtagtcaccttgaccaaacattcttga

SEQ ID NO: 797 - DNA, 1524 bp, Glycine max var. Williams 82
atgtctttcagtttcactgaccttctttctactaacaacaacaatagcttgaacatggatgatgatccctttggacttgaatttgctaataatttcaagtcagcttcactgcctctctctccttcttcaatctacccttcttcttatgctgagttccctcctggttttgtcccaacttcacagtcattgaattcacaccactttttttcttctcaaattgttcctgcatcttacacaactgagcaatcttctagcatgagctacaacatgagaaacacttcaactgagggtcaacaaggaaacaaggaggaagagagaaactactctgacctctctttcctaacaaaaacaaaccacgtgcctctctttcaatcttccacaaccatgtttcaagtggagccactaaagaaacaggacacaatgatatccagtgaagctgcaaagcaaacagatttctcatctgagaggacagaaacaaaacctgaatatccatctactcagggcttctcagcagcattagcctcaatcaaacctgaaatacaaagcaattctgctcctggttctgttcattttaactccacttatgctcctaagtctattagggaacaaaagagatcagaagatggttacaattggaggaagtatggagagaaacaagtgaaaggaagcgaaaatccgcgtagttattacaagtgcacgcacccgagttgtccaacaaagaagaaagttgagaggtctttggagggacatatcactgaaatagtatacaagggaagccacaatcatcccaagccacttggtagaaaaaatggttctcaatcaattcatcaaacttcttcgtcctgcactaactcagggatttctgatcaatctgtgggagaggaagatcttgagcaaacatcacagactagttattctggagggggtgatgatgaccttggaaatgaggccaaaagatggaagggggagaatgaaaatgatggccattcctattcttctgctgggagtagaactgttaaggaacctagagttgtagttcaaaccacaagtgaaattgacatacttgatgatggatataggtggaggaaatatggacagaaagtagttaaaggaaatccaaacccaaggagttactacaaatgtgtagccccaggttgtccagtgagaaaacatgttgagagagctgcacatgatatgaaagctgtgattacaacttatgaagggaaacatatccatgatgtacctttaggacgaggaaactcaagctatagcatgaacagaacttctctaaacaacaacaccaacaccagcaccagcaatgtaacagctcctgcccctattaggccctcagcagtgactaattattctaactcagcaagtttcacaaactcacttcatgacacaaagccaccaacatctgcaagccaagaaccttttccaatggacgtgttgctgagccccggaagtatcggatttgcggctaatgacctgttccttcagtcttttttgtcaaagaacttttaa

SEQ ID NO: 798 - DNA, 1266 bp, Glycine max var. Williams 82
atgatggacaccacttcatcccctttgtccctccaaacccaaaaaaccaccttccaagaacttccagaagcttctcccaagccatacaagaagggcatagtagcaaccttaatgggaggaggtttattcaaagaagacaactactttgtgtcccttctgagatcctcagagaaaaaagcccttcaggagctgaaaaccaagctcaaagcttcatttgaagactctccctctgatgcatccatgtggggaattcccctccttggaggtgatgacaaagctgacgtcattctcctcaagttcctaagagcaagggacttcagggttggtgatgcacaccacatgcttatgaagtgtctatcttggaggaaggagtttggtgctgacacaatcttggaagaggaatttttaggcttgaaggagcttgaaggggtggtggcatacatgcaagggtatgacaaagagggtcaccctgtgtgctacaatgcctatggggtcttcaaggacaaggaaatgtatgagagggtctttggtgatgatgaaaagctgaagaaattcttaaggtggagggttcaggttcttgagaggggcatcaaggtgcttcatttcaagcctggtggggtcaattccctcattcaggtcacagacctcaaggacatgccaaagagggagcttagggtggcatccaaccagatcctctccttgttccaagacaactacccggaaatggtggctcgcaagattttcatcaacgtgccttggtacttcagcatgttgtattcaatgtttagtccgtttctgactcagagaaccaagagcaagtttgtgatctctaaggaaggaaatgctgccgagacactctacaaatttatgagacctgaagacattcctgttcagtatggaggactgaatcggcccagtgatttgcagaatggtcccccaaaacctgcatctgagttcacaatcaaaggaggagagaaagtgaacatacaaatagaaggaattgaggctggtgcaactatcacatgggacattgtagtgggagggtgggacttggaatacagtgctgagtttgtgccaaatgctgaaggaagctacaccatagctgttgagaagccaaggaaaatgggggcatcagaagaagcaatccacaactcattcacatcaaaagaatctggcaaaatggtactctcggctgacaacactgcctcaaggaggaaaaaggttgctgcatatcgctactttgtccgcaaaagcagcaccatttga

SEQ ID NO: 799 - DNA, 585 bp, Glycine max var. Williams 82
atgccaaccctcaatgatgtcctcacattctcattcttccttctcctctcttgctattgccacctcctcaatggccaagaggacacctcatttggccatgccatcgacagaaaattgctaggcctaaagagaaaagaaaaactcagccacttcaagttctattggcatgacatagtgagtggtcgcaacccctcgtcggtggcggttgttatgccaccgacgaggatgaacacgaccacagcatttggcttggtcaacatgatcgacaacccgttgaccttgggcccagaattaagttccaagcttgtgggaaaatctcaaggtttttacgcttctgcctcgcagagtgagattggtcttcttatggctatgaattttgctttcattgaagggaagtacaatggcagcaccatcaccatattggggaggaattgcgtcttccacaaggtgagggagatgcctgtgattggagggagtggactcttcaggtttgctagagggtatgctgaggctaggactcattggtttgatctcaaggctggggatgctattgttgagtacaatgtttatgttatgcattattaa

SEQ ID NO: 800 - DNA, 1764 bp, Glycine max var. Williams 82
atgaaagatgcttttgaaatgacagaccttggaaggatgacattctttcttagtatgcaggtgtatcaaaaacagaatgaaatatttctttgccaggaaaaatatgcaaatgaagttctcaagaagtttaacatggctgggtgcaaaccagctgcaactccaatgaatcaaaaggagaagttttgcaaagaagatggagctgaaaaagtggatgaaaagttgtataggagccttataggctgcgtaatgtatttaagtgcatcaaggcctgacatcttgcatgcagtaagcttgttatcaagggaactgaactctagtgaagcacttgagcttttgagtttgtatgcctttaaccaaaatcatcttgatatggagtattataagctattaaagagggtggtcaactattcccaaggcataccattagttgttaaagttttgggtcatctttgtgagaaagataaggaagtttgggaaagtcagctagacaaacttaagaacatgccaaatatagatatttacaacgcaatgagattgagttatgatgatctagatcacaaagaacaaaagattcttttagatcttgcatgttttttcatgggattgaatatgaaagtggaccacataaaagttttattgaaagacagtgaaaaagatgattcagtggctgttgggttagaaaggttaaaagataaagctcttataaccatttctgaagataatgttatatctatgcacgatatcaaacaagaaaaggcttcggagattgttcgtctagaatcaattgtagaccctggaaaccgtagccgattgatgcatcccgatgatacttacgaagtattaaaatataacaaggggactgaggccataagaagcataagggcagacttgtcagtaattaggaagctgcacaaatataatcaagatggatttcctcttcttccttgcggccttcaatctttcccagttgagctaagatatcttgcttggatgcattaccctctgaaatccttggcagagaatttttctgtggaaaacctgaatttggtgaatttaaaagaagttaaagtctctggttctgaaaacttgaaggagctgccagacctttcagaagccacaaatcttgaagtgctggatatcaatttttgtcctcagttgactagtgtgactccatctattttctctctcaacaggcttgagagattgtctgtagcttattgttcccttacaaaaattaccagcaagaaccacctaagctcccttagatatctcaaccttgagtcatgcaaaaagctaagggaattttcagtggcatcagagaatatgattgaactagatttatcatccacttgtgtcaatgcatttacctcatcttttggatattgcacagcattgaagactgtattgtttccatcagttgctcaacaattcaacgaaaacagaaaagaagttctgttttggaattgcttgaaattggatgaagattctctcaaggctgttaaactaaatacacatattaatttgaggaaatttgcataccaacatttatctgcaccagatgaaaattttgatgattataatcgtacttatggatctgatcaggtaaagtatgtgtatccaggaagaagcgttccagaacttacattctatatcactgtgagtgatgatgaggatgaaagtaaaaaggatagcatcaacatctacatgtccaactcaattgtctgggctgcatcagatcatgtgtgtgtgatttatgaccaatga

SEQ ID NO: 801 - DNA, 2136 bp, Glycine max var. Williams 82
atgacactttcttcgtttttgtatattgttttcatatttcatttcttcttcacatccccctcactctctttgtcgtccgatgggctcgcgcttctcgccctaaagtccgccgtggacgagccctccgccgccgctttctccgactggaacaacggcgaccccacgccttgtgcctggtcggggatcgcctgcgccaatgtctccggcgagggggagccgcgagttgtcggaatttccctcgccggaaaatcgctctctggctacctcccctcggagctcggcacgctgcggttcctccggcgactcaacctccacgacaacgccttctctggcgtcctcccggcgcagctctccaacgccaccgcgctccacagcctcttccttcacggaaacaacctctccggcgcaatcccctcctccctctgcaccctcccccgcctccagaaccttgacctctccgaaaacgccttctccggccacatcccggagcacctcagaaactgcaagaacctccagcgcctcgtcctcgccggcaacaaattctccggcgagattccggccggcgtgtggccggacctgcaaaacctcctccaactcgacctctccgataacgagttaacaggctcaatccccagcgaaatcggaaccctaatttccctctccggcacgctgaacctctccttcaaccacctctccggtaaaattccgtcttcgttgggaaaattaccggcaacagtgatctttgacctcaaaaacaataacctcagcggcgagattccccagacggggtcgttttccaaccagggccccaccgcgttcctcggaaacccagacctatgcgggtttccactcaggaaatcgtgttctggttcggaccgaaatttttcttccggttcggaccagaacaaaccggacaacggtaaccggtccaaggggctgagtccggggctaattattttaatctcggcagctgatgctgctgtggtggccttgattggtcttgtgattgtttacatttattggaagagaaaggatgatgagaatgcttgtagttgcattaggaagaggagttttggtgaagagaaagggaacatgtgtgtgtgtggtgggttatcatgttttggtggggtgaagagtgatgatgatgatgatgaagagtttgaaggtggtgagggtgagggtgaaggggaattagtgaggattgataagggtttgagttttgagcttgatgagttgttgagggcttcagcttatgtgttggggaagagtggattggggattgtgtataaggtggtgttggggaatggggttcctgtggctgtgaggaggttgggggagggtggggaacagaggtataaggagtttgctgctgaggttatggccattgggaaggtcaagcaccctaatgttgtgaggttgagggcttactattgggcacatgatgagaagcttctcatcagtgatttcatctccaatggcaatttggctcatgcccttagagggagaaatggccaaccatctacaaatctttcatggtccaccaggctgagaatcgccaaaggaacagcgaggggcctggcctatctccacgaatgcagtccaagaaaattcgtccatggcgacatcaagccctccaacatcctgctagacaacgactttcaaccctacatatccgattttggcctcaaccgtctaatcagcatcaccggcaacaacccctccaccggtggattcatgggtggagctcttccttacatgaactcatcacagaaagagagaaccaacaattacaaagcccccgaggctcgagtccctggctgcagaaccacccagaaatgggatgtgtattcgtttggagttgtcctgcttgaaatactaactgggaggtcaccagagtcatctcccaccacatcaacttccatggaagtccctgacttggtaaggtgggttagaaaaggattcgatcaagaaagcccattatccgaaatggttgatccatctctgctccaagaagtgcgcgtcaagaaagaggttctggctgtgtttcatgttgcactgtcttgcactgaggaagatccagaggctcggcctaggatgaaaactgtctgcgaaaatcttgataagattggaacgtaa

SEQ ID NO: 802 - DNA, 1221 bp, Glycine max var. Williams 82
atggcaaaggcacatcaaatagtgctagggagcaattggggaatcagaaacatttttcagtctcttgtggccatcttaaccactattctagttgtcgctgccatttatctaacacaggagggagaacaatggtctaatgaaaggaacaagttacattcattatcaaaatgtaacttgttttctggcaagtgggtttttgataatgaatcatatccactctacaaggagcatcagtgcacgttcatgtctgatcaattggcttgtgagaagtttggaaggaaggatctaagctaccagaattggaggtggaagccccaccaatgtgacttacccaggttcaatgccacagcattgcttgaaaggctaaggaacaagaggatggtgtttgtgggggattctctcaacagaggccagtgggtttcaatggtttgccttgttgaatcttctgttcccccaactctcaaatccatgcggactattgcaaatgggtcactcaacatttttaaggccgaagaatacaatgcaacaatcgagttctattgggccccattgctggtagaatcaaactcggatgaccctgtgaaccatagggtagccgaaaggactgtgagagtgcaggccatagagaagcatgctaggtactggactgatgcagacattctggtcttcaacactttcctctggtggagaaggcgcgcaatgaatgtgctgtggggttcatttggagacccaaatgggataagcaaaagggtaggtatggtgcgagtctatgagatggccttgaggacctggtcagattggttggaagtccatattaaacctaacaagaccaagttgttcttcgtttctatgtcaccaactcaccaaaagtatgctcatgaatggggaggcactaagggtgacaattgttacaaagaaacagatcaaattacagaagaagggtattgggggaatggttcaattccaagtatgatgcgagttgtggaaaatgtgattgaaaatttgaatggaagaggtttgaatgttcaattgcttaacatcacacagctctcagagtataggaaagaagggcacccatcaatctatagaaagcaatgggaccctctaactgaagaacaattatcaaatccaaaaacttatgctgattgcatacattggtgcctccctggtgtgcctgatgcgtggaatgagctactctatgcctatatttttcatcgatga

SEQ ID NO: 803 - DNA, 513 bp, Glycine max var. Williams 82
atggctagcgatggcagcgaagagttcaggctagtatcaccggcgttcaaaaacggggggaagttaccgaggcactacaccgacgatggtcagggtacgaagaagaacatatcccctccattggagtggtataacctcccggaggggacgaagactcttgccctcgtggtggaggatattgatgcgaccgattctggtgggcccatggtgccatggactcactgggtcgtcgcaaacatcttggccacggtgaagggcttgccggagggattttccggcaaatcggccgagatggggggcgactacgcggcgatcaaggaggggaacaatgacctgaaggtgcctgggtggaatgggcccaggctgcccacgcctggacacaggattcagtttaggctctatgctttggatgatgagctcaagcttggtaacaagttgacgaaggagaagttgttggaagataccattgaaggacatgtgttaggagaagcgaccttgatggctatattctaa

SEQ ID NO: 804 - DNA, 1257 bp, Glycine max var. Williams 82
atgatgaagcctcccagtggaaagtttcctatcatcaaaatctgtgttcttatattcattattatcttgtatgcagagagtttcaagttcctttcttccggttccattttcaatttcaaaccatgtcctacaaatagtaccaagcctaaatccaatgataacaagatacaagaggtggttcctaatgattcactatggtttcatgatggattcgtttatgaccctgaggagtgcgattttacaaatggaaaatgggtgtttaacagttcaataaagcctttgtattcagacaaaacttgtccatacataagtagaccttattcttgtgtcaacaatgggagggtagattctgactactgttattgggaatggcagccagaagattgcaccttgcccaagtttaatccaaagctagctcttgaaaagcttcaaggaaagaggctgctattcgtaggggattcactgcaaaaaagccaatgggaatcttttgtgtgtatggttgaatggatcatacctgaaaagcagaaatctatgaaacgagggactcattcagtcttcaaagccaaggaatataatgctaccatagaattctattgggccccaatgcttgtggagtccaacactgagttttttaccataagggatcccaagaagcaaatagtaaaagttgatgccatcatggatcgtgccaagaactggacgggagtggatattcttgttttcaatacctatgtatggtggatgagtgacattaaggttaaagcactatggggttcatttgccaatggagaagaagggtatgaagaattagacgcacaaattgcttacaacttaggtttaaggacatgggccaattgggttgactcaactattaatccaaacaaaaccagcgtcttcttcacaactatgtccccaacacacacaagaagcttagactggggcaacaaagatggtatcaaatgtttcaacgagacaaagccaatagggaaaaagaatcattggggaagtggctctaacaagggcatgatgagcgtggtggaaaaagtggtgaagaaaatgaaagttccagtgacatttatcaacataacacaaatctcagagtataggattgatgcacattcctctgtttacactgaaactgggggaaagctattgactgaggaggaaaaggccaatccaagaaatgcagattgcattcattggtgtttgcctggagttccagatacttggaatcaaatatttttgacaatgttgtaa

SEQ ID NO: 805 - DNA, 1284 bp, Glycine max var. Williams 82
atgataccttcaggaacaatgaagcctcccagaggaaagcttcctctgccaatcattatcaccacaatctgtgttcttctcttcatagcagtcttgtatgctgagagactaagtttccttaactccagctccattttcaagtccaaaacatgtcctagaaagcacaacaaatcaaagtctaatgataaaaaatctgaggaagtgtttgcaaatgcctcgtggatcgatgataggttcgattttgacccagaagagtgcaatgttgcaaatggaaaatgggtgtttaacagttcattgaagcctttgtactcagacacaagctgtccatacatagacaggcagttttcttgtgtcaagaatggaaggaatgattctgattacctccattgggagtggcaaccagaagattgcaccttgcctccgtttaatccagagctagcactcaaaaagcttcaaggaaagaggctattattcgtaggggattcactgcaaagaaatcagtgggaatcttttgtctgtatggtacaaggtatcatacctgaaaagaaaaagtcaatgaaaagggggcgtgttcattcggtcttcaaagctaaggaatataatgctaccatagagttctattgggccccatttctagtggagtccaacactgacattcgtatcataggagacccaaagaagagaataataaaagtggatcaaatcacggagcgtgccaaaaactggacaggagtggatatactagttttcaacacctatgtatggtggatgagtggtcttagattaaaagcactatggggttcatttgccaatggagaagaagggtttgaagaattggatacaccagttgcttacaaactaggtttgaggacgtgggccaattgggttgactcaactattgatccaaacaaaacccgggtcttcttcacaaccatgtcccctgcacacacaaagagcgcagactggggccacaaggatggtatcaaatgtttcaatgagacaaggcctgtaaagaagaagaatcactggggaagtggctctaacaaggacatgatgagtgtggtggccaaagtggtgaagagaatgaaagttcctgtgaatgtcatcaacataacgcaaatctcagagtacaggattgatgctcattcctcagtttacactgaaactggggggaaaattttgagtgaggaggaaagggctaacccactaaatgcagattgcatacattggtgtttgcctggagttccagatacttggaatcaaatatttttggcgatgttgtaa

SEQ ID NO: 806 - DNA, 1834 bp, Glycine max var. Williams 82
agttatcaccttattttgcgtgcctttccgtcgtgctttttattaaaataccctccttccttcctaccataccatactgcccagtttcttctccatctaccacttggctttcacgtttaccttcgcagcgctctttctctctgaaccctaatttacacacactccctttattcgatccctctctccaaccatggcgatcaactcttccaagaatccagatggttctgtccaaaatgcaatgccttcgtatttttattctccaccactagatgtttctgctgcatttccacaagcaacaccagcatcaacgtttcctccttgtgcttcagattattttcaattggacaacttattgacaacagaggagcaagccattaggaagaaagtaagagagtgtatggaaaaagaaattgctccaataatgactgaggcatgtatttgtgatgctgttactacttggatggaaacaattacgatgtgaaattattctcccataatgttatcttttttctttctttcaatcccatcatcatgcaattttttttttcttctcagtactgggagaaggccaagtttccatttcatgttattccaaagcttggtgcgttgcgcattgctggtggcacaatcaaggattatggttgtcctggtctttctatcactggaagtgctatagctgtggcagaagttgcaagagttgatgcaagttgttcaacttttattttggtccattcatccttggcaatgctcactattgcattatgtggatcagaagctcagaagcaaaagtatttgccttctttggcacaattgcaaactgtagcatgttgggctttgaccgaacctgactatggaagtgatgctagtgctttgaagaccactgccacaaaggtggagggaggttggatcctggagggtcaaaagcggtggataggaaacagtacatttgctgatgttttggttgtctttgctaggaatgcatcaactaatcagataaatggatttattattaaaaaggatgctcctggtttaacagtcacaaaaatagagaataaaattggactcaggattgtacaaaatggagacattgttatgaggaaagtttttgtccctgacgaggacagaattgcaggagtaaactcttttcaggacacaaacaaggtacttgctgtttcacgcgtaatggttgcttggcaacccattggtatatcgatgggcatctacgatatgtgtcacaggtacctaatggagaggaaacaatttggagcaccattagcagctttccaaatcagccagcagaaacttgttcagatgcttggtaatattcaagctatgatacttgttggttggcgcctctgcaaattgtatgagagtggtaaaatgactccaggtcaagctagcttgggaaagtcatggatcactttgagagcacgagaaacagctgccttggggcgagagttgctaggtggcaatggaattttggccgatttccttgtggcgaaggcattctgtgatttagaacccatctatacctacgaaggcacgtatgacattaataccttggttacaggtagagaagttactggttttgccagctttaagccagttgctcaaagaagtcgattgtaaaagtgaaacacattacatgctccttttgtagactccattaggcaacttcaatgtatggcatgtgactgtgactgtgtattggttaatgttttgtattttgagaattgagaagcatttaatttaataattatacaaatgctcgtgttgatggcaacagaatgagaaaaaaattagagttcttgaatccagatattttttcacattt

SEQ ID NO: 807 - DNA, 504 bp, Glycine max var. Williams 82
atgtctttgactctttgtagatacaaagatgcaaaaagcaacacattcttgccaaaagatgcttccacaactattaactcagagggctttgttctccttgatattaggccaacttgggagagagagaaggcacgtgtggcagggtctttgcatgtgccaatgtttgtggaggacactgataacagtccaataactctgcttaagaagtgggtgcattttgggtacattgggttgtggactggccagtacctcactactttgaattctgagttccttattcaagtggaaaattccattcctacaggtaaggagaccaagcttcttgtggcatgtggaggaggattaaggtcaatggcagcagcttcaaaactatacaatggaggttacaaaaatcttggatggttggctggaggctttaatctttcaaagaacaatgacttcccaacagtagaaggaaaagaaaagttgcagcatgcaactgtagggggtgcttcttatttctaa

SEQ ID NO: 808 - DNA, 1053 bp, Glycine max var. Williams 82
atggcaccatttcccacttcccattacttcagggccttcactttctccattttgttcctcaaaaccctagcttttgacccaattcctctgttttcctatgctggctttggaaaagatctgaaatttaagcccaacgtggccctttttggtaatgcaaaggttctcaatgaagggtctgggattcatttctctggctttgggagttcaagaggcactgggagaatcatgtacaagaaacccatcaagctttctcaaggtaaaccaaggcaattagtgtctttttctacttactttgcattttcagtgtccttggaagatgggggtggcttggcttttgttatggctccaaagggttctcaaggtaatgtgttttatcaaagttcttcttctgggttgaatgatggaaaatttgaagttgttggtgttgagtttagtgcctcaaagagtggtagaaaaggggtttcttctagttgtgatgtgaacatgaatattggtggttctgttgttgctaaaaaaagtaacacctctattggagaaaagttgcatgtttggattgactatgaagctagttcgaggcgcttagaagtgagattgagtcagcatggtaaagcaaggccatcatatccattgatgtggcattcaattgacttgtcaaacgtgttgaaggagaatgaaatgtttgtggggtttagttctgtaaaggggaataatgattctcaagcatgcgatctctattcatggagctttgttctgagaaattttccacattcaatgcattcagagcctctggatccaaaggtctttgttaaaaacactgaaagtccagtggctaaacaaaggagtgattgctttttgagtgttcttgctgcaatgatatttggtactggatgtggagctttaacagcatttattgtgctttacttgtggaccatctttggcaacaataaacgtgcagtggtgccagaggagtctcttgtggaacctgtagatgttgattataggaaaaaagtcaaaattgttgtagataaaaccatcgaagatggtaagaagtag

SEQ ID NO: 809 - DNA, 1473 bp, Glycine max var. Williams 82
atgaacgggaagagctttaagagcatcgagaatggacaattgatattgcagcggttcaaggaggattgggtttcggcccagagggttgtctccgagtccaggaccagaaccgaaacctccatgcccaaacgcgtccttgagaggctcacgactccagaaatatggatgaagccaaacagtgacaaatattacaaatgcgtttctccacccaggaatgtaataaggccaaaacagacaaatggctatcttcttgttcatgcgaatggtggattgaatcaaatgagaactgggatatgcgatatggttgcagtggcaaaaataatgaatgccacccttgtccttccttctctagaccatgattcattttggactgatccaagtgactttaaagatatctttgactggagacacttcgtgaaagttttgaaagacgacattgagatagttgagtacttaccggtccagtatgcgtcgctgaaacctcttgtgaaggcccctgtttcctggtcaaaggctagttactacagaggtgagattcttccattgttgaagcaacatactgttgtacagtttactcacacagattcccggctcgccaacaatggccttgcttcctcattgcagaagctgaggtgccgtgccaattaccatgctctcaagtacacggcagaaattgaagagcttggaagggtcttggtgaataggctaagaaacaataaagaaccatacatagcccttcatttaagatatgagaaagacatgctatcctttactggctgcagtcacaatctcactgctgaggaggcggaggaacttagggttatgaggtatgaagtgaagcattggaaggaaaaagagattgatagtgtggatagaagattacaaggggggtgcccaatgtcacctagagaggcagctatttttctcaaggccatgggatacccttccactacaacaatctacattgttgcaggacctatttacggtggcaatagtttggaagcctttcaatctgtgttccctaaagtattttctcattctacccttgcaactgaggaggagctagaacccttcaagccatatcaaaaccgtctcgctgctttggattatatagttgcccttgaaagtgatgtctttgtgtatacctatgatggaaacatggccaaggcagtgcagggtcataggaggtttgaagggtttcagaaaaccatcaatcctgacagattgaattttgttaagctgattgatcaactggacgagggtgccatatcttgggaagcattcgcttctgaggttaagaatttgcattccaataggctaggcgcgccttatcttagacaagtaggagagtcaccaagaatggaggagaatttttatgccaatccctttcctggttgtgtatgcaacaagtctcaggagcaaatcacaagccagaaactagaccatcagtttggtattggagcacaaagatag

SEQ ID NO: 810 - DNA, 918 bp, Glycine max var. Williams 82
atggtggcagattctaagtccaattccgacctctccttcggaaaaatctttgccagcagtgctttctctgcatgtttcgctgaggtgtgtactattcctttggatactgccaaagtgaggcttcagcttcaaaagcaagctgtagctggtgatgttgtctccttacctaaatataagggtatgctgggaacagttggaaccattgccagggaagaaggtctttcagcactctggaagggcattgtgccagggttacatcgtcaatgtttgtatggaggcttaagaattgggttatatgaacctgttaagactttctatgtggggaaagaccatgttggagatgttccattgtcaaagaaaattcttgctgcatttacaactggtgcttttgcaattgcagtggcaaatccaaccgatcttgtcaaagttagacttcaagctgaaggaaaattacctcctggtgttcccaggcgctactctggatctttaaatgcttattcaacaattgtgagacaggaaggagttggggctctttggactgggcttggccccaatatagcaagaaatggtatcatcaatgctgccgaattagccagctatgatcaagtgaaacagactattttgaaaattccaggattcactgacaatgttgtaactcatcttcttgctggtcttggggcagggtttttcgccgtctgtattggctccccagttgatgtggttaagtcgagaatgatgggagattctagttacaagaacacccttgattgttttatcaaaacattgaagaatgatggacccttagccttttataaagggttcctcccaaattttggacggctgggatcttggaatgtgatcatgtttctaaccttagaacagactaaaaagttcgtcaaaagtttagagtcgtcctga

SEQ ID NO: 811 - DNA, 930 bp, Glycine max var. Williams 82
atgaacaggggaattgaagttctttctccagcctcatacctccgaagttccaattggctgttccaagaaagcttggggaccaggtggactccacaggagaacaagctctttgagaatgctttggctgtgtttgacaaggacactccggaccggtggctgaaggtggcggccttgattcccggcaagacggtcggcgatgtgatcaaacagtatagggaacttgaagaagatgtgagtgtcattgaatcagggtttattccacttccagggtacactgctgctgattcctttacattggagtgggtcaacaatcaaggatttgatgggctcaggcagttttatggtgttactggcaaaaggggtgcttccactagaccatctgagcaggagaggaagaaaggtgtgccatggactaaagaggagcacaggcaatttctgatgggtctgaagaagtatggtaaaggagactggagaaacatctctcgcaattttgtgaccacaagaacaccaactcaggttgcaagtcatgctcagaagtatttcatcaggcaactaagtggaggaaaggacaagaagagatccagtatccatgacatcacaatggtgaatctcccagaagcaaaatctccttcatcagagagtaacaacagaccctattcaccagatcactcagtgaaggatgtgaatccaccatcccagaatcaaagattgtctactactatggtaattaaacaggaacatgattggaaattgccatgtgaaactgtgcctatgcttttcaattccacaaatggaaacatgttcatgacaccactttgtgggatttcttcatatggatctaaaccacttcaggagcagtatttcctcagtggatgccagtttggaccttatgatacaattatgcaaatgccgtccatgcaaaatcaatga

SEQ ID NO: 812 - DNA, 1404 bp, Glycine max var. Williams 82
atgccttcctcttccaccaccatagtctccaaatgcgtgatccaccccgaccagaaatcaaacatgaaacccttgagactctctgtttctgaccttccaatgttgtcatgtcactacatccaaaagggcgtgttactcaccgccccgccctcctcttttgacgacttaatactttcttttaaacacactctttctatcgcgctctctcactttcccgctctcgcgggaaggtttgagaccgattccaacggttacgttaatattgtatgcaacgacgctggcgttgattttattcatgctaaagcaaaacacctaactttaaacgccgtcgtttcgccgtccctcgttgatgttcacccttgcttcaaggaggagttttttgcttacgacatgactatctcctacgccggccacaacacacccctcgccgccgtccaggtgacggaactcgccgacggagttttcgtcggctgcaccgtcaaccactccgtcaccgacggcacctcgttttggcacttcttcaacacctttgccgccgtcaccaaaggcggcgccgccaaaaaagtcctccgagcaccggactttactcgcgacaccgtcttcaactccgccgccgtcctcaccgtcccctccggcggccccgccgtcacgtttgacgtaaaccagccactccgggaacgcgtcttccacttctcccgcgaagcaattcagaaactcaagcaaagagccaacaacaccgtcaacaacgaactaacggaagttatgggaaaacaagtaaacgacggttggaaaatcgttaacggtaacggaaaaattaacggtaacggaagaaacgagatctcgtcgtttcagtcgttatcagctcagctctggcgagcggtgacacgtgcgaggaaattcaacgacccagcaaaaacgtcgacgtttcggatggcggtgaattgccgccaccgtctagagccaaagatggacgcgttgtacttcggcaatgcgatccagagcatcccgacggtggctaccgtcggagaaatcctctcgcgcgatctgcgcttctgcgcagatcttctgcaccgtaacgtcgtcgcgcacgatgacgctacggtgcgccgcggcatagaggattgggagagcgcgccgaggctgtttcccctcggaaacttcgacggcgcgatgatcaccatgggaagctctccacgttttcccatgtacgacaacgacttcggttggggtagacctgttgcgattcggagtgggaaagcgaacaagttcgacggaaagatttccgcgtttccagggagagagggaaacggcagcgtcgatttggaggtcgttttggccccggccaccatggcggggctcgaaaacgacatggagtttatgcaatacgtaacgcaggtcgtttga

SEQ ID NO: 813 - DNA, 1286 bp, Glycine max var. Williams 82
tcccccttctccctcttgcttctttcaacaacttagcattgtattgtcttcaaactttgcttcttccatactttcttctttttccttagccatcattgattgttgcctttcttggctttaaaatggagttcgaggaccgcttcagacaccaggctcagagaccaaaatatgactgccttctttttgatttagatgacactttgtatcccctcaaatctggtcttgcaaaatcatgtctccaaaatattaaagactacatggttgagaagcttggcatacaccctagcaaaattgatgacttgtccaacctcctttacaagaattatggaacaactatggctggtctaagggcaattggatatgactttgactatgatgaatatcacagttttgttcatggaagattaccttatgagaacctaaaaccagaccaagttctgaggaacctgttgctgagcctaccctatagaaaacttatcttcacaaacgcagacaaagttcacgcggcgaaggcgcttaacaggcttggattagaagactgctttgaaggaatcatatgctttgagacccttaatcccatccacaagagcattgtttctgatgatgaagatgacattgagtttgtaggttcaagaaccaccaatccaaccaccacttgtaatggttcaggcacctctcaaatctttgacatcatagggcattttgctcagctcaatcccagtgcagtcttgccaaagacaccaattgtttgcaagccatcagaaaatgccattgaactggccctcaatatagccaatcttaacccacagagaactttgttcttcgaggacagtacccgcaacatacaagctggaaaacgtgtggggcttcacactgtgctggttggtacatcacaaagatgtaaaggtgcagattatgctttggaaagcattcacaaccttagggaggctgtgcctgaactatgggaggctgatataaaatcagaagctgcataccctggaaagctagctgtggagacatcagtcacagcttgagattattattatgtgcatgaaattaattaagccccttcaatattgttcatttaatcaaaattgaaaacccgaccaccaacaaaaaaaaaagagagagagagaagaagcccacgggaattcccccaacttcagatgatgtagttgtagttgatgtagatgctttgtaagttgcaataaattagtcattcaaataagtcctcctttttggccttactatattaagaatctaactaattaccttcctcattcagc

SEQ ID NO: 814 - DNA, 243 bp, Glycine max var. Williams 82
atggagtcagtgactacaaggctttccccaaaggtagttggaggggcaaactcccaacatggcatggagtggtgtaggcactttcagatgccactgcactatccaaggtacacccaagctgactatgaggcaatgccagagtggaggcttgactgtttgctcaaagagtatggcttaccaatctttggggatgttgaaaacaagagaaactttgccatgggtgcctttctatggatcaagtga

SEQ ID NO: 815 - DNA, 1332 bp, Glycine max var. Williams 82
atggacaaaacaaaacgtgtttcatttttatgttgttttggcatcaaaactaacggtctttcagttaagttactttctcgttcgttccctctcaaccaaaaccaaccacttcatgttatcattgctatgacccttcaagcttttcatggctctgcatgttgtttccgttcccaccttcttcacttttcttcttccaccgcttcatctccaccattccttgcttcgaggaggttccaatcatgcccttcaacaagaaaatctctcaagttgaattgcagttcaagtggcaataatggtgaccaagattaccttctggatgctccagtttctgttggagatggattctctttcagtggagggaagtattcagatggccctagtccaagtgatgaatggtttaagcaagggaaaaaggttaaagcctattcaatacctggcactggtgaaaaggcaaaagatccaatttttggacttgctatgggttccggttctcaagctactggcgatcgtttcagatggttttgtgttgaaagcggaagtgctgataatccttcagtgatattaatccatggtttcccttcacaggcatattcttaccgcaaagttcttccagtactctccaaggactatcacgtcatagcctttgactggctaggatttgggttttctgacaagcctcaacccagatatgggtttgactacacactggatgagtatgtctcatcattggagtcacttattgatgaactggctgctactaaagtctcacttgttgtccagggatatttttcgcctgttgtagccaagtatgccagcattcaccaggaaaaagtcagaaacttaatactccttaatccgcctctaacagcccaacatgccaagcttccaccaacattgtccatattcagcaactttctactaggtgaaatattttcacaggatccattaagggccagtgacaaagctctaacaagctgtggcccctataaaatgaaagaagaagatgcaatggtctatcgaagaccctatcttacatctggttcctctggctttgctctaaatgcaattagcaggaacatgaacaaagacctcaagagatatgtggaggatatgcaaacaatactgaaggacaaaaattggaaagttcaaaccacaatatgttggggccaaagagaccgctggttgagctatgatggagtggaggatttctgcaaggattccaatcataaactcattgatgttcctacggctggtcatcatgtgcaggaagattgtggcgaagaagttggacaacttattcgtgggataataagcaaaaggaccaagatatag

SEQ ID NO: 816 - DNA, 1857 bp, Glycine max var. Williams 82
atgacgagcatggagagcttgatcggcttggtaaatagaatccagcaggcctgcaccgtgctcggcgactacggcggcgccgacaacaacgccttctcttctctttgggaagctcttccctccgtcgccgtcgtcggtggccagagttcggggaagtcttcggttttggaaagcatcgttggacgtgactttcttcctagaggatcaggaattgtgacgaggcgtccattggtgttgcagcttcataaggttgacggtaaagcgaaggagtatgcagagtttcttcacatgccagggcagaagataaccgattatgcgattgtccgtcaggaaattcagaatgaaactgatagagtaacggggaggacaaaacaaatatctcccgttccaattcatcttagcatttattctccacatgttgtcaacctaactttgattgatttacctggattgactaaagttgctgtagagggacagcctgagactattgctcaagacattgaaaatatggttcgatcttttgttgacaagcctaattgtattatactggcaatatctccagccaaccaagacatagcgacttctgatgctattaaactttcgagggaggtggatccctcaggtgagaggacatttggagtgttgacaaagctggatttgatggacagaggaactaatgcattggatgtccttgaaggaagatcttaccgtctgcaacatccctgggtcggtgtagtaaatcgatcccaagcggatatcaataaaaacgttgacatgattgttgctagacgtaaggagagtgagtattttgaaactagtcctgactatgggcacttagccaataaaatgggttctgtataccttgcaaaacttctctcacagcatttggagtcggtaattaggcaacggatacctaatataacatctttgataaacaaaacaatcgaagaacttgaatcagagatgaatcaaattgggagacccattgctgctgatgctggggctcaactatatactatcctagaactttgccgcgcatttgatcgggtattcaaggagcatttagatggagggcgaccaggaggagataggatctataatgtctttgacaatcagcttcctgcagcgttacggaagcttccattcgaccggcatctttctcttcaaaatgtaaggaaagtggtatcagaggcagatggttaccagcctcacttaattgcaccagagcaaggttaccgacgcctcattgagggagctctcagctactttagaggtccagctgaagcttcagttgatgcagttcactttgtcttaaaagaacttgtgaggaaatcaatagctgaaactcaggaactgagacgtttcccaactctccaagccgaaatagcagcagctacaaatgaggctttagagaggttccgcgaagagagtaagaagacagctatgcggcttgtggacatggaagcttcctatctcactgtggagttcttcaggaaactgcctcaagaaatggagaaagctggaaatccagctaatcaagctactccaaatgtggatcgatatggagaaggacattacaggaggattggatcaaatgtatcttcctatatcagtatgatatcagacactctcaggaatactattccaaaggctgtagtgtattgtcaggtcagggaagcaaaactgtcattgctaaaccatttctacatacaaataggaaagaaagaggctaaacagctatcacaattgttagatgaagatcctgccttgacggggaggaggcaacaatgtgctaaaaggcttgaactatataaagcggcaagggatgaaattgattctgtttcttgggcacgatga

SEQ ID NO: 817 - DNA, 1173 bp, Glycine max var. Williams 82
atggaagactcgtgggagaattggatttcttctttggaaatgggtgaagacaacaattccaatggtcaatctcacactaactcactggatcgggataagctcctcactgggattgacctagagccaccagatttctcatttcatcaaagtgaccaccaccaccaccacacttataccatgtcatataatcatcatcatagtaataacaatgattttcccactacaagcaccatgggaagtagtagcttatcctatgatgaagatgcaagctttgatgagaggcatggcaaaatgctcaagtgtaatagctcaaactccatcaatatttctcaagatgttgccaattcacacataccctcctcctcttcagcaccttccaaatctaccttcattttgtcctttgaaaactcaactgttgaacctgccctccatgatagagtacctaattattataataattcccctaataagcattttgaggccacatgttcttcccttttgagctcagaaataacactcatcagcagtgaccatgtcatcactaaaccaaaagcaaagcaaggggccaagaagtatagaacctcatcagagatcaaagatcacataatggctgagaggaaaaggagacaagacctcactgagaggttcattgcactttctgccaccatacccggattgaagaagacagacaaggcctatatacttcaagaagctatcacatatatgaaacaacttcaggagagagtgaaagtgctagagaatgagaacaagaggaaaacaacatattcaaaaatattcatcaagaaatcacaagtgtgctcaagagaagaagccacatcatcatgtgaaacaaactctaattatagatccacgccaccaccactacctcaagttgaagcaagaatgttggaaaaggaagttctcattggaatccactgccagaaacaaaaggatattgtgctcaaaatcatggccttgcttcaaaatctccatctctctcttgctagtagtagtgtattgccatttgggacttctacagtaaaagttacaatcattgcccagatgggcgacaaatacggtatgacagtgaatgatctagtaaaaagactgaggcaagatctcttgaagtcacatgacattcaagagtcacattccaaagagtgccaaatatga

SEQ ID NO: 818 - DNA, 810 bp, Glycine max var. Williams 82
atggctagtgtttcttcggttttagctccatttagaaggcttgatgggaaggtggcgattatcactggtggtgcgagtggtctaggtgcagccactgcaagactcttctctaagcatggagcatatgtagtcatagctgatattcaagacgacttgggtctctctgttgccaaagagttagaatctgcttcctatgtccattgcgatgtgacaaaggaagaggacgttgaaaactgcgtgaacacaacggtttccaagtatggcaaattagatatcatgtttaacaatgcaggtgtatctgatgagatcaaaacaagcattcttgacaacaacaagtctgattttgagagagtgataagtgttaacttggttggtccttttctgggaacaaagcatgctgcaagggtcatgattcctgctaaaaagggatgcataatcaacacagctagtgttgctggatgcataggtggaggtgctacacatgcctacacaagttcaaagcacgcactaattggactgacaaaaaacactgcggtggagcttggacaacatggtattagggtaaattgtttgtcaccttatcttgttgtcacaccgttaagtaagaaatatttcaatattgatgaagacaaaattcgtgagatatattcaaacctaaaaggtgctcatcttgtgcctaacgatgtggccgaagctgctctttacttggcaggtgatgagtccaagtatgttagtggtcacaatcttgtgatagatggagggtacactgatgtaaatgcaggatttaccgtgtttgggcagtctcagtaa

SEQ ID NO: 819 - DNA, 1401 bp, Glycine max var. Williams 82
tctttttgcttcctaaggaggaaaaagcaattagtgcactgtacacagaccgaccaatccattagacaattcgaaaacggtttcgtgaattgatgtcggttcacctaaattttctcttcgcaataaaaagtggggtccgaacgaacttccattgcatgggagtgaactctatataagaccaacgccaacttcagataaaggcacatccttcacgaccacataagcaattaattaagcactctaaaacatatctttatttccttgtctacatatcttgaaaaactcaatcatggctagtgtttcttcggttttagctccatttagaaggcttgatgggaaggtggcgattatcactggtggtgcgagtggtctaggtgcagccactgcaagactcttctctaagcatggagcatatgtagtcatagctgatattcaagacgacttgggtctctctgttgccaaagagttagaatctgcttcctatgtccattgcgatgtgacaaaggaagaggacgttgaaaactgcgtgaacacaacggtttccaagtatggcaaattagatatcatgtttaacaatgcaggtgtatctgatgagatcaaaacaagcattcttgacaacaacaagtctgattttgagagagtgataagtgttaacttggttggtccttttctgggaacaaagcatgctgcaagggtcatgattcctgctaaaaagggatgcataatcaacacagctagtgttgctggatgcataggtggaggtgctacacatgcctacacaagttcaaagcacgcactaattggactgacaaaaaacactgcggtggagcttggacaacatggtattagggtaaattgtttgtcaccttatcttgttgtcacaccgttaagtaagaaatatttcaatattgatgaagacaaaattcgtgagatatattcaaacctaaaaggtgctcatcttgtgcctaacgatgtggccgaagctgctctttacttggcaggtgatgagtccaagtatgttagtggtcacaatcttgtgatagatggagggtacactgatgtaaatgcaggatttaccgtgtttgggcagtctcagtaaaaattgtagctgtgtcttcaaagttaaatcattattgttggtgtttgaagtgtctgtgtttcgatggccctgtagttcagaaacttgagctgttagcatgtgtgaagaaaaagaaggcaaattaatacagggtgatatgatacctgccttactgattatcgtggatgtgtgtgaagtgtctgtattcgtgctgttttggctttcgtgactctgtttcgattgctttgaagttcaaaaactttataggattatattaatatatatgcctcactcttagctagcagctgtttttgcattcaaaa

SEQ ID NO: 820 - DNA, 678 bp, Glycine max var. Williams 82
atgtcagaattaacaaatgaagagcacgaacagtgctgtgaaatggccaagatcatgctaaatgtcacggttgcatcagagactattttaaacaccgttaacgccaaggaccagatttacgatgaagttaataggtcatttgttgtgaggtggaaagacgtacttgaccgtttctggcatttgcttgacaaggatggaaatttccataccgttctttacaaccaaaatttggacagaccaacaattgtagcagggtggacaacactaagagatttctatcacatgaccgaagatcatcaagtgtcgttaacccattatggtaagagtgtattttttctcaccgtattcaagagcagtagccatccaaaatctttctcaagatggtactcattataccatcaagttccaaattctgtcactttcaacgtgtttttcactcagcacaaaattacctgcagcagcctgaaagctgttgggtgccccaagcagttgccttacgaagggcatttgaatcctatattctttttatttgtattctgcacttcttattacattatgcttattctgaaatgtaaatttgtatttggtaatgagctttctagactacaacaagaagtattggatgtaatagtgggagttcaggaaacaaatgccttcaccaagtttgaattaatgtga

SEQ ID NO: 821 - DNA, 699 bp, Glycine max var. Williams 82
atggctcaagcaatggcatcaatgactagcttacgtggttcctctcaggctgtgttggaaggtagccttggctccacacgcttgaatgtggggagtggaagcagggtggcctcagtcacacgtgcagggttcacagttagagcacagcaacaacaagtgaatggtggtgaggtacaaagtagccgtagggcagtgctttcacttgttgctgctggtttgaccactggctcttttgttcaagctgtgcttgctgatgccaaacctatcaaagttggaccacctcccccaccttctggcggattacctggaacattgaactcagatgaaccaagagaccttaagctgccattgaaagataggttcttccttcaaccattgtctccaactgatgctgcacaaagggcaaaggaatcagccaaggaaattgttggcgttaagaagttgattgaaaagaaggcttggccatatgttcagaatgatctgcgtctcagggccgagtatctgcgctttgatctcaacactgtcattgctgcaaagcctaaggatgagaagaaatcactcaaggaactcactggcaagctcttccaggatatcagcaatctggatcatgcagcaaaaattaagagcagcccggaagcagagaagtactatgctgctactgtatcttctctgaacgatgtccttgccaaacttggttaa

SEQ ID NO: 822 - DNA, 1335 bp, Glycine max var. Williams 82
atggggtctactattgaatatcacatccaacacataattaaaatcccagaagagattgagcctgcattgtggccagaatgttgtatctacaaggtacctactagtcttttgaaggtgaaagaggtggcctacactcctctattgatctcaattggccctatccaccataacaaagagcaactaatggaaatgcaagagcagaaacacagatattttcatttcttttgggcacgcctaagcctaatgaacaagcttgattttgtgcactacaaagccttccttgaactagaagagcgaaacctacgccgttgttaccaaaagaaattccccgaaatcagcaaggagcaatttgtggagatgctgctgctggatactgtgttcatcatggagctgtttctgagagaagcgaaaaaatgggaacataaggatgactatctaatgactcaaggatgtgttagcaaaagtatccggtgtgacttgatgctgcttgagaatcagcttccaatggtagtgttggaaaatctatatgatagagttgttccaagcaatgccaaaaaacacaccagatttattaaccttgctcatgagtactttagatcttattatcctcatcagcaatcttcagaaaacaagtttgagctgagaaagtgggagaaatcactgcatttcactgatttaattagaaatgcctatctccctaagaaactgagcagtcagaaaaactatcctcaaaaggagtgtgtgctaaggactgcaacaaagttgaatgagtctgggataagctttgataaggttgacgagagatgcttacttgacgtaaagtttgagaagaagcgatttttcagctggtttctttgcttgggttgcttgccatgctgcaagttgttcaaagctaggtttctaatcccccagttgaaagtagaccacacaacagaatgtgttcttaggaacctgatagcctttgagcagtgtcactatcctgaggagccttacatttgcaactatgtttctctaattgactctcttattcacaccaaagatgatgcagagtttcttgttgagaaagaagctattgtccatgaactgggaagtgatcaggaattggcaaatttggttaatgatcttagtaaacatgtggtgacaaattcaacatgctaccaccaaattattgaagatgttaatgaacactacaacaataattggaagtgggcaatgggtacattaaggtgggtttacttccgtgacccttggagaagcagttctactatagttggagttgctgtcctcgtattcaccatcttcaacttctaccgcgtaactgatctactcttttag

SEQ ID NO: 823 - DNA, 474 bp, Glycine max var. Williams 82
atgcattcatcatcatcatctatggctcttcttcctccttcttctctcggaacccttttccatatctcatctcaacattatcttcttaataattcctttcacaatcccatcactctcacaccatcatctttcaatccacccactcataattattcaaagcagcaccgggaccacagaagcttcaactccaagctcttggctatttcttacagatatttcattgaagaagaagatgacgacgatgacaataaaggtgaaaaccagaactttgatgaagcagtggctctcttcaacggaggagagtactacaaatgccatgactatcttgaagcactttggctcaatgctgaagagcccaccagaacactcattcatggaatactgcaatgtgcactggatttccaccacctcttcaaccaggttttcatacatttaggcttaattacaattttatttcatcgagattattgctaa

SEQ ID NO: 824 - DNA, 1275 bp, Glycine max var. Williams 82
atgctcctccttagtcctcctcagcctcaacttcaacctttcttcacttcccttcacatggcagctcttgtgaaaccaatttccaatgtcactcccaaatttgtcagcagccccagaatgggctcatcacactcctccaaattcagcaccataataagaatgtctgccactgccaccccaccaccatccacctccacaaagccagcaagcagcaagaagggcaatatcaaggagaccctcttgactccaagattctacaccactgactttgatgagatggagacactcttcaacactgagatcaacaaaaacctcaaccaggatgagtttgaggcactgctccaggagttcaagactgactacaaccagacacactttgtcaggaacaaggagttcaaggaagccgctgacaaacttgagggtcccctcagacagatctttgtggagttccttgagaggtcctgcactgctgaattctctggcttccttctctacaaagagcttggaaggaggctaaagaaaaccaaccctgtggtggctgagattttctcactgatgtctagggatgaagccaggcatgctgggtttttgaacaagggtttatctgatttcaatttggctctggacttgggtttcttgaccaaagctagaaaatacacatttttcaagccaaagtttatcttctatgctacatacttgtctgagaaaattgggtactggagatacataaccatatacagacatctcaaggccaaccctgagtttcaatgttatcccatttttaagtactttgagaactggtgccaggatgagaacagacatggagatttcttctctgccctgatgaaggcacagccacaatttctaaatgactggaaggcaaagttgtggtctcgattcttctgtctatcggtttatgtcacaatgtatctcaatgattgccaacgtacagctttctacgaaggcattggacttaacacaaaagaatttgacatgcatgtcattatcgagacaaaccgcacaactgctcggattttcccagccgttcttgatgttgaaaacccagagttcaagcggaagttggaccggatggtggagataaatgagaagcttgttgctgttggtgagagcgatgacatagcggtggtgaagaacttaaagaggatcccactggttgctgccttggtgtctgaactcttggctacatatctaatgcctccaattgagtcagggtctgtagatttggcagagtttgaaccacaacttgtgtactaa

SEQ ID NO: 825 - DNA, 1893 bp, Glycine max var. Williams 82
atgtacattacaggacatcttgattcagtattccccgaagagtataaaaaagaaattcttcgttacatgtactatcaccagaatgaagatggaggatggggactacacattgagggtcacagcaacatgttttgtactgcactaaactatatatgtatgcgagttcttggagaaggccctaatggaggtcatgacaatgcttgtgctagagcaagaaaatggattcatgatcatggtggtgtaacacacataccatcatggggaaaaacttggctttcgattcttggggtatatgattggtatggaagcaaaccagtgcccccagagttttgggttcttccttcatttcttcctatgcatccatctaaaatctggtgttactgtcgattgacatatctacctatgtcttacttatatgggaagaggtttgtgggtccaatcacaccacttatcttacaattgagagaagagctctttactcaaccgtatgaaaaggttaattggaagaaagcacgtaaccaatgtgcaaaggaagatcgttatcatcctcattctttgatacaagacctggtatgggatagtttatacatatttattgagccactacttactcggtggcctttcaacaagctagtaagagaaaaggcccttcaggtaacaatgaagcatatcctttacgaagatgaaaatagtcgatacataaccattgggtgtgtggaaaaggctttatatatgcttgcttgttgggtggaagatccaaatggagatgctttcaagaagcatcttgcaagggttccagattacttatgggtttctgaagatggaatggccatgcagagttttggtagccaaggatgggatgctagtttggttattcaagctttgcttgccactaacctaatggaggaaattggtcctacacttgcaaaagcacatgatttcatcaagaagactcaggtgaaggatgaccctttaggagattttaagagtatgtatcgtcatatttctaaagggtcttggacattctctgatcaagatcagggatggcaagtttctgattgcacggcagaaactttgaattgttgtctacttctatccatattgccatcagagattgtaggagaaaagatggaacctcaaaggttatatgattcagtcaatatcctattgtcacttcaaagtagaaaaggtggtttagcagcatgggaaccatcaggaactcaagaatggttggaaatactcaatcccacagaatttttagggaacattgtggttgaacatgattatgctgagtgcactggatctgctattcaagctttagttttgtttaagaagctatatccaaggcatagggagaaagagataaagaattccattgccaatgcagttcaattccttgaagatacacaaacagctaatggttcatggtatggaagttggggagtttgctacatttatggcacttggtttgcacttcgtggtcttgcagcggcgggtaaaacttacactaattgtgctgccattcgcaaaggcgttaaatttctactttcaacacagaaagaggatggtgggtggggagaaagttatctttcatgcccaaaacagatatatgtacctcttgaaggaagtcgatcaacagttgtgcacactgcttgggctcttttgggtctaattcttgctggacaggcagagagagatactacttctcttcaccgtgctgcaaaattgctcatcaattctcagttgaaagagggtgattggcctcaacaggaactcactggagtattcaatagaacgtgcatgctgcattacccaatgtacagaaatatttatccaatgtgggctctagctgaatatcgtaggttggttcccttgccatccactgaagtttaa

SEQ ID NO: 826 - DNA, 411 bp, Glycine max var. Williams 82
atgtggaggctgaagatagcagatggtggaaaagatccatacattttcagcacaaacaattttgtaggaagacagacatgggaatttgatcctgaggcaggaactccagaggaacgagctcaagttgaagcagctcgtcaaaatttctataacaaccgtttcaagttcaaggcctgtggtgacctcctttggcgctttcagattctgagagaaaataacttcaaagaaacaatatctagtgtgaagatagaagatggagaggaaattacatacgaaaaagtcacagccacgatgacaagggccgcacattatctatgtgcattacagactagtgatggtcattggcctgcacaaattgcaggagctatgttttttgttcctcctttggtaagtactaaatattcgtattag

SEQ ID NO: 827 - DNA, 294 bp, Glycine max var. Williams 82
atggcatccagttcaatctcagcctctggctcatggagtgttaaggacaacaaggcctttgaaaaggctttagctgtttatgacaaggacactcctgaccgttggtacaatgttgctcatgctgttggtggcaaaactccagaggaagtgaaaaggcactacgaactccttgttcaggatgttaagcatattgagtctggacgtgtgccattcccaaattacaagaaaactacttcagggtcaactgatcaggaggaaaaaaggctgaggaatttgaatttgaacctccagtga

SEQ ID NO: 828 - DNA, 705 bp, Glycine max var. Williams 82
ttgagtctgatcactatatacacactactcttcagccttttcatatttcataacacccctttgctaccaaaccaattcagtgatctttttgctttgctctttcctgagtttgaaaaccttagaaccatttcagtacacaacactttctgttccttaatggcatccagttcaatctcagcctctggctcatggagtgttaaggacaacaaggcctttgaaaaggctttagctgtttatgacaaggacactcctgaccgttggtacaatgttgctcatgctgttggtggcaaaactccagaggaagtgaaaaggcactacgaactccttgttcaggatgttaagcatattgagtctggacgtgtgccattcccaaattacaagaaaactacttcagggtcaactgatcaggaggaaaaaaggctgaggaatttgaatttgaacctccagtgacccccctcaagaacaacaaattgattttctaattttcatatcaaccaacatcattaatttccagcatccctggtagtactacgtggtgttatgtcacacataattgctagtgcaatagcatcttaggctatattagtcatcataagaatcatatgtcccgtgattccatctggtactttcttgtcgttgaagcttcctcttgaaagggtcaacgaccgtttcagttcctcatcgtcctaaataaatttataattt

SEQ ID NO: 829 - DNA, 825 bp, Glycine max var. Williams 82
atggaaatcgttccgattcccgccgattcctacaatctcggcttcatcggcgccggaaaaatggccgagtccattgccagaggcgccgtccgctccggcgtcttgccgccttctcgcattcgcaccgccgtccactccaaccccgcccgccgcgacacattcgaatccttcggcgtcaccgttctcccctcaaacgacgacgtcgttcgcgaaagcaacgtcgtcgttttctcggtcaaacctcaactagtgaaagacgtggtgttcaaattgacgccgcttctgacgaagaacaagcttttggtttcggtcgctgctggtaccaaattgaaagatcttcaggaatgggctgggaacgacagatttataagagtgatgcctaatacacctgctgctgtaggcgaggcagcatcagttatgagcttggggggatctgcaacagaagaagatggaaatattatagccaaattgttagggtcaattggcaaaatatggaaagctgaggaaaagtattttgatgctataactggcctgagtggcagtggtcctgcttatgtttatttagcaatagaggctttggctgatggaggagtagcagctggtttaccacgtgatctttcattaagtctagcttctcaaactgtattaggagcagcatcaatggtcatccagactgggaaacacccaggacagctcaaagatgacgttacttctccgggtgggacaacaattacgggcattcatgagttagaaaatggcgggttccgtgggacactgatgaatgctgttgttgctgctactaagcgcagcagagagctttcctga

SEQ ID NO: 830 - DNA, 1149 bp, Glycine max var. Williams 82
atgaggcgccagcagctacacttcgcggcagttgtcgcggcgattgtcgtcaccgcttgggttgcgcacatgcgcggcggggttggccaatcggaggccaagggttggcagttcgaggccgttccgattgacggcgccgtcggaccggagagcttctccttcgatcctcgcggcgaaggcccttacaccggcgtttctgacggtagaatcatcaaatggcaccaaacgcagaatcgttggctcaacttttccgctattgcttcttcttcacactgggatgaagagtgtggaggaccatgtgatgagcattccaagaaagagcacgtgtgtgggcgtccactaggcttgtgctttagtacactatcgaatgatctttacattgctgattcttacaagggcttagttgttgttggtccccatggtggcactactagaagactcgtatcaacaatagaaggtgaacccttggcttttactaacggtttggatgttgaccaacgaactggagcagtgtacttcaccagtagtagttcaaaatatccgaggaggaattacatgtcgttgatcctaagcagagataagacggggatgctaatgaaatatgagccacaaagtgaacaagttagcgttctcctaaagaatctctcctatgcaaatggagtagcattaagcaaagatggtgaatatatcctaataattgagaccacaacttgtagagtattaaggtattggctagaaacaccaaaaactggaaccttggaagtctttgctgatctaccaggtttcccagacaacatcaaacggagtccaagaggaggattttgggtgggaatttactcaagaagagaaaaaattatccaatggattctatcatatccttggattggaaaagttttgcttaggcttcctttggacatcccaaaagcttattcatatttggctaagctaaaaaggagtaatggaatggcaattagactaagtgagcagggtgatatattagaaattgttaacgaaaaaaatgggagcatagggaggtctattagtgaagtggaggaaagagatgggatattatgggtgggatccatagatgcaccttttgttggtaagtataatattcatgttgtagaagggcaagtcaaacggatttga

SEQ ID NO: 831 - DNA, 2535 bp, Glycine max var. Williams 82
atgatggatcatattagtaatgaggccagtgttgaccgttttccaattggtccttctggcattcttggtaggacaattgctttcagggttcttttttgcaagtctatctcacattttaggcaccacatatttattgtgttgttagatctcttctataggtttagggggggtttggcatcctttatatcatggttgcatcccaggaaccctcaagggatattggcaatgatgacaattgttgctttcttgttgaaacgatacacaaatgtgaaatcaagggctgaaatggcatataggaggaagttttggagaaacatgatgagaagtgctttgacctatgaggagtgggctcatgcagctaagatgcttgataaagagacaacaaagatgaatgaatcagacctttatgatgtggaattggtgaggaacaagcttcaagagctccgccaccgtcgacaagagggatctctcggagatataatgttttttatgcgtgccgatcttattagaaatttaggtaatatgtgtaaccctgaactacacaagggtaggcttcaggtgcctaaattaatcaaggagtacattgatgaagtaacgactcaattgagaatggtctgtgattctgattcagaggagctatcattggaagaaaagcttgctttcatgcatgaaactaggcatgcatttgggaggactgctttgctgttaagtgggggtgcctctcttggagcttctcatgtgggtgtagttaaaacactggtagaacataaactcatgcctaggataattgctggttcaagtgtgggatccattatgtgtgctgttgttgccactaggacttggcctgagctccagagcttttttgaggattcatggcactcattgcaattttttgatcaaatgggtgggatttttgcagttgttaagagagtcacaacattgggtgctgttcatgagatcagacagttgcaaatgatgttgaggcatctaacaagcaaccttacatttcaagaagcttatgacatgacaggcagaattcttgggattactgtttgttccccaaggaagcatgaaccgcctagatgtcttaactacttgacttcaccccatgtggttatatggagtgcagtaaccgcttcttgtgcctttcctggcctttttgaggctcaagaattgatggcaaaggatagaagtggagagattgttccttaccaccctccttttaacttaggccctgaagagggctccacaccagtgcgccgttggagggatggtagcttggagattgatttacctatgatgcagttgaaagaactattcaatgtcaatcattttatagttagtcaggccaaccctcatattgcaccactattgagattgaaagaatttgtgcggacttatgggggcaactttgctgccaagcttgctcatcttgtggagatggaggtgaaacataggtgtcatcaaatactggaacttggttttccattaggtggacttgctaaattgtttgctcaagactgggaaggtgatgtgactgttgttattcccgcaactcttgctcagtacaccaaaattatacagaacccttcttatggagagcttcaaaaggcagccaaccaagggagaagatgtacctgggagaaactttcagccataaaagcaaattgtggcattgagcttgctcttgatgagtgtgttgtgattctcaatcatatgagaagactaaagagaattgctgagagagctgcttctgcctctcatggtttgtccagcactgtcaggttcagtgcttcaaaaagaattccttcgtggaattgcattgcacgagagaattcgaccggctcccttgaggaccttactgatgttgcctcctcattgcatcaaggcatcggcagttccagcagagccaatggcaaaacttggaagacccaccgtggcatacatgatggaagtgacagtgactctgaaagtgttgatttgcattcttggacaagaactggcgggcctttgatgagaactacttcagcaaatatgttcgttgattttctccaaaacttagaggttgatacggatcctaataaaggcttagtgagtcacactatccataatgattttcagtatcatagccccaggctcacaacactagataggaactctgatagcacagaatctgagccaagggaaactggcaacagggttgtcaatgtgtccagcatacttgtgaccgaaggtgatcttctgcagcctgaaaggatccataatgggattgtgtttaatgttgtcaagaaagaagacttgtcacccttaagtagtagcagtcatggttttgaaaattacaacattgaagttgctgaatgtgtccaagatgagtgtccagggaaggagatagatgctgctagctctgcatctgaacacggagatgatgaagaatccatgccagccaggtccttaactgacatgccagattacaattccattgatcatcattcgggcacagattcgggtatggatcaaagcattgttgacagttag

SEQ ID NO: 832 - DNA, 315 bp, Glycine max var. Williams 82
atggctggccttcaacaatacaacttcttccccaccgatctcttgtaccctcgtccacaaccccaacaagcttctcctaaacccaccatgcttcccctccaaacccctaatgttcaagatcacactcagcaccaacaaccaccaaggaccaatgccaccccttcaacttcttctgccgttgtttatagccaaaagggtcattctattgctgccgttgacgacaacaacaaggtctccaaattctcatcagaccctctttcttggttgctttggatgcccgaagatgaagatgaaaattgttcggactcttcttga

SEQ ID NO: 833 - DNA, 1614 bp, Glycine max var. Williams 82
atggtccactatcaccgctcccatcaacccagaaaggccaacaacacagactccatcatcaaagacgaagagtcacagaacaacatcacgttggattgttcatcctctgcttactacaagagaacaaggcccaagttgttgtcttttctcttcctcatcaccttcctctcttgctgctatgtttttgctcctcttttccttggcccttctttccctctatctctcttgtactctcccgcaactgaaaatgatttgaaacaagatggggttggtgctaatgattctccatgctcttctgtttctactggaactatatgttgtgatagaagtggttatcgttctgatgtctgtgtgatgaaaggtgatataagaacacactctgcttcctcttcggtcttcctctacaattcaaggagcaacaacaatgtttcgagaaattttgaagaagaactccaacatgaaaagatcaagccgtatactagaaaatgggagacaagtgttatggacaccattgatgaattaaacctcatctcgaagaaagtgaattcaggtagtgttggaggttgtgatgtccaacatgatgttccagcagtgttcttctcaaatgggggctacactggcaatgtttatcacgaattcaatgatggaatcgtacccttatacattacttctcagcatttcaagaagaaggttgtgtttgtgattcttgagtatcataattggtggatcatgaagtatggagatatcctttctcgcctatcggattttccgccaatcgattttcaaggagacaatagaactcattgcttcacagaagcaatagttggtctcagaatccatgatgagctaactgtggattcttcattgatgaggggtaacaagagcattgctgattttagaaaccttttggataaagcttattggccaaggatcaaggggctgattcgagacgaagaaaggaaagcacaagagaaattgagagaacaagtctcttcatctgaatcatcagaagcctcacaacaacagtatataactattaggcaacaagtgcaagaaaatccaatgaagaagcctaagttggttattctttctagaagtggttcaagagctataactaatgagaatttgcttgtgaagatggcaaaggaaattgggtttttggtgcaagttttgaagcccgacagaacaacagaaatggcaaagatttataggactctcaatgcaagtgatgtcatgattggtgttcatggagcagctatgacacattttctgttcctgagacctggttctgtgtttattcaagtggttcctcttggtaccacatgggctgcagaaacttattatggggaaccagcaaggaagcttggattgaaatacattggctatcaaattttgcctagagagagcactttgtatgagaaatatgataaaaatgatcctattctgagagaccctacaagcattaacaagaaggggtgggaatacacaaagaagatctatcttgacagccaaaatgtcatgttagacctcagaagattcagaaaaaggttgcatcgagcgtatgagtatacactctccaaatcaaaactgagtctccaacatcaaccaatgtga

SEQ ID NO: 834 - DNA, 2253 bp, Glycine max var. Williams 82
atgactgtcacacctaagatctcagttaacgatgggaaacttgttgtccatggtaagaccattctgactggagtgccagacaacgttgtgctgactccaggttctggaaggggtcttgtgactggtgcttttgttggtgccacagcttcacacagcaaaagtctccatgtgtttccaatgggtgttttagaggggctccggttcatgtgttgtttccggttcaagttatggtggatgactcagagaatgggaacttgtgggagggatgttcctctggagactcaattcatgcttattgagagcaaagagagtgaaactgatggggagaattctccaatcatctacactgtcttgcttcctctcctcgaaggtcaattccgagctgttcttcaaggcaatgacaagaacgagatagagatttgcctcgagagtggggataatgcagttgagactgaccaaggccttcacatggtttacatgcatgctgggaccaatccctttgaagtcatcaatcaagctgtcaaggctgtggaaaaacacatgcaaacttttcttcatcgtgagaagaaaaggttgccatcttgtcttgactggtttggatggtgcacatgggatgctttctatactgatgtcacagctgagggtgttgaggaaggcctgaaaagtctatcacagggaggtacacctccacgattcctcatcatagatgatggttggcaacagattgaaaataaagcaaaggatgctactgaatgtttggtacaagaaggagcacagtttgctactaggttgactggtattaaagagaatactaaatttcaaaagaaattacagaacaatgagcagatgtcaggtctgaagcatctagtacatggagcaaagcagcatcacaatgtgaaaaatgtatatgtatggcatgcactagctggttattggggtggagtgaagccagcagcaaccggcatggaacattatgacactgccttggcatatccagtgcagtcaccaggcgtgctaggaaaccaaccagacattgtcatggacagcttggctgtacatggccttggcctagtgcacccaaagaaggttttcaatttctacaacgagctccatgcttacttagcttcttgtggagtagatggagtgaaggttgatgtgcagaacattattgagacccttggtgcgggacatggtggccgagtgtcacttactcgcagctatcatcacgcgcttgaggcttccattgctagcaattttactgataacggatgcattgcgtgtatgtgtcacaacactgatggactttatagtgctaagcagactgctattgtgagagcttctgatgatttttaccctcgtgatcctgcttcccataccatccatatttcttctgttgcatacaactcactattccttggagaattcatgcaacctgactgggacatgtttcatagtttacacccagcagcagattatcatgctgcagctcgtgcaattggtggatgtcctatttatgttagtgacaagccaggcaatcacaattttgatcttcttaagaagctggttctcccggatggttcggttctccgtgctcagttacctggcaggccaactcgtgattctctatttgtggatccagccagagataggactagcttgctcaaaatatggaacctgaacaaatgctctggagttgttggtgtatttaactgccaaggtgctggatggtgcaagatagagaagaaaacccgcatccatgatacatctcctggtacactcaccgcctctgtctgcgcctctgatgttgacctcatcacacaagtagcaggtgctgaatggcttggagatacaattgtttatgcttacagatcaggtgaggtgattcggctaccaaaaggggtttcaattccagtgacactaaaagttctggagtttgagcttttccacttctgtccaatccaagaaatagctccaagtatatcatttgcagcaatagggctactggatatgttcaacactggaggagcagtggagcaggttgagattcataaccgagcagcaacgaaaacaatagctcttagtgtaaggggaagaggcagatttggagtttactcctcccagagaccactgaagtgtgtggtaggtggcgctgaaaccgacttcaactatgactcagagaccgggttgacaaccttctccattccagtttctccagaggagatgtacagatggtcaatagagatccaagtttga

SEQ ID NO: 835 - DNA, 204 bp, Glycine max var. Williams 82
atggcaaaacttgctggctgtgtagctcatttttttattgcagcaatggttttgagcacgttttacgtgaccaaaactgtggcacaatcagagatagctcctacttcacaaatggagactggagaagggtttgctttgtctgtttctggggtgaccttgtgttcttctctgttggcttctattgtggcgtttatgatgcagtga

SEQ ID NO: 836 - DNA, 2693 bp, Glycine max var. Williams 82
ttgttgtccatccccgactctgtctacaatttcttttgggtaagttaaccctctcttctactttacctgagtctaccctctcttctctctctctctctctctaattcagtcttctgaggaggtagtttactgtcataattgtggaatgtagctttactcatctttcatgtgaaaacccttcatatggttgctgcaacccattgaatagtccccgaaattcattctcttagtatacttttactttgcccaattaatgcccttcagcctacagcgtgtgtcttcaatcacagcatttggatgaaaaaaaagggtagagagggttggtagtagaattcacattcacacatacttcgccataaagaatctattttttctctccttttctttttactctcttaagttcgtagtagcaaatcaggatttgctgcttcagtgcttcttcaccctttgtcttctagcctctggaatttttccatggagatagagaacggtgacaccaggtccaaaaagatggaagagtatcaagtcatagagcaaattggaagaggagcttttggctctgccttcctcgttcttcacaagtccgagaaaaagagatggacctgattgccaaactgaataacccatatattgtggagtacaaagatgcttgggtggagaaggaggaccacatatgcattataactggctattgtgaaggaggtgacatggcagagaacataaagaaagctcgaggttcattttttcctgaagagaaagtctgcaaatggctgactcagttgttgatagctgtagactacttgcactctaatcgtgtaatccacagagatcttaagtgttccaacatattcctcaccaaagacaacaacattcggcttggtgactttggtcttgctaagcgacttaatgcagaagatcttgcttcctcggttgttggaactccaaattacatgtgtcctgagctccttgcagatataccttatgggtataaatctgatatgtggtctcttggttgctgcatgtttgagattgctgcacatcaaccagcatttcgcgctccagacatggctggacttatcaataaaataaacagatcctccatttctccactgccaattgtttattcttccacactgaaacaacttatcaaaagcatgcttaggaaaaacccagaacataggccaactgcagctgaattgttaaggcatccgcttttacagccttatgttcttcgctgtcataatgcatcatctaatgttcttccagtatatcccttagttaatccaaaggataaaacaagaagatctaataaatctagtggtggcaaggaccataaggacaaagaagctagtttggtaaatcgtttggagcggattcatccaattgagggaaatggagatatacagataagcaatcttcctaatgatgcggtaacaatctcaaccagtgcagaagacaatctagagaccaggatggctgatcttaccagctacatagtggaatcttgtactagtattagtggctcaaaagatgggtcaacaacatctgaatcaactatttgcagtgtgtgcaaggaggactttaaaagtagacctgcaagggaaacggctaacaatgagatctcttctaagagtacacaaaattctatgcatgaaaaacaaagatttgctgctaaacattttcataaattagaagaagacaacataaatgtggcgaccacagaagttgaagatgcttcttgcaatgaaggtttggatagtgctgaagcacagagggaagattcgaactttgaggactcaggtaaatccacaatgtccagtgcaggcagtagcactgataaagataagtccatcaatgaggaaagttcatcactgattatgcatcctattagggttgaacatgacactgaatctggaaaccactcgaagaaaagcaaaacccctgatgtatttacagaagtctctcatatgaactgcttgacatcttttagtaatgatgcacttccagttaaggatgatgacatggcaaacgtacacattctttgctccacgcataaagaagatgataatgcggtggaggttgatcaggcaccaagaggtgtttcattgagtgtaataactgaagtagatggtgatgaaacaatcaagactccggtggatagtccctgccagcaaagagcggatgctctggaatctctgctcgaattatgtgctcagctactcaagcaagataaactcgatgagcttgctggggtgctaagaccatttgggaaagaagctgtctcatcaagagaaacagcaatatggctggcaaaaagcctcatgtctgcccaaaagtttaatgctgaagcctaagttctggccataaatttatacattgttgtaagaaatgtgcatttcaaatgtcacatgagttcctttcgagatttgttgcttggttgaagatgggagactggaagatagcatgccacatgttctttcttggttgtcgtaaatggttacagtaaatgaattaaattatttttgttaggttggatagtcatttgtgcttgttttccagcagtgtatgggccactgattgtgtatattttcttacttccccttttccgaactaaacaataaccatgcacttggagcttgatattttattcatttggtttatttgttagaagacattctcatgaccatattaac

SEQ ID NO: 837 - DNA, 270 bp, Glycine max var. Williams 82
atggcaaccttgatcggttgccaatactactatctcttgttccttctttggtttatctctagcttaaccttcttattgtttttggactatcatgttatgtttctacgtgtgaaaatactactatttggtaacattcactcctttgacgttaatagaccagtgtcttcatcgctggctcgttgctgggaccagttcagcccagtaatccctcttggcctttatgcagacttgcaaacaacacaaatgcttgctcttgcttttcattcctag

SEQ ID NO: 838 - DNA, 1560 bp, Glycine max var. Williams 82
atggctgattaccaaggcaccatcatacttttcatcatatggctagtctccacaatagtggttcgagccatagtcagcaaaaaacagaacaagactaatagaccaccaagtccactagccttacccatcattggacatctccaccttcttgctccaatacctcaccaagctcttcacaagctctccacccgccatggacccataatgcaccttctccttggctccgtgccatgtgtcgtggcttccacaccagaagccgccaaagaattcctcaaaactcacgaaaactccttctccaaccgcccgcaaagttttgcggttgattatctaacatatggctcgcaggacttctctttcgcgccatatggaccgtattggaaattcatgaagaaaatatgcatgtctgagcttctggggggtcacacactgagtcagcttctacctgtgaggagacaagagactttaaggtttcttagacttatgcttcagagagggaaggcagctgaggccattgatgttgggagagaactactgaggctctcgaataacgttgtgtcaaggatgattatgagccaaacgtgttctgaagatgatagtgaggctgaagaggtgaggaagttggtgcaagacactgtgcatctcactgggaagtttaatgtttcggacttcatttggttccttaggaagtgggatttgcaggggttcgggaaaggactcaaggagattcgggacaggtttgatgccattatggagagggcgatcaagaagcatgaagaggaaaggaagaaaagaagggaagagggtagtggaggagagggtcatatcaaggatctacttgatgtattgttggacatacatgaagatgagaactctgatattaaattgactaaagagaacataaaggccttcatcttggatgtgtttatggcaggaacagacactgcagccttaacaaccgaatgggctctagctgagttgattaaccacccacatgtgatggagagagcaagacaagagattgatgctgtgatagggaatggtagaatagtagaagaatcagacattgccaacctttcttacctgcaagctgtagtgaaggaaactctgaggattcaccccacaggtccaatgattattagagaatcatcagaaagcagcactatctggggctatgagattccagcaaagactcagttatttgttaatgtgtgggctattggaagggaccctaatcactgggagaacccacttgagttcaggccagagaggtttgctagtgaagagggaagtgggaaggggcagttagatgtgagggggcaacattttcacatgattccatttgggagtgggagaagagggtgtcctggaacctcactggctttgcaggttgtgcaggcaaaccttgctgctatgattcaatgctttgaatggaaggttaaaggaggcattgaaattgctgacatggaagagaaaccagggttaactctttcaagggctcatccattgatttgtgtccctgtgcctaggcttaatccttttcctaatatatcaaatgcctaa

SEQ ID NO: 839 - DNA, 1560 bp, Glycine max var. Williams 82; identical to SEQ ID NO: 838

SEQ ID NO: 840 - DNA, 1530 bp, Glycine max var. Williams 82
atggcttatcaagtgttgctaatttgtttggtctccaccatagtgtttgcatacatactatggagaaaacaaagcaagaaaaaccttccaccaagtccaaaggcccttcccataattggccacctccaccttgtgtccccaattccccaccaagatttttacaagctctcaacccgccacggacccatcatgcaacttttccttggctcagtcccttgtgtggtggcttccaccgcagaagccgccaaagagttccttaaaacccacgaaatcaacttctccaaccgccccggccaaaacgtcgccgttaagggcttagcctacgattcccaagacttccttttcgcgtttgcacccttcggaccctactggaagttcatgaagaaactctgcatgtccgagcttctcagcggccgaatgatggaccagttccttcccgtgaggcagcaagagaccaagagattcatcagccgcgtgttccgaaaaggagtcgccggcgaggccgtggatttcggagacgagctcatgacactctccaacaacatcgtatccagaatgacgctgagtcagaagacttctgagaacgacaaccaggctgaggagatgaagaagctcgtgtcgaatatcgcggagctcatggggaagttcaacgtttcggacttcatttggtacctgaagcctttcgatttgcaggggttcaacagaaaaatcaaggagactcgggacaggtttgacgttgtggtggacggaatcataaagcagcgtcaagaggaaagaaggaaaaacaaagaaacgggcacagcaaaacagtttaaggacatgcttgatgttttattggacatgcacgaagatgagaatgctgaaatcaaattagacaaaaaaaacattaaggccttcatcatggacatatttgttgctgggactgacacgtcagctgtaagcatagaatgggctatggcagagttaatcaacaatccagatgtgttggagaaggcaaggcaagagatagatgcggtggttggaaaaagtagaatggtagaagaatcagatattgccaaccttccttacttgcaagccattgttagagaaacacttaggcttcacccaggtggtccattggttgttagagaatcatcaaaaagtgcggtggtttgtgggtatgatattccagcaaagactcgattatttgtcaatgtttgggctattggtagggatcccaatcactgggagaaaccttttgagtttaggccagagaggtttatcagagatgggcaaaatcaattggatgttaggggacaacattatcattttattccattcgggagtggaagaagaacgtgccctggtgcttctctagcgtggcaggttgtgcctgtgaatctggctataattattcaatgtttccaatggaagcttgttggtggcaatggcaaggtggacatggaagagaagtctggcatcactcttccgagggctaaccccataatttgtgtccctgttccaaggattaacccattccctactatttga

SEQ ID NO: 841 - DNA, 648 bp, Glycine max var. Williams 82
atggctaatttcataactttcttcattcccctagccctaaccctccttttctcctccctcgtcactgccagttaccatcaaagcatctctccaagccttctacgttctcgtgagaagctcacgcaccttcgcttctatttccatgaaatttttactagcgacaaaccctctaatctcgtgatcgacccccccaaggtggtagccgactctccccttccatttgggtcccaagtggtgatcgaggacccattaacaattgggcctgatgtcgagtccaaacagataggtaaggcccaagggttttacctatccgcaacccaaaggcccggtttggagttggagatagtcatggggatggccttgaccttcttagaaggcgaatttaacggtagcagtttaagtgtgttggggagaaacaaaatcttcaatgaggtgagggagttgcctattattggtggcacgggtgagtttcgcttcgcacgtggctatatcctagctaggagtgtcaaggtcgattaccataaaggggatgctaccgtggaatacaacgcttatgtgtatcattattcttccactagctcttcgtctcacgagatttttaacgatggagttcagttcatgacagaccctattcttagcaagatttag

SEQ ID NO: 842 - DNA, 1218 bp, Glycine max var. Williams 82
atgaaggacgaggtggattccccttttggtgttcttgaggactatttcaacttcaagagttcagaatcagaaacaagctcttccaaagaaccaagtactattgtggattctgataagttaaaaccaggttctaggtggaatgcgtttcttcaattgttgagggtcaaatcgaagccaatagctacattgcatcctcttagtgtcctcaagctttcaagaagaatgagcagtagcatgagggagactgtaatagatgcagattcgtccttgcataggtcaccctggaagatcttcactcaccatgagatacaaattgcaaccaattacttcatccaagaaaattgtattggaaagggtggttatgctgaggtttacaaagggtgtttgccaaatggtcagctggtagcgattaaaatgctgacacgtggaacagaaaacgaaactataggtgacttcttatcagaacttggtataatggctcatgtaaaccactccaacactgccaagttagttggctatggggtggagggaggaatgtatctagtgcttgagttgtctgaaaaagggtgcttagcttcaatgcttaatggttccaaggagaaactaccatggtcttttaggcagaaaatagcattaggaacagctaagggtataatgtatcttcatgaaggttgtcagagaagaattatccatagagatataacagcggcaaatatcttgcttactgagaactttgagccgcagatttgtgatttcgggctagcaaaatggctaccagaaaattggacccatcacattgtttcaaaaattgaagggacttttggttatcttactcctgaatacttgcttcatgggatagtggatgaaaaaacagatgtatttgcgtttggtgtagtgctattagaattagtcacagggagacgagcacttgatcattcacaacaaagccttgttttgtgggcaaaacctttgctgaaaaagaattgtattagggagctgattgatccttcattagccgatgattttgactgtcggcagattaaaattatgctcttggcagcttctttatgcattcaacaatcctctattcgtcgcccctctatgaaacaggttgtacaacttttgaatggtaaccttagctgctttaagttcacgaagaaatctcaacatccattgttccgaaaagtctttcaagaagagcttcttgacgctgattaa

SEQ ID NO: 843 - DNA, 2448 bp, Glycine max var. Williams 82
atggcttctcacttccgccttccgtctttctcttcttctaaccatttccttttaacatcttcttcttcttcttcttctatctctcttcaccacttctccaaatcctctctgggtgccgtgtcgtctgagactaacgacaaacaagagataagatgcagagcaatatccaaaccacgaacacaagaatgttcagacatatttcagggtagtctagcaacgttaaagtttcgtgagattaatgtggaagatgacatagaagaggagcaagacattggggctttggtggcaaatgagatcaagaagagagtggacactatcaaatcaatattgggttccatggaagatggagagataacagtatctgcttatgacactgcttgggttgctctgatagaagatgttcatggaactggtgtccctcaatttccatcgagtctagaatggatagcgaaaaatcaacaccccgatggttcatggggtgataaggaattattctcagcccatgatcggattattaacacgttggcttgtgttattgcattaaaaacatggaatatgcaccctgaaaagtgtgagaaaggaatggcattttttagagagaatcttggcaagcttcagaacgagaatgtagagcatatgccaattggttttgaagtagcctttccatcacttcttgacatggctcgtggcttggacattgaagtgccgaacaattccccaatccttaataaaatcttcgcaatgagaaacgtaaaactcacaagaataccaagagctatgaggcataaagtgcccacaagtctccttcatagcttggaagggatgtcaggccttgactggaaagaacttctaaaactgcagtctcaagacgggtctttcttgttttctccgtcatccacagcctttgctctcatgcaaactaaggaccaaaattgccacaattacttgaataaagtggtcaagaggttcaatgggggagttccaaacgtgtatccagtggatttgttcgaacatatttgggtggttgataggcttgaacgtctaggaatatctcagtattttcagcaagagatcaaggactgtttgagttatgtttacagatattggactgaaaagggtatttgttgggcaagaaattcaaatgttcaagacattgatgacacggcaatgggtttcagactattaagattacacggttaccaagtttcagccgatgtgttcaagaactttgagagaaatggtgaatttttctgctttacggggcagaccacacaagcagtgacaggaatgtttaatctgtatagggccacacaaatcatgttcccgggagagagaattcttgagcacgggaagcacttctctgccaaatttttgaaggagaagagagcagcaaatgagcttgtagataaatggatcataatgaagaacctggcagaagaggttgcgtatgctttggacgtaccatggtatgcaagcctacctcgagtggagacaagattctacattgatcaatacggcggtgagagtgacgtgtggataggcaaaaccctttataggatggcatatgtgaacaacaataactatctcgagcttgctaaattagattacaacaattgccaggcactgcatctaatagagtgggggagaattcaaaagtggtactcagaatctagattggaggagtttggaatgaacagaagaacgcttctattggcctattttgtggcagcagcaagcatatttgagcctgaaaagtctcgtgtgagactagcgtgggcacaaaccagtatcttacttgagaccataacatcctatgttagtgatgcagaaatgaggaaagctttcatgaaaaaattcagtgactgtcttaacaggcgagactactccattggctggaggttgaacaggaacagaacaggacatggactcgctgagactttggttgccaccatagatcaaatctcgtgggatatactcgtgtctcacggtcatgaaattggatatgacatgcatcgcaattgggaaaagtggctttcgagttggcatcgggaaggagacaaatgtaaaggacaagccgagcttttggcgcagacaataaacctatgtggcgggcattggatttccgaggatcaagtgtcggatccactgtatcagagtctccttcaactcactaacaatctctgcaataaacttcgttgccaccaaaaggacaaggaacttgagagcagcaacagcggcacgaatgtaaacagcatgatcacccaagaagaagagtcaaaaatgcaagaactcgtgcaattggtgcaccaaaaatctccaactggcattgatttcaatatcaagaatactttcctcacagtggccaagagtttttactatacagctttttgtgattcaaggaccgtcaacttccatattgccaaagttctgtttgatgaagtcgtttaa

SEQ ID NO: 844 - DNA, 2709 bp, Glycine max var. Williams 82
gggaatctcttgggagtcatttctgtcgctgcttgcctcttctgggccttttaaattctggctttctctccatagtgaaacaaaaaattgttgaatcaacacaaacactccatggcttctcacttccgccttccgtctttctcttcttctaaccatttccttttaacatcttcttcttcttcttcttctatctctcttcaccacttctccaaatcctctctgggtgccgtgtcgtctgagactaacgacaaacaagagataagatgcagagcaatatccaaaccacgaacacaagaatgttcagacatatttcagggtagtctagcaacgttaaagtttcgtgagattaatgtggaagatgacatagaagaggagcaagacattggggctttggtggcaaatgagatcaagaagagagtggacactatcaaatcaatattgggttccatggaagatggagagataacagtatctgcttatgacactgcttgggttgctctgatagaagatgttcatggaactggtgtccctcaatttccatcgagtctagaatggatagcgaaaaatcaacaccccgatggttcatggggtgataaggaattattctcagcccatgatcggattattaacacgttggcttgtgttattgcattaaaaacatggaatatgcaccctgaaaagtgtgagaaaggaatggcattttttagagagaatcttggcaagcttcagaacgagaatgtagagcatatgccaattggttttgaagtagcctttccatcacttcttgacatggctcgtggcttggacattgaagtgccgaacaattccccaatccttaataaaatcttcgcaatgagaaacgtaaaactcacaagaataccaagagctatgaggcataaagtgcccacaagtctccttcatagcttggaagggatgtcaggccttgactggaaagaacttctaaaactgcagtctcaagacgggtctttcttgttttctccgtcatccacagcctttgctctcatgcaaactaaggaccaaaattgccacaattacttgaataaagtggtcaagaggttcaatgggggagttccaaacgtgtatccagtggatttgttcgaacatatttgggtggttgataggcttgaacgtctaggaatatctcagtattttcagcaagagatcaaggactgtttgagttatgtttacagatattggactgaaaagggtatttgttgggcaagaaattcaaatgttcaagacattgatgacacggcaatgggtttcagactattaagattacacggttaccaagtttcagccgatgtgttcaagaactttgagagaaatggtgaatttttctgctttacggggcagaccacacaagcagtgacaggaatgtttaatctgtatagggccacacaaatcatgttcccgggagagagaattcttgagcacgggaagcacttctctgccaaatttttgaaggagaagagagcagcaaatgagcttgtagataaatggatcataatgaagaacctggcagaagaggttgcgtatgctttggacgtaccatggtatgcaagcctacctcgagtggagacaagattctacattgatcaatacggcggtgagagtgacgtgtggataggcaaaaccctttataggatggcatatgtgaacaacaataactatctcgagcttgctaaattagattacaacaattgccaggcactgcatctaatagagtgggggagaattcaaaagtggtactcagaatctagattggaggagtttggaatgaacagaagaacgcttctattggcctattttgtggcagcagcaagcatatttgagcctgaaaagtctcgtgtgagactagcgtgggcacaaaccagtatcttacttgagaccataacatcctatgttagtgatgcagaaatgaggaaagctttcatgaaaaaattcagtgactgtcttaacaggcgagactactccattggctggaggttgaacaggaacagaacaggacatggactcgctgagactttggttgccaccatagatcaaatctcgtgggatatactcgtgtctcacggtcatgaaattggatatgacatgcatcgcaattgggaaaagtggctttcgagttggcatcgggaaggagacaaatgtaaaggacaagccgagcttttggcgcagacaataaacctatgtggcgggcattggatttccgaggatcaagtgtcggatccactgtatcagagtctccttcaactcactaacaatctctgcaataaacttcgttgccaccaaaaggacaaggaacttgagagcagcaacagcggcacgaatgtaaacagcatgatcacccaagaagaagagtcaaaaatgcaagaactcgtgcaattggtgcaccaaaaatctccaactggcattgatttcaatatcaagaatactttcctcacagtggccaagagtttttactatacagctttttgtgattcaaggaccgtcaacttccatattgccaaagttctgtttgatgaagtcgtttaaatcatattgtatttcttgaatagattttagactccaacttatcattgtgaatattttccgcctgcaatgataaaaaaaaatcagttgttgcggctccatgtatatatgaaacattcactagttttattaatggttaatcttccttgaaaa

SEQ ID NO: 845 - DNA, 447 bp, Glycine max var. Williams 82
atggcaggagcactgacagatgatcagattgctgaattccatgaagccttttgcctcattgacaaggactctgatggattcattactgtggatgaattggcaaccattatccgatcattagaagggaatccaacgaaagaagaaatccaagacatgattagtgaggtcgatattgatgggaatgggagtatagattttgaagagttcttgaatattatgggaagaaaaatgaaggaaactctagctgaagagctgagagaagcattcaaagtatttgacagagatcaaaatggatacatatccgccactgagctgaggcacgtaatgatgaatttgggagagaggctgacagatgaagaggcagaacaaatgattagagaggcagatttggatggggatggtcaagttagctttgaagaattttcaaggattatgatgctcaaatga

SEQ ID NO: 846 - DNA, 402 bp, Glycine max var. Williams 82
atggcaacaatcatcgccggcaccccaactacatcaatcactcgcacaggtcatgtgctcaaacgacctgttggggcctcatcctctaccgttcttggattgccagcaatggccaaggcggggagagtgaggtgctccatggaggaaaagccttcaagcagctcaaacctagggatgggggcatccttgttagcagctgcagctgccgcaaccatgtcaagcccagcagccatggctttggttgatgagagactcagcactgaaggaactgggcttccctttgggcttagcaacaaccttcttggttggatcctgtttggtgtctttggtctcatatgggctctcttctttgtctacacttccacccttgaagaggatgaagagtctggattgtccctctaa

SEQ ID NO: 847 - DNA, 207 bp, Glycine max var. Williams 82
atggctctctcacacagaaggatcctcttcacggtttttcagattcttttgttcaccctcatcatttttgttgcttctccggaatctggggtagcttgcaggccattgttcttgcattatcaatggtcatgggattatgggcttctcatgcaatcacttccaaacgcaccggcgccaccgtcaacgggagatccaactcatccttga

SEQ ID NO: 848 - DNA, 1821 bp, Glycine max var. Williams 82
atggcagtggtagaagaaaagggctttgcaagtggaagagaggattacacccaagatggcacagtggacctcaaaggtagacccgttttaagatcaaatactggaagatggagagcttgttccttcatagtagggtatgaaatgattgaaagaatggcatattatgcgatagcatcaaacctagtgcagtatctaacaaagaagctccacgagggcactgtgaaatcttcaaacaacgttaccaactggtctggtacagtgtggattatgccagctgcaggggcttacatagccgatgcctatcttggccgttattggacctttgtaatagcatcagccatttaccttctgggaatgtgtttgttgactctagcagtgtcactaccagcattgagaccgccaccatgtgctcccggcatagcagacaaggattgccaacgagcatcgtcgtttcaagtgggaattttcttctttgccttgtacatcattgcagcaggcacagggggaaccaagcccaacatttccacaatgggagcagaccaatttgatgagtttgagcccaaggagaggtcccaaaagctttccttctacaactggtgggtgtttaatattctaattggaaccattacagcccaaactctcttggtttacatacaagacaaggttggttttggacttggttatggaatcccaaccattgggctagccgtttcagttttggtgtttcttttaggaactccactttataggcatagattgccctcaggaagccctttaacaaggatggttcaggtcttggtggcagctatgaggaagtggaaggtacatgtcccacatgatctaaatgagctacatgagttgagcatggaagagttttatgcaggcaaagggagaagcagaatttgtcacagctcttcgttaagcttccttgacaaagctgcggtaaagacaggccaaacatcaccgtggatgctttgcactgtgactcaagttgaggaaaccaagcaaatgatgaaaatgattccaattttgattactacatgcattccaagcaccataatagctcaaaccaccacactcttcatcagacaaggcaccacacttgacaggaacatgggaccccattttgaaatccctccagcatgtctcatagcatttgtaaacatcttcatgctgacaagtgttgtgatctacgaccgccttttcgttcccgcgatccggcgctacacaaagaactccagagggatctccttgctgcagagacttggaattggccttgtgctacatgttattataatgctcactgcatgctttgttgagaggaagagactcagtgttgcaagagaaaaacacctcttaggtgcgcaagatacaattcctcttactattttcatcctcctccctcagtttgctttgacagggattgctgatacctttgttgatgttgctaagttggagttcttctatgatcaagcaccagaagccatgaaaagtttgggaacatcatatttcacaaccaccataagcattggaaattttcttaacagttttcttctttcaactgtttctgatctcacccttagacatggtcataagggttggatcttggataatctaaatgtctcccatttagattattactatgcattcttggccgtgctaagctctaccaacttactttgctttgtggttgttgccaagttatatgtctacaatgatgatgtaacacaaaccaaaatggagttgggtatgaaccatgcttcatctaagggcaatactggaataagtttaagtagcccacaaccagatgacaagtcctag

SEQ ID NO: 849 - DNA, 4338 bp, Glycine max var. Williams 82
atggagggtgggggtagtagttttaggattggaagttcatccatttggaggaacagcgacgcggcggagatcttctcaaactctttccaccaagagaatgatgaagaggctcttaaatgggctgccattcagaaacttcctacagttgcgcgtttgaggaaagctttgatcacttcacccgatggcgagtccaatgagatcgatgtaaagaaacttgggttgcaagaaaagaaagctttgcttgaaagactggtgaaaactgctcaagaggacaatgagaagtttttgctcaagctcaaggacagaattgatagagttggaattgatcttcctaccatagaggttcggtttgagaacctgagcatcgaagcagaagctcgtgcaggaactagagctttgcctacattcactaacttcatcgttaatatactggagggcttgttgaactctcttcatgtacttccaaacagaaaacaacatttaaacattctagaggatgttagcggaataataaagcctggaagaatgacattgcttttaggccctccaagttctgggaaaaccacactcctactagccttggctggaaaacttgatccaaaattaaagttctctggaaaggtaacttataatggtcacgggatgaatgagtttgtaccccaaaggactgctgcttatgtcaatcaaaatgatcttcacgttgcagaattgacggtcagagaaaccttggccttctcagccagggtccaaggagttggacctcgttacgacttgctggcggaattgtccagaagagaaaaagaggcaaatatcaagcctgatccagatattgatgcctatatgaaggctgtagcatctgaaggacagaaggcaaatatgataacagattatatcctgaggattttgggactagaggtttgtgctgatactgttgtaggaaatgcaatgttaagaggtatctctggtggacaaaggaaacgtgttacaacaggggagatgctagttggaccagctaaagctcttttcatggatgaaatatccacaggtttggatagctcaacgacttttcagattgtgaattcactaaagcaatatgtccacattctcaaaggaaccacagtcatctcactcctgcagccagcaccagagacttacaatctttttgatgacatcattctactctctgatagtcacattgtgtatcagggtcctcgtgaacacgtgcttgaatttttcgaattaatgggttttaaatgtccccagaggaaaggtgtggcagactttttgcaagaagttacatcaaggaaagatcaggagcagtactgggcacacaaagatcagccttatagatttgtcacagccaaagagttctcggaggcacataagtcatttcatattgggagaagtcttggtgaagaacttgctactgaatttgacaagtctaagagccacccagccgcattgacaaccaaaatgtatggagtgggaaaatgggagctgttaaaagcttgcttatcgagggaatatttacttatgaagcgcaattcattcgtctacaccttcaaactttgccaacttgctgtattagcaattattgccatgaccattttcctccggaccgagatgcacagagattcagtgactcatggaggcatatatgtgggtgcattgttctatggtgttgttgtgattatgttcaatggattggctgaactttccatggtcgtttcacggcttcctgttttctacaagcaaagggactatctcttcttcccttcatgggtatatgcacttcctgcatggatcctaaaaatccccttgacttttgtggaagtgggtgtttgggtattcctcacctactatgccattggttttgatccatatgttggaagattgtttaggcaataccttgttcttgtactagtaaatcaaatggcatcggcattgttccgattagttgcagcagttgggagggaaatgacagtggctctaacacttgggtcgtttacactggccatcctatttgctatgagtggttttgtcctatcaaaagaaaatattaaaaaatggtggctatggggcttctggatctcacctatgatgtatggacaaaatgccatggtaaataatgagttccttgggaagagatggagacattttctacctaactcaaccgaggcactaggagttgaaattttgaaatcccgtggattcttcactcagtcatactggtactggataggtgttggggctttgattggatatacattacttttcaactttggctacatccttgctctcacatacttaaatccacttgggaaacatcaagctgttatatcagaggaacctcaaatcaatgaccagagtggtgatagtaaaaagggaactaatgtgttgaagaacatacaacgtagcttctctcagcactcaaatagagtgagaaatggcaaaagtttaagtggaagcacctctcccgagacaaaccataacaggacaagaggaatgattcttccttctgaacctcattccatcacctttgatgatgtaacatattctgtcgacatgcctgtggaaatgaggaatagaggtgttgttgaggataaattggctctattgaagggtgtcagtggagctttcaggccaggtgttctcactgctctaatgggtgtcacaggtgcaggcaaaacaactctgatggatgtactcgctggtagaaaaactgggggatatattggggggaatatcacaatctctggttatccaaagaagcaagaaacatttgcacggatttctggatactgcgagcaaaatgatatccactctcctcatgttactgtatatgaatctttgctttactcagcatggcttcgactgtccccagaaatcaatgctgacaccaggaagatgttcatcgaggaagttatggaacttgtggaactgaaagcactaaggaacgcattagttggattgcctggtattaatggtctctcaacagagcaacgcaaaaggttgactattgcagttgaacttgtggcaaatccttctataatatttatggatgagccaacttctgggctagatgcaagagctgctgctattgtcatgagaacagttaggaacacagtagacaccggaagaacagttgtctgtaccatccatcagccaagcatagacatatttgaatcttttgatgagcttttgctaatgaagcaaggaggccaagaaatatatgtggggccacttggacatcattcttcccatttaattaattactttgagggaatccaaggtgtcaataagattaaagatggctataatccggcaacatggatgctggaagtctcgacttcagcaaaagaaatggaattggggattgattttgctgaggtgtacaaaaattcagagttatacaggagaaacaaagcacttattaaagaattgagtactccagctcctggttcaaaagacctttatttcccatcacagtactcaacctccttcctcactcaatgcatggcttgcttatggaaacaacattggtcttactggcgcaatcctctatacactgctataagatttctttactcaactgctgtagctgctgtgcttggtagcatgttctgggaccttggctccaaaattgacaaacaacaagatcttttcaatgccatgggctccatgtatgctgctgttctccttattggcattaagaatgctaatgcagtgcagccagtggttgctgttgagcgaacagtcttttatagggaaaaagcagccggaatgtattcagctttaccgtatgcttttgctcaggttctaattgagctcccatatgttctagtacaagctgtggtatatggcattataatttatgccatgattggttttgagtggactgtaactaaagttttctggtacctattcttcatgtacttcaccttcctgaccttcacctactatggcatgatgtcagtagcagtgaccccaaaccaacacatttcttctatagtttcctctgcattctatgcagtgtggaatctcttctcaggattcatagtcccacgaccgagaattccagtgtggtggagatggtacagttgggcaaatcctgtagcatggagtttgtatggattggtggcttcacaatatggagatataaagcaaagcatggaatccagcgacgggagaacgacagtggaaggctttgtaagaagctactttggtttcaagcatgattttctgggagtggttgcagctgtgattgttgcattcccagtagtctttgcattggtctttgccatatcagtgaagatgttcaatttccaacggcgttaa

SEQ ID NO: 850 - DNA, 4903 bp, Glycine max var. Williams 82
aaaagtaaaggaactgagtcctttcaacaacacaaaataaaacaaaaaagaaacaaactaattgtccagatttttgaagttgattctgtgaaacagtaactggggttgcatcaaggttgagacttgttatggagggtgggggtagtagttttaggattggaagttcatccatttggaggaacagcgacgcggcggagatcttctcaaactctttccaccaagagaatgatgaagaggctcttaaatgggctgccattcagaaacttcctacagttgcgcgtttgaggaaagctttgatcacttcacccgatggcgagtccaatgagatcgatgtaaagaaacttgggttgcaagaaaagaaagctttgcttgaaagactggtgaaaactgctcaagaggacaatgagaagtttttgctcaagctcaaggacagaattgatagagttggaattgatcttcctaccatagaggttcggtttgagaacctgagcatcgaagcagaagctcgtgcaggaactagagctttgcctacattcactaacttcatcgttaatatactggagggcttgttgaactctcttcatgtacttccaaacagaaaacaacatttaaacattctagaggatgttagcggaataataaagcctggaagaatgacattgcttttaggccctccaagttctgggaaaaccacactcctactagccttggctggaaaacttgatccaaaattaaagttctctggaaaggtaacttataatggtcacgggatgaatgagtttgtaccccaaaggactgctgcttatgtcaatcaaaatgatcttcacgttgcagaattgacggtcagagaaaccttggccttctcagccagggtccaaggagttggacctcgttacgacttgctggcggaattgtccagaagagaaaaagaggcaaatatcaagcctgatccagatattgatgcctatatgaaggctgtagcatctgaaggacagaaggcaaatatgataacagattatatcctgaggattttgggactagaggtttgtgctgatactgttgtaggaaatgcaatgttaagaggtatctctggtggacaaaggaaacgtgttacaacaggggagatgctagttggaccagctaaagctcttttcatggatgaaatatccacaggtttggatagctcaacgacttttcagattgtgaattcactaaagcaatatgtccacattctcaaaggaaccacagtcatctcactcctgcagccagcaccagagacttacaatctttttgatgacatcattctactctctgatagtcacattgtgtatcagggtcctcgtgaacacgtgcttgaatttttcgaattaatgggttttaaatgtccccagaggaaaggtgtggcagactttttgcaagaagttacatcaaggaaagatcaggagcagtactgggcacacaaagatcagccttatagatttgtcacagccaaagagttctcggaggcacataagtcatttcatattgggagaagtcttggtgaagaacttgctactgaatttgacaagtctaagagccacccagccgcattgacaaccaaaatgtatggagtgggaaaatgggagctgttaaaagcttgcttatcgagggaatatttacttatgaagcgcaattcattcgtctacaccttcaaactttgccaacttgctgtattagcaattattgccatgaccattttcctccggaccgagatgcacagagattcagtgactcatggaggcatatatgtgggtgcattgttctatggtgttgttgtgattatgttcaatggattggctgaactttccatggtcgtttcacggcttcctgttttctacaagcaaagggactatctcttcttcccttcatgggtatatgcacttcctgcatggatcctaaaaatccccttgacttttgtggaagtgggtgtttgggtattcctcacctactatgccattggttttgatccatatgttggaagattgtttaggcaataccttgttcttgtactagtaaatcaaatggcatcggcattgttccgattagttgcagcagttgggagggaaatgacagtggctctaacacttgggtcgtttacactggccatcctatttgctatgagtggttttgtcctatcaaaagaaaatattaaaaaatggtggctatggggcttctggatctcacctatgatgtatggacaaaatgccatggtaaataatgagttccttgggaagagatggagacattttctacctaactcaaccgaggcactaggagttgaaattttgaaatcccgtggattcttcactcagtcatactggtactggataggtgttggggctttgattggatatacattacttttcaactttggctacatccttgctctcacatacttaaatccacttgggaaacatcaagctgttatatcagaggaacctcaaatcaatgaccagagtggtgatagtaaaaagggaactaatgtgttgaagaacatacaacgtagcttctctcagcactcaaatagagtgagaaatggcaaaagtttaagtggaagcacctctcccgagacaaaccataacaggacaagaggaatgattcttccttctgaacctcattccatcacctttgatgatgtaacatattctgtcgacatgcctgtggaaatgaggaatagaggtgttgttgaggataaattggctctattgaagggtgtcagtggagctttcaggccaggtgttctcactgctctaatgggtgtcacaggtgcaggcaaaacaactctgatggatgtactcgctggtagaaaaactgggggatatattggggggaatatcacaatctctggttatccaaagaagcaagaaacatttgcacggatttctggatactgcgagcaaaatgatatccactctcctcatgttactgtatatgaatctttgctttactcagcatggcttcgactgtccccagaaatcaatgctgacaccaggaagatgttcatcgaggaagttatggaacttgtggaactgaaagcactaaggaacgcattagttggattgcctggtattaatggtctctcaacagagcaacgcaaaaggttgactattgcagttgaacttgtggcaaatccttctataatatttatggatgagccaacttctgggctagatgcaagagctgctgctattgtcatgagaacagttaggaacacagtagacaccggaagaacagttgtctgtaccatccatcagccaagcatagacatatttgaatcttttgatgagcttttgctaatgaagcaaggaggccaagaaatatatgtggggccacttggacatcattcttcccatttaattaattactttgagggaatccaaggtgtcaataagattaaagatggctataatccggcaacatggatgctggaagtctcgacttcagcaaaagaaatggaattggggattgattttgctgaggtgtacaaaaattcagagttatacaggagaaacaaagcacttattaaagaattgagtactccagctcctggttcaaaagacctttatttcccatcacagtactcaacctccttcctcactcaatgcatggcttgcttatggaaacaacattggtcttactggcgcaatcctctatacactgctataagatttctttactcaactgctgtagctgctgtgcttggtagcatgttctgggaccttggctccaaaattgacaaacaacaagatcttttcaatgccatgggctccatgtatgctgctgttctccttattggcattaagaatgctaatgcagtgcagccagtggttgctgttgagcgaacagtcttttatagggaaaaagcagccggaatgtattcagctttaccgtatgcttttgctcaggttctaattgagctcccatatgttctagtacaagctgtggtatatggcattataatttatgccatgattggttttgagtggactgtaactaaagttttctggtacctattcttcatgtacttcaccttcctgaccttcacctactatggcatgatgtcagtagcagtgaccccaaaccaacacatttcttctatagtttcctctgcattctatgcagtgtggaatctcttctcaggattcatagtcccacgaccgagaattccagtgtggtggagatggtacagttgggcaaatcctgtagcatggagtttgtatggattggtggcttcacaatatggagatataaagcaaagcatggaatccagcgacgggagaacgacagtggaaggctttgtaagaagctactttggtttcaagcatgattttctgggagtggttgcagctgtgattgttgcattcccagtagtctttgcattggtctttgccatatcagtgaagatgttcaatttccaacggcgttaagatcgaacgtgttcaagtagtttgtacagggtgtttcatgtaatgtaacatgttgagagaagatatccacatagcttttttttattcttttatttaccaattaaattaaacttatcatagtcgaaatccactaggatctgtcaacagtagtggagaaatttagttagttttcatgagatcatagatttaaatctcattggcatatcactgtaaaaaaaagtgtatcatatttgatgatattaatatatgtaacacttgatatagttagtaaatgcatatgttatttcgttctttttcttatggcattaagcacttgtaaactctcaaagtagagcagtggctttatctttgcaaaatctgcatcgccatgttgacatgcctcctttctgtcaatggtgctcctatatattgcaaaacgtagaatgtactcgcttgat

SEQ ID NO: 851 - DNA, 339 bp, Glycine max var. Williams 82
atggctgcagattccaactcaaaccttagaatcaccattgaaagaaacccttcccagtcacgccttgctgagttgaacatcaagtgctggcctaagtggggttgctctccagggaagtaccagttgaagtttgatgcagaagagacatgctacttggtgaaagggaaggtgaaggcatacccaaaagggtcatcagagtttgtggagtttggtgctggggaccttgtcacaattccaaaaggactcagttgcacttgggatgtgtctgttgccgtggataagtactacaagtttgaatccaattcttcttcttctactacttcatcatcatcttgttaa

SEQ ID NO: 852 - DNA, 2288 bp, Glycine max var. Williams 82
tagactcgaattgttgttgttgtggtgagtgtttgggcacgatggcggaggctcctccgtctctattatctgtgtgcatcgacgctctcacacaacaacttctccgtccatgcgatgatgatcttcttccttgtatctacgatcttccttctcacttactcgacaccttaatcacgcgtttgccccctctcgcactccgcacattccaccaccacctgccattcgacgaggaagggttttctcacgacgactcaaccaaaaagcgaaaacgcgcaagggattggaatttaaattcagcttggcagaggttgtttcagctacgctggcctgatcgcgttaagcagattcatagaacggattgggagcaactctattgggaaactcatttgcaagattgtttagatgaagcagtggaggtagcactaattccatcttttactggatatattggtgacatacagatttcagatagcatactgaaatatattggctttgtggggaatacaaaccattctacttgtgaccattcaaaattgtcttaccattgcctacaatttggcagccatgtgagttgcctggggctgcaaaatgttctatgtactgcagaaactagtgttttgttgagggaatgcaagctacagagtctggtacttagatgtatcagatccaaggaacaaattgatggattatgcaaacttcttgctcaacattgtagaacgttaacgtctctggaatttgttcactgtgcactctcaacagattttattaatgcaatatttggctctttagtcatagagagagtacaaaaacatgggatccaacatttgtcaatcattgccacaagttttctggaaccatgtacagtttctttacctagtggactcgtgtcgtttttgtcttcgggaaggtccttgtgctcattaaaattatctgagaaccaccatggatggacttttgccaaagatctttttgtgactcttctcaatctttcatctggcatatctgtccttgacctttctcggaatagaatatcaggatggcttttttactacaggagatccttgagtggttcacatctgtcgtttggaaatggaaagtccttgaaactgttgcgtgtactcaatctgagggaaaacaatttaggaaaagatgatgtacaacatcttagatatgctcttgaacatgtgcctaacttggaggagctggatataagtgacaattcaattgaagatgaaggaatcaggaatttaattccctattttgttggagcatctgaaacctgtcctcgcataacttgtttgaaattagagaactgtgatctgtcctgtgttggagtgaatcttctcctacattacctttctactttcaaaggaccattaaagtctctttctattgctgagaattaccttggcagacaagtagttgaagcattgggaaatttttttcacaccccaatcgaagtacttgacattgcaggcattggattgggttctgacggttttcaagagcttcaaagtctaataaaagaggagattaagctggtgaaaattaatataaggctccacaactagttgatgtgaatgcagcctgtaatcttatgccaatagaatcactggccatcatctgctgtgcattaaagtttgcaaaaggtaatgttcagcaagtggacttgacaggacatatatgggactataagccagagcatgtttccccttacgctgaatttgtacataatggattacctatattggttcttccatcaccatcagtctctgctgctcctcacgaccatgatccttagaattaaaattttgtgcgatttcaatttatgttgcatggcatatgcagttaatagttctctttgtttcttccttcctttatcattatgtatgttagcatagtttcatacataatgcttgcaaacattttattggctgtacagcaaagttagagaagggaaatttaacttgtgttcatattgatcaatttttcttttgtgtgtttcaagcaatgtgtttttttaacctctatttttggggttgtttttcttcctagtttcccttgtgttttgtaatttaatgtagtttgtagttcattagatgctgtgcaacagaacatggacaatctggtgtatcaactatgaagatgcaacgaaaatacttgtttggggttacttttgtatgaacagttgtcatagtggttcggaaatctactgttcatttctattggaatgattaccctcattgcattacttttgtttcaaaaacatgtaactgattttcaatctc

SEQ ID NO: 853 - DNA, 2520 bp, Glycine max var. Williams 82
atgcatatggcgttgaacataacatctatcaaagcatcctcaaacggagtgtggcaaggcgacaaccctttggactatgccttcccactcctcatagtccaaaccatcttggtcctcgccgtcagccgctccctcgctttcctcctcaaacctctccgacaacccaaagttatagctgagattgtcggtggagttttgctgggcccatcagcgttgggaagaaacaaaagttatttgcaccgtatattcccttcatggagcatgcccacgcttgaatctgtagccagcataggccttctttttttcctcttccttgtgggtctggagcttgatctccactccattcgccggagcggccgaaaagcattctgcatcgccgccgtcgggatctctctccccttcatatgtggcatcggcgtcgccgtcatcctccgcaaaaccgtggacggcgccgacaaagccgggttcccgcagttcctcgtcttcatgggagtcgccctttccatcaccgcattccctgtgctcgcgcgcatcctagcggagctcaagctcctcaccacgcgcgtgggagagaccgccatggccgcggcggcgttcaacgacgtcgccgcgtggatcctactcgccctggccgtagccctcgcgggagacggcggaggacacaagagccccctcgtgtcggtctgggttctcctctccggcctcgggttcgtcgtcttcatgattgtggttattcgacccgcgatgaaggttgtctctcgtaagggcgaaaacgacgccgttgacgagatttatgtctgtttaacgttggcgggggtgctggcgtgcggtttcgtaactgaccttatagggattcattctatattcggggcttttgtgttcgggttaacggttccgaagaatgggagcttcgcgaggaggttgatggagaggatcgaggattttgtgttgggcttgttgctgccgttatactttgcctctagcgggttgaagactgatgtaactacgattcgtggcggtgcggcgtgggggcttctttgtctggtgatattcacggcgtgtgctgggaagattctagggactttcgtggtggccatgttttgcatgatccccgccagagaatcgctcacgcttgccgtgctcatgaacaccaaaggactcgtagagcttatcgtactcaacattggcaaagagaaaaaggttttgaacgatgaaatgttcgcaatcttagtactcatggctctattcaccactttcatgacaactccaatagtgatgagcatctacaaagcagcgaagacccaacggaagctaggagacattaattccttgagttccaaggtaaatgagttccgagtcttggcatgtatccacggcccaaacaacatcccttccataatcagtttcatcgaatcatctcgcagcaccgccaagtcccttctgaagctgttcatggtgcatctcgttgagctctcagagcgctcttcctccatcacaatggttcaacgcgcacacaagaacggtttccctttcttcagccggtcccaccgtgacacgtggcaggatcgcctcgctggcgcgtttcagggctacggtcaactgggccaagtcaaagtccggtcaaccaccgccatctcttctctctccacgatgaatgaggacatttgccacgtggcggaggataagagggtgaccatgatcatcttgccgtttcacaaacagtggaggatggaaatggatgaggataataataatgagaactgtcgtgtgttggagaatgtgggccacgaatggagactggtgaaccaaagggtgcttaagaatgcgccttgttcggtggcggtgcttgtggaccgtggatgtggcaatctgcctcagactccaagcccaattgtggcccaacgcgtatgcatcatcttctttggtgggcccgatgatcgtgaagccctagagctggggaagaaaatgattgaacacccagcagttaaagtacgtgttgtgaggtttgttgaaaaggatgacctgatgaatggaaatgacactgtgttaagcttctcacatgacgaaaatggtgacaagagttacagcttctccactgctaaaatgaaccaccagaaagaaaaggaattggatgagaaggccgtgggaaattttcgaagcaagtcgaatgaaatggtggaatatgttgagaaggttagtgagaacattgtggaagaagtaatagtaatagggagtagtggagattatgatcttataattgttggaaagggtcgatttccgtcgaatatggtggctggattggcagaaagacaagcagagcacgccgagttaggccccattggagatgttttaacatcatcggaaaatgtggtgtcatcagttatggttattcaacaacatgatgtagcgtcggtagatgatgctcctgtatataaggtgcatggaaagcacgacaaggtcaacgatagtgattcatcccataaggttgggatttcaatatcaaacgacaacgtagtgtaa

SEQ ID NO: 854 - DNA, 1566 bp, Glycine max var. Williams 82
atgatgaagaaacaattaacaggtatacggggagattctcccctgcaatcggcaatccgagctggaaatttagaattggttctggaaatcatctctcagagtccagaggaagaattaaaggagttgctttcaaaacaaaacaactcttgtgaaactgccttatatgttgctgctgaaaatggtcatcttgatatactcaaggaattgattagataccatgatattgggttggccagcttcaaagctagaaatggatttgatgcattccacattgctgctaaaaatggacacttggagatattgaaagtcctcatggaggcctttcctgaaatttcaatgactgttgatctgtcgaacactactgtgttgcatactgctgcagcacaaggacacattgaggtagtaaattttctcttggaaaaaggtaatagcctggtaactattgcaaaaagcaatgggaaaactgtgttgcattcttctgcaagaaatggctacatggaggttgtcaaggcccttgtgagcaaagaaccagaaattgcaatgagaattgataaaaaggggcagacagcactccatatggcagttaaaggacagaatcttgagttggtggatgagctcgtgaaattgaatccatctttggccaatatggtggataccaaggggaacactgcactgcatatagcaacccggaagggtcgtctacaggttgttcagaagttactagattgcagagaaataaacacagatgttatcaacaaatctggagaaactgctttagatactgcagagaaaaatggtcgtttggaaattgccaactttctgcaacatcatggagctcaaagtgccaagtccatcaagtcacctactacaaacacggcccttgagctcaaacaaacagtgagtgacataaaaagtggggttcataaccagctggaacacacaattaaaacgcaaagacgtatgcaaggtatagcgaagcgaatcaacaaaatgcacactgaggggcttaacaatgcgatcaactccaacattgttgttgctgtccttattgcaacagttgcttttgctgccatatttaatgtcccgggccagtatcctgagaaaccaagtgaactctctcctggaatgtctcctggggaagcatatattgctccagatattggattcatgatattcataatctttgattctactgccctcttcatatcattggctgttgtgattgtccaaacatcagtggttgttattgagaggaaagcaaagagacaaatgatggcagttataaataagttgatgtgggttgcatgtgtgctgatttctgtggcatttattgcaatgtcatacataattgttggggatcataaagagttggctatagcagccacagctctaggaacagtgattatggcagctactttaggaacactctgttattgggtgattgctcatcgccttgaggcctcaagattgcgaagtcttaggacaacaatgagcagtaggcagtcaatgtctatgtcaatgatgtcaggatcagagaatgagtataagacagtgtatgcaatataa

SEQ ID NO: 855 - DNA, 876 bp, Glycine max var. Williams 82
atggaatctaatttcttctttaaaaccaatatgctaactctgaaccacacattgcagcatgaattagtggtccctttagttggcacggattggtcatggatgatggagttcctgaagggtatggtgaagccagtggctgccactgcagtggtgtgtttggctgtggccttgtccttctaccagaagctggggctggagctagagatggttgttgccattgtgagggcatttattcaactttctatcattggctttgtgttggagttcattttccgccaggacaacgctggatggatcctcctagcataccttttcatggtatcaatagcgggttacactgcgggtcagcgtgcgaaacatgttcctcgtgggaagtatgtggcaggggcctccattctcacaggaactgcagtgaccatgttggtgctggtagctttgagcgtgttccctttcactcctagatatatcatacctgtggctggcatgatggttgggaactcaatgacagttaccggtgttaccatgaaaagactcagagacgacatcaaaactcaaatgaacttggttgagacagcattgtctcttggtgcaaccccacgacaagcaacgcatgaacaagtgaaaagggctctgatattggccctttctccggtggtggacaacaccaaaacagtgggtctaatatcccttcctggggcaatgactggtctcattatgggtggggcatcgccgttggaagcaattcaactacagattgtggtgatgaatatgatgattggtgcagcaactgttagcagcataatggctacatacctctgttggccagcattcttcaccaaggcctaccaattggaaaccaaagtcttctcaagttga

SEQ ID NO: 856 - DNA, 900 bp, Glycine max var. Williams 82
atggacgtgcaacacttgaagttgtcaatcaatggcaatggtgggtctggaaagaaggttagaaagccttatactattaccaagtcaagggagagctggtccgaggaagaacacgacaagtttctcgaagctcttcaactatttgacagagattggaagaaaattgaagattttgttggttcaaaaacagttattcagatcagaagtcatgcccagaagtacttcttgaaagttcaaaagaacggggcagtagcacacgtgcctcctcctcggcctaagcgcaaagcttctcatccttatccacaaaaggcatccaaaaatgttttgttgccattgccagcttccatggtttatgtttcttccactagtgcccttccacctgggtatgtcacatgggatgaaaattccttgctcatgaattctggatccaacaaatcagtgccttgtaatgatgagctcgcctatcttcttggaaatgaaggcatgcatgcttcttttactgatattggatcaaaggggataacacgaattggtcacagcagtcttagtggtgttgggaactctactagaaatctgcctgctactgagatggcaaaacaagggaaacaggctcaggtgattcatggtttgccagattttgctgaagtttacagcttcattggaagtgtttttgatccagacacaaaaggtcatgtccagaagctgaaggaaatggatcctataaattttgaaactgttttgttgttaatgaaaaacctcactgtcaatttgtctagtcctgactttgagccagttaggaaggccatgtcatcatacgatgtcaatacaaatacagtaggagttaccgcaggaatcgacgtcaagaagcagacaaatgatctatcatgtcaaacagcttga

SEQ ID NO: 857 - DNA, 1491 bp, Glycine max var. Williams 82
atggcagcagggtacgcatccggttattctctagaacacactccaacatgggcaattgccctagtttctttcattcttatctccgtctcaatcatcttggagcatctcattcatctaataatcaaatggttaaagaaacatcggaggagcgatttggttgaagcaattgagaggcttaaatcagagttgatgatcttaggattcatgtcgcttttgttgacagtaactcaagacgctataatagaaatctgcataccagtgatggctgcagatactatgcttccatgtcgtaaacgaactaacaatgctacttcaattttggattcttgcagtgccaaaaatgccagtaaagttgctttagtatcaaaacatggaatccatcaacttcacatgttcatttttgtcctagctctcatgcaaattgtgtacagttttctcaccgtgtctctggcaagggctaagatgaggcactggaaagcttgggatgaagagactcaaacagttgaatatgaaattgccaacgaccctaatagattcagatatacaaggcaaacaacattcggtagacggcacatatctactagtacgccatcaccagtatatgtttggattaaatgttttttcagacagttctttcactcagtagaaaaagttgattatctcaccctgaggcatggtttcatatcagctcacttttcagctaggaacaacgacttcgatttccaaaactacattgaacagtcacttgaggaagatttcagaatcatagtgagcattagccctgtgatgtggttcactgttgttatttttctgctggtggacgtacacggttggcatgtgtatctctggttatcctatgttcccctcttgctggttctggttgtgggaactaaacttgaagtcattgtcgaccaaatggctcttaaaatgaaagatgtcaataatgtgaccaaggggaccccacttgtttgtccaagtgacgaattcttctggtttggccatcccggatttgtgttaacactcctacattacactttattcgtgaatgcattcgagcttgccttctttatatgggtatcaacacagtttggaataaattcttgctaccacgaacacagaacatttacaatcataagggtggtgatagcggtggcagttcaagtcctgtgcagctatgttactctccccctctatgcactagtggcacagatgggttcagaagtgaagtgcaaagcattggctaaaatgctgaagcagtggcatgttgaggtgagggagagaaggaagaaccgagaacaactcaagtcttttagttttaggcacacaaacatgtcctcagaatggagccaagtaaataagactgcccctgatttttcttccacactatgtgaaagcattcgttcttctgatgaaggagaaattgtagaagaattggagcatatggataaaacaaaggcgtgctcatcaagtgatccacctggtgttgtgtaa

SEQ ID NO: 858 - DNA, 735 bp, Glycine max var. Williams 82
atggcaaagctaatccattttctccttttccttttcatccaaacaatttcagcccaaacaccagcagcaccagcgggccccaccaacatcacccaagttctagagaaagcaggacaattcacaaccttcattaaactcctcaaagcttcacaaatagctgatagaatcaattcacagctgaacaactcaaaccaaggcctaaccgtgtttgcacccactgataatgcattctcaagcctcaaagcaggaacattaaactccataaactcacaagaccaaatgcagctgatacaattccacattctccccactctctacaccatctcacagttccaaaccgcaagtaaccccttgcacacgcaagctggaaacagtgatgatggagagtatcctttaaatgtgaccacctcagggaaccaagtgaatgtaacaactggggtggttgatacaacagtgtccaatactatctacagtgatactcagctctcagtgtatcaggtggataaggtgcttcttcctatgaagcttttcggcgcgacggcaccggctgctgcaccggcggaggctcctgcgccatccaagccggagaaaaatgtccgggcaggggctgctgatgcttcatctgggtcatcgggttcatcggttgatgcttcgaatgcagtgagtttgaatagaaagacagttaaaggttttatcatgaccgtggcaatcattgtttcttgtttgtggatgtaa

SEQ ID NO: 859 - DNA, 1383 bp, Glycine max var. Williams 82
atggatgccaaggtattcaaattccagatcctccaaggctccatcgctaagcgcgtggtcattcgctcaatactactcgcgtgcgccgtctcaattgtctccatctaccgcgcgcaatccctcttcgatttcggaaccctcgctcccatcgccacgtacttcgactgcgtttccggcttcgagggcgtcacctttcgccctggttcccacttgctccgaacccgcttctgggcctccgccaattgcgagaaagacgccaacttgaccctctccgtggtcaccgacctaactggtaacaatttactctacaccggagcgaaaagcctctgcgtcggagaaggctcctcaatggccgtcacggcaatgaaacagttaggtttctccagcgtcagcgccgtccaaacgcaccgtttcgtgcagaggaacgtcctgtacgaggataactccttcgatttcgtgttctccagagacctagacaaggtttctgtcccagcattgctggtgctcgaggttgagcgtgtccttaagccacgtggcattggtgcctttcttgtaggcaccactagttctcaccccaatgatttgataagagcagccacacccgtttcctctttgttaaggtcttccaatgttgtgcatgttggttctgtcaacgagcttaaccttgttgttttcaagaaacgagttggaaacgctacttcattttaccaacatggtaatttacccgctgattgtcccagtctcacattcactaaatccctcatagagttgatggagcctctcgtgagtgagaaacaaaaaccaccacctcttgagtttcacaagaggattccctatttgcctaaatttgtggatgtttccactaggaagaggttggtgtatattgacattggggtaggggagcttcttgatgccaatgttagtgattggttcctaccatcgtaccccattgatcagaaggatttcaatatttattttgttcactacaacacttcgattatgttgtcccatgtgaagcaacctggtattacctttgtttaccaccctggcttgtctggtattgataaggtcaatgctaagcttggtagtgatgatgatgatgacatggatcctttacttggggaggaggagaagtttgatttccttgcctggttcaaagaaactgtgcaatatgctgattttgtggtcctcaagatgaatgcaggcagtgttgaactcaagttcctctctgatatatttgagaatggagctatatgctatgttgatgagttgtttctcaagtgtcccgagaggggaggtgatgccagcaagggaagttgcatggatatttacaaggatctccgaagcaatggtgtctatgtgcatcaatggtggggagactga

SEQ ID NO: 860 - DNA, 861 bp, Glycine max var. Williams 82
atggcgaaagacatcgaaactgaggtccaaagtgggctgccacacaaggactaccacgacccacccgccgccgcattctacgaccccgccgagctccgcaagtggtccttctaccgcgccctcatcgccgagtttgtcgccactctcctcttcctctacgtcaccatcctcaccgtcatcggctacaatcaccagaccgccaccggcagccccgacctctgcaatggcgtcggcgtcctcggcatcgcttgggccttcggaggcatgatatttgtccttgtctattgcactgctgggatatcagggggacacataaacccggcggtaacgtttgggttgtttctggcgaggaaggtgtcgcttataagagcagttgggtacatggtggctcaggtgttgggggccataagtggtgtggggctagtgaaggctttacagaagagctactacaacaggtacaatggtggcgtgaacatgctcgctgatgggtacagcaaaggaaccggtttgggagctgagattattggcacatttattcttgtctacaccgtcttctctgctaccgatcccaagagagtggcaagagactcccatgttcccgtgttggcaccacttccaattgggtttgcggtgttcatagttcacctggccaccatccctatcaccggcactggcatcaacccagccagaagcctagggcctgctgtcatattcaacaacgagaaggcatgggatgaccagtggatcttctgggttggacccttcatcggtgctgccattgctgcattctaccaccagtccgtgctgagggcccaagcagcaaaggctctcgggtctttcaggagctcctcaaacctgtaa

SEQ ID NO: 861 - DNA, 348 bp, Glycine max var. Williams 82
atgctgtactgctccaaaaaaaaaatggaactaattggtactagttcagatgccgttccccatcagaatcactcttcaaggggctcaagcaatgctggcaacaagaatttaactgagaaagaagtctatgtaaaccatgctgagttagcctggcatcaaatgaggacagaatgggttggtgatcaatcaaaaaaattacggaggtcacctaaaggttcaacattaagcgtcacaaggacttatgaagaggtgcttgcatctagagaaccttttaaacgaccaatactattatctgagatggtaagttttttggttgaaatttggctcgaggatggtctctatgattag

SEQ ID NO: 862 - DNA, 1527 bp, Glycine max var. Williams 82
atggatgaagatcctaagagaatggaagaaggcctcaattcagcattgaatggtgatggcaataaggatgacttgaagaagagggcaaccattaaaaccagtaatggaggttctatttttgagcatgacaaagacacaatggctaagcctgtggctgagggtgagtccgtacagcaaatagctgaacaggagcaaccaccggttaagcagaagacaaagagggttgcaacccttgatgcatttaggggtctcaccatagtgttgatgattctggtagacgatgctggtgaagcttatccacgcattgatcattccccttggaatggatgtactttggcggatttcgttatgcctttctttcttttcattgttggggttgccatagcccttgcactaaagagaatctcaaagataaagcattccgtaaagaagataatccttaggacattgaagcttctcttctggggtataattttgcaagggggttactctcatgcccctgatgatctcgaatatggagttaacatgaaatttatacgatggtgtggcattctccagagaatcgctcttgtatactgtgttgtagctctaatagaaacatttaccaccaagcttagacccactacgttggcttctggacacctatccatttttgctgcttataaatggcaatggtttgggggcttcgtggcatttctcatttatatgatcacaaccttcagcctctacgttccagattggagtttcgtggatcactttaacggcgatgaaccaaagagatacacggtcatatgtgggatgagaggacacctagggccagcatgtaatgctgttgggcacgtggaccgacaagtttggggggtcaaccatctttattctcaaccagtttggagacgcttgaaggcgtgtacattcagttctccaggcagtggtccttttcgtgatgatgccccaagttggtgtcttgctccttttgaacccgaaggcttgttgagttctatatcagcaatcctcagtggcactatcggcatccattatgggcacgtcctgattcacttcaagggtcattcggagaggctaaaacaatgggtctcaatggggtttgtgttactcatcatagccatcatccttcacttcacagatgctttaccaattaacaagcaactctacagcttcagctatgtttgtttcacagctggggcagctggaattgtcttctctgggttctacatactgatcgatgtttgggggctccgcacaccattcctgttcttggagtggataggaatgaatgctatgctagtgtttgtgatggcagcggagggcatctttgcagcatttgtaaatggatggtattatgaagatccacgtagctcactagtacactggatcaagaagcatgtgtttgtcaatgtttggcactcagagagggtgggaaccatcttatatgtcatctttgcagaaatcactttctggagtgtggttgctggcgtcttacacaaattaggaatatattggaaactataa

SEQ ID NO: 863 - DNA, 1597 bp, Glycine max var. Williams 82
atggatgaagatcctaagagaatggaagaaggcctcaattcagcattgaatggtgatggcaataaggatgacttgaagaagagggcaaccattaaaaccagtaatggaggttctatttttgagcatgacaaagacacaatggctaagcctgtggctgagggtgagtccgtacagcaaatagctgaacaggagcaaccaccggttaagcagaagacaaagagggttgcaacccttgatgcatttaggggtctcaccatagtgttgatgattctggtagacgatgctggtgaagcttatccacgcattgatcattccccttggaatggatgtactttggcggatttcgttatgcctttctttcttttcattgttggggttgccatagcccttgcactaaagagaatctcaaagataaagcattccgtaaagaagataatccttaggacattgaagcttctcttctggggtataattttgcaagggggttactctcatgcccctgatgatctcgaatatggagttaacatgaaatttatacgatggtgtggcattctccagagaatcgctcttgtatactgtgttgtagctctaatagaaacatttaccaccaagcttagacccactacgttggcttctggacacctatccatttttgctgcttataaatggcaatggtttgggggcttcgtggcatttctcatttatatgatcacaaccttcagcctctacgttccagattggagtttcgtggatcactttaacggcgatgaaccaaagagatacacggtcatatgtgggatgagaggacacctagggccagcatgtaatgctgttgggcacgtggaccgacaagtttggggggtcaaccatctttattctcaaccagtttggagacgcttgaaggcgtgtacattcagttctccaggcagtggtccttttcgtgatgatgccccaagttggtgtcttgctccttttgaacccgaaggcttgttgagttctatatcagcaatcctcagtggcactatcggcatccattatgggcacgtcctgattcacttcaagggtcattcggagaggctaaaacaatgggtctcaatggggtttgtgttactcatcatagccatcatccttcacttcacagatgctttaccaattaacaagcaactctacagcttcagctatgtttgtttcacagctggggcagctggaattgtcttctctgggttctacatactgatcgatgtttgggggctccgcacaccattcctgttcttggagtggataggaatgaatgctatgctagtgtttgtgatggcagcggagggcatctttgcagcatttgtaaatggatggtattatgaagatccacgtagctcactagtacactggatcaagaagcatgtgtttgtcaatgtttggcactcagagagggtgggaaccatcttatatgtcatctttgcagaaatcactttctggagtgtggttgctggcgtcttacacaaattaggaatatattggaaactataacaatcagctgcattattaatggtcaatctggaattgttattcctctattatattcttctttttgctattt

SEQ ID NO: 864 - DNA, 1467 bp, Glycine max var. Williams 82
atgggtgcccaagaacagcaactccactttgtcttgtttccattgatggcacaaggccacatgatccccatgatggacattgcaaaaatattggtgcaccgcaatgttattgtgactgtagtcacaacaccgcataatgctgctcgtttcacttcaatctttgatcgttatattgaatctggatttcaaatcagattagctcaacttcaattcccatgcaaagaagctggagtcccagatggatgcgagaatctcgattccataccttcacttggcatggccgcgggtttcttcaatgcaacaaactttctacgtgagccagcggaaaaactgtttgaagagctaacaccaccaccaagctgcataatctctgatatgtgtttaccatacacaaaccacattgctaaaaaatataacattcccaggatttcatttgtcggagtaagttgcttctatctcttttgcatgtctaatgtacgcatccataatgttatggagggaatagctaatgaatcggagcactttgttgtgcctggtattcctgacaaaattgaaacaaccatggctaagacaggactagcaatgaatgaagaaatgcaacaggtcactgatgcagtgtttgcagttgaaatggaagcttatgggatgatcatgaattcatttgaagagttggagccagcatatgcaggtggatacaagaagatgagaaacgataaagtgtggtgtttgggaccactgtcatatagcaacaaggatcaattggataagtctcagagaggtaaaaaggccacaattgacgagtaccacctgaagagctggcttgattgtcaaaagccagggactgtaatatatgcatgctttggaagcatatgcaatttaacaacaccacagttgatagagcttggtttagccttggaagcatcagaaagacccttcatttgggttttcagggaaggaagtcagtccgaagaattggggaaatgggttagtaaagatggatttgaggaaagaaccagtggtcgtggccttctaattcggggttgggctcctcagttactaatattatcacaccctgctgttggagggttcataacacactgtggttggaactctaccttagaagcaatatgtgctggggtgccaatggttacatggccactatttgctgatcagtttttgaatgaaagtctagttgtggaaatattacaagttggagtgaaggttggggtggagagtcctgtgacatggggcaaagaagaggaagttggtgtgcaagtgaagaaaaaagatgttgagagggcgatcacaaagttaatggatgagacaatcgaacgagaggaaagaagaaagaggataagagatcttgctgagaaggctaaaagagccacagagaaagggggatcatctcattctaatgtgaccttgcttatccaggacatcatgcaaaaaatcaaacgagatgtatga

SEQ ID NO: 865 - DNA, 1636 bp, Glycine max var. Williams 82
tctttccacaacaagaataatgggtgcccaagaacagcaactccactttgtcttgtttccattgatggcacaaggccacatgatccccatgatggacattgcaaaaatattggtgcaccgcaatgttattgtgactgtagtcacaacaccgcataatgctgctcgtttcacttcaatctttgatcgttatattgaatctggatttcaaatcagattagctcaacttcaattcccatgcaaagaagctggagtcccagatggatgcgagaatctcgattccataccttcacttggcatggccgcgggtttcttcaatgcaacaaactttctacgtgagccagcggaaaaactgtttgaagagctaacaccaccaccaagctgcataatctctgatatgtgtttaccatacacaaaccacattgctaaaaaatataacattcccaggatttcatttgtcggagtaagttgcttctatctcttttgcatgtctaatgtacgcatccataatgttatggagggaatagctaatgaatcggagcactttgttgtgcctggtattcctgacaaaattgaaacaaccatggctaagacaggactagcaatgaatgaagaaatgcaacaggtcactgatgcagtgtttgcagttgaaatggaagcttatgggatgatcatgaattcatttgaagagttggagccagcatatgcaggtggatacaagaagatgagaaacgataaagtgtggtgtttgggaccactgtcatatagcaacaaggatcaattggataagtctcagagaggtaaaaaggccacaattgacgagtaccacctgaagagctggcttgattgtcaaaagccagggactgtaatatatgcatgctttggaagcatatgcaatttaacaacaccacagttgatagagcttggtttagccttggaagcatcagaaagacccttcatttgggttttcagggaaggaagtcagtccgaagaattggggaaatgggttagtaaagatggatttgaggaaagaaccagtggtcgtggccttctaattcggggttgggctcctcagttactaatattatcacaccctgctgttggagggttcataacacactgtggttggaactctaccttagaagcaatatgtgctggggtgccaatggttacatggccactatttgctgatcagtttttgaatgaaagtctagttgtggaaatattacaagttggagtgaaggttggggtggagagtcctgtgacatggggcaaagaagaggaagttggtgtgcaagtgaagaaaaaagatgttgagagggcgatcacaaagttaatggatgagacaatcgaacgagaggaaagaagaaagaggataagagatcttgctgagaaggctaaaagagccacagagaaagggggatcatctcattctaatgtgaccttgcttatccaggacatcatgcaaaaaatcaaacgagatgtatgatgatatcagctttcagtactaatttgaaataaaaggccaaaccttgtagtttttcacttaattctctagcttttgaatacatgatcatgatctcttttaaatttattgccagtttgtgcaagtcatacaattttttaggagattattttg

SEQ ID NO: 866 - DNA, 1467 bp, Glycine max var. Williams 82
atgggtccccaagaacaacaactccactttgtcttgtttccattgatggctcaaggccacatgatccccatgatggacattgcaaaaatattggtgcaccgcaatgttattgtgacagtagtcacaacaccacataatgcagctcgtttcacttcaatctttgatcgttatattgaatctgggttccaaatcagattagctcaacttcagttcccatgcaaagaagctggagtaccagatggatgcgagaatctcgataccataccttcacttggcatggctgcgggtttcttcaatgcaacaaactttctacgtgagccagcagaaaaactacttgaagagttaacaccaccacctagctgcataatctctgatatgtgtttaccatatacaaaacacattgctagaaaatttaatattcccaggatttcatttgtcggagtaagttgtttctatctcttttgcatgtctaatgtacgcatccataatgttatcgagagcataactgctgaatcggagtgctttgttgtgcctggtatccctgacaaaattgaaatgaacgtagctaagacaggaatgacaattaatgaaggcatgaaagagtttactaatacaatgtttgaagctgaaacagaagcttatgggatgatcatgaattcttttgaagagttggagccagcatatgcagggggatacaagaagatgagaaacaataaagtgtggtgtttcggacctctatcatttactaacaaggatcacttggataaggctcaaagaggtaaaaaggcttcaattgacgatggccacctgaagagctggcttgattgtcaaaagccagggagtgtaatatatgcatgctttggaagcatatgcaatttaacaccttcacagttgatagaacttggtttagccttggaagcatcagaaagacccttcatttgggttttcagggaaggaagtcagtcagaagcattggagaaatgggttaaacaaaacggatttgaggaaagaatcagtgatcgtggccttctaattcggggttgggctcctcagttactaataatatcgcaccctgctattggagggttcataacacactgtggttggaactctaccttagagacaatatgtgctggggtgccaatggttacatggccactatttggtgatcagtttatgaatgaaagtctagttgtagaaatattaaaagttggagtgaaggttggggtggagagacctattacatggggcaaagaagaggaaattggtgtgcaagtgaagaaaaaagatattgaaagggcaatagaaagtttaatgggtgagacaagtgaaagtgaagaaagaagaaaaaggataagagagcttgcagagaaggctaaaagagctgtagaggaagggggatcttctcattctaatgtgaccttgcttatcgaggatgtcatgcaaaaagtcaagagagatgtgtga

SEQ ID NO: 867 - DNA, 1467 bp, Glycine max var. Williams 82; identical to SEQ ID NO: 866

SEQ ID NO: 868 - DNA, 2025 bp, Glycine max var. Williams 82
atgaaaaaagtttgtcattgtcccatattcctggcactggccttgtgcttgtgcatcctctgtgttgctgcagaggctgcagggcaaaatgatacactcgctctcaccgaattccgtctccaaaccgacacccacggcaacctcctcaccaactggaccggcgccgacgcctgctccgccgcgtggcgcggcgtggaatgctccccaaacggcagagtagtgggcctcactctcccttccctcaacctccgcggcccaattgataccctctccacactaacctaccttcgctttctcgacctccacgaaaaccgcttaaacggcaccatttcacctctcttaaactgcacaagcctggaactactgtacctctcccgcaacgatttctccggcgagattccggcggagatatcctcgctccgccttctcctccgccttgacatctccgacaacaacatccgcggcccaatccccacacaactagcgaaactaacccacctcctcacgttgaggttacagaacaacgcactctccggccacgtccccgacctttccgcttccctccttaatctcaccgtactcaacgtcaccaacaacgaactccgcggccacgtccccgattccatgctcaccaaattcggcaatgtaagcttctccggaaaccacgccctctgtgggtccaccccgctacccaaatgctccgaaacagagccagacacagagactaccacgataaccgttcctgcaaaaccgagctcgttcccgcaaacaagtagcgtaaccgttcctgacactccgagaaagaaagggttgagcgccggtgtcatcgtggcgatcgtggtggcggtttgcgtggcggtgctggtggcgacgtcgttcgcggtggcgcattgttgcgccagaggatccacctctggttcggtggtggggagcgagaccgcgaagagaaaaagtgggagtagttctgggagcgagaagaaggtgtatgggaacggtggaaacttggatagagatagtgatgggacgaacactgagacggaacgaagcaagcttgtgtttttcgataggaggaaccagtttgagttggaggatctgcttcgagcttcggcggagatgctcggaaaaggaagcttgggaacggtttacagagcggtgctcgatgatggttgcactgtggctgtgaagagactcaaagacgctaacccctgcgagaggaacgagtttgaacagtacatggatgttgtagggaagctcaagcaccccaacattgttagactaagagcttattattacgctaaggaagaaaaacttcttgtctatgattatctccccaatggaagcttgcatgctcttcttcatgggaaccggggaccaggaaggattccgttagattggaccacgagaataagcttgatgttaggtgcagctagaggtttggcacggattcatgcggagtataacgcatcaaagatacctcacgggaacgtgaaatcttccaacgtgcttcttgacaaaaacggcgtcgctttaatatctgactttggcctttcgctgcttttaaaccctgttcacgcgattgcaaggttgggagggtacagggcgccggagcaagttgaggtgaagaggctgtcgcaggaggctgacgtgtacggcttcggggtgctactgttggaggttctgacgggtcgggctccgtcgaaggagtacacttctccggcgcgtgaggctgaggtggatcttccgaagtgggtgaaatcggtggtgaaagaagagtggacttcggaggtgtttgaccaggagctgctgaggtacaagaacatagaggatgagttggtggcgatgctgcacgtgggactggcgtgcgtggcggcgcaggcggagaagaggccgtgcatgttggaggttgtgaagatgattgaggagatcagagtggaagagtctcctctgggagatgattacgatgaggctcgctcgcgcacttcgctttcgccttcccttgccaccaccgaagacaacctcgcttga

SEQ ID NO: 869 - DNA, 1551 bp, Glycine max var. Williams 82
atggcgtggacttcagaacatccttcactctttctcctactcctgtctctgtctctccccctcttcctcttcctcctccgccgccgcaacagcaaaacctcatcctcaaaccatcgtcttccgccgggaccaccgggctggccagtcttcggaaacatgttccagctcggagacatgcctcaccgcaccctcaccaatctaagggacaagttcggccccgtggtgtggctcaaaatcggcgccatgaacaccatggcgattctctccgccgaagccgccaccgtgttcttcaagcaccacgaccacgccttcgcggaccgaaccataaccgaaatcatgcgtgtccacaactacgacaagtcatccctggccctcgccccttatggcccttactggcgcctcatgcggcgcctcgtgaccgtggacatgctcgtttcaaaacgcataaacgacaccgcatccatccgtcggaaatgcgtaaacgacatgatcaactgggtggcgaaagaagcgagcaagtcagaacatggtcgtggggtccacgtgtcgcgttttgttttcctgatgacgtttaacttgttcgggaacctgatgctgtcacgggacttgtttgacccggaatccgaagacgggtcggagtttttcagcgcgatgatggggctgatggagtggacggggcacgctaacgtgaccgacctgtttccgtggctgagttggctggatccgcagggactgaggaggaagatggacagggacatggggaaggcgctgggaatcgcgtccaggttcgtgaaacagcgtttggaacagcagctgcaccgtggcaccaacaagtcaagggacttcttggatgtcttgattgactttcaaagcaccaacagtcaagaagcactcaacgtttcagataaagatctcaacattttcatattggaaatgttcttggctgggtcagaaacaacgagcagcacaatagagtgggccatgacggagcttctgtgcaaccgggagtgtctgttgaaggtgaaaagggagctgagttgggtggttgggtgcggaagagaagttgaagagagcgacatagacaagcttccgtacctgcaaggtgtggttaaggaaacacttcgcttacatcctccgattccgttgcttgtccctcgcaaggccacggaggacacagagttcatgggatattacatacccaaagacacgcaggttttcgtgaacgcgtgggcgattgggagagaccccagcgcctgggatgaaccattggtcttcaagcccgagcgattttctgagaataataatattgattacaaggggcaccacttcgagtttattccgttcggggctggaagaagaatgtgtgcgggtgtgcctttggcgcatagagtgcttcacttggtgctgggatcattgcttcaccgtttcgattgggaacttgactgccacgtcacgccctccaccatggacatgagggacaagctcggcataaccatgcgaaagtttcagcccttgctcgccgtcccaaaattaattgtctcttcctcctga

SEQ ID NO: 870 - DNA, 1602 bp, Glycine max var. Williams 82
atggatcgtttttcttctagtaccattctccccgaagcgtttcaaggtgccaaagatgacttcaccatgcagcttgcattggtctggaaccaaatcaaagcgccactcattgtcccgttgctgagaataacagtgtttctgtgcttgatcatgtcggtgatgatgttcatcgagagggtctacatgggcattgtcatcactctggtgaagttgtttgggagaaagccagagaaacgttacaagtgggaaccgatgaaggacgacatagagttgggaaactcttcttacccaatggttcttgttcaagtccccatgtacaacgaaagagaggtttatcagttgtctattggagcagcatgtgggctttcttggccttcagataggatcatcatacaagtccttgatgactccactgacccaacaatcaaggagttggtgcagcttgaatgccaaagatgggcaagcaaaggggtgaacataaagtatgaggttagggacaataggaatgggtacaaagcaggggctctcaaagaaggcatgaagcgtagctacgtgaaacaatgtgattgtgttgctatctttgacgctgattttcaaccagagcctgatttcctgtggcggaccgttccattcctcgtgcacaatcccgaattagccctcattcaagcacggtggaaatttgtgaatgccgatgaatgtttgatgaccagaatgcaagagatgtcactagattaccattttactgtggaacaagaagtggggtcttccacttacgccttctttggtttcaacgggactgcgggagtatggagaatttcggcgctgaatgaggctggtggatggaaggatagaaccacagtggaagatatggacttggctgtgcgagccagtctcaaaggatggaaattcttatacttgtcagacttgaaggttaaaaatgagttgccaagtactttcaaggcctaccgctaccaacagcaccgttggtcttgtggcccagccaatctttttaggaaaatggccatggagatcataaacaacaagaaagtgtcattgtggaagaagatacatgtgatttacagcttcttctttgttcggaaggtcgtagcacacatcaacacgtttgtgttttattgcattgtattacctgcaacagttttggtgcctgaggttgtggtcccaaagtggggagctgtctatatcccttccatcatcactattctaaatgcagttggaactccaaggtcactccatttgatggtcttctggattctctttgagaatgtcatgtctctgcatcgaacaaaggcaacaattattggtctacttgaggccagtcgagtgaacgaatgggttgtcactgaaaaacttggtgatgctctcaaggctaaagcaggaggtaaagcacctaaaaagcctcgattcaggattggagacaggattcacttgttggaacttggtgtcgcattctacctcttcttttgtggctgctatgatgttatgttcgggaaaaaccatttcttcatcttcctctttatccaatcttttgccttcctcatcatggcatttggatatgttggcaccattgttcccaactcctag

SEQ ID NO: 871 - DNA, 1335 bp, Glycine max var. Williams 82
atggaggaagaagccaatcaccacgcaatagacatctcaaatataatagacagagagaggcttgcttcgatggagctcaagatttcggagaatcccaagtttctatgcaaagccgcggggaagagatcttgctgcatcttccgggtcccacagagcctagttgaggtaaacggaaaagcttatcaacctcgtatcgtgtcgataggaccatatcaccgtaaccaacctcgcctcaacatgatcgaggagcacaagtggcgttacctcggttcccttctctccagaacaaacaccatcggtttcgttctagaagatttgttcaaagccattgcacccttagaatccgaagccagagagtgctactccgaaaccatcaacctcgactctcacgacttcatccaaatgatgatcctcgatggctgcttcatcattgagctctttcgcaaagtcgccagattagtaccctttgaacgcgaagaccctcttctcaccatggtgtggatattacccttcttttacagagactttctcaagcttgaaaatcaaatcccctttttcattctgaaccagttataccaagttacaaaactacccggagaaaagtcaacgccaacactgtcaactctcgcgttgctcttcttcaacaactcgttgcaaaagccagacgaatccttgcaaaacgacgtgcagggaaagcatttacttgacttggttcgttcgagtttcattcccaaaaacgatgaagaaacagagccacgaaaaagagtcatgacgccaacgcacgtgatcctctgcgtgtcgaagcttcgtcgcgcagggattaaaattaatccaagcaaggaaagtgagagttttctgaacgtgaagttcaggcgcggcgtgattgaaatgccaagccttacggtggatgatttcatgagctcttttttgctgaactgcgttgcgttagagcagtgctacagcggttgctcgaagcacttcactgcctatattaccctcttggactgtctcgtaaacacgtatagggacgttgagtatttgtgcgatcggaacgtggttgagaaccaccttgggacggagggggaagttgcaagcttcataaacaacgcgggaaaggatgtggcggttgatttggacttgtgttacttgtcactattgttcaatgatgttcacaaatattatataaatagttggcatgttcagtgggctagcttcaagcacacttactttgatacgccctggtccttcatctcgcttctcgccgcctccattttgctgcttcttaccgtggctcagacttacttttcggcttctcagtattttcatcagacttaa

SEQ ID NO: 872 - DNA, 1878 bp, Glycine max var. Williams 82
atggcagtgagaaatgcttcacatcaagaacgaagaacaggaatggtcctgccgtttcaacctctttcactcgcattcaatgacgtgaactactatgtagacatgcctgctgaaatgaaaagtcaaggaatcaatgaagatagacttcaactactacatgatgctagtggtgcttttagaccaggtattttgacagcacttatgggtgttagtggtgctgggaagactacccttatggatgtattagctggaagaaaaacaggtggatacattgaaggaagtattagcatctcaggttatccaaagaaccaagcaacatttgctcgtgtcagcggttattgtgaacaaaatgacattcattctccatatgttactgtgtatgagtcactattgttttcagcatggcttcgccttccttcagatgtaaaagcacaaaatcgaaagatgtttgttgaagaagttatggagttggttgagcttaaccaaatcagaaatgcacttgtgggccttccaggagtggatggtctatccacggaacagaggaaaagggttactattgctgtagaattggttgccaacccttcaattatcttcatggatgaaccaacatctggccttgatgctagagctgctgctattgttatgcgtactgtaagaaacacagtggacactgggagaaccgttgtttgcacaattcatcaaccaagcatagacatttttgaagcttttgatgagttacttttgatgaaaagaggaggacaagttatctatgctggacctcttggtcaccattcacaaaagctcatagaatattttgaatccattgcaggggttcaaaaaatcaaggatggttataatcctgccacatggatgctcgaggttagcactccttcaattgaggctcatcttggcatagattttgcggagatttacactaactctactctttaccaaaggaatcaagagcttatcaaagagctcagtactccaccacagggttccagtgacttgcgcttcccaaccaaatattcccaatcattctttgttcagtgcaaagcttgcttctggaaacaatattggtcgtattggagaaacccttcgtacaatgcagttcgattgttcttcacaatagccattgggataatgtttggtctaatcttctggaataaagccaaaaatatcaaaaagcaacaagatttgtttgatcttttaggagccatgtacgctgcagtgatgttccttggaacctcgaacactatgggagtgcaaccaattgttgacatagaaagaactgtattgtatcgtgaaagagctgcagggatgtattcaacattgacttatgcaattagtcaggtggcaatagaggcaatttattctgccactcaaacgaccatcttcagtgtcatcatctactccatgatggggtttgaatggacggccaggaaatttctttccttctactacttcatgcttatgtgtttgatctactacacattatatgggatgatgattgttgccgtcaccccaagttttcaaattgctgctgtttgcaattccttcttcttgaccatctggaacacgttctgtggctttgtcattcctaggacgcaaattcctatatggtggagatggtactattggctagctcctaatgcttggacactgtatggccttgttacctctcaattcggtgataaaattacacaagtggaaattccaggagctgaaaacatggggctgaaggaactacttaagaaaaacttcggttatgactatcacttcctcccagtggttgttgttgttcacttaggctgggttctccttttcttgtttgtttttgcctatagcataaaattcctgaacttccaaaagagatga

SEQ ID NO: 873 - DNA, 2427 bp, Glycine max var. Williams 82
atggcatccacatcagtgagaaatgatttggtcagcggaaaaagaaaccagcggagctggccctcatcgagtttcagagcagcaagttggagtgcatctccattcacaaagagtgctggacgcagcagtggagaggataatgaggaggatctcaaatgggctgccatcgagcgtttgccaacgctagatcgcatgagaaaagggatgatgagtgtagtgcttgacaacggaaaggttgtgtgttgccaagttgatgtcactcatcttaagttgcaagacaagaagcaactattggatactgtactcaaatatgttgacgatgataatgataagtttcttcgtaaacttagagacagaactaatagggtggggattaaaattccaaatattgaagtcagatacgagaatttatcggtggagggaaatgtgcatgttggaactagagcacttcctaccctgcttaatgttactctcaacacctttgagaggattctggagttgtttcgccttgcaccttccaagaagaggaaaattcatattcttaaagatgttagtggaatcgtcaaaccatcaaggatgaccctacttctaggtcctccaggtgcagggaaaacaacattacttttagcacttgcagggaagcttgacccagatttaaaggtttcagggagaataacttattgtggccatgaactgaaagaatttgttgctaaaaaaacttgtgcctatattggtcaacatgaccttcactatggagaaatgacagtgagagagacattagatttttcaggacgttgtctaggtgttggcacaaggtatcaaatgttggaagaacttttacgaagggagaaacaagcaggaattaaaccggatcctgagattgatgcatttatgaaggctacagccatatatggtcaaaaaactaatttgcaaacagattatgttcttaagataattggattggatatttgcgctgacactttggttggtgataacatgagaaggggtatctccggtggacaaaggaagcgtgtcacaacaggggagatgctagtaggtccggcaaaggcactatttatggacgaaatatcaacaggattggacagttccaccacttttcagatatgcaagttcatgaggcaaatggttcatataatggatgaaaccatggtgatttctcttctacaaccagcaccggagacatatgaactatttgatgatgttatccttctttcagaaggtcaaattgtataccaaggtcaacgagaacatgtgctagagttctttgaaaacatgggtttcaaatgtcctccaagaaagggagttgctgactttttacaagaagtaacatctaagaaagatcaagaacaatattggtttagaagagatgaaccttatagatacatttcagttcctgaatttgcagagtgcttccaatcgttttacataggagaacaacttgcaacagagtttaaggttccttatgataagagtcaaactcatcgtgctgccttagctaaagacaagtacggtatatcaaattgggaactactgaaggcatgtttctcaagagaatggttgcttatgagacgcgaaatgtttgtctacatatacaggataatacagttagttgtcttatctattttaggctttactttgttccttagaactgaaatgtcagtgggcactgttgaagatgggatgaagttctttggagcaatgtttttctctataatgaacataatgttcaatgggttttcagaacaagccatgcttgtttcaaggcttcctgtcttttacaaacaaagggatttcatgttctaccctgcatgggcatttgggttacctatatgggttctcaggatccccatttccttggtggaatcaggaatatgggttgttttcacatactacacaattggatttgctccttcagctagcaggtttttcaaacaattcttggcactgtttggcgttcatcagatggctatctctctatttcggctcgttggtgcagttggtagaacatatgttgttgctaatatcctgagtggcttgacttttcaaatagtattggtgcttggaggatttattgtctccaaaaataatatcaagccatggttgaaatggggctattatgtttctcctatgatgtatggtcagaatgccatagtaataaatgaatttttagacgaaagatggagtaaaccaaatacagactctagatttgatgcacctacagttggaaaagtacttctgaagtctagaggctttttcactgatgattattggttttggatatgtattggagccttgtttggttttgttcttcttttcaatcttctgtgcattgttgcattgacttatttgaatgctatgggtgattcaaaagcatttcatcacagacgaagacgacaagaagaatga

SEQ ID NO: 874 - DNA, 774 bp, Glycine max var. Williams 82
atgggaaatatgccaccaggttatcgcttctaccccacagaagaggagctgattttgttctatcttcacaataagcttgaaggagaaagggaagacatgaatcgagttattccagtcgttgatatatacgactacaacccatctcaactcccacaaatttcaggagaggcaagtatgggagacacggagcaatggttctttttcattccgaggcaagagagtgaagccagaggaggaagaccaaagcgtctcacaactacagggtactggaaggccacagggtctcctaatcatgtttattcttcggataatcacatcatcggaattaaaaggactatggttttctatagtggaagagctccaaacggaaccaaaaccgattggaagatgaatgagtacagtgccatcaaaggtgaaccatcatcctctatttccaataaggctgttcccacgttaaggaaggaattcagtttatgccgagtgtacaaaaaatcaaagtgtttgagggcatttgatagacgaccacctccaaggagggacgtagttagctattccggtgctcaaaatgtagaagagcaacaaaagggttcaacattatatgattatcatcataaaataatggtgaagagaagtacaacgtgttcaccagagacttctacttcctccggagaccatgaccagccccctcttcacggtgaggaaactactcaaatggatgttgacccttttttggattgggagaaagtggattttttcttgggatcagaaccatga

SEQ ID NO: 875 - DNA, 573 bp, Glycine max var. Williams 82
atgtctggctcccgaaagaagcttcttctgaacaccgtgtccgtgaaactaggctgcggcacctgcagaagaccaagcctgcgtcgcatattccacccaaagccaaaaccaaagaatcttaacaacaacaccaattaccgaaagcacaaacattcttcttcttcttctgcttcttcttccttttttgcaagccaatgggggggtgacagcaccagcgccacccccaccaacaccaacaccacattctcaccctacgttgattcctcacacttttctgactcagattcctacgtgaaggctgtggggggtttaggcagagctgggaaagaaggtgtggctgtggagaaagactctgatgacccttatcttgatttcagacattccatgcttcaaatgatattggagaacgagatatactccaagcaggatctcagagagcttctgaactgctttcttcagctgaattcaccgcatcatcatggtgttatagtcagagctttcactgagatctggaacggtgttttctctgtgaggtccagttctcacatccaccttaagccacgtgagttctaa

SEQ ID NO: 876 - DNA, 573 bp, Glycine max var. Williams 82; identical to SEQ ID NO: 875

SEQ ID NO: 877 - DNA, 684 bp, Glycine max var. Williams 82
atggccgataagcaaccccacttgaatggtgcttattacggtcccgccattcccccggcggagcaaccacactaccgccctagccgcgaaagaagctgctgttgctgcctcttcggaatcttgtggaagattctggttgcactcattgtcctcgttggcctcgcggtcctcatcttctggctggtggttcaaccccgttccttcaagttccacgtcacgaaagccaacctaacacaatttgattactataccaacaacaacacccttcactacaacatggtcctcaacttcactgcacgcaaccccaacaaaaaactcagcatatactacgacaaagtagaggcattagcattctacgaggatgtcaggttcgccaattacagtgtgataacgcacatgaactccttccgccagtacaagaagaccaccagccacatgagcgccgttttctcggggcagcaagtgttgccgctcgacaacgacctagtctcagagttgaaccaagacaagagtggtggggtgtacgagatcgatgtgaagctctacttcaggattaggttcaggctcggggatgtcaaaacccgtcgcttcaagcccgaggtcaaatgtgatatcagggttcccttgaggaccaatggcagcgtaactttgtttcagaccaccaagtgtgatgtcgattactag

SEQ ID NO: 878 - DNA, 732 bp, Glycine max var. Williams 82
atggccgataagcacggaagaagctgctgttgctgcctctttggaatcttgtggaagattctggttgcactcatcgtcctcgttggcctcgtattcctcatattctggctggtggttcaaccccgctccttcaagttccaggtcacggaagcggacctaacccaatttgattactacaccaacaatcacactctccactacaacatggtgctcaacttcactgcacgcaaccccaacaagaagctcagcatatactacgacaaagttgaggcattagcattctacgaggatgccaggttcgccaattacgatgtcataactcacatgaactccttccgccagtacaagaagagcaccagccccatgagcgccgttttctcggggaagaaggtgttgatgctcaacagcgaacaagtctctaagttgaaccaagacaagagtgatggggtttatgacatctacgtgaagctcaacttcaggattcggttcaggctcggggactccatatccggtaacttgaagcccaaggtcaaatgtcacctcaaggttcccttcagtaaaagtggcacctttactctctttgagaccaccaaatctgctgttgctgcctctttggaatcttgtggaagattctggttgcactcatcgtcctcgttggcctcgtattcctcatattctggctggtggttcaaccccgctccttcaagttccaggtcacggaagcggacctaa

SEQ ID NO: 879 - DNA, 2001 bp, Glycine max var. Williams 82
gtggcttggaaagaaacacatggagctctgagttgccgtatggtccccacacacaggctgtaaaagaatagtatatgctatatgttcatgtgacatgaacgcaaaggaagagttgagatagagaccgagcaaccataccccacacccacgcatccttcttctcttgtcatttccccacactctctttccctccatgagcgccatggatttctcttccatctatggtgtctcacacaaacccttcctcaccctcttccttctcttccttctacctctccattctcactctcacaactctacaacctcagctcagattaactctaactccatcctcgtcgctcttctcgattcccattacaccgaactcgccgaacttgttgagaaagcgcttcttctccagcagcttgaagacgccgtcggcaaccacaacatcaccatcttcgccccccgaaaccaagcccttgaacgcgacttagaccctgaattcaagcgtttcttgctcgagcctcgcaatctcaggtccctccagacgctcttgatgtctcacattctccccacgcgaatcgcctctcaccactggcccgccgccgacctcctccaccgcactctctccgaccaccacctgcatttggcctccaagccctccggccagagaaccgtcgactccgccgagatcctccgcgccgacgacgtcctccgccccgacggcgtcatccacggtatcgagcgcctcatcgtcccccgatccgtccaggaggatttcaaccgccgccgcaacctcgccgccatctccgccgtcctccccgagggagcgccggaggtcgatccccgcactcaccgcctcaagaagcccgctcccgtccccgctggcgcgcctccggtcctcccaatctacgacgccctggcaccgggaccgtccatcgctcctgcgccggcgccgggaccgggaggcccgaaacaccacttcaacggcgagcgtcaggtgaaggacttcatccacacactcttgcattacggaggctacaacgaaatggctgatattctggtaaacctaacgtctctggccaccgaaatgggaaggctagtttcggaaggctacgttctcaccgttttggccccaaacgacgaagccatggcgaagttaacgacggatcagttgagcgaacccggcgcaccggaacagatcatgtactatcacattattcctgagtatcaaaccgaagagagtatgtacaatgcggttagaaggttcggtaaggttagctacgatacacttcgcttaccgcacaaggttctggcgcaggagtctgacggctccgttaaattcggtcacggcgattcctccgcttacctgttcgaccctgatatttacaccgatggaaggatctccgttcagggaattgacggcgttcttatccctcccgaagaagaagaagaagaacgcactcgccgcatcactccacttgtcaaggttgctgctcctaaaccaagaagagggaagttggtggaagtcgcctgtagcatgtttggatcttttggacaagtctgccaatgaaatcgctttctcaactaattacaaaaataataaagagtgcatgtatgtaaactcgatgaatggtaagttttacttttacccaccactcattgcttgcttttattcatttcttgcaatagcaggtctgatctgattcatattttccccccatgcattatgcagttgtagagtaatgatttcaatacaaaaaggatggaagcatcgtgaatctatagttggagagcgattacaccgaagataacaaaaacaaattttctgtcattttggtctcatactgtaattacataccatttttttattaaattttattttatgttgattctccgtctttatgcgtaaataaccgacaccccttcttggttgccttttttttttttttcttcttgtttgtatgtatgtgaatcaattcatacataatctactttattattattatgccttccaaa

SEQ ID NO: 880 - DNA, 975 bp, Glycine max var. Williams 82
atgggttccctccctcacgtagtagaggactgcatgggcttcctccaactttatagcgacggttccattttccgttccaacgacatagaattcaaagtttcacccattcaagacaactccataacctataaagattatctctttgacaagagattcaacctttctcttcgcttctacaagccccaacacgtagcacccatagacaataacaagaagcttcctattgtgatgttccttcacggtggaggcttttgcttcggttcgcgcacgtggccccatattcacaactgttgcatgcgcctcgcgtcggggctccaagcggtggtggtttcgccggactaccgtctggcgccggagcaccgtcttccggccgcagtagacgacgccgtggaggcggtgaggtggctccagaggcaggggctgagcttgaaggaggacgcgtggttgagtgggggcgttgactttgattgcgtgttcgtggtgggtgactcgtctggcgggaacattgcgcaccacctggcggttcggttggggtccggttcgagagagatggacccggttcgggtacgaggttacgtgttgtttgctccgttttttggcggggaggttcggaccaagtccgaggaaggtccaccagagcacatgttgaacctcgagttattagacagattttggaggctgtcgatgcctgttggagagagcagagaccacccattggcgaatccgttcggacctggaagcccaaatcttgaacaagtgaagcttgatcctattttggtaatagtaggtggcaatgaattgctcaaggatagggcaaaaaactatgcaacaaggttaaaaaaattagacaaggacattaaatacgttgagtttgaagggtgcgagcatgggtttttcacgcatgattcattctcatcagaagttacagaagaggtcatccaaatccttaaaggattcatgcttgcaaacttctag

SEQ ID NO: 881 - DNA, 1362 bp, Glycine max var. Williams 82
atggcaacaaatagattcgtgtgtgagatctgcaacaaaggatttcagagggaccaaaaccttcagttgcaccgcagaggtcacaatcttccgtggaaactgagacaaagaacaagcgctgaggtgaagaaaagggtctatgtgtgccctgagccatcatgcgtgcaccataacccagctcgtgcactaggggacctcactggcatcaaaaagcattatagccgcaaacatggtgagaagaaatggaaatgtgacaagtgctccaaaagatacgcagtccaatctgattggaaggcccaccagaaaacttgtggcactagggaatacaaatgtgattgtggtaccatattttccaggagagatagtttcatcacccacagagctttctgtgacgcattaaccgaagaaaacaaccgagtgaacaaccagggattaacaagtggcatgccaccaaacttgcaaagtaaaatacctgatctcatgtccaccatgcccctaacaactagtcccaacacaacaaccaaattcggggactatgaccctaagaaccctctaaaatcactagcccaagaacttgtcccaatacccttcaagcccacaagcatgggagggggcatgttctccaccaatgcaggtgcacgttttggtggcccaaaaaccatgtctccctcttcttccagcctccaactaggttccagcacctcatcaagcttcaattacttgcaagatagcaaaaacggaggactaatcgcagcctcggctcaaatgtccgcaacagctttgttacagaaagcagcacaaatgggtgccactgcaagcaatagtattaactccccaatgatgcaaaaaggctttgttggtggcactaccactggtcctgatcatgtttctttcactactaggccaccatattatggtgctatgcttcagcacaacaactcctatgaccacttctctccacagcatgatctttccaacatggctggggtgagtggtggaggagcattcatcaatcaattgtttcataaaggacaagaaatttcacaagtttttgacactaacactacaatgaatggtgtgggaatgttcagccaaatgccaatggggagtgaacacaatcacaaccaagggttgatgaagaatgtggaacaagaggttagtaatggttccagtttgatacatgtaagagatgtgagtgatggtaaccacacaatgcagccatcaaggtttggagggagtgacatgacaactgttcatgacttcttggggattggtggttcaacttcaagagttatgaatcattttcatcaccattttccacacgaggattcggctattgaggaacccatgtgggatgtttga

SEQ ID NO: 882 - DNA, 1638 bp, Glycine max var. Williams 82
tttcaggtgatgaaggaagcttctcctcaggaaacaatggggaagaagttcatcaagaaagtcagcaccaacatcaacaaagccaacttcatgactcaagttcaggaccatccggtgcttgcaatagcaatgcctccactaatcaacaacaaaccaagaagaaacgaaaccttcctggaaccccagatcctaatgctgaagttgttgtcttatcaccaaccacactaatggcaacaaatagattcgtgtgtgagatctgcaacaaaggatttcagagggaccaaaaccttcagttgcaccgcagaggtcacaatcttccgtggaaactgagacaaagaacaagcgctgaggtgaagaaaagggtctatgtgtgccctgagccatcatgcgtgcaccataacccagctcgtgcactaggggacctcactggcatcaaaaagcattatagccgcaaacatggtgagaagaaatggaaatgtgacaagtgctccaaaagatacgcagtccaatctgattggaaggcccaccagaaaacttgtggcactagggaatacaaatgtgattgtggtaccatattttccaggagagatagtttcatcacccacagagctttctgtgacgcattaaccgaagaaaacaaccgagtgaacaaccagggattaacaagtggcatgccaccaaacttgcaaagtaaaatacctgatctcatgtccaccatgcccctaacaactagtcccaacacaacaaccaaattcggggactatgaccctaagaaccctctaaaatcactagcccaagaacttgtcccaatacccttcaagcccacaagcatgggagggggcatgttctccaccaatgcaggtgcacgttttggtggcccaaaaaccatgtctccctcttcttccagcctccaactaggttccagcacctcatcaagcttcaattacttgcaagatagcaaaaacggaggactaatcgcagcctcggctcaaatgtccgcaacagctttgttacagaaagcagcacaaatgggtgccactgcaagcaatagtattaactccccaatgatgcaaaaaggctttgttggtggcactaccactggtcctgatcatgtttctttcactactaggccaccatattatggtgctatgcttcagcacaacaactcctatgaccacttctctccacagcatgatctttccaacatggctggggtgagtggtggaggagcattcatcaatcaattgtttcataaaggacaagaaatttcacaagtttttgacactaacactacaatgaatggtgtgggaatgttcagccaaatgccaatggggagtgaacacaatcacaaccaagggttgatgaagaatgtggaacaagaggttagtaatggttccagtttgatacatgtaagagatgtgagtgatggtaaccacacaatgcagccatcaaggtttggagggagtgacatgacaactgttcatgacttcttggggattggtggttcaacttcaagagttatgaatcattttcatcaccattttccacacgaggattcggctattgaggaacccatgtgggatgtttgagatcagatactaatcatgttgtgtggaagattttaatggttagaattgg

SEQ ID NO: 883 - DNA, 396 bp, Glycine max var. Williams 82
atgaggcatttcgtcgaacagttggcgatggagtgcgacgtggccggacgaggcgtagacgtcgaggatggagttgcggacgcagaggtcttggtggtggccgagtttaaggacgtgggtgtggacgcactgcgcttgcgtgacgtggcgggtgtcggagagggacttgaagaggggagggaaggtgaagttgttggggaggacggagttgaagcgcatgcgggtgtagatgaagagagggttgtgtggagtttggttttgggaatgggagaaggctctgatgagggtgttgaaggtgtgaacgtgggggtggtgaagagaacaagagcagtgttgagaaggccgtgtgattggcacgcgccgatgaagtgttcagcgattctggtgtttgggtag

SEQ ID NO: 884 - DNA, 882 bp, Glycine max var. Williams 82
atggcagccaaaccagctgaagaagctcctcaaggagaaaccctcaagtaccagacgtgggctttgaaagtattgatccactgcgatggctgcaaaaggagagttaagaaaattcttcagggaattgatggggtttatacaacagaggttaattctctgctgcacaaggttacggtcaccggtaacgtggacgctgagactctcatcaagaggctttcaagatcagggagggtagtggagctttggccagaaaaaccacctgagaagaaagataataagaagtctgggaaatccaataagggtggtgctggtgatgctaataaggagaaggaagaccaaaagaatagtgaaccagattctgatggtggtggttcaaatgagggttctaaagacgctcccggtgaagattctgacaaagaaggtcatagttatgaatgtgaggagggaggtggtggtggtgaaggtggcaaaaagaagaaaaagaaaaagaaaaagaagaacaaaggggaaaacggtggttctgcatctgcaactcctaataataatggaggaggagaagaaattagtaaagttgaagcattagtcccttcaaatttggacacttccttcactcccaaggatcttattagtcctccaattcagcatgcttacccatatccaccacaggtgtattatccacctcctccagcatatggattaagctataacacagcatatcctgtctccagtactgcttcatattatgttggtgctcctatcatgcccatgcatgcttacactactccatactctagactgccaccacctcctccaccatctgatccaatcaagcactatgttgaggatgagtatgaaagtgatggatattgctccattatgtga

SEQ ID NO: 885 - DNA, 975 bp, Glycine max var. Williams 82
atgaagttctgcaaaaaataccaggagtacatgcaaggccaggagaagaagcttccgggcgtaggattcaagaagctcaaaaagatattgaagaagtgcaggagaaactcttcatcccagaaaccccttcatgcatcccttgccgccaaaacctgccccgaccattgcccagtgtgcgatgggaccttcttcccttcccttctcaatgaaatgtcagatatagtggggtgctttaatcagcgtgctcagaaattgttggagctacatctcgcttctggggtcagaaagtacttcttgtggatcaaaggcaaattacaagggaaccatacggctctgattcaagaaggcaaagatcttgttacttatgcactcataaatgccattgcaattcgaaaaatactgaaaaaatacgataagattcattattccaagcaagggcaattgttcaagtcgcagatccagagtatgcacaaggagattcttcaaagtccctggctttgtgagcttatggccttccatatcaatttaagggaaactaaggtcaagtcaaggaaggcacatgctttgttcgatggatgttctctcacattcaaggatgggaaaccggcacttacttgtgagctctttgattctatcaaagttgacattgacttgacttgttctatatgcttggacaccgtgtttgatccagtttctctgacttgcggccatatattctgctatatttgtgcatgctcagctgcatcagtatctattgttaacggacttaagtctgcagatcctaaaatgaagtgtcctctatgtcgtgagggagcagtttatgaaggtgctgtgcacttggaagaattaaatattctgttaagccgaagctgtcaggaatactgggagcagaggattcagacagaaagggtggagagggttaagcaaataaaggaacactgggattcacagtgtagggcattcgtgggcgtctaa

SEQ ID NO: 886 - DNA, 486 bp, Glycine max var. Williams 82
atgaagttgaggtcttcaatcgcatttatttgcattctggcgagtgtgagtgtgacaatttcagaatcattaagccaacaagagcaattgtcagcatatgaagttcttgagaaatacgatctcccagtggggcttcttccaaaaggtgccacagggtatgagctaaacgaaaaaaacgggcacttcacagcgtatttgaatggaacatgctacttcagcatagagtcgtatgagctaaagtacaagtccacaatcaagggcgtgatctccaagggcaagttgtcgaagctgaagggtattagtgtgaagattgaagtgttgtggctcaaaatcgtggaggtcactcgcgacggcgatgacctccaattctcggtgggtgttgcctctgctggcttcagcgtcgacagcttctcagagagcccccagtgtgggtgtggattcgattgcaactatttcaatcaaaacggtgatgtttcttctctttag

SEQ ID NO: 887 - DNA, 663 bp, Glycine max var. Williams 82
atggcagaggttgtcttgctagtcgatgatttgaaactactttctgcgattcctcgctgtagaatttgtcatgaagaagagtttgaaagcgtagaaaccttggaagcaccttgtgcttgttctggaaccgttaagtttgctcatagagattgcatacagagatggtgcaacgaaaaaggaaatacaacctgtgaaatatgtctccagcaatacgaacccggatatacagctcctccgccaaagaagtctaagataaatgatgaagcaatgtctattagggaggaggaagaagcgtcaaacgcaagaatagagattatggttgaaggagtggcaatggaaagcgattactccgaatgcagctctgccgctgacagaagcgggtcttgctgtcgatcacttgcaatagcttttacactagtcttacttgtaagacatcttttcccagtgcttacaaatggaacggaagattacccatttacactacttactgtaattatactaaaggctagcggaattattataccaatgtacataattattaagattctcggagctattcagagttgtattcagcactataaggatgctgactatgatacatcaatgtctgaggaagatgacgaagatgagatacatcataatgtaaatccaagacatttatag

SEQ ID NO: 888 - DNA, 3171 bp, Glycine max var. Williams 82
atggtgatgcacatagagcaccacgtgattttgaattcagaatatgttctctctcaattccaatccgaaattgagcattcggccggactgatacaccctataaattcgtcctcaaccaattttgcaaaacttttgagttcaactctccaagatactaacctttcattctctgatatcaagaccaaggtggctccgttattatttaaagcatttgagacggttcctaacttagcccaaatttcatacatagaaaagaaaggtttatttttctcatactacactgattatggtcaagttttggcaatgtactcaaactcatcatcactttccacttcttttgggggtgcctcaaatttaagcatatattatatccagcccgtaaatcgtgacactggagagttatatgggaaagccataatatctgaagtaccatctaatattatcaatacaagttggtttgtgaaagcagttaatagttcacttagttatgcctcattgggaaccaagtggaacaatgatcatgatcttctattcgttagttcatctagaataaaggggacacaagtgatctctctaggcattccagtaacaactatcactgatttcttcactccggttggggcgaatttgtctttggttaccaaagatggaaaaatgcttgtagaagggattcaaaatactcgtttgggcttctctaatgacatggtttatttccaatcagtgaatgcaaatggtgatcaaacaagttatgacggcgttgtttcatgcaaagatggagatgcagaagctgcctctattttgaatattcagggtgttgagtatttaattcgctgctccaccattgatataatggaaataaaatcggtgtatgttttggctgtcccacgaaaaggattggaccactttgttctggacattaagaaaaaaggattggcactattgacaacaatgattgtcatgatactcattgccatggtcagttttctatacataaatgttagatcattaaggcgagaaatgcatttgtgttggtcactcatcaaacaaaatgaagccacacaacaagctgagcgaaaatgtatgaacaagagccttgcttttgctagtgccagccatgatgttcgcgcttcgctggcgggccttactggtttgatagaaatgtcctttcatgaagtttctcctgattctgaattaggaaccaacttaagacaaatggattcttgtaccaaagatttactaggactattgaattctatacttgatgcaagtaaagttgaagctggcaaaatgctgcttgaggaagaggaatttgatgtatttcaactccttgaagatgtggttgatttataccattctgtggctatgaagaaaggagtagatattgtgttggacccttgcaatggttctgtactcagatattcgcgcacgaaaggcgacagaggaaaactcaaacaagttttgtgcaatttactgagcaatgctgttaaatttaccgaggaggggcacatagctgttcgagcatgggctcagaagccaagcttgcagagctcaatgattgctactcaccaatacgggtccagtagacttttgtcgcgcttgtgttgccgccaaaatgaagcacgtgatgacgtggaagacttgaacatccaacaagatccaaattgtatggattttactattgaagtggatgacactggcaaaggaattcctaaagagaagcacaagtctgtttttgaaaattatgtccaagtcaaagaaactactcttggccaagaaggaactggcttgggacttggtattgttcagtcactggtacgtttgatgcatggagatattgaaatcatggacaaggatattggtgaaaagggaacctgctttaggttcaatgttctcctcactgcccatgagacacagatgaatgatgacacaagagatgaccaagctggatcaggtaacaaaaatcaatctcatggactaaccatgagtcccaagttatctatttggacccgtagtcctagatccgaggcttctcgagttgttttattgattcaaaatgaggagcgtcgagggactacgcagaggttcatggagaggttagggatcaaagttaaggttgtgaaggagtggagacaacttcattacactctgaagaagatcatcaaacaaaagggtctccatccaaatagctcaagctcgccagagtcttcagattctccctctgcatcaagctgcacaaacggagtccctttgagtgcacaagatggaactaattacataagttcaatcttcaagagaacagatattgaagcttcctcgggttttgtcctgattgtgattgatgctaatgcaggacctttttcagagctttgcaaagtggtagctgagttcaaaagaggcctttgttatccttgtagggtggtttggttggagaatccacttataccttctgtggacaacaaaatccttaacaaggatgtttctaattctaatgacattgtcttgtctaagccacttcatggtcatcgtttattccaagtcataaggattctccccgagtatggaggtgtttggccatgcagttctagtgaaacaaagaaagaaaagggtcaagtttccttaactgatgaaggtgcaattcgacgtgttgaactacaagagtgtggcagctcaagcgttacacagcaatcttatgatagatctagagcaagaaaatctcatatccaccaaggagaaatacaagaatgtgaagagttaagcaatgaaaaacccttgtggggtatgaaatgtttggttgttgaggacgttgttttgttacgtaggataactaagtctactcttgatcggcttggtgcttctgtcatggaatgtgagaatggtgaacaagctgttcagacagttgaagagggtctaactaggaattcttccaatcgtccatgtgatttcatcttaatggactgccagatgccggtaatggatggatatgaggcaacgagacggataagggagattgagaagtctcatggtgttcacattcctatctttgcattaacagctaatacagggaaagaggcaatattgtccattgaagctggaatggacgatcacttaatcaaacccatcaacaaagaggctttacttaaagccatcaaaagaatatatactaaagagtga

SEQ ID NO: 889 - DNA, 801 bp, Glycine max var. Williams 82
atggatgttaaggtgaagaaatcacagtccatagaattacaggtgcaggattgtgaagaagacatcagaaaaggtccatggagcgttgaagaggacaccattctccaaaattacgtcgccacccacggtgacggtcgctggaattccctcgcacgctctgcaggcctgaagagatcagggaaaagttgcaggttaagatggctaaactacttgcgtcccgatgttcgtcgtggaaatataacactccaagaacagataacgattctggaactccactctcgctggggcaataggtggtcgaaaattgctcggcatcttccaggtagaacagacaacgaaataaagaattattggaggacccgagtgattaagcaagcaaggaacctcaagtgtgacgtggacagtaaacagttccaagatgccttgcgttacgtctggatgccccgtttgatagagcggactcacccttcactaccaataccatcggaaactcacggcccggcccatgttgacccaaatccaaccgctccggcccaacacgagttgcatggttctggttcgggctcgggtccctctgccttggaggatgtctcatcaggagcggagttaaacgctcctttagattctgattctgaacatttggtttatgatgtttggggtacatgcgacagtttcaatgggaatagcacgttacctttaggtggtggggacttgatggagagtttgtgggaggatgagaatatgtggcttatgcgacagctttgtcatgatctggaaattaaagacaatttccttgcgtga

SEQ ID NO: 890 - DNA, 1407 bp, Glycine max var. Williams 82
atgaggataccttcaactctcgtggaagtgcttctggtacttgcattgttctgttgtagcccatggacagtgtggagcagcaccactctttgccaacagacgaacgaggaagttcgacctcacagtgtcagcatcaccgaatttggtgcagttggcgatggggtcactctcaacacaaaagcatttcagaatgccatcttctacctgaattcctttgcagacaaaggtggagcaaagctttttgttccggcaggccggtggttaactggtagttttgatctcatcagccatctaactttgtcgttggacaaggatgcagtaattctgggatcaacgaaccctgaagattggccagttgttgatcctctaccgtcgtatgggagaggaagagagttgccaggtggaaggcataagagcctcatttatggacataatttgactgatgttatcataacaggtaataatggaactatcgatggtcaagggagtatctggtggaacaggttttggaacagaagtctggattatacacgtccccatttggtagaattgatgaattcaacaggggttctcatttcaaatttaaccttcttgaattctccattttggacaatccatcctgtatattgcagccaagttacagttcagaatgtcaggatccttgctcctcatgattcgccaaacacagatgggattgatccagattcttctgacaatgtatgcattgaagattgttatataagcactggtgatgatctgattgccatcaagagcgggtgggatgagtatggcattgcatatggtcgcccaagcacaaacattatcatccacaggctagttggtagaactcaaacaagtgggattgctattggaagtgagatgtctggtggtgtatctgaagttcatgcagaagatattcaattctatgattcatataatgcaatcagaataaagacttctcctggcaggggtggttacgttagaaacatctatgtctctaacgtgaccttggctaatgtagatattgctattacgttcactggtttatatggggagcatccagatgatgcttataacccaaatgctctacctgtaatagaaaagattacaatcaaggatgtggtaggagaaaatatcaaaactgcaggtcttatagagggtatagaaggtgacaattttgtcaacatttgcctatcaaacatcatccttaatgtgacctcaaactatccatggaactgctcctacgttaaaggatattctgacttggtccaaccagaagcttgtgagcctctcaaggagagaatattccctggtcattgttcagattgttactatttgacaaatcaaattcagagttccaatagtcaaaatagagcaggacaaacttcaggtgacataagaggttga

SEQ ID NO: 891 - DNA, 840 bp, Glycine max var. Williams 82
atggatacttctcgcagaatttctggattcaagtacgattgtttgcttttggatatggacgatactctctacccattgagcacaggtctcaatttggcatgtcgaaagaacatagaagggtatatgttgaaacatctgctgatggaagaaagtgaagtaccaaagctttgcgtggatttgtacagggagtatgggacaactatggcaggactaaaggcctttggttatgagtttgacaatgatgaatttcatgcctacgtgcatggaagattaccatacgagaaactgaagccagatccagtgttaaggagccttctgctttccatgcctcagcgtaaaatagtattcactaatgcagatcaagcacatgcacaccaagttctcaacagattggggttgaacgattgttttgatggcatcatatgctttgaaacgcttaatccgcctaattacacaaatgtacctactgatactcacttgctaacatggagtaagtcgtttaacaaagactgtaaccaagtagagagcggatgtttcaactccaagacacaaatcctatgcaaaccctctgtggaagccattgaagctgccattcagattgctaatgtagatccaaggaaaacgttgttttttgatgacagtgcaagaaacattgcaagtgggaaagctgctggacttaacacagttattgtgggacgctcagatttggtgcctggtgctgactatgcactgaatagcattcataatatcaaagaagcattgcccaaaatatgggaggttgagggagagctacagcaaatgatccaatccccagcagttgaaaccatggtccttgcatag

SEQ ID NO: 892 - DNA, 1995 bp, Glycine max var. Williams 82
atggcagatttggaaaacatgcttcttgaggcagctggaaggactagttctccggtgagcaagcggcccaagccaaagaactcaaaggccaaacgtgagggtggtgctggtgcagcattctctgatggtggaagtgactccagagatgaaaactctgatgagggtgcaggcaagaaaccacagaggtattcatcccatgttcctttgaagaagagattggacatgaacaaaagaggtaataataataatgaccgtggtggggctgagttggaggatggagttcctgatccagatagagatggtggcagcagtgaagaatctgatgttggcagcgatctctacaaggacgaagacgacaagcagaagcttgcaaatatgacagaacttgaaagagagatgattttgtctgatagagcaaccaagaaatgtgaaaaggaattcaagaaaaaaatgagagtgaagagggaaaacaaaaaagcaaatgcaaagactactactactaatactactactgcaaattcatctcatcatccttcttctgtcaaggttcgttcctcggctagacatgctgaaaggacggcttcaaagggagacgtactaagcgaattgcgcgcgaaaaggaagaagcaacaagtcttagaacctcgtgataaattgcgaaatgctttaggaacaggctcaagtagcaagcagaaacccggaatcacagcaagtccaagtagctctagtcagagtgagagtgcttttcggtcagacagcgaaagagactcgtctgatgatggtggattgggtgacagtgatgatgacaagagcatgcatgaatcgaagatgccaacatttgagaacataagggacatcaccattaggaggtcgaagcttgtgaagtggttgaatgaaccattttttgatgagttaattgttggctgttttgtgagaattggcatagggaagttagaaaatgtacctgtctataggctctgcattgtccagagagttgatgggggtgacccaaataagcattacaaggtagagaatagagtcactcacaagtacctagtttgtgtgtggggcagtgataactctgctaaaaagtttcagatggctgtagtttcagattctgcaccattagagaaagagttcagacagtgggttagagaacatgagagaacttgcagccagatgccaagtaagatgagtgtgttggagaagaaggaggccataagaagaactagcaagtatgtttattcagctgccacagtgaagcagatgctagaggagaaaaaatctgttccatctaggccactgaatgttgcagtggagaaggatcggttgaagaacctgttggaggtagcaaaaagtaagaatgatgaggcagagatggataggatcttgaaaaagcttgtggaattggaagcatctcgtagaacctgggagaatgatgccaaggctgtgaggctggctgagatgaacaggaagaacagggttgagaacttcaagatgttgtctgaacaaaaacagttcaatacaaatttgaaggctggagaggaaggcgttgatcccttttcgaggaggtggacgaggtcgaggaattactatgggaaagaagctgagaagaatgaagataaaagagaaaaggatggtgaagttagtaaggtgggagaaaaagaacaagaaaaaggaggtgttacaacaaaggttggtgttgaagtcacagaattggcattgcaagctgctgctaatgcagggaagttgattgataccaatgctcctgtagatggtggaacagaattacatatgctgcatgattttgacttgcctatctctttggccgaactcaagagttttggtggaccacagggactcaaaaatgggtttctggcaaggaaacaaaaaatagaagcaacagttgggctccaggtttctgagaaggatgggagtaggcatgctcttacattatctatcagtgactacaagagaagaagaggacttctgtga

SEQ ID NO: 893 - DNA, 1857 bp, Glycine max var. Williams 82
atggtatcaaaaaggcaatctggtcagaggcacgaaggcaggggcaaagttccaattcaggagcaaaaacaagcatcaatcagtggccttagaaatgtgatcaacgcgctatggatgagtgataaatcttcctatttggaaaattttctgcgaagagtggtaagagaggtggtggaacaaaaaatccaggaccaagctcatctattttcaagggaaagggttggtgaggctggcatatccggagccaaacatttaaagttgtgttttattaataagctgcctgaaacaatttttacccggtctagtataataacaaaagatgaatcatttcttcaaattgcgttatttgatgttagaactgagtctgtagtaaatgatggtcctctttcctcactaaagatagagatctgtgtcctggatggagagtttggatctcatggctgtgaggattggactgaagatgagttcaattccaatattttacgcgaaagagaaggtaaagagcctctattgattggagagagatttattacgctaaaaggtggagttggttgtataactaaaattgccttctctgacaactcgagatggcaaagaagcagaaggttcaggattggagtcaaagctgtgcaaccaacttccaatggagaaaagattcaggagggtagaagtgaaccttttgtagtcaaagataacagaggagagtcctacaagaaacactaccctccatacttgaagttgaatgatgatatatggcgtttgaagaaaattgctaaggaaggaaaaatccacaagcagctctctttgcatggaattcacaacgtcaaggatctcttgcgtttttacataaccaacgaaccttcattatatgaaacgtttggaaatattccaaagaagtcatggttagtaatcactgagcatgccaaagcctgtgagatagatgattaccagctttacagctatcactcagaagaactgcaagtaggcctgctattcaattccatctacatccttgtgggagtgacattcgattggcaaaattattatttacctgatactctcaatcctagagaaaagcatttggtggaaatagtgaagcatcaggcctacaaaaatgtgtacgatttgaaattgattgaagagactaagttgaactatttaaatctagctgcatgtctaaaagcaaggcagtctgacactcaagatcaaggtctgcaacatgttaatatctcaactgcacaaggtatatgtaatggtataacttttggctatttcatcatctcctattctgtatcactcagcaagactttgaacttacaagggatcaatcactattcactaagcaagggctatggcaggacaggtcaatcagtaacatttccagattatagtcaaccatctatctctccttcatatactgatgaaggaatgcatgaccaccaagtttatgctgatccactgccaggcataacagagatgtcacaaaacagtcatctgttagatgaactttcctctgaaatgtacactgaagaggatagttgtgaccttaatggatcgcaatttccattcgtgcgaggtggttattcaacagagaatgaaagctcagagattcaattcatagatgattgtcctccttacacaacatgggagccagaaactggcattttatttggttctcctgttggagcagaatttagcagctattctactttcatcaattcggatgtggatatatcaagtagtggcaaaaccaaagcagtgtggtataagattcgtgttgctctcaaatgggtcatatcagtgaaaagggatgcagctgccagaaggaatggccatctattttaccataactattag

SEQ ID NO: 894 - DNA, 300 bp, Glycine max var. Williams 82
atggaggaaataaagcacaggacagtggaagtgaatggcataaaaatgcatatagcagagaaaggagaaggccctgtggtgttgttcctccacatagtggctgatcttgttgcccttattggttggtacctctgcatctttcgccccgaaaaggttaaggcatacgtctgcctcagtgtccctctccttcacagtcaaaaccgcagttgcaatttattttcatattttgatgggcaggaatattcatcaacttccctgctgcttgtgttgtgtgtaccttgtatatattgtacccgctaa

SEQ ID NO: 895 - DNA, 484 bp, Glycine max var. Williams 82
gatcattgtaaaagatgaatatcggtttgtaaagagagagatggaggaaataaagcacaggacagtggaagtgaatggcataaaaatgcatatagcagagaaaggagaaggccctgtggtgttgttcctccacatagtggctgatcttgttgcccttattggttggtacctctgcatctttcgccccgaaaaggttaaggcatacgtctgcctcagtgtccctctccttcacagtcaaaaccgcagttgcaatttattttcatattttgatgggcaggaatattcatcaacttccctgctgcttgtgttgtgtgtaccttgtatatattgtacccgctaaactttagcatataatataaactttcaatcttgtcatgcaatcgtattatgttgtgctttcaataatattcatggctcatgcattgatccattttgggtttattagaaagaactggaatgaaatggaaggctagtgttcagtttt

SEQ ID NO: 896 - DNA, 1284 bp, Glycine max var. Williams 82
atggcttccatcctccactactttttagccctctctctttcttgctcttttcttttcttcttatccgactcagtcacccctacaaaaccaataaaccttgttgttctacccgttcaaaatgatggttccacagggctccattgggccaacctccaaaaaagaacccctctaatgcaagtaccagtcctggtggacctcaatggaaatcacttgtgggttaactgtgagcagcagtactcatccaaaacgtaccaagcacccttctgccactccacccaatgctctagagccaacacccaccaatgcctcagttgccccgcggcatcaaggccagggtgccacaaaaacacgtgtggcctcatgtccactaatcccatcacccaacaaaccggtttgggtgaactaggagaagacgttcttgcaatccacgccacacaagggtcgacccaacaacttggcccattggtcacagtcccacaattcctcttttcttgtgcaccttccttccttgttcaaaagggtcttcctagaaacactcaaggtgtggctgggttaggccatgcaccaatttctcttccaaaccaactcgcttcccactttggcctacaacgccaattcaccacttgcctttctcgctaccctacttcaaagggtgctataatattcggggatgcacctaacaacatgcgacagtttcaaaaccaagatattttccacgatttggccttcaccccattaaccatcaccctgcagggagagtacaacgtgagagtcaactcaataagaatcaaccagcacagtgtgttcccactgaacaagatatcatccaccatcgtagggtcgacctctggaggaaccatgattagcacctcaactcctcacatggttctccagcaatccgtgtaccaggctttcactcaggtgtttgctcagcagctgccaaagcaagcacaggtgaaatctgtggcaccatttgggttatgcttcaactccaacaagatcaatgcatatcctagcgtggaccttgtgatggacaagcccaatggtcctgtttggagaatctctggtgaggacttgatggtgcaggcacaacctggggtcacgtgtttgggtgttatgaatggaggaatgcaacctagagctgaaattaccttaggggcacgtcagttggaagagaacctggtggtgttcgatcttgcaaggtcaagggtcgggtttagcacctcatcactgcactcgcatggagtcaaatgtgctgacctcttcaactttgccaatgcatga

SEQ ID NO: 897 - DNA, 534 bp, Glycine max var. Williams 82
atgagggtgtggagggttcacccacaagagcaaaagctttgtccaaatggtgttttgaggtgggttttggtttggatgagtgtttgttttcttgtgttcacggttggtccaccgtctcgctcgagggtgaggaagagtgtatcttctcaactttcttgtcctccatgtgattgtttctgctcttcagctgaatatctcctcgatcctctaggactggtcaacagctcaatttccaattgtggtaaacatgatccgattttgaatgaggaaatgaacaagggtctactgacaatgctatctgaggagctaaatttgcagaaaattgtggccaacgagaccatggaacacaccaaacagttaataatggatgccaggaaaaccttttcacattaccagaaggaagcagaaaagtgcaacattggggtggaaacttgtgaagaagcaagggagagggcagaggcagagctcattgaagaacacaagctgacaacattatgggaaaatcgtgcaagtgaatatgggtgggtggaatga

SEQ ID NO: 898 - DNA, 1430 bp, Glycine max var. Williams 82
cgttcctaaattacagggcacatacaaacggttgttgttgttgttgttgtttaatcacggaagatgatagtaacacaattttgaagtcataagtagtaaccaaacgggacataacataacccaatgttacggcaaaatgtcaaagattaccgttctcacttaaaccaataaacaaacccacccaatcactaaagcaaccttcttgattatcctaaagccgcagcgcaagcaatcactctttttctttctcataataatgcaaattcttccccactctgcagcaacaaattctcatttgcaaaccccataaaggcatatcatctttatactttaccgggatctgtgtctccttttatttttccccaagacaaagtagacattgtcttccactcacttcaaaaaagagagtgagagagagaaactttgtggtctgtgttctgtgaaactgaagtgttcttcctcaatcattgtcttttacagtcaaattcagcgtctaagatctcatttcaaaaaaatttccgcttgttaaagttggtttctcactcacaagtcacaagtcacaccctttatttacttcagcatccaacaaagtgttccttacttgttctgttcaatgactcagatcttcaaatgtgagtgttgtagcatcattgcatgagtcacccatcaaacattgttcaagtaactgtttttagtttattttgtaaatgagggtgtggagggttcacccacaagagcaaaagctttgtccaaatggtgttttgaggtgggttttggtttggatgagtgtttgttttcttgtgttcacggttggtccaccgtctcgctcgagggtgaggaagagtgtatcttctcaactttcttgtcctccatgtgattgtttctgctcttcagctgaatatctcctcgatcctctaggactggtcaacagctcaatttccaattgtggtaaacatgatccgattttgaatgaggaaatgaacaagggtctactgacaatgctatctgaggagctaaatttgcagaaaattgtggccaacgagaccatggaacacaccaaacagttaataatggatgccaggaaaaccttttcacattaccagaaggaagcagaaaagtgcaacattggggtggaaacttgtgaagaagcaagggagagggcagaggcagagctcattgaagaacacaagctgacaacattatgggaaaatcgtgcaagtgaatatgggtgggtggaatgactgaagaacacactgaaggagtttagttaaccattgctacattatgttatgttaccccttaattgtatcatagcttttatagccaatacacagatctcttgtgatgatttcaaccaggttaacaattctattgaaacaagttttgtgcttcactacttcacacataatgaattgatccctgttttccta

SEQ ID NO: 899 - DNA, 1035 bp, Glycine max var. Williams 82
atgaaaaatgcaacactagccttgaaaagcctgcatgtgggtgtggccctgacatcatgccctggacaactgaaaccggtaacatgtgaatttagggtcagaatccgatgctcctccaatgttggtgtttctaggcaacaagttctggagaaattggacaaggagctagcaaagggagatgatagagctgcgctcgcacttgtcaaggatttgcagggtaagcctgatggccttcggtgttttggtgcagccagacaggtgcctcaaaggctttacaccttggatgaattgaggcttaatgggattgaaactttgtctcttctttcgcccgtggacacaactcttggttcaattgagagaaacctccagattgctgctattgtaggaggccttgctgcatggaatgcctttgctatttccccacagcaaatcttctatatttcacttgggttgctctttctatggacattggacgcggtctcttttggtggaggtattggtggcttggttgttgatacaattggtcacagcttcagtcaaaaataccacaatagggttattcaacatgaagctggtcactttttaattgcctatctggtaggaatacttcctagaggatatactatttctagtttggatgctctgcagaaggtgggatctctgaatattcaagcgggcacagcctttgtagattttgagtttcaagaagaagttaattctggaaaagtatcagctacaacattgaacaaattttcatgtatagcattggctggggtgtctactgaatatcttatatatggattttctgaaggaggtctggatgacataagaaagttggatttattgctcaagggcctaggcttcacacagaagaagacagattctcaggttagatggtctttgctaaacacggtcttgctcttgcggaggcatgaagcagctcgagggaaggttgccgaggccttatcaatgggaaaatctgtaggatcctgcattgacattatagagaattctatcgatgtttcagatctctaa

SEQ ID NO: 900 - DNA, 1644 bp, Glycine max var. Williams 82
atgggtggtgaattaagttacgtgctttcaaaaatggaaatgctaacttcagatcatgcctccgttgtgtccatgaacattttcgtggctctgctttgtgcttgcattgtcattggccatcttcttgaggagaatcggtggctgaatgagtctatcactgcccttttgataggtatttgcactggggtagtcattttgttgttgagtcgcggtaaaagctcgcatcttctagttttcagtgaagatcttttctttatataccttctgccacctatcatatttaatgccgggtttcaggttaaaaagaaacagttttttgttaacttcattaccattaccctgtttggagctgttggtacattaataagttgtagcatcataacttttggtgtcacgcaaatttttaagagaatgggtgttggtaaatcactggatatgggggattatctagcaattggtgcaatatttgctgcaacagattctgtctgcacattgcaggtgctaaaccaggatgagacacctttactgtacagtcttgtatttggcgagggtgttgtgaatgatgctacatctgtggtgcttttcaatgcaatcaaaagttttgacctcaacaaaattgaccacagaattggtttgcatttttttggcaacttcttgtatctgtttaccacaagcaccttgcttggggtcttggctggtctacttagcgcttacattattaaaacgctgtatattggcaggcactctacagatcgtgaggttgctcttatgatgctaatggcatacctttcctacattctggctgaattatggtatctgagtggcattctcactgtattcttctgtgggattgttatgtctcattatacttggcataatgtgactgagagctcgagaataactaccaaacatgcttttgcaactctctcatttgttcttgaaacctttatcttcctttatgttggtatggatgccttggacattgaaaagtggaggtttgttagtgataggcctaaaacatctgttgctgtgagttcagttttattgggtctagtgcttgctggaagagcagcctttgtttttcccctatccttcttatccaacctcactaaaaagacgcaaagtgaaaaaataagtttcagggagcaggtgataatttggtgggctggtcttatgagaggtgctgtttcaatggcacttgcctacaatcagttcaccttgtccggtcacactgaactgcgaaccaatgccatcatgatcaccagcaccattactgttgtgcttgtcagcacaatggtgtttggtttgatgactaagccactcataaggtttttgctgcctattaacccccctcctaaacgcaaaaacagcatgtcagatataggttcatttaataattcccccaaatcaatcactatgccctttcttggaggctcccaagattctgaaaacgaatttgatggcagtgaaaatcaacgtccaagcagtattcgtgccttactaacaactccaacacataccgttcatcaactatggcgtaattttgataattcatttatgcgtccagtttttggtggtaggggatttgttcctgtagttcctacctcaacaaccgctcgcaccattaatcaacaatggcattaa

SEQ ID NO: 901 - DNA, 918 bp, Glycine max var. Williams 82
atgatcgcaggttgtttcagccaacccaacactccttcatccagcagcagcagcagcagcagctcccaagtgccacagaatctgataacatgcatatacaaaactcaactatgtaattcccccacttatctcactctcagctggtccaaaacccttttctcgcactccctaaccatttcagctacagacatattttccatcacaatttctctgaactcctcaaccttctccttcttcagaagacgccagggctcaaaatcaatcaacaagcgcaaaatcaagctccactggaacttcacccgcgcagagttcattcaaaactccgcagagccagagtcacgcttctaccttgcaatctcacacaatgacaaactccaattctttctcggagaccttctccgagatttgaatcggcgcaacaaaagggtcgacgttgaggctaacaacgttgttgacccggttctgctgtcgaggagagagcacgtgttcggaagaaggtgttacgtgtcacgtgcggtgttcatggggtcgaagcacgtgatagagatcgagtgcggagggggtgtgctaggagtgaaagtggacggtgagacgcggttggtggtgaaaaggttggcgtggaagttcagaggctacgagaagatattcatcaacggcgtccaagtggagttctattgggacgtgctgagttgggtggttaacagcaacaaagggaacgggcacggcgtttttgtgttccaagtgggagacggaacggtgtggccagaaatggtgggtgcggagaagaaattaatgaacaagagcgtgtccgcttctagcgtcttgcaatggccagaggacacttgtgactgtgggaggacttctgggaccaacgccaccggcttctctttcttgctctatgcttggaccattaattaa

SEQ ID NO: 902 - DNA, 417 bp, Glycine max var. Williams 82
atgcccaccacggttgctgtctccgtacctcaaaatcaaaacactaaccatggagtcgaatcccccaagaagaacaaaattcaggtttctaacaccaagaaaccccttttcttttacgtcaatcttgccaagaggtacatacaacagcgcaatgaggttgtgctttctgctcttggaatgggtataaccacagttgttacaattgcggagattttgaagaacaatggacttgctattgagaagaaagtttcgacatcttcagttacaatgaaggatgagaccaaaggtcgcctggttcaaaaggctaagattgaaattgttctggagaaaactgagaagtttgacagtctgacggctgttgcaaacactgaatcaaaagtagttgcagctgacgatgacaatcatgagaagaaatga

SEQ ID NO: 903 - DNA, 1750 bp, Glycine max var. Williams 82
ggcatgagtattttttctgttcatcgaaatttcgaaactgcattccttcttattgaataataaaaaaaaaagtgacgatcacgaaacaacacccctctgcccggaaaatttgacgatggcgttcttcagttgaggcatgttattcgctgctcactcttccaactactactgttgttcttcttcgtcgtcttggccttcgcatcttcacaatcacatccaatagagacacgttgactttgctggaagaagaagaagaagagaatggaacaatcgcttttggatgacataatcaatcgcctcctcgaagttcctaccctaccggctaagcaggttcagctatccgagtccgagatccgtcaactctgcgtagtttccagagaaattttcttgcaacaacctaatttattggagctcgaagcacctattaagatttgtggtgatgtacatgggcaatattctgatcttttaaggctttttgagtacggtggattacctcctgaagccaactatttgtttttgggggattatgttgatcgagggaagcagagtttagaaacaatttgcctcctccttgcttataaaataaaatatcctgagaactttttcttgttaaggggaaaccatgaatgtgcttctataaaccggatatatggattttatgatgagtgcaagagaaggttcaatgtaaggttatggaagacatttacagactgcttcaattgcctgcctgtggcagcccttgtcgatgaaaagattttgtgtatgcatgggggactttctcccgacttaaataatttggaccaaattagaaatttacagcggcccacagatgttcctgatacaggtttgctttgtgatctgctttggtctgacccgagcaaagatgttcaaggatggggaatgaatgacagaggagtttcatacacatttggtgctgataaggtctcacaatttcttcagaaacatgatcttgatcttgtttgtcgtgctcatcaggttgtggaagatggatacgagttctttgctaatcgacaacttgtaacaatattttcagcacctaattattgtggggagtttgacaatgctggtgctatgatgagtgttgatgagacgctaatgtgctctttccaaatattaaagccagctgataaaaaagcaaagctcaattttggaagtacaaccactgctaagcctggaaactctccagcaggtgtaaaggttggaagatattaggtatgtgcttgcttgcatgacatcagtagtccttcctggatgcgaaagtgtgaaattaaatttggctaaaagattgctactactacggatcagcttgggcttgaactcctaatggttgcaagaaggggaaaatcaagttccatttcgcctactatgatattttggaattgtaaaatcaaagagaacaccattatgaagtttgtaaaccattgtttattattggtacaaatttgcatttcaagatggagagccataatctccttgtcttccttgtacactaataactggtatattttcttaactgtaagcttcacaagcgtagatggatacatccgaatctgttgctgagaaccatttaaaaatgcttatacgatttggcatatatggatggcagttgaggctggtgaaacagaatgtcgtcaaatctcttcgttttctcattttgattgtcttttttgtgtgagaaatcttgtttgatctgggaccatcttcgttttatttagatttttatttcctg

SEQ ID NO: 904 - DNA, 1098 bp, Glycine max var. Williams 82
atggctagttgtatggtttatgcgtgttacatttatattgttctgggaatattagtgttgaaaggtgcagaggcacagcgtgcgttctttgtgtttggggattctcttgtggataatgggaacaacaactttttggcaactacagctcgagcagatgctcctccttatggcattgatttcccaaccggaagacccactggccgtttctctaatggctacaacattcctgacttcatcagtcaatcacttggggccgaatccacattgccttatttagatcccgagctcgacggggaaagattgcttgttggtgccaactttgcttctgctggtattggaattctcaatgacactggaatccaatttgtaaacataatcagaatatatagacagttggagtactggcaagaataccagcagagggtgagtgctctgataggacctgagcagactgaacgcttaataaatggagcattagtcctcattactcttggaggcaacgactttgtgaataactattacttggtcccttactctgcaagatcacgccaatacaatttaccagattacgtcaagtatatcatttctgagtataagaaagttctcaggaggctatacgaaattggagcacgtagggtgctggtgacgggaacgggtccattgggttgtgttcctgcggaattggcccagcgaagcaccaacggtgactgctcagctgagctgcagcaagctgcagccttgttcaaccctcaacttgttcagattatcagacaactcaatagcgaaattggttccaatgtcttcgttggagtcaacacgcaacagatgcacattgatttcatcagtaaccctcaaagatatggatttgttacatcaaaagtagcatgttgcggtcaaggaccctacaatggtcttggactgtgcactccggcatccaacttgtgccctaaccgtgacagttatgcgttttgggatcctttccatccaacagaaagggctaataggataatcgttcaacagattttgtcaggcacctcagagtatatgtacccaatgaatctcagcaccattatggctttggattcgtctaagaactag

SEQ ID NO: 905 - DNA, 1422 bp, Glycine max var. Williams 82
tcatcatcctcctctacttaattacataacttgattatattgtgtcttcctcgatccatggctagttgtatggtttatgcgtgttacatttatattgttctgggaatattagtgttgaaaggtgcagaggcacagcgtgcgttctttgtgtttggggattctcttgtggataatgggaacaacaactttttggcaactacagctcgagcagatgctcctccttatggcattgatttcccaaccggaagacccactggccgtttctctaatggctacaacattcctgacttcatcagtcaatcacttggggccgaatccacattgccttatttagatcccgagctcgacggggaaagattgcttgttggtgccaactttgcttctgctggtattggaattctcaatgacactggaatccaatttgtaaacataatcagaatatatagacagttggagtactggcaagaataccagcagagggtgagtgctctgataggacctgagcagactgaacgcttaataaatggagcattagtcctcattactcttggaggcaacgactttgtgaataactattacttggtcccttactctgcaagatcacgccaatacaatttaccagattacgtcaagtatatcatttctgagtataagaaagttctcaggaggctatacgaaattggagcacgtagggtgctggtgacgggaacgggtccattgggttgtgttcctgcggaattggcccagcgaagcaccaacggtgactgctcagctgagctgcagcaagctgcagccttgttcaaccctcaacttgttcagattatcagacaactcaatagcgaaattggttccaatgtcttcgttggagtcaacacgcaacagatgcacattgatttcatcagtaaccctcaaagatatggatttgttacatcaaaagtagcatgttgcggtcaaggaccctacaatggtcttggactgtgcactccggcatccaacttgtgccctaaccgtgacagttatgcgttttgggatcctttccatccaacagaaagggctaataggataatcgttcaacagattttgtcaggcacctcagagtatatgtacccaatgaatctcagcaccattatggctttggattcgtctaagaactagataaatcaagggtctgtgtccatcattttattaccgcacatcttctgtgtcttgcaaaagtctacctacgcctgttaatttgtcatatatgtgttcaaattaggtgccatatatagtaattaatcatctccaatgtgtcagtgaatagtatattataatgttggggtggatggatgatgttaagtgccgtcttcgttctccttctcttgggcagtacaaaagaaagactgcatatataataattgagtgaatttttatcttcaataa

SEQ ID NO: 906 - DNA, 1389 bp, Glycine max var. Williams 82
atgtcccttaattcatgcggctttcaaagcttgtaccttggcagttccaaatgctccaacctcgttttccaggatgttaggaaactgcaacagtaccaagatgcattagacaagtgctccaacttcgaccacccatttggtgaatcttgtgcagattgcaccggtgcaatattaagcttaagagatagtttatataatcaagtgaccaacaacaacaacaaccacactgaggtagccatatgtgcggtagcagctattgttgctgttgcagctgggaaaccaaatgatcctgccgttgacaaagtcttacgctgcttgccaccttcagcttctggatcagacaagattatccttgcaatattgcttgtggttataatggtaaaacgtttgtccaagaagaagcttcgtagacaggcaaacttgaaagagatcgctgcgtggtctggattgtactggttctgcaaaagggaaattgagaatgccatgaattatggcggtgaaaagatatgccttggacgtgggagtgcagggcaggtgtatagaggtattctcccaagtggtcaactcgtggccatcaagcatttaacaaagagtaacacctctgagtctttcactcgagaagttgaaggtctttcaaggcttcgccatcctaacctggtttgcctctttggatgctgcatagaaggggatgagagatatttagtctatgaattctgtgcaaacgggaatcttgctcaacatctcttaagaagagatagccacttgacatgggaaaccagagtaagaattttgagagattgttcatatgcactcaagtacctccaccatcatatagaaggctgtgttgtccatagagatataaagcttacgaacattcttttgaatgagaaataccaagcgaaactgtcagattttggactggcaaaagtgatggggattaaagagagcaaggtttttactgatgttagaggaacaataggctacatggatccagagtacatgagtaatgccaagctaacctgcgctagcgatgtttacagttttggtattgttgctctacaaattctgtcgggacagaaagtcatcgagttggatcttgatgccagagatcaactcactaggaaggcaagagatgtgagcatgggaaagcgtccactgtcagattttgaagacccgcgactaaatggaaaagttgataagacagacttcgaagccatccttcagattgcagttttgtgtgttgccaaatcaagcaaaggtcgtccaaccattgagcttgtttttgaggaattggacaaggtctgcagggatacagaaacacggatggatgagagcttatcaacaacatccaccccgagctccaaatcgtcaaaatcggcgcctctatga

SEQ ID NO: 907 - DNA, 1143 bp, Glycine max var. Williams 82
atgattccaaaggtatctgccgatttctttgtcattgtcacaattgtgttgctttgcttgttcagtttaagtcacagtgaatgtaatttcaaggcaattttcaactttggggattcaaattcagatacaggtggtttttatgctgcttttcctggtgagtctggcccttatggaatgacttactttaagaaaccagcaggcagggcttcagacggaagactcattattgattttcttgctcaagctcttggattgccatttttgagtccatatctgcaatcaattggatctgattataaacatggggccaactatgctacaatggcatccaccgtgcttatgcctaatacttctttgtttgtcactggtatcagtcctttttcccttgctatccaactcaaccaaatgaagcaattcaaaaccaaagttgaggaaaaagttgagcaaggaatcaaacttccttcatcagacatatttggaaattctctttacacattctacattggccaaaatgattttactttcaacttagcagtcattggcgtaggtggagtacaagagtacctccctcaagttgtttcacaaattgttgccaccattaaggagctatataatcttggaggacgtacatttatggttcttaatcttgcaccagttgggtgttaccctgcattcttggtggagtttcctcatgatagttcaaacattgatgattttggatgtttgatttcttacaacaatgcggtactgaactataataacatgttgaaagagacattgaagcaaaccagagaaagtctttctgatgcttctgtcatctatgtggacacccattctgtcttgttggagcttttccaacatcccacttctcatgggcttcaatatggtacaaaagcgtgttgtggatacggagggggtgactacaacttcgatccaaaagtttcttgcggcaataccaaagagataaatggaagcataatgccagctacaacctgtaatgatccctacaactatgtcagttgggatgggatccattccacagaagctgcaaacaagcttattacctttgccattctcaatggatctttttctgatccccctttcatatttcaggaacactgtgatcttcaacctataggttga

SEQ ID NO: 908 - DNA, 228 bp, Glycine max var. Williams 82
atggcatttctcagagcagcttctgaagttttggcaatctatacccttgtctttaccattttttcacctgctgttcttgaagcacagtctctttcccttgcagctgctcctgctccttccagagatggtacttcaatagaccaaggaattgcatacgtattgatggttgtggcgctggtgctcacgtacctcatccacccctttgacgcgtcttcccatcacttctga

SEQ ID NO: 909 - DNA, 1224 bp, Glycine max var. Williams 82
atggcaaagccaagatcttggactcagatatggccttctattgttggagtgtgtcttctgaattttgttctgaacttcaagatcgtggcagtagcagatgacactggaagcaacagtattgtatcagaaggtgactgcaagaacacaaattatcagatttttctccctccaccttatcagaatatatcctctaccatatgcaaacctgtttggcattcatacgaattgaggtacaccaagacgggtgacaccacaactatcatattatctgctccctacactgttggatgggtgggaattggattttctagggatggtatgatggctggttccagtgcaatggtgggatggattaacaaacatggccatgcaaaagtcaagcagttttatttaaggggtaggaggcaatcagaagtaattatagacaaaggtgaactgcctctaaatactgtgcctgcggcagtggcaacaaatggagctgaaatttacatagcttttcagctgcaaaccacaattccatttgggaagcaaccgattttattggctttcagtactaaacatccactgaaccaccatctatcaaaacatgttgacaaaacggcaattatatttgatttttcttcaggttctactggcccagtatccaatgggttgattcacattagaaagagccatggaatagtgggtataattgggtggggcctaatcctgccagtgggggcaattattgctagatacttcaggtataaggatcccctatggttctatctccattcagtcattcaatttgtgggattttcatttgggcttggcacagtccttcttggattacaactctatagaaacatgcatgtccacataccagctcacagaggcataggcatctttgtccttgtcctaagtattcttcagatattggcatttttcttgaggccagacaaggattccaagtatcgaaacatttggaatttgtatcacggttggtttggaagaatggcacttttctttgcagcattgaatatagtgttggggatgcgagctgcgggggcagggaatgattggaaggcaggctatggattccttcttagcattgtacttgtggcagttatcgttctggaagtgttggcgtatttgaaaaggtcagaaaagcgttctcttcctcagactttccaaatggacccagttggagaggctaactttccaacaaatctagctaaagggtga

SEQ ID NO: 910 - DNA, 579 bp, Glycine max var. Williams 82
atgggtttagaagcagagagagaggagcagaggagcatagcaaggctaccattgttctccatccagtccccagagagatcaggaatggccactcctccacttcacaccttagcatcagtcccatttaggtgggaacaagtgcccggaaaaccaaggccatgcagtgcccttgtgtccttctccaaccccaagtgcttggaactccctcccaggttgttcacaccttctcccgccactgtctttaaggtttccagcaacagatttcggtctccatctttcagaatgagcgccaattgctatggttcggatacaaaggtgcttggtgccatggttctcaccaaagccaatgactacgcctggtttggttcttggagaaaaaaagccttcaaactcaataaaagagaggtcactggtgccagccatgtctttccttcttccactgacaccgacatcccaaacatgaaacaacgctctgccaattctcgcatctggacaagtatctgtgaaggtttgaagcaggtggttccatggaagagtaaaataccggagaaaaaaaatgggagtggccttaagctctaa

SEQ ID NO: 911 - DNA, 738 bp, Glycine max var. Williams 82
ggccagtggagatcactaccaaaaacagctggtcttcttagatgcggaaaaagttgccgactgagatggatgaactatctgagacctgatataaagagaggaaacataaccccagaagaagatgatcttataattagaatgcactcacttttaggaaatagatggtccctcatcgcgggaagattaccaggacgaacagataatgagattaagaactactggaatacccatctcagtaagaagctgagaaatcaaggaacggatccaaatacacacgacaagttaactgaggcaccagagaagaagaagggcagaaagaagaataagcaaaagagtactgagaataacaaagggtcagagaagaccttagtttatctaccaaaaccaatcagggttaaggctttatcgtcatgtatacccagaacggatagcaccttaacccttgattcgaattcagctacgactgcatcaacaagccaagagaaagttcaaagcccagaagcagaaacaaaagaggtgaacatggtttggggggtaagtgacaatattggagacaatggtgggattggaatattctttggtgaagaccatgacctagtcaacagtgcctcttacatggaatgctattctgatgatcatgatacgctagaaaagctctatgaagagtacttgcagctcttgaatgttgaggagaaaccagatgaattagattcttttgctcaatctttattggtgtaa

SEQ ID NO: 912 - DNA, 1016 bp, Glycine max var. Williams 82
ggccagtggagatcactaccaaaaacagctggtcttcttagatgcggaaaaagttgccgactgagatggatgaactatctgagacctgatataaagagaggaaacataaccccagaagaagatgatcttataattagaatgcactcacttttaggaaatagatggtccctcatcgcgggaagattaccaggacgaacagataatgagattaagaactactggaatacccatctcagtaagaagctgagaaatcaaggaacggatccaaatacacacgacaagttaactgaggcaccagagaagaagaagggcagaaagaagaataagcaaaagagtactgagaataacaaagggtcagagaagaccttagtttatctaccaaaaccaatcagggttaaggctttatcgtcatgtatacccagaacggatagcaccttaacccttgattcgaattcagctacgactgcatcaacaagccaagagaaagttcaaagcccagaagcagaaacaaaagaggtgaacatggtttggggggtaagtgacaatattggagacaatggtgggattggaatattctttggtgaagaccatgacctagtcaacagtgcctcttacatggaatgctattctgatgatcatgatacgctagaaaagctctatgaagagtacttgcagctcttgaatgttgaggagaaaccagatgaattagattcttttgctcaatctttattggtgtaaacgtacaaataatggtgaaaatatatggttggaacaaataaaacaaattaagtttgctcctgctagcacgtgaacatattgtattatttattcctcagattagtatcatttatttagaatattttttaaattttaaatattattaatttaactataacatttgatttatttattgataaagttatagttagattttaattttttattttattttgaatcggtcgtgtgatgattattagtcttgtcactcatataaatgtttgttttcagaggttttt

SEQ ID NO: 913 - DNA, 381 bp, Glycine max var. Williams 82
atggaaagcaaccaatcggcaaaagagatcacggtggaagtagaagagttcgaggacttgctgcccgtgatggcagagaagttggatgtggagacctttgtgtctgagttgtgtgggggtttcaagcttctggctgacccagaaacgggtttgatcactggtgagagtcttatgaggaactcagctatgttgggtatggatgggatgagcaaagaggaagcagaaaccatggttagacagggagatcttgatggggatgggaagctcaatgaaactgagttttgcatccttatggtgaggcttagccctgggatcatggaagatgctgagacctggcttcacaaggcacttgaacaagagctcaccaagtcctcaacttaa

SEQ ID NO: 914 - DNA, 711 bp, Glycine max var. Williams 82
atgaatcaggaaatgaatggggttgaggcagagagggtgaaagtgaatgtgcatgacaaaatagattatgtgtttaaggtggtggtgataggggactcagctgtgggtaagactcagatactgtcaaggtttgcaaagaatgaattctgctttgactcaaaatctaccattggagttgagttccagacaagaactgtcacaattaatggcaaagtcatcaaagcccagatctgggatactgctggccaagaaaggtacagggcagtgacaagtgcatactacagaggtgcattaggggccatgctggtgtacgacattagtaaaagacagtcgtttgatcatgtggctaggtgggttgacgaactgagagcacacgccgacagttccattgtgatcatgctcattgggaacaaaggtgaccttgtggaccaaagagtggtacatgctgaagatgcagtggagtttgcagaggatcagggcctcttcttctctgagacttcagctctcagtggtgagaatgtggagagtgcctttttcaagttgctggaagagatccatagggttatctcaaagaggtccttggaatgtggtaatgggaaggccaatgcagacaacaatcttgccactcttaaagggtcaaaaatagatgttatctcaggtgctgaattagaaattactgatatgaagaagttgtcttcatgttcttgttaa

SEQ ID NO: 915 - DNA, 279 bp, Glycine max var. Williams 82
atgtggtcgacgccatttaacaagactcttgtagttgttccctccgccaatgctaagcaacaaggtgggaaattgggtgacacccttttgcccaaatcgactccaattccaaaaccagcacaagaagaaggcgagatgagtgggtcagatttgttaaactttttccgcaagatattcatattagcacatgggggaataaaaaggttgcagtgggtaacagatttgaatatgttggtatcctatttgaatccaaatagtaatctacattaccatggttga

SEQ ID NO: 916 - DNA, 594 bp, Glycine max var. Williams 82
atgtcaaaggacaaagtttccggtgatccaagacgcgcagtgtgcacaggcatcaccatcttcctcctcttagccggcgtcactctcctagtcctctggctggtctaccgtccccacaagccgcgcttcacagtaatcggcgccgccgtctacgacctaaacaccaccaccccaccgctgatgtcgaccaccgtgcagttctccgtcctcataaagaacccgaacaggcgtgtctccatttactacgacaggttctccgcctttgtctcgtacaggaaccaggccataacgccgcaggttctgctgccgcctctgcaccaggagaagcgaagctcggtgtcggtgtcgccggtgatgggaggcacggcgcttccggtgtcggtggaggtgtctgacgggctggcggtggacgaggcttatgggttggtgggtctgaggctgatatttgagggcagagtgaggtggaaggccggggccatcaaaactgcgcactatggactgtacgttaagtgcgatgttttgatgggtttgaagaaagggttggtgggtcaagttcctctcctgggagttacaccctgccatgtccatctatga

SEQ ID NO: 917 - DNA, 783 bp, Glycine max var. Williams 82
atgggtgactcttccgcggctaatgaccatttgggtgaatccccggccgttgagttaaccggaaagataatgattgtggttattattatcatgttcttcgttattgtaattgctctctgccttcatctcttcgccagaaacttctggtggcgcagccctgctccccaatctcgcagccaccgccgccgccgctttgttttctcgtccggtccagacggtggaagcggactggatcccgcggtgctgagctccctaccggtgttggtattcgaaggccatgcccaagagtttaaggatggtttggaatgtgcggtttgcctctccgaggttgtcgaaggagaaaaggccaggcttttgcctaaatgcaatcatgggtttcacgttgcttgtattgacatgtggttccaatcccattctacttgccctctttgcaggaaccctgttgcatcctcagaagaatcttcagaatctcccacttttcccacaaacgtcttggtttgggggaatcaagctcaaataagttctactggtggtggtggtgcttctttggaggaaggttcatcctcatcctcttccgcttctacttgtgatgatcatggaatgttggtgattgatataccaagtgagatgacttcaacctctctgtcgcctgaagatgacgtcaaatcgcctatgacgggaagactcaggtcattgaagaggcttttgagcagggacaaaaggtttaatccttccagtcctacttcttctccagatgtacaacaaccaggatcagggagctga

SEQ ID NO: 918 - DNA, 1053 bp, Glycine max var. Williams 82
atggcaagtccaaaattcagtttttgcatcctgcttctttttccaaaagaaaacgctgcattatttgtatttggagattcaatatttgatgttggaaacaacaattacatcaatactactgctgacaatcatgcaaatttctttccatatggtgaaaccttcttcaagtatccaaccggtagattttctgatggtcgcgtgattccagatttcgtagctgagtatgctaagttgcctctaatccccccatttctatttcctggtaatcaacgatacatagacggaatcaattttgcatcagccggagctggggctttggttgaaacccatcaaggactggtgatagatctaaaaactcaactaagttatttcaagaaagtcagcaaggtattgaggcaggaactaggagtagcagaaaccacaactctattggccaaagctgtctacttgattaacatcggaagcaatgattatgaagtctatctgacagaaaaatcgagtgtctttactcctgagaaatatgtagacatggtggttggtagtcttacagccgtgataaaggagatacacaaggcgggtgggaggaaatttggggttcttaacatgccagctatgggttgtgttccatttgtcaagatactagtaaatgcacctaaaggttcctgcgtggaagaagcgtcagcactagccaaactgcataacagcgtgctttctgtggaacttgggaagttaaagaaacaactaaaaggatttaaatattcatacgtcgatttttttaatctgtcatttgatcttataaacaacccttcaaaatatgggtttaaagaaggcggtgtggcatgctgtggcagcgggccttacaggggaaatttcagttgtggaggtaaaggagcagagaaagattacgacttatgtgagaatcccagtgagtatgtcttctttgactcggttcatcccactgaaagggctgatcagattatttcccagtttatgtggagtggacaccaaagtattgctggcccattcaatctcaaaacactatttcaagaataa

SEQ ID NO: 919 - DNA, 1053 bp, Glycine max var. Williams 82; identical to SEQ ID NO: 918

SEQ ID NO: 920 - DNA, 2334 bp, Glycine max var. Williams 82
atggctaacattatgcggaatgctgatcctcccgcgctcctttcctgcaacttgttgttgttgtttttcattattctctttagttttctcccacaaaccatagcgctgcagtatcaagtttcgaaaacattcatcttcagaatcgattcagaatcgaagccgtcagttttccccacacactaccactggtacacctccgagttcgcagacccaacccgcatcctccatctctacgacaccgttttccacggcttctccgcagttctcacccaccaacaagtcgcttctctcggccagcacccctccgtcctcgccgtcttcgaggaccgccgccgccaccttcacaccactcgctcccctcagtttgttggcctcagaaaccagcgtggcctgtggtccgaaactgactacggatccgacgttatcatcggagtgttcgacactggaatctggccggagcgccgcagcttcagcgactccaacttaggccccattcctaaacgctggaaaggggtttgcgaaagcggcgtgagattctctcccagtaactgtaacaggaaattgatcggtgccagattcttctctaaaggccacgaggcaagcggcacttcctttaacgacaccgtcgaattccgttcgcctcgagacgcggatggccacggaacccacacggcgtcaaccgcggcgggccgttacgttttcgaagccagcatggccggctatgcttttggagtcgcaaagggcgtggctcccaaagcaagactagccatgtacaagttgtgttggaagaattccggttgctttgactctgacattctcgcggcctttgacgccgccgtggccgacggcgtcgacgtcatttctatgtccatcggcggtggcgacggcatttcctccccttactatcttgaccccattgccatcgggtcttacggtgcagtttcaagaggtgtgtttgtgtcttcttcgggtggaaacgacgggcccagtggcatgtcggtgacaaacctcgctccgtggttgacaaccgtcggagcaggcaccattgatcgtgattttccggcggaggttatattgggaaacggacgaagactctccggggtatctctgtactccggagagccgttgaaggggaaaatgtatcccttaatataccccggaaaatcaggggttctgacggattctctgtgcatggaaaactcattagaccccgaactggtaaaagggaagatagtggtttgcgacagaggaagtagtgcgagggttgcgaaggggttggtggtgaagaaagccggtggagtgggaatgattctggctaacggaatatccaacggagaaggtcttgttggggacgctcatcttcttcccgcgtgtgcgcttggtgctaactttggagacgaaatcaaagaatacattaatttctccgcgaaccccacggctacaattgatttcaaaggcaccgtggtgggaatcagaccggcacccgttgtggcgtcgttttcggcgagggggcccaacgggttgagtttggaaatacttaaaccggatttgacggcaccgggggtcaacattctggcggcctggaccggtggggttgggccttctgggttggactccgacaccagaagaaccgaattcaacatattgtcgggcacctcaatggcgtgtcctcacgtgagtggcgcagcggccttgttgaagtcggcgcaccctgattggagccccgcggccataaggtctgccatgatgacaaccgccacggtttttgacaacaccaacgctctgatgattgatcaagccaccgggaatgcttccacgccctatgattttggcgctggccatctcaacctcgctctcgcaatggaccctggcttggtttacaacattaccccccatgattatgtcaccttcctctgtgctattggttacgggcccaggttgattcaggtcattaccggatcgccgcccaattgtcctcggaggaggcccttgccggagaatctcaattacccgtcgtttgtggcggtcttaccggtgtcgtcgtcgttgttgagcaagacgttcttcaggacggtgacgaatgtgggcccgccgagtgcggtgtatcgggtgagggtggagacgcaggcggagggggtggcggtgacggtgaggccgtcgcagcttgtattttcggaagcagttaagaagcggagttttgtggtgactgtgacggcggatggacggaatctggagctgggtcaggctggggcagtgttcgggtccctttcgtggacggatgggaagcacgtggttcggagccccatggtggttactcaagctcaaccgctttaa

SEQ ID NO: 921 - DNA, 999 bp, Glycine max var. Williams 82
atggacttaccggagaagcttttctttgcagcatttctcattctttcagtggccattgatggaacgcaggcagacaccatggtcactggcactgtcttctgtgaccaatgcaaagacggacagagatcccttttcgattatcctattaatggtgcaaaagtaactctgtcctgtgctgacagtaatggacaaattacaatgtcaagagaagaaacaacaaactggtttggaagctatacaatgaggttcgatggcgcacccgacttgagtggttgttctgcccatgtctcgggcagtggtcaagggtcaacgggttgtggtgaagtggctggtccttcacaaaatccaaaactcatgtttaggatgtttgacatggagatgtatacagtggattctctccttgctcagcctgcacaacccatgcagtactgttctacatcttccaacccagtcccagcaccagacacaccaaccaagcctccaccacatttcaatctacctccagtaccaggatttccgccattgccgccattgccacccctgccacccctgccatcactaccacccctgccatcattgcctcccctgccatcactgcctcctctgccaccagtgatttttgcagaagcttcagcatgtccgtcagagaagtggacactgccagaatacaaatgctactggaggggtgtgaacggggacacaaaagtagcagtggcatttggaatggttgcggcgaggagatacggaacagacattacactgtggcatgggttgaaagggagaggagacccttacaggactcttctcagagaagggatcacagcacttcttaactcctataacagctttcaattttcttatcatccactcggcgtcgtccaacacatgaatttggctttgatgggctccactaggagtgtcctgcttactgctctacgcttcaagagggccaattctggtgctggaaatgtcacctgcaaattcaccacttgcaaataa

SEQ ID NO: 922 - DNA, 1005 bp, Glycine max var. Williams 82
atggggattgcagagaactcaaagggtttggttcttgctgtggcatcgggtgtgttcataggagcaagcttcgtcctcaaaaagaagggtcttaagcaggctgccacccacggcactcgcgcaggagttggcggctattcttatctactccagccactttggtgggctggcatgcttacaatgcttattggggaggttgcaaattttgtcgcttatatatatgctcctgcacttctcgttactccccttggtgcactaagtattattgtcagtgctgttttggctcacttcttgctcaaggaaaagcttcagaagatgggcattttgggatgtgtcttctgcattgtgggttcagttctcattgtcatccatgcacctcaagagcatgctttaaattctgtccaagaaatatgggatctcgccactcaaccgttatttctagtttatgtggcggcggcagtttcggtagttttagccttgattttgcattttgaacctcgctacggacagacaaatatgctggtttacttgggaatttgctcgttaattggctcacttttggttatgagcacaaaagccatagggatcgcaatcaagcttacattggagggaacaagtcaattaacatatcctcaaacttggttttttcttaccgtgactgtcatatgtatcattacacagttgaattacctgaacaaggcactggatacatttaacaccgcaattgtctctcccgtatattatgtcatgttcacaactctgaccattattgctagtgtgataatgtttaaggattggtctgagcagagtgcaggtagcatagcctctgagatatgtggatttgtcattgttctttcaggaacaatcttattgcatgcgacaagagaacaagaacaatccaacaaacaagggtccttaacatggtacattggtgaggacttggtaaagcgcattgaggatggacacctgaaccttttacatggttcagattatgttgaaaagtga

SEQ ID NO: 923 - DNA, 501 bp, Glycine max var. Williams 82
atggctgaagcacaactacgagaccagcatggcaaccctgtcccactcaccgatcaatacggtaatccggttatcttaactgacgagcgcggtaatcccgtccaactcactggtgtcgctaccaccgctaccggcacagcaggttctgggtttgggtcctatggtaccggtgcttacggtggtggtgcaagtgcaaccaccgttgcagatcttttggcaacccaaccaaggagtggcagggaggctagagagcttcgtcgttcctccagttcaagctctagctcgtctgaggatgatgggcaaggtgggaggaggaagaagggagtgaaggataaaataaaagagaaactaccaggggtaggaggagggaataataataaggagcatgcacacacaacaactgctccaaccaccgccactaaccaccctgctgatcagcatgagaagaagggcataatggagaggatcaaagaaaaattgcctggccaccacacccactga

SEQ ID NO: 924 - DNA, 2136 bp, Glycine max var. Williams 82
aaaaccatataagatttttctcgtgaggggtctggctcacaagccaataaaggcaacctctagtaccttcatcaccactcgatcgcattaaaagtctaataattgaccttcaataatcttaaaaataaaaaatcactgtgtgattgattctccagatttccactttattgcacacttataacttaattaatttaatcctcttcaggttcaccttccttggtggcaggtttgcaagaactctaaacatttgatccatcaccatcttcttagcagtgaggtgaagtgaggtgactgcaatggcttctgcttgtgtgaccttgaaatccaatacccatttagcaaactctgagaagggctttctaggagaaagaataaaaggtggcttcaacaacagtgccttggtaatgaatcagttggctatacgttctagaagccacaagagggtgaaacatggtgttggtgttgtatctgctgttctcacttcaaacaatgccaaagaatcactgaccttgcaagtgccttcctttttaagaagaagggctgatccaaaaaatgttatttccatcatattgggaggaggacctgggacacaactctttcctctcaccaaacgtgctgccacacctgcggttcctgtgggtggatgctacaggcttatagacatccctatgagcaactgcctcaacagtggcatcaacaaaatatttgtgctgacacagttcaactctgcatccctcaaccgtcacattgcccgcacctattttggaaatggcatcaactttggggatgggattgtggaggttctggcggctactcaaacaccaggagaggctggaaagaattggttccaaggaactgcagatgctgtgaggcaattcacttgggtatttgaggatgccaagaatacaaatgttgagaatgtattgatcttggctggagatcatctatatcgtatggattacatggaccttgtgcagagtcacgttgatagaaatgctgatattacagtttcatgtgctgctgtgggtgacagccgtgcatcagattatggattggttaaagtagatgacagaggccgcatcattcaattttctgaaaaaccaaatggtgatgatctgaaagcaatgcaagcagatacctctcttcttgggttgtctccccaagatgcattgaagtcaccatatattgcatctatgggggtttatgtattcaagacagatgttttactcaatcttctgaaatggagatatcctacctccaatgacttcggatctgaaatcatccctgcagctgtgagggatcacgatgtccaatcgtatttttttgaagactattgggaagacattggaacgataaaatcgttttacgatgctaacttggcccttactgaagagagtcacaagtttgaattttatgaccccaagattcccatttacacatctccaggattcttaccaccaacaaagattgacaaatgccagattgtggatgctattatttcccatggatgtttcctgcgagaatgcacagtccaacactccattgtgggtgaacgttcacgtttggattatggtgttgagctcctggacactgtaatgatgggagcagactattaccaaactgaatctgaaattgcttctctgctggcagaggggaaggtcccaattggtattggaaggaataccaaaattagggcgttcaagaagcagatagaccagaagatggattctacattcgatcaggaatcaccatcataatggagaaggcaaccatagaagatggcactatcgtataaatggatagctcatttctgggctgattatccaaaggcgctggaagaggaatgctcccatctttggggacagaagggtatctgtttgcaatgctgtgttacaatggaggaagcagcacatcaccccatttgctatatgtaaaatagaaggctcccccactactcaatacatgtaaaaatagaatgaataaaaccatgaaaatcaagatgcatgaggagtaaataaattaaagggctgaccctgagctagctacaaagttgctttacccccttgtaaaagacactttctaaattatttgtattactaaggtatcagtgaatggctgaattgattcattggcatc

SEQ ID NO: 925 - DNA, 768 bp, Glycine max var. Williams 82
atggcgtccatttcgcggttctgttgtgtgcatatgcgagcgtctctatgcaacttcacagcccagaaaggtccatcacctcccacaaccttggacttggagcatcataaaacaacaccatgtttgctttcttccatcgaagaaggacgtgcggttaataggagacaacttattcttcacacgccagtagcagtagctgcatttgcagtcccaaatgcattggcactcaatgatgtgtctgaggatgttcgtgtctacactgacgatgagaacaagttcaagattgagattccccaagagtggcaagtgggaacaggagacggagaatctagtgggtttaaatccataactgctttctacccaacagtggcatccaattccaatgtgagcgttgtgatcacagggctgggaccggatttcactaggatggaatcctttggcaaagttgacgagtttgcccagactctagttagtgggcttgacagaagctggcgaaaacccccgggtgtggctgctaaactcatagattgtaaatcatctgatgggatttattacatcgagtattcgctgcaaaatcccggtgagagtcgcaggtatttatattcagctatcgggatggcatcaaatggttggtataacagactgtatacggtgacaggacagtatgtggaagaggaaacagacaagtatgcttcaaaagttcagaaggtgattttttttttttttgttatcatactccgttatttgacagaagtacgtaggtcatga

SEQ ID NO: 926 - DNA, 1116 bp, Glycine max var. Williams 82
atggcggcgagttctagaggcttctccacgacgcagtttgatttcaagctcagagtaatgcgactcaatgccgctcttcttcctaagagtcacgtgctcgaatttggtcccagaaagcgtagaaagctctgtttcgactctgaccgagttcgactcggtgatggcgcaatgcgctgttgctgttccgactcggttactccgattcgcagaacgagtggacctggcaacggcagtgacaagaacgaggagtggaggttcgataccaaaaaaccccctcacattcacagagtgagggttcaggcctcccctgccgcaatgcctttcgcttctccaccatcatttctgaagcaggaaaaattctttcctcgttgcaccccgagaaattctggcccacagtcacgtgatacaccccccaaaagaggtgtggagaaatctggtagaaattctgagggggatacttggtgggaaacatggcaggaaaatcttcatcaagatgaatggagtaacatagcaagaatagaaagaagtgcacaaaaacaagcaaaatcaggaactgaaaatgctggatggtatgaaaaatggtgggaaaagtatgatgctaaaggctggactgagaaaggggcacataagtacggtagactgaatgaacaatcatggtgggaaaagtggggagagcattatgatggaagaggatctgttctcaaatggacagataagtgggcagaaactgagcttggaacaaaatggggagacaagtgggaggagagattctttaaaggcataggttcaagacatggagaaacatggcacgtatctccaagcagtgaacgttggtcaagaacttggggagaagaacactttggaaatgggaaagtccataagtatggaaatagcacaactggtgagagctgggatatagttgtagacgaggaaacttattatgaggccgaacctcattatggatgggcggatgttgtgggtgattcaacccaattactttcaattgagcctcgggagaggcctcctggtgtcttccctaatttagactttggttcacctccatcgcctgaagctcatgatgactcacctgatgaagattttccctcttcacaatga

SEQ ID NO: 927 - DNA, 1989 bp, Glycine max var. Williams 82
atgggctgcaacacctcgagacttgaccggctaccggcggtggcactgtgccgtgaccgttgcaagttcttggacgacgcgcttcgccaaagctacgccctcgccgacgcacacgtggcacacatggaggccctcaaaacacttggccacgctctcctctgtttcttcgacggtttcgaggattccgacgaaactaatgtcccaaataaggaaaccaaagttcctgtcgccacgaaatctccaccccctcactccccttcttcctttagttcggactcagacgacgcacacgtgcttttgcattccgaatcagaaaccgaagacgcagaaaaagaagagttccaattgttcactcacgcgcgttatgactacgctcactcggctcgttaccccccgttttctccgccgcgtggctattccggctcgaagccgccgtctccgccgcctccttccggctccgcctgggatttccttaacttcttcgagccgtacgagaagtaccacgtgccttattttcctggcggcggtgacgctgacgtggccgagaatgaaaaggggaaggttgagaaacgtgacgggtctaaatctaaggaggaaaatggagaagcgaagaaaaagaagggtgattcgaaggagaagaaggtggtttctgagaaagcggaagttgtattagtttcagagcaatgtagtgactctgcgaaaggtttctctgaggcagtgaaagagattcagattctgtttgagaaagcgtcggagtcggggaaccccgttttggagatgctggacgctgggaaactccgttaccatcgaaaatttgacctcaacccggtttcgtgcaagatgatgcatgtgtttactccctcaagtcctcttggggttagatgcatgaaatcctcggttgggcggagaatgggatctgggtatgaaggagacaaggatctcacttacgccaatctctgctctactctgaaaaaactatgtatgtgggagaagaagctgtatcatgaagtcaaggctgaggagaaattgcgtatgcttcatcagaagaagtgtaagcagttgagacgtatgaaacaaaaggatgccgatgcacagaaaattgattctgttcaaactttcattgggattttatctacaaaaatgaaaatttctatccaagtagttgacaagatatctattacaattagtaagttgagagaagaggagctgtggccgctgatctacaggtttattctcacgtttctcggaatgtggaaagatatgcaagaatgttacaaatgccaatatcagcaaattgttgaagccaaaactttagatgccttatcgttaaacacaaagcctggcaatgctcatattgatgcaacaataaaactcaaatctgaggtacagaaatggaatttgagcttcttagattggattcacgcccagaggtcccatgtgaaagccttgaatggttggctggtaagatgtctattatacgaacccgaagaagtacccgatgattcaactcccttctcacctagcaagattggggcaccacctgtgtttgtgatctgtcacaaatggtcaagggcagtggataatctctcagagaagaatgtaattgaagccgtaaatgggttcatgctacgagtgaacgagctcttggaaaagcatattttagaccttcaacaaaaactaacattggacaaagaatttgagagaaaggtgaaaatgttggagagggaggagcaaaagatgcacaaagtgatgcgggctcatgagaggaagatggttacagttggcagagaagaatctgatgcacttttacgtggagatgctgtgcatcacgctgatatcgttgattctactaacctacaatcaagtttgaagcagatctttggtgccatggaaaagttcacagactccactgttcgcttatatgaagaactttgtcaacaaattaagcaagaggatcatgttttgggagaaaccaacaaaattagctag

SEQ ID NO: 928 - DNA, 969 bp, Glycine max var. Williams 82
atgtcatcggcggcgagaactcccggtggcgaggagggaaagcactaccctgctccactcgcccctcacgagggcgtcgtgaaggactccactctcttctgggacactctaaggcgctttcactttgttatgggtaccaaatttatgattcctgtgattggagggaaggagctggatttgcacgttctttacgtggaagttacgagaagaagtggctacgagaaggtagttgcagagaagaagtggagggaagttggtagtgttttcaagttcgcagctaccaccaccagcgcttcttttgtactcaggaaacactactttagtcttctttatcattatgaacaagttcacttctttaaagctcggggtcctatctacactccatcagcagatgcattttccggcaacagcccttcgtggagacctgaattagctattgtggaatattcgcctaagcctatggataatagtcctgaatctcgtgctgaagatacttcatgcctttcaggaaatggaaccatcgagggaaaatttgactgtggttatttagtgtccgtgaagcttggttcggaggttcttagaggggtgctttaccatcctgagcaattggttcctccaccatcgattccaaaacatgagagtgccattgtaccaatcaaccgcaaacctcaccgttctggtcgtaggaagaaaaacaaaagaaggtgggaccccaattatccaaagccgaataggagtggctataacttcttctttgctgaaaagcattacactctcaaaactctctacccaaacagagaaagggagtttaccaaaatgattggccagtcatggaacagtcttagcccagaagaaagaatggtttatcagaacattggcttaagagacaaagaaaggtacaagagagaattgacggagtacaaagagaagatgaagcttaggcagacctcagaagttggacgtccatag

SEQ ID NO: 929 - DNA, 1350 bp, Glycine max var. Williams 82
atgagagagatcttgcacgttcagggaggccaatgcggtaaccaaatcggttccaagttctgggaggtgatctgcgacgagcacggcatcgatcccaccggaaagtacaacgaggaaggcaacagcagcatccaactcgaaaggatcaatgtgtattacaacgaggcctctggcggaaggtacgttccccgtgccgtgcttatggatctcgaacctggaaccatggacagcatcagatctggcccctacggcaagatcttccgccccgacaacttcgtcttcggccagtccggcgccggtaacaattgggccaaaggtcattatactgaaggcgccgagctgatcgactccgttctcgacgtcgttcgcaaagaggctgaaaactgcgattgcttgcaaggttttcaagtttgccactctcttggaggaggcacaggttctggcatgggaacactgttgatatcaaaaattagggaggaatacccagacagaatgatgctcactttctctgttttcccatctccaaaagtttctgatacagttgtggagccatacaatgccactttgtctgtacaccaactggttgaaaatgcagatgagtgcatggttcttgacaatgaagcactttatgacatttgctttaggacattgaaactcagcacccctagctttggtgatctcaaccatctgatttctgcaaccatgagtggggttacctgttgtctgaggtttcctggacaactgaactctgacctcaggaagctggctgtcaatctgattccatttccccgtcttcacttctttatggtggggtttgcacctctcacttctcgtgggtctcagcaatatgtctcccttactgtcccagagctgactcagcaaatgtgggatgccaaaaatatgatgtgtgctgctgatccccgacacggccgatacttgactgcatctgctatgttcaggggaaagatgagcaccaaagaggttgatgaacaaatgatcaatgtgcagaacaaaaactcgtcatactttgttgaatggattcccaacaatgtgaagtccagcgtttgtgatattccacccaggaatttgaagatgtcatccacatttattggcaactcaacatcgattcaagagatgtttaggagggtcagcgagcagttcactgctatgtaccggcgcaaagccttcttgcactggtacactggggaggggatggacgagatggagttcaccgaggcagagagtaatatgaatgatttggtagcagagtaccagcagtaccaggatgcaacagcagaggaggatgaatacgaggatgacggtgatgagcagcagtatgatgaccagtag

SEQ ID NO: 930 - DNA, 1960 bp, Glycine max var. Williams 82
gaggaatgaacggcacagaataccgcacttgaaaacaaaatatcccgccatccattattaccatcctaacctccgaatatccctctctctctctttcttccataaatcactccactctctgtaacgcatcgcatttcatttccctcccccaccctcaccaccaacgccaaacaagccctaaatctctcttctctttcttcttcttcctttaaccatgagagagatcttgcacgttcagggaggccaatgcggtaaccaaatcggttccaagttctgggaggtgatctgcgacgagcacggcatcgatcccaccggaaagtacaacgaggaaggcaacagcagcatccaactcgaaaggatcaatgtgtattacaacgaggcctctggcggaaggtacgttccccgtgccgtgcttatggatctcgaacctggaaccatggacagcatcagatctggcccctacggcaagatcttccgccccgacaacttcgtcttcggccagtccggcgccggtaacaattgggccaaaggtcattatactgaaggcgccgagctgatcgactccgttctcgacgtcgttcgcaaagaggctgaaaactgcgattgcttgcaaggttttcaagtttgccactctcttggaggaggcacaggttctggcatgggaacactgttgatatcaaaaattagggaggaatacccagacagaatgatgctcactttctctgttttcccatctccaaaagtttctgatacagttgtggagccatacaatgccactttgtctgtacaccaactggttgaaaatgcagatgagtgcatggttcttgacaatgaagcactttatgacatttgctttaggacattgaaactcagcacccctagctttggtgatctcaaccatctgatttctgcaaccatgagtggggttacctgttgtctgaggtttcctggacaactgaactctgacctcaggaagctggctgtcaatctgattccatttccccgtcttcacttctttatggtggggtttgcacctctcacttctcgtgggtctcagcaatatgtctcccttactgtcccagagctgactcagcaaatgtgggatgccaaaaatatgatgtgtgctgctgatccccgacacggccgatacttgactgcatctgctatgttcaggggaaagatgagcaccaaagaggttgatgaacaaatgatcaatgtgcagaacaaaaactcgtcatactttgttgaatggattcccaacaatgtgaagtccagcgtttgtgatattccacccaggaatttgaagatgtcatccacatttattggcaactcaacatcgattcaagagatgtttaggagggtcagcgagcagttcactgctatgtaccggcgcaaagccttcttgcactggtacactggggaggggatggacgagatggagttcaccgaggcagagagtaatatgaatgatttggtagcagagtaccagcagtaccaggatgcaacagcagaggaggatgaatacgaggatgacggtgatgagcagcagtatgatgaccagtagctggatcaatcttagggcaatgctctgatggtaattaccaatggcgtgatgataacttctggcaccgatctacttttactgctattcgtgtatctacagccatatgaactctatttcattcccatttatctcttcttttaaattctgctaatttcatttatatgttctgcttttgaattgtttggaatgtgcccggtgagacaatagttgattattctatacttccaattgccaagcatagcaagtgtatgaacaagttttgtttcctcccatgtcatggtcctgaagaaatggcctcaaatgggccaccttttttttgttggcgttctattgtttttcctctttttataaaataactagcataagtgttttcttacaatattaaattcacatttt

SEQ ID NO: 931 - DNA, 738 bp, Glycine max var. Williams 82
atgctgaaatcgggcattggaattgaggagaggaagcaattgaagaagccagcacaagccagctcgagaaagggttgcatgagaggaaaaggaggtcctgagaatgctagttgcacctacaaaggtgtgagacagagaacatgggggaaatgggttgctgaaatccgtgaacccaatcgaggtgctcggctctggctcgggacttttgagacctctcatgaagctgctttggcttatgatgctgctgcacgtaagctttatggctctgatgccaaactcaatttaccagaactctctatcaaatctcaatctcagtgtccaccaccatcaccaccaccaccttcttctgttaccaacaacactcaaatggaaaacctgcagcagattcaaaacaattacatagacatggctacgtgttctaatttcaacaacatcaataatccagaagtttccatggcctctcagcaggttggagttggaccaatttacaccagtgactccatcgtgtctcttcccttggacaccaatcccaagcctgtggagaatgaggtcgagtttcgtccatcgtgggcgacaatgaacgagggtttgccggttttcgatgattccatttgggctgaagctgctatgtctctagattttcctcacattgcagcagagactgcgatttacgcgtcggggaacaacttggctgatgttggtgtttgggactctctgcaaaccccatggtgcatgtaa

SEQ ID NO: 932 - DNA, 1275 bp, Glycine max var. Williams 82
atgataaaagagaagaaaggagtggtgattgaaatgggaaaaagtgatagtggtgaggatggtagtagtattagagtgagtgagaaaggaatgtatgtggacgtgtggggtgggaagttgtggatagatgttttgagtgcaacattggagtatgggctggctcccatgtcttggaccgattacttgtatttgtctgtgggtggaaccctatccaacgctggaattagtggacaaaccttcaatcacggtcctcagatcaccaatgtttatgagctcgatgtcgttacaggaaagggtgagctggtgacatgttcagaagatcgtaactcggagttgttccatgctgttctaggtggtcttggacaatttggaatcatcacaagggctagaattgctctcgaaccagctcctcacagagttcggtggatacgagtactgtattcgaattttgcaaggttttgtaaggaccaggagtatctgatatctctgcatgggaaagcagcaagggagagattcgactatgtggagggtttcgtgatagttgatgaagggctgatcaataattggaggtcttcgttcttttcagctagtaacccagttaaaatcacttccctcaacgctgacggaggtgttttgtactgcttggagattaccaaaaattacgaccaaggaaacgcagattctgttgatgaggaaatacaagctctattgaaaaagttaaattttataccaacatcggttttcacaacggacttgccttacgtggattttctggatcgtgtacataaggcagagctgaagcttagatccaagggtttatgggatgtacctcatccgtggctcaacctttttgttccaaaatcaaggataggggacttcgacaagggtgtgttcaagggcattcttggaaataagacaagtggacctatcctcatataccctatgaacaaaaacaagtgggaccagcgaagctcggtggtgacaccagaagaggatgtgttttacctggtggcatttctaagatcggcattggatactgagacgctggagtacctgactaatcagaaccgtcaaattctgaaattctgccatgatatagagatcaaggtaaaacaatacctgccccattacactacgcagcaggagtggatggaccactttggtgataagtggacccagttcaatgctaggaagatgcaattcgatccccgccgaatcttagccacaggccagcaaatttttcagtttcatccctcactcaccctcaatatgtag

SEQ ID NO: 933 - DNA, 675 bp, Glycine max var. Williams 82
atgctagaggcaatggaaagttcggtcaatggtggcttctcccatttgcagagctgtggagatagtagcgaagaagagttatcggtgcttcctcgtcacaccaaagttgtcgtaaccggaaataaccgcaccaaatcggtgctcgttggtcttcaaggtgtcgttaagaaagccgttggactaggcggatggcattggctggttcttacaaatggtattgaagttaagctacaaaggaatgctcttagcgtgattgaagcacccaccggtaatgaggaagacgatgaccttgagtttgaaaatatgccgtggaatggatcagatatggcatcggacgacacacacaagttccacaagtcgaggcatagaatgcatagaacattgggatcatctcacaaaaccacgagtaggtccttctctgccgattcacagtcaaaggggtccgtttctatgccgcttcatggctccacgaaggtggacttgagcaaacttgaaatggctgcactgtggagatattggcgacattttaatctagtggatgcgttcccaaacccatcaaaagagcagctagtagacgttgttcagaggcatttcatgtcgcagcaaatggacgaattgcaggtgattgtgggatttgtccaagctgcaaagaggcttaagacagtgtggaaatga

SEQ ID NO: 934 - DNA, 1566 bp, Glycine max var. Williams 82
atgacatcaattacctctgcatcccttcctttgctgcaactccaatcttcattgaagagaaaaccctgcaacttgaagagctccaccaccatgcgtcgttttacaaccaaagcctcagcctctgaaacgacgtcggcggctgcgccagcgcccgagcccagcaagcttcccatgcgaaagatcccaggagattacggtctccctttcataggacccatcaaagaccgccttgacttcttctacaaccaagggcgcgacaagttcttccaatcccgcgcccaaaaatacaactccaccgtgttccgcgccaacatgccccccggccccttcatcgcctccaatccaaacgtcatcgttttgctcgacgccaaaagcttccctgtccttttcgacgtcagcaaagtcgaaaagcgtgacgtcttcaccggcaccttcatgccctccacccaactcaccggcggttaccgaatcctctcctacctggacccctccgaacccagacacgaacaactcaagcgcctcttgttcttcctcctcaaatcccgaagcagccacgtcatccccgagtttcattcaagctacacaaccctctttgaaaccctggagaatgagcttgctaaggaaggcaaggctagcttccaaaccgccaacgaccaagctgcgtttaacttcctcgctcgcgcgctttatggcaccaacccctccgacacaaacctcggacgcgacggcccaagcataatccaaacatggcttttgttccagctcggcccaattatgaccttgggccttccaaaattcctggaagatcccactcttcacaccttccgcatccctccttttctgataaaaaaagattacaagagactctacgatttcttctacgagtcctccgggttcgcgcttgacgaagcggtgcgtttaggagttcccagagaagaagcgtgccacaaccttttattcgccacgtgctttaattccttcgggggaatgaagatattcttccccactattctgaaatgggttgggcgtgcgggggtgaaacttcacgctaggttggcggaggaagtgagggccgccgttaagtcaaacggcgggaaggtgacgatggcgtcgatggaggaaatgccgttgatgaagtcggtggtttacgaggcgtttcggatagagccgccagtgccgctgcagtacgggagggcgaagaaggagttggtgattgagagccacgagaatgcgttcgtggtgaaggaaggggagatgctgttcgggtttcagccgtttgcgacaaaggatccgaagatatttgagaatgcggaggaatttgtggcggatcggtttgtgggggagggagagaagttgctcaaacacgtgctttggtccaatgggcctgagaccgagggacccacccttgggaacaagcaatgtgcagggaaggattttgtggtgttgttctctcggcttctggtggtggagttctttcttcattatgattcctttgatgtccaagtggggaattcatctttgggttcttcccttaccttcacctccctcaagaaagcaagctattag

SEQ ID NO: 935 - DNA, 2191 bp, Glycine max var. Williams 82
aaatccttcttcctcgtattgtagtattttctttttcttgtctcttcaaagtgtagacacttgtatacaagaagaagaagagttctaagtatgaacacgtgcaaaaatcacgactgaggttttctattttcagaagtcatctaccattatttaatgccaaaaagttcagaatagtcactcctctagcaatatataaaaaacaccattgctataatagaactgttgtcatcttaaaatccttcttcctcgtatactatatattgttgttcttgcatttaattaaagtgtgatcagatcacacaaattaaatgacatcaattacctctgcatcccttcctttgctgcaactccaatcttcattgaagagaaaaccctgcaacttgaagagctccaccaccatgcgtcgttttacaaccaaagcctcagcctctgaaacgacgtcggcggctgcgccagcgcccgagcccagcaagcttcccatgcgaaagatcccaggagattacggtctccctttcataggacccatcaaagaccgccttgacttcttctacaaccaagggcgcgacaagttcttccaatcccgcgcccaaaaatacaactccaccgtgttccgcgccaacatgccccccggccccttcatcgcctccaatccaaacgtcatcgttttgctcgacgccaaaagcttccctgtccttttcgacgtcagcaaagtcgaaaagcgtgacgtcttcaccggcaccttcatgccctccacccaactcaccggcggttaccgaatcctctcctacctggacccctccgaacccagacacgaacaactcaagcgcctcttgttcttcctcctcaaatcccgaagcagccacgtcatccccgagtttcattcaagctacacaaccctctttgaaaccctggagaatgagcttgctaaggaaggcaaggctagcttccaaaccgccaacgaccaagctgcgtttaacttcctcgctcgcgcgctttatggcaccaacccctccgacacaaacctcggacgcgacggcccaagcataatccaaacatggcttttgttccagctcggcccaattatgaccttgggccttccaaaattcctggaagatcccactcttcacaccttccgcatccctccttttctgataaaaaaagattacaagagactctacgatttcttctacgagtcctccgggttcgcgcttgacgaagcggtgcgtttaggagttcccagagaagaagcgtgccacaaccttttattcgccacgtgctttaattccttcgggggaatgaagatattcttccccactattctgaaatgggttgggcgtgcgggggtgaaacttcacgctaggttggcggaggaagtgagggccgccgttaagtcaaacggcgggaaggtgacgatggcgtcgatggaggaaatgccgttgatgaagtcggtggtttacgaggcgtttcggatagagccgccagtgccgctgcagtacgggagggcgaagaaggagttggtgattgagagccacgagaatgcgttcgtggtgaaggaaggggagatgctgttcgggtttcagccgtttgcgacaaaggatccgaagatatttgagaatgcggaggaatttgtggcggatcggtttgtgggggagggagagaagttgctcaaacacgtgctttggtccaatgggcctgagaccgagggacccacccttgggaacaagcaatgtgcagggaaggattttgtggtgttgttctctcggcttctggtggtggagttctttcttcattatgattcctttgatgtccaagtggggaattcatctttgggttcttcccttaccttcacctccctcaagaaagcaagctattagatattattaactttgcatgagctttcaatattcatatttttaaacattttgattaatacttatgtatactagtttctatctttttatcatgttattgtgttattgtacttgtaatgtacatttgtttagaactgggtgtttcttatttggtacgagagagaagagcatggaaaatagagaataagactttagccatttacccatttccagactcatattgaccatacatgccggggttcaactgttcaacttgaaattaacttcttataaaagtttggttttctctctaaatttgtattagttttttttttctgaat

SEQ ID NO: 936 - DNA, 375 bp, Glycine max var. Williams 82
atggctatggccacagctgtcgtgtgtcctcagaacatcaccggagccatcgtgagctcacctagcaagaccaagaagagagtggtacacgtgagaggcataaattcatttgggggactgaaggctagcaatggtgttgtctctttggggattcctatgagcactgagaagtgctttgctaaggttgtgagctcagtgaaagcagctacatcaaatgggaaaggaaaaggaggggctctttcttccacgtgcaacgctgctggtgagatattcacgattgctgctatcatcaatggacttgttcttgtcggggttgctgttggctttgtgctcttgcgagttgaagcatgggtcgaggagtccgaggcagagtga

SEQ ID NO: 937 - DNA, 1839 bp, Glycine max var. Williams 82
atggcatacttcgattgcaatttgcaacttggtttcctatataaatttatggcgaatgaactactaatcctaaagaagctagcggcacgttctatcctaaagaagacactaacaatgggaatctgcagaaatatgggtacccaaccaagggtacaaagaaggctaggaggaaacagagctacactttttgtatatgctatggaagggctagagaacatggcttttgttgccaatgctgtgagcctagtaacttacttctttgggtacatgaacttcagcttaacaaaatctgccacaaccctgaccaactttatgggaactgcatttttactggcactggttggtggattaatcagtgacacatatctttctaggttcaagacttgtgttctgtttgcctgcatggaattgctgggatatggtatcctcacagttcaagcacgcttccaccaattaagacccatcccctgcaaagatctagcaacaacccaaatgagtcaatgtgaggctgctacaggtggccatgctgcaatactttatactggcctctaccttgttgctttaggaaccggtggtattaaggcagctttaccagccttaggggctgatcaatttgatgaaaaagatcccaaggaggcaactcaactttcaagctttttcaactggttcttgttcagccttaccataggagcaattattggtgttactttcattgtttggattggtgtcaacctgggatgggattggagctttattgtatgcacattaacaattctattcgcaattgtgttcatatgcatgggcaactcgttgtaccgaaacaatgtcccaaagggaagccctctagttcgaatcattcaggtgtttgtggcagcctttagaaacagaaaacttctgattccagataatacagacgagctgcatgagattcatgaaaagcaaggaggagactattatgaaattattaaaagcacggatcaattcagattcttggaccgggcagcaattgctagaagcagcacaggtgcaagaacaacctcaggcccctggagactttgcacagtgacacaagtggaagaaacaaaaatcttagtccgcatgctaccaataatactcagcaccatatttatgaacacttgtttggctcaacttcagactttcactatacaacaaagcaccaccatggacaccaacctaggggggtttaaagtgccaggaccctctgtaccagtcatccctttgctgttcatgtttgtcctaatccctttatacgaccgtgttttcgtcccgcttgctcgaagaatcacagggattcccaccggaattcgacaccttcagaggattggaattggtttggttttgtctgctgtttccatggcagtggctggttttgtggaaacacgccgcaagtctgtggccatacaacacaacatggtggatagcactgagcctttgccaataagtgtgttctggctgggtttccaatatgctatttttggagctgcagacatgtttaccctgatagggcttttggagtttttctatgcagaaagttcagcaggaatgaagtcacttggcactgcaatctcgtggagttccgttgcattcggttactttacaagcacggtggtcgttgaggtggttaacaaagtgagtggaggctggctggctagtaacaacttgaatagagacaacctcaactacttctactggttattgtctgtgttaagcgttgtaaactttggattctatttggtttgtgcttcttggtatagatacaaaacggtggaaaacgagcaaggtgattcaaaagataatgttgacatggccaaggtttag

SEQ ID NO: 938 - DNA, 2300 bp, Glycine max var. Williams 82
tggggaggagaataggaacttagcctacaaaacgtgacaaaaattatttctctaatgccaagttgacatttgattttcttatggcatacttcgattgcaatttgcaacttggtttcctatataaatttatggcgaatgaactactaatcctaaagaagctagcggcacgttctatcctaaagaagacactaacaatgggaatctgcagaaatatgggtacccaaccaagggtacaaagaaggctaggaggaaacagagctacactttttgtatatgctatggaagggctagagaacatggcttttgttgccaatgctgtgagcctagtaacttacttctttgggtacatgaacttcagcttaacaaaatctgccacaaccctgaccaactttatgggaactgcatttttactggcactggttggtggattaatcagtgacacatatctttctaggttcaagacttgtgttctgtttgcctgcatggaattgctgggatatggtatcctcacagttcaagcacgcttccaccaattaagacccatcccctgcaaagatctagcaacaacccaaatgagtcaatgtgaggctgctacaggtggccatgctgcaatactttatactggcctctaccttgttgctttaggaaccggtggtattaaggcagctttaccagccttaggggctgatcaatttgatgaaaaagatcccaaggaggcaactcaactttcaagctttttcaactggttcttgttcagccttaccataggagcaattattggtgttactttcattgtttggattggtgtcaacctgggatgggattggagctttattgtatgcacattaacaattctattcgcaattgtgttcatatgcatgggcaactcgttgtaccgaaacaatgtcccaaagggaagccctctagttcgaatcattcaggtgtttgtggcagcctttagaaacagaaaacttctgattccagataatacagacgagctgcatgagattcatgaaaagcaaggaggagactattatgaaattattaaaagcacggatcaattcagattcttggaccgggcagcaattgctagaagcagcacaggtgcaagaacaacctcaggcccctggagactttgcacagtgacacaagtggaagaaacaaaaatcttagtccgcatgctaccaataatactcagcaccatatttatgaacacttgtttggctcaacttcagactttcactatacaacaaagcaccaccatggacaccaacctaggggggtttaaagtgccaggaccctctgtaccagtcatccctttgctgttcatgtttgtcctaatccctttatacgaccgtgttttcgtcccgcttgctcgaagaatcacagggattcccaccggaattcgacaccttcagaggattggaattggtttggttttgtctgctgtttccatggcagtggctggttttgtggaaacacgccgcaagtctgtggccatacaacacaacatggtggatagcactgagcctttgccaataagtgtgttctggctgggtttccaatatgctatttttggagctgcagacatgtttaccctgatagggcttttggagtttttctatgcagaaagttcagcaggaatgaagtcacttggcactgcaatctcgtggagttccgttgcattcggttactttacaagcacggtggtcgttgaggtggttaacaaagtgagtggaggctggctggctagtaacaacttgaatagagacaacctcaactacttctactggttattgtctgtgttaagcgttgtaaactttggattctatttggtttgtgcttcttggtatagatacaaaacggtggaaaacgagcaaggtgattcaaaagataatgttgacatggccaaggtttagattattaggcctgcaagatgttcagtgtaatttttatgtttctgttcgagtatctctgttataaatattaggcctgctagcaaatcctgcataaatagctgctgtaaaactgtgaaagtgaaacaaccaaggaaaattgcagaacagttcttggtcaaaagcaacttatcaagctcgatcggcagatgaaccaaatgcaatgcttggatataaatataatggcaagtttatttctgaaacatacactagaggttggccaagaaacagatatcattgatatgcttgtttaccgccactggaatgtaattgaactcttttaatgatgtattagtataaatatttacattaatcaaaatcatgaatagaatttaaatttaaact

SEQ ID NO: 939 - DNA, 621 bp, Glycine max var. Williams 82
atgggtgtgttctaccatgaagagccaccaaaccatcccaagagatgcaaataccttgtggcaactcttaaggaagtattttcccgttgccaaacgtttgcagcacggctttcaacttcaagttttgaggatgagtgcccagtgagcgattttgacgagaaacaagaattgtttatctcagcagtgataagccgaaacatggagaaacaaaagcacaagccaagtgtcttgagacacagcttttcctgggtatattctcctgcaacgaaagaactttatttcactcaggcagtggcaccagaagaaaaggtggtgaagggtgatgaagaaagtggtgaaggagaagagtttttgtcagttaaaagttgtttctcacgctgttcaagttcgccaagtggggaagcattctattctgtgaagacaaacctttcacggtgttcaagcttgaacgaacttgacttgtctaaatattggaggcgctcagtgattcaggagttttgtcattgccagggatggccttttggtctctgccgcagagctgtgttgcttccaccactgcccatgtcaccttctgagtcatggttgtcgcgtaaaatgcaaccaactattaagaaaccatga

SEQ ID NO: 940 - DNA, 1218 bp, Glycine max var. Williams 82
atggagaatctgttagagaagctgaaacactctctttctctcaccctcttccatttctatcctttggcaggccaacttgtcacccaaaaaacccaagaccctccctcttatactatttttgtcgattgcaacaacactagtggagccagattcatctatgcaactttggatatcactatatctgacatactctccccaattgatgtcccacccattgttcactcattctttgaccatcacaaagcagtcaaccatgatggccacaccatgccactgttgtccatccaagtcactgaactattggatggtgttttcataggctgttccatgaaccataccataggtgatggcacttcttattggaatttctttaacacatggtctgagatcttttttcaaactcaagctcaagggcttgaatatgatgctactgttcccatttcacgccaccctattcataataggtggtttccagatggttgtggtccattaatcaatcttcccttcaaacatgaggacgagtttattgacagatttgaatcaccaaagctgagagtgagaatcttccacttttcagcagagtctattgcaaagctgaaagcaagggctaactctgagtccaaatccaaaaccagcgaaatctcttcgttccaatccttatcagcgcatgtttggagatccgtaacacgagcacggaagctgccaaatgatgagataacaagttgcaaattggccataagcaatcgatcaagattggaaccgcctcttccacacgagtactttggaaacgcagttgatgtggtgagcactgcagggttcacggcaggggaattgcttgagaaggatctaggatgggcagcatggaaggtgcacgtggctgttgcgaaccaaaacgacaaagcggtgagacaaaagctcaaagagtggttgaagcttcctgtggtgtaccaacttggtgtgcactttgatccttgtactgtgaccatgtcgagttccccgaggttcaacatgtatgggaatgaatttgggatggggaaagcggttgcagttctgagtggatatgccaacaaaaatgatgggaacgtgacagcataccaaggatatgaaggagagggaagcatagatttggaaatttgcctttcgcctgatgcagtgagcgcgctggaatcagatgaggagtttatggaagctgcttctgtggccaatttcctacactag

SEQ ID NO: 941 - DNA, 1425 bp, Glycine max var. Williams 82
atggctaccgaagtgagaaagaagacttcaagaggagccacaacagtaatatggctggcctcgtggagccttattatggcctacaatgtctgtttagcagaaagagttttgaaagaccaaaaacctgagagttttgttgtcaaagaaaggcaaggagttatgaatagtataattgatttcttttggaacgatggagagcctaccaatgaccgtgtttggcctgaaatgaagtttggttggagaattgtagtagggtcgattgttggattttttggagctgcgttgggtagtgtaggcggggttggaggtggaggaattttcatccctatgctcactttggtcattggttttgatgccaagtcttccacagccctttctaagtgtatgattatgggagcagcggtatcaactgtatactacaacctgaggtttagacacccaacactagacttgccagttatagattatgatctggctttgctcttccagcctatgctaatgctaggaataagcattggtgttgcatttaatgtcatgtttgctgattggatggtgacggttttgcttatcatcttatttattgctacatccacaaaagctttattcaaaggcatagatacatggaaaaaggaaacaattatgaaaaaggaagcagctaagatgttggaatcagattcttctcctggttatgtttctgaagaagactataagtctctaccagctggttcagctgatccacgagatgaggaggtccctttactaaagaacatctattggaaagaattattagtcctagcgtatgtctgggtggcttttctcattgttcagattattaagacatacactaaaacttgctccatactgtactgggttcttaattccttgcaggtgcctattgcaatctcggttacgctttatgaagccatatgcttgtgcaatggaactagagtgattgcatcaaagggaaaggaaaatacagattggatgaagcttcacaagatctgcctttactgttcctgtggaataatagctggtatagttagtggattgctaggtctaggtggtggcttcattttgggaccactctttctagagttgggaattcctcctcaggttgctagtgctacatcaacttttgctatggttttctcttcctccatgtcagtggtgcaatattaccttctagaacgcttcccagtaccctatgcttcttactttattttggttgcaaccatagctgcattaactggccagcatgtggtgagaaagataattgctatcttcggtcgagcatccatcatcatctttgtactagcattcaccatttttttgagcgcgatcagtttaggtggagtgggaattgagaacatggttgagaagatggaaaataatgagtatatgggatttgcaaatatctgccattaa

SEQ ID NO: 942 - DNA, 510 bp, Glycine max var. Williams 82
atggaagaagcaggtttaggagattgttgttcctcgaattcgacgattacgaggaagagcgataagcgaaagcagcaacaccaacaacaagagaagccatacagaggaataaggatgaggaagtggggcaagtgggtggcggagattagagaacccaataagcgttcgaggatctggctgggttcttacgccacccccgtcgccgccgcacgcgcctatgacaccgccgtcttccacctccgaggcccttccgctcgcctcaacttccccgaattgctgtcccaggacgacgacgtttcgacccaacaacagggcaacatgtccgccgattcaattcgcaaaaaagccacccaagtcggcgccagagtcgacgcgctccaaaccgcgcttcagcaatcctcgtcctcacactccgctaattccagccacgtcagcagctctgacaaaccagacttgaacgagtatcccaaacctgaagattactggagtcgtggactggtagctacgtag

SEQ ID NO: 943 - DNA, 1104 bp, Glycine max var. Williams 82
atgggtactaacagatctttaatggccacgatcctcatcgtgttcttcacggtgttggcagtgtcatcggcgttggacatgtcgataatctcgtatgacagaagccacgcggacaagtcagggtggaagagtgacgaggaggtaatgagtatatacgaggagtggcttgtgaagcatgggaaggtgtataacgccgtcgaagagaaggagaagaggtttcagatcttcaaagacaacctcaactttatcgaagaacacaatgctgtgaaccggacatacaaggttggactgaaccggttcagtgatcttagcaacgaggagtaccggtcaaaatacctgggaaccaagattgatcccagcagaatgatggccagaccaagtagacgttactctccgcgcgtggctgacaatttgccggaatctgttgattggaggaaagaaggtgctgttgtcagagtcaaaaaccaatcagaatgcgagggctgctgggcattctcagcaattgccgcagttgaaggaattaacaagatagtaacaggcaatctaactgcactgtcagagcaagaactgttggactgtgatagaaccgtcaatgcaggatgtagtggcggacttgtggactatgcctttgagttcattatcaacaatggtggcattgacactgaagaggattacccctttcaaggtgctgatggtatctgtgatcaatacaagataaatgctagagctgttacaattgatggttacgaacgtgttcctgcttatgatgaattagccttgaaaaaggcagtagcaaatcaacccgtgagcgttgccattgaagcatatggcaaagagtttcaattatatgaatctggtatattcacaggaacatgtgggacatcaatagaccatggtgttacagctgttgggtacggaacagaaaatggaattgactattggatcgtcaaaaattcatggggtgagaattggggagaggcaggttatgtaagaatggaacgtaatatagcagaagacactgcaggaaagtgtggaattgcgattctgacattgtatcccataaagattggccaaaatccctcaaacccagataactccagctaa

SEQ ID NO: 944 - DNA, 780 bp, Glycine max var. Williams 82
atggatcggataaaagggccatggagtcctgaagaggacgaagcgttacggaggttggttcagacttacggccctaggaactggtccgttataagcaaatccattccgggtcggtctgggaaatcgtgccgcttgcggtggtgcaaccagctgtctccggaggtggagcgccggcctttcacggcggaggaagacgaggcgatcctgaaggctcacgccaggttcgggaacaagtgggccaccatcgcgcgcttcctcaatggccgcaccgacaacgccatcaagaaccattggaattccaccctcaagaggaagtgctccgagcctctctccgagcctcggcctctgaagagatccgccaccgtttcgggtagtcaatccggatccgatttgagcgattcgggtttacccattattcttgcaagaagcgtgagcgtgacggtagctccctctaaccaccttgcggaaaccgcgtcttcttcagtaactgatcctgccacgttattgagtttgtctctaccgggattcgattcgtgcgatggggctaataatgggcctgggccgaatcaggggcccagttgcggcccgttccaggagataccgatgcttggttcccaaaagcagttgttcagccaagagtttatgaaggtgatgcaagagatgatacgagtggaagtgagaaattacatgtctgtactggaacgtaatggtgtgtgtatgcaaaccgatgccattaggaactcggtgttggagaggatgggaattggtagggttgaataa

SEQ ID NO: 945 - DNA, 1307 bp, Glycine max var. Williams 82
ttaaattccgtattgtttcgtaatgggattgagggatcgtcgcagtcaaagaagtgatatttaaattagctattggtggcacatttcgtgataggatttgattccaaacacgcatcacaaattagggttggcaactggcacaaaccgtacgtagtggattggggaactcaaccgcagccataatgtacacatacgtgtaaaaacatgggattctcattccacaggtgtcacttttgattgctgtaagctagtaactacctcgtcaggatcaacacaccgctcctaaccgctctaaccggacatggatcggataaaagggccatggagtcctgaagaggacgaagcgttacggaggttggttcagacttacggccctaggaactggtccgttataagcaaatccattccgggtcggtctgggaaatcgtgccgcttgcggtggtgcaaccagctgtctccggaggtggagcgccggcctttcacggcggaggaagacgaggcgatcctgaaggctcacgccaggttcgggaacaagtgggccaccatcgcgcgcttcctcaatggccgcaccgacaacgccatcaagaaccattggaattccaccctcaagaggaagtgctccgagcctctctccgagcctcggcctctgaagagatccgccaccgtttcgggtagtcaatccggatccgatttgagcgattcgggtttacccattattcttgcaagaagcgtgagcgtgacggtagctccctctaaccaccttgcggaaaccgcgtcttcttcagtaactgatcctgccacgttattgagtttgtctctaccgggattcgattcgtgcgatggggctaataatgggcctgggccgaatcaggggcccagttgcggcccgttccaggagataccgatgcttggttcccaaaagcagttgttcagccaagagtttatgaaggtgatgcaagagatgatacgagtggaagtgagaaattacatgtctgtactggaacgtaatggtgtgtgtatgcaaaccgatgccattaggaactcggtgttggagaggatgggaattggtagggttgaataatgaattcaagagcggaaaattatattcatattaggtcatggaaaaatgattaggtgaaatcgcagagaaatagtgattctatctttttattttttgttaggttaattatcctttttttaaatgataattattttttatctgtaccgatgaaaatgagggagattaaaaaatcatggagataaaaaaagaaaaaatcattttgtgatagaggggttatacagggaac

SEQ ID NO: 946 - DNA, 2502 bp, Glycine max var. Williams 82
atgcatttaagtactagtagagaggttccgaatcaaccacaactcatcgtgcatgtatctctctatctgttcattcctgtactttatgctatgcgcatggttctactcttcctccttctcctcttcgtcccaacctcctttgggacaatagaaagactcccagaaggttcctcactttccgttgagaaacaaaacgacaccatcgtttcatccaacggcgatttctcagctggattcttccaagtcggcgacaacgccttctgcttctcggtatggttcacaaggtccgaacgacccaccgttttatggatggccaaccgcgacaagcccgtcaacggcagaggctcacacctctccctctggaaagacggtaacgtcgttttgaccgacgcaggcggaaccatcatctgggcaaccgccaccctctcctcctcacaacaactacacctaaagctaagaaacaacggaaacctcgttctcctcgcttccaaatccaccaataccaccatcatttggcaaagcttcgattccccaacggacacccttcttactctccaaccactcacggagcaagcgagcctcgtttcctcgagaagcacaacgaaccattcctcgggattctacaaactctacttcgacaacgacaacgttcttcgcttactctacaagggtcccacgttgtccagcgtgtactttccagagccgtggaggcttccaatggatataggcagatccacctacaatgttaccaaaaccgcggtcttagattcctttggacgattcacttcctctgatggcttccaattccgctccaccgatcatcccaaaaaactgtttcgaagactcaccatggatcctgacggtaacttgcgtttgtatagcttcgacgagaagcttaagacgtggcaggtgacgtggcagcttattccccaaccgtgtaccgttcatggcatttgcggagctaacagcgcgtgcaattacgatcgtgttgtcggaaggacctgctattgtttaaaagggtttaaggttaaggatcctaatgattggactcaggggtgtgagcccgagttcgatccttctgttttttcttgcaacagtggcgagtctatgggttttctccattatccaaccacggagttgtacggctatgactggaacataacagtggttaatagcttggaggaatgcctgaatctatgcctggaactttgtgataagtgcgtagctgttcaattcaagttcaacgatgttgctaagtataattgttaccccaaaacgatggtattcaatggaaggtatactcctaatttcgacggagagatgtatctgaagttgccgcaagcgattttgggctcatctgccacgcctcttaataagcattcaacgatgaattgtaccgctggtttgtctcaacagttggagaggttttacgaagcgcctagtagaaactccacgttgagtttcttggtttggttcgcttgcgggatgggggtgtttgagttgtccaccattttcctggtgtggttcttcttgttcagaaccagcaagaactctgagacggtggatcaacaacggcaccttctttccgccactgggtttcagaggttcacctacgcagagctcaaaagcgcaacaaaagggttcaaagaagaaattggacgaggagcgggtggggttgtttacaaaggagtactctatgatgaccgtgttgcggctattaaacgcttaggagaagctacacaaggagaagctgagtttttggcggagataagcacaataggcatgttgaaccacatgaatttgattgacatgtgggggtactgcgttgaagggaagcataggatgttggtgtatgagtacatggaacatgggtccttagcgggcaatcttttttctaatacccttgattggaagaagaggtttaacgttgctgtgggtacagcgaaaggtttggcttatttgcacgaagagtgtttggagtggattttgcattgcgatgtgaagcctcaaaacattctccttgactcggatttccaacccaaggtggcggatttcggtttgtcaaaacttttaaacagagacgagcgtgggaattctactttctcaagaataagagggacacgaggttacatggctccggagtgggtttacaatctgcccataacttccaaggtggatgtttatagttatgggattgtggtgttggaaatggtgactggaaggagccctatggaaattcacagccttgagaacagtaggggcatagagcagcgacggttggtgatgtgggtaacggacaagataaacgatgcacccacgagtgggttttggattgaggagatacttgatcccaacttggaaggccaatgccaagtttcgcaagttgaggttttggttaaggtggctttgcagtgtgtgcaagatgacatgaatcaaagaccctccatgagccaagtagtggagatgcttctgtcccatgaaaataatgtgctccctcgttaa

SEQ ID NO: 947 - DNA, 558 bp, Glycine max var. Williams 82
atggtcttcctctatgataaagattccccgaggcagcaaaaaagaaaaagcatgagctgcaatggttgccgagtcctccgcaaaagatgcagcgagaggtgcagcctgagatcctccctgaactggatcgattgtccgcatgcacaggcccatgcaactctcttcctggctaagttcttcggccgtagcgacctcatgtttttcatctcctccgtcccactaaacaacagacccgcgctctttcagtctcttctgtttgaagcgtgcggacggaccgttaatcccgttaacggtgccgtcggactcctgctgagcggtaactggcacgtgtgccaggccgccgtccacacggtgctcgccggaggcgttctccggccgctgtcggaggttgtggcgccatcagaaagcatgttctctcatcagttccagtctctggcgtcagattctttgaagagaagcagcgatgcaacagcaccggttatgtcgaccatggtttctggagaatcagagatttgcagcagcgacgatgggaaaaagcttttgaatctgttcgtctag

SEQ ID NO: 948 - DNA, 555 bp, Glycine max var. Williams 82
atggatatatcaagttcacaatacaatagtgctggtgaatctggctggacacattacttggatcattcctctctttctgaaagttatttccagatgagaggtgggatagaagaccatggaggaaagggagcaagagtggaggaagaggaagaagatttgtctatgatctctgatgcttcatctggtcctcaacattaccatgaagatgatggtcaacactactgtgtaaattggtatccttctacttctcactacaccaaagaatcagaaaagaagaagaacaacaacaagaaggccaaagaatatggtaacaatcaacatccttcacctcttgatgacactgccagttcccctgttcttaactgtcccaagaagaaagccagtttctcagggaatggagcagtggaaaatgcactagattttcccccatgtttctcgggaacaaaaataaagaaaaagtctaaattccagaagcacttcagtttctttgagcgttctcttggtggaaaacaagcttcagaggaaccaggtggtttcgatgaaggatggaaatga

SEQ ID NO: 949 - DNA, 1811 bp, Glycine max var. Williams 82
tgaatactgttttttcttctctgatgccgcatcgtgtcaaggcaccgaacaacttctccaatctctcttcttctcgtcgcactgtagaaattcagaagctcatcgtcatcgcgtacaaatcttggccataaaccctagactggtttagtttttggaacattgataaccaattaagcaattgagaagagatgcttggtgatggaggcgaaatcccctcaaggtatgaattgttgagcatggtgaagaagcattccaatttaatagggaaaacggtagttgaggagcaacatgcttctgatatcgaaatggatatgaggttttggcacgatgtctttgatttgtattttgtctgtggcaaggagtcaaggggacgccaagatgatgatcttgttttctttgtcagaaaattgggttcccatggttctggttccaacaataaaacagagagcgttgatccttattttgtacgcagtcaccaggatcttctgaaccatcgagctgggcaggatacacctgctgggcaggatacacctttatcccctatatataaggttgtgaagactgtttatgcatccccaagtcgtgtaaattttcaattggactctgaaaaggaagtggaaacgactcctgcttatccagatatatgtttcgcaattgatgattttgactccacttttgatgctgtggttttgactgaaaaagatcattgctattgtgtagttcttaacgcacatgatggggcagcatttccgagtgaaaaggtggccaatgattgtagtactagtgatagctcctctttgccagtccattctagttctgcaaagaaaaggaatacaaagcttacacttttatcaggatttgtcagctatcagatggtccgagatgcttatgatgctggtaggtctcgatttgggagccttttatccgtgggccattcttcaggcaaaacagacaggatttacatgaaaggtcctggtggccgaggggaagttgaagtagctgtttctggtgttgcggatcaaagccagcaggattcaggcccattttcgccagttatatcaaagaaagggtttgggcttggcgtcattgtccacaaagcagcatctgctgcatcagtagcagcaaggcatgcttatgcagctgcctctgcctccagcccaaattttgatgagttgatacctttgaaatgcagcttaatgtccatatcattgccctgggaatttattgcgtatgatcttctgtttaagggagctcctccagtgaacatgtgaccatccaatgtatctgtgggcaatgaaaatcgaaatggagatttctgccatcaactttttcctagttatgaaattcatttctcttctgacagttgtctttggtgcatgttgtgtgcacgtgcatgcttagaaatgtgcatatttggtgttgggttgagtatcccggggtaatttgtttgttgcatctggttataaatctatattagttggttggtgtatatattggattactgtaattgccacatttccaattaccaggttcttcctgactaggtttttttttaattattttttaaaaattgtttatacttcctagccaattccaccagagaagataaaaggtaaaagaaattggtctccggtcaaagctgaactgcacgcaggcagcgatggccactaaagatgggacttttttaatagatgaatttatttatgaaaaagtatgcattcacttttcggtgttaatctacataaacaacttcatccattagtgttagtgctttttttttcttcatttttcttttttacttttaaatcaca

SEQ ID NO: 950 - DNA, 156 bp, Glycine max var. Williams 82
atgtttagtagcagtggtttcttatgtaaatatatcattttgaaaaatagtgtggtacatgatatattggtctatattctttgttatataatttttactttcatttttgttacaaaagcacaacttattatatttataagagccttgttatattaa

SEQ ID NO: 951 - DNA, 1155 bp, Glycine max var. Williams 82
atgattcaaagaattgtgtactttcccagtttaaggaaattgcttcttcgggctggttctaattctgcttcgtccaagatcggaacgaacaattgctttgcttctcagccctcccctcttcggagtcacagcagtgatgacgagtatgctgatgtggactgggacagtcttggatttggactgatgaccactgattatatgtacattactaaatgttgtgagggccaaaattttggacaaggacaactcagtcgttatgggaacattgaactcagtccatcagctggggtcctaaattatggtcagggattattcgaaggcacgaaagcatacagaaaagaaaatgggggcttgctactcttccgtccagaagaaaatgccattcgcatgaagattggagccgaaagaatgtgcatggcatccccttccattgataattttgttgatgctttgaagcaaactgtattggctaataagcgttgggttcctccaccgggcaaaggatccttgtaccttaggcctctgctcctaggaactggtccagttttgggtttggctcctgcacctcaatacacattcctcatatttgcttcccctgttcgtaactatttcaaggagggctctgctccactcaacttgtacgtggaggagaactttgaccgtgcttctagccgcggcactggaaacgttaaaaccatttccaattatgcaccggtcttgatggcacaaattcaagccaagaaaagaggattttcggatgtgctataccttgattcagccacaaagaaaaatctggaggaggtctcttcttgtaacatttttattgccaagggcaaatgcatctcaacacctgctaccaatggaactattctttccggaattactcgaaaaagtgtcattgaaattgctcgtgatcatggctatcaggtagaagagcgtgttgttaacgtggatgaattaattgaggctgatgaagttttctgcacaggaactgcggtcggtgttgctccagtagggagtatcacataccaggataaaaggatggaatatataacaggttctggaaccatttgtcaagagttgaacaatacgatttcaggaattcaaacgggtactattgaagataagaagggatggattgttgaagttgattaa

SEQ ID NO: 952 - DNA, 1542 bp, Glycine max var. Williams 82
ttccaaaaaaaaaataaaaaatgagcaaaacactcgaggttgtataaatggctattcagattgtagagctggctttaccctttactcctatatatagtgcatatcactttcttagtttctctccattatttgatgtgcatgctctcgcattcatacctgtttccgacacatacacctcaccaccaccactgcgttttaaagttgggcttctcctaccagaaggatagggcacaatgattcaaagaattgtgtactttcccagtttaaggaaattgcttcttcgggctggttctaattctgcttcgtccaagatcggaacgaacaattgctttgcttctcagccctcccctcttcggagtcacagtgatgacgagtatgctgatgtggactgggacagtcttggatttggactgatgaccactgattatatgtacattactaaatgttgtgagggccaaaattttggacaaggacaactcagtcgttatgggaacattgaactcagtccatcagctggggtcctaaattatggtcagggattattcgaaggcacgaaagcatacagaaaagaaaatgggggcttgctactcttccgtccagaagaaaatgccattcgcatgaagattggagccgaaagaatgtgcatggcatccccttccattgataattttgttgatgctttgaagcaaactgtattggctaataagcgttgggttcctccaccgggcaaaggatccttgtaccttaggcctctgctcctaggaactggtccagttttgggtttggctcctgcacctcaatacacattcctcatatttgcttcccctgttcgtaactatttcaaggagggctctgctccactcaacttgtacgtggaggagaactttgaccgtgcttctagccgcggcactggaaacgttaaaaccatttccaattatgcaccggtcttgatggcacaaattcaagccaagaaaagaggattttcggatgtgctataccttgattcagccacaaagaaaaatctggaggaggtctcttcttgtaacatttttattgccaagggcaaatgcatctcaacacctgctaccaatggaactattctttccggaattactcgaaaaagtgtcattgaaattgctcgtgatcatggctatcaggtagaagagcgtgttgttaacgtggatgaattaattgaggctgatgaagttttctgcacaggaactgcggtcggtgttgctccagtagggagtatcacataccaggataaaaggatggaatatataacaggttctggaaccatttgtcaagagttgaacaatacgatttcaggaattcaaacgggtactattgaagataagaagggatggattgttgaagttgattaacaacgcgtgtttataattgtttattccaatgttattaaacaaattttaaactataatgattgtctatacctaaagtgaatgaaatactgtgttgttcgttatctaaatgcatgttatatatgtaaaatgttatgcacattatataaagcaaaaacta

SEQ ID NO: 953 - DNA, 1446 bp, Glycine max var. Williams 82
atgaacgcaacctcatactctgctcttccttctacgttccgcagtctccatcatcggaatttctcagcgttttgttctgatatccaaaatcctggctatgttgattgccattcaaattgtaataagtctacatctcaagcgtctttgtttttgtgttccgactccaacagtagaagaaatggtgtttttggtagaccactttgtgtgaacccctctggcaggagaaacctagttggtccagctttttattctctggagactagtgcttatgacgtggctgctttagaatctccttcccgtgttgcagaagaaaaagttggtgtgctgcttctcaatctaggaggaccagagacattgagtgacgtgcaaccttttctgtttaatctttttgcagatcctgatatcattcgtcttccaaggttgtttcggtttctccagcgaccattggcaaaattgatttctgtacttcgggctcctaaatccaaggaagggtatgctgctattggtggtggctctcctttacgaaaaattacagatgaccaggcacttgcaattaaaatggctttggaagcaaagggcatctcttcaaatgtctacgttgggatgcgatactggtacccatttactgaagaagcaattcagcaaattaagagggacagaataacaaggcttgtggtactacccctttatccccagttttctatatccacaactggatcaagcatccgtgttcttgagcatatattcagggaagatgcctacttgtctaagctccctgtttccattataaactcttggtatcaacgagaaggttatattaagtcaatggctaacttaattcagaaagagctccagagtttttctgaaccaaaagaggtaatgatatttttcagtgcccatggtgtacctgtcagttacgttgaggaagctggggatccataccgagaccaaatggaggagtgcatcttcttgatcatgcaagagttgaaagctagaggaattagtaatgagcacactcttgcttatcagagtcgagtgggtcctgtacagtggctgaaaccatatactgatgaagttctcgttgagcttggccaaaaaggtgtgaagagtcttttagctgttccagtgagttttgtgagtgagcatattgaaacccttgaagaaattgacatggagtacaaggaattggctcttgaatctggcatcaagaattgggcacgtgtacctgcccttggtgttaccccttccttcattacagatttagcagatgcagtaatagaagctctcccatcagcaacagcaatatatgcaccgaccagaacctctgaagatgttgatcatgacccagttagatattttatcaagatgttctttggttcaatcttggcattcatcttgttcttgtcacccaaaatgatcacggcattcaggaatcatgtcatttag

SEQ ID NO: 954 - DNA, 1035 bp, Glycine max var. Williams 82
atggcggattcagtgtcggtggacatggaagccatctctcctccacccgaggaacatgttgttagaactcgtcatggttgtgtctcagttgctgtgtatggggaccaggacaagccagcgcttatcacgtatcctgatttggctttaaattatgtctcctgctttcaggggttattattttgtccagaagcctgttcattgctgctccacaatttctgcatatatcatattagtccacctgggcatgagttgggagctgctgccattgatccagatgatccaattctttctgctgatgacttggttgatcaaatagctgaagttcttaactattttggtcatagtacagttatgtgtatgggagtaactgctggggcttacattcttaccttatttgctatgaagtatagacatcgtgttcttggtttgatacttgtttctcctttatgtaaagcaccatcttggactgaatggttgtacaacaaggtcatgtcaaatttactctacttttatggcatgtgtggggtggtaaaagaaatattgctaaagcggtacttcagcaaggaagttcgaggcagtgattatttgccagagtcagatatagttcaagcatgccaaaggtcattagacgagaggcagagtttgaatgtgtggcggttccttgaagcaattaatgggagatatgacataagtgaaggattgagaaaattagagtgtcgttcactaatttttgttggagatatgtcttgctttcacggtgaggctctccatatgacatcaaagttggatagacgactcagtgctttagtcgaggttcaagcgtgtggatcaatggtaacagaggagcagcctcatgccatgttaataccgatggagtattttctcatgggatatggcttgtacagaccatctaagctgagtgtcagcccaagaagtcccctgagtccctcttgcatttctcctgagctttactccccagaaagtatgggtttgaaattgaaaccaataaagacacgaatttccgaggagatatag

SEQ ID NO: 955 - DNA, 678 bp, Glycine max var. Williams 82
atggaggaagggtaccccagaagcaagttcaagaccgtgtgtgtcttctgtggcagcaacagtggcaaccgacaagtcttcggtgacgctgcgattcaattgggcaatgaactggttaagaggaacatagacttggtgtatggtgggggcagtgttgggctgatgggcttaatatctcagagagtgtatgatggaggctgccatgtcctagggatcattccaaaagctctcatgcctctcgagatatctggtgaaacagtaggtgaagtgaggattgtttcagatatgcacgagcgtaaggctgcaatggcacaagaagctgatgcatttgttgctctccctggaggatatggaaccatggaagagctgttggagatgataacttgggcccaacttggaatccataaaaaaccggttggtctactgaatgttgacggttactataactgtttgcttgcattatttgacaatggtgttaaagaaggtttcattaagccttgtgcacggaatatagttgtctctgctacgtcagccaaagaacttatgatgaaaatggagcactacactccttcgcacgaacatgttgcccctcatcagagctggcagatgaaacaattaggtaatatccagatgcagagtgagactgttattgatggaaggtttttctccgaaaattga

SEQ ID NO: 956 - DNA, 648 bp, Glycine max var. Williams 82
atggctgtgtcctccaccactgccacagtatgtattcctgctaagaacattccaaccactcaagcaccaaaaattggattctcaagtaccatcgcctttgctgcgaaaccgcgaagaagattattacgcatcagaagctcctcagccgaaacatctggcacagaggtagattcagagacttccattgaagttccagaagaaacatcatcactcatttctgctcttaacgtcgaaaagattctccgtggcttaccaattacagatgcagatcattatggtaggctaggtattccaagaggatgtccctttgacttggtggggggtgcatataatatcaaggttcaagaattgaagagtcagaatttagaggaggatgaacttgagaagaaattggaacttctcaaagaatcatacaccatcctgtcatcggaggaagaaagaagaatatatgactggagcttggccagagcagaaaatacagacaaattcgtttggccgttcgaggttgacataacacagtcaaaaatttcaaaagaagatcctccacaactggaccccgaggatgtcggaccaacgagagtagttgggtatttcttattgggatggataatgctatctattgtgttatctattgcactaaacttgtaa

SEQ ID NO: 957 - DNA, 2958 bp, Glycine max var. Williams 82
atggcgtttcggtttggactactccttctgttttctctcctttgtttggattcaattggttcggtgaattcacacgacggagaaacgttgttggagataaagaagtcgttcagtgatgtagataacgttctgtatgactggacagactcaccttcttcagattattgtgtttggagaggggttacgtgtgataatgtcactttcaacgtggttgcactcaatctttcagggttgaatcttgagggcgaaatttcacctgtaatagggagacttaacagcttggtctctattgatttcaaggaaaaccgtttatctggccagatacctgacgagcttggtgattgttcctctttgaaaagcatagacttgtcatttaatgagattcggggggatataccgttttcggtttcgaagatgaaacagctggaaaatctaattttgaaaaataatcagctaattggaccaattccttcaactctctctcaggttcctaacttgaagattctagacctggcacagaataatcttagcggggagataccaagacttatatactggaatgaagttttacaatatcttggcttgcgaggtaacaatttggtgggttcactttctccagacatgtgccagttaactggattgtggtactttgacgtgagaaacaatagcttgacaggcactattcctgaaaacataggcaattgtactactttaggggtcttggatttatcctacaacaagctaaccggagagataccattcaatattgggtatctgcaagtagcaactctgtcattgcaaggcaataaattcttggggcatattccatcagtgattggtctgatgcaagcgcttactgtcttagatttgagttgtaatatgttaagtggaccaatccctcctatcttgggaaatttgacctacacagaaaaattgtatttgcatggaaacaagctgactggcctcatccccccagaacttggaaatatgacaaaccttcactatttggaattgaatgacaaccatttaagtggacatatcccacctgagcttggaaagcttactgatttgtttgacttaaatgtcgccaacaacaaccttgagggtccagttcctgataatcttagctcatgtaaaaacctcaacagcctcaatgtgcatgggaataagctgagtggaacagtcccctcagcttttcatagcttggagagtatgacctatcttaatctttcttcaaacaatcttcaaggctccattccaattgaactctcacggattggtaatttggatacactggatatatcaaataataatataattggttctattccttcttccattggtgacttggaacatcttctgaagttgaatctgagcagaaatcatttaacagggtttattccagcagaatttggaaatctaagaagtgtcatggatattgatctttcaaataatcaactctctggcttgattcctgaagaacttagtcagcttcagaacattatatccttgagactagaaaagaacaaattatccggggacgtgtcttcacttttaaattgctttagtctttctctacttaatgtctcttataacaacctagttggtgttattccctcaagcaagaatttttccaggttttcccctgacagttttattggaaatcctggtctttgtgtcgattggctggattcgtcttgtcttgggtctcactctacagagcgagttaccttgtccaaggcagctatcctaggaattgcaataggcgcccttgcgattctttttatgatattgctagcagcttgccgaccacacaatccagcttccttctctgatgatggatcttttgacaaaccagttaattactcacctccaaagctagtgattcttcacatgaatatggcacttcatgtgtatgatgatatcatgaggatgaccgaaaacctaagtgagaagtatataattgggtatggtgcatcgagtacagtttataaatgtgttcttaagaattgcaagccggtggctatcaagaagctctattctcactatccgcaatatttgaaagagtttgagactgagcttgagacagttggcagcattaagcacaggaatctggtcagtctccaaggctactcattgtctccatacggaaatcttctcttttatgactacatggaaaatggcagtatatgggatcttctacatggacctaccaagaagaaaaagcttgattgggatcttcgtctaaaaatagcacttggatcggcccaaggactttcttatctgcaccacgattgcagtccacgtatcattcacagggatgtgaaatcatctaatattttacttgacaaagattttgagccccatctcaccgattttggcattgcaaaaagtctctgtccatctaagacccacacttcaacttacataatgggcacaattggctatatagatccagagtatgctaggacttctcgcctcactgagaagtctgatgtgtatagctatggtattgtattgcttgagctcctgactggaaggaaagctgttgacaatgaatcaaacctccaccatctgattttgtccaagacagctaatgatggtgtaatggaaaccgttgatccagatattactgctacatgcaaggacatgggagcagtaaaaaaggtttttcagcttgctcttttatgcacaaagaagcaaccagttgataggcctacaatgcatgaggtgactcgtgtgctggcaagccttgtgccatccatcactccaccaaaacaaactgaccaaacacaagtagtgctatctgattcacagccatctgctaaaatgcaatgctacaaggatgaatatgcaaatcttacaactccacaccttgtgaactgtccatccatgagcacctctgatgcccaactcttcctcaaatttggagaagtaatatcacaaaacagtcactga

SEQ ID NO: 958 - DNA, 498 bp, Glycine max var. Williams 82
atgagaaccatccccaccacaacaacaactccaatagcacccgcagccaccaccataagtccttattctcagcactcgacgtggcactctccggttccgtatctgtttggaggactggctgcgatgctcggtctcatagcctttgctctcttgatcttagcctgctcctactggaaactttccggccagttactgaacgaagaaaacgccgaaagggacttggaaagtgttgctggtgagaaacagggtgactctgcaaacaaggactctgttaaggtgtacgaggagaagattctcgtcattatggccggagatgacaaacccacattcttggccaccccgaaagcctcctctgttactcgctgtgttcccaaccattttgaggaaaacctcgaaaaccatgtgacttctgagaaattagagaaaaaccctgttcaacaacctacgtctccgcaaccacaagaaacaacgcaacaacagagcctgccacgacaataa

SEQ ID NO: 959 - DNA, 537 bp, Glycine max var. Williams 82
atggctggttcctctgcttctcttttgttccttttccttctctttggattctcagcagctaaggagctattggttggaggcaaaatagatgcttggaagattccatcttctgaatcagataccctcaatcaatgggctgaaaggtctcgtttcagagtgggcgatcatctagtgtggaaatatgagagtgggaaggactcagtgttggaagtaacaagggaagattatgctaattgcagcacatccaaccccatcaaagagtacaatgatggaaacactaaggtgaagcttgaacatcctggtccattttacttcatcagtggatcaaaggggcactgtgagaaggggcaaaagttgattgtggtggtaatgtctccaaggcacacattcactgccattatttctccagcaccaacaccttctccagcagagttcgagggtcccgctgttgctcctactagcagtgccacaacgtttcaagttggccttctcactgctcttggagttttggctatttatgtgggttttctcatgtaa

SEQ ID NO: 960 - DNA, 708 bp, Glycine max var. Williams 82
cttgttcaacttggacgaagtagctatatagctcccataatggatcaagaggtagaaacgcttgaagcgaagctgcaacgtgtgaaggaggataatcgcactctaagagtgatgctggaaactctgagcagcaaatgcgagaagcttcaatctcatcttcaagaaatcaataatgaggaacaacaagtgggcacgaagtcagaccaaagtggatcagtattattagctagacccgagttttccatggcacaaaagccatcacaaatcttttttaaaacccaccccaaggacaatagtttgatggtaaaagatggttatcagtggaagaagtatggacagaagaaggttaccaaagacaatccttcgcctagagcttatttcaagtgctccctggctcctagctgccccgtcaagaaaagggtgcaaagaagcatacaggataagtctatccttgttgcaacttatgaaggaaagcacaaccatggtgtttttcacgatttactcaagccatcatcttctatacccgaaacctcaataatgattaataatttacctatgacaaacatgcctaacgacaaagatacggtgaacattgacctggctctatgtaattgggatcaaacagatataagactttgtgatgagatgttaagcaacagaacgaccgtggcagcaaaagcaaaattgaaggatatgcaagtcctctag

SEQ ID NO: 961 - DNA, 846 bp, Glycine max var. Williams 82
atggaaacactgagccacgagcctcttctctatgataactctgctggagagactccgccaagtccaagcacaccattgcagaattcacgggagaagaaacaactatctgttaaggaagaagaagaggaagaaaaggaggcaaaagcagatactttattggatctaaatgcccctggtggtgattctgctattgggtgcagtccagtgctgaatctgatcacgtgtttggacacagatttgtcaagcaccacatcagaaaaccaacatggctcagagccacgagtgttctcttgcaactattgtcagagaaagttctacagttcacaagctcttgggggacaccaaaacgcccacaagagagaaaggtcaattgcaaagagaggtcatcaaagatcaggatcacgtttgatggcctcagctacaacagctttgggaattccctttctccataatcaccttcaccaccactatgccactatggcttctctgcctctccatggtgcttctagtaataataaaccacttggaattcaggctcactccattattcacaagccttcttcttcaaattattctcatttttcattcaatgggtttggaaccacttttggacatcgtggttggtctagaccccttattgatcaacaacctggaatagggaagctaacgatggaaagttttcataaaacatcaagaggcaatgttgggaaattcgatgtggtgaaaacgaccaggcttaattcagcgaccaatgaagaaatcagtggatatatggttagtggtattagtcttttgaagactaatcaagaggaaatgaagcaccttgacttgtccctaaagctctaa

SEQ ID NO: 962 - DNA, 534 bp, Glycine max var. Williams 82
atggcttccaacaaactcctggccaccattttggtgctttctctcctctcttactcaacattcactcatgccaattgcccaccacccactccatctccaaagcccacaccaccaactccaataccaacaccacccacaccaaagcccacaccacccactccaaagcccacaccaccaactcctaagcccacaccacccacaccaaatcccacaccacctactccaaagcctagttgtcctcctccttctcctccttcaccaccatcaaacaaagcctcatgccccaaggacacattaaagctaggtgcttgtgctgatctcttaggacttgttaacattattgttggaactcctccttcgagccagtgttgtgcattgatcaagggtttggcggatttggaagctgcactttgcctatgcaccgcaattaagagcaatgtgcttggaatcaacttgaacgtacctgtgacgctcagcgtgatccttagtgcttgtcaaaagactgtccctcctggtttccaatgtccctcctga

SEQ ID NO: 963 - DNA, 940 bp, Glycine max var. Williams 82
attcaacatcaatcaaaattacacacatttagctacccttactttctatggcttccaacaaactcctggccaccattttggtgctttctctcctctcttactcaacattcactcatgccaattgcccaccacccactccatctccaaagcccacaccaccaactccaataccaacaccacccacaccaaagcccacaccacccactccaaagcccacaccaccaactcctaagcccacaccacccacaccaaatcccacaccacctactccaaagcctagttgtcctcctccttctcctccttcaccaccatcaaacaaagcctcatgccccaaggacacattaaagctaggtgcttgtgctgatctcttaggacttgttaacattattgttggaactcctccttcgagccagtgttgtgcattgatcaagggtttggcggatttggaagctgcactttgcctatgcaccgcaattaagagcaatgtgcttggaatcaacttgaacgtacctgtgacgctcagcgtgatccttagtgcttgtcaaaagactgtccctcctggtttccaatgtccctcctgagataatcaaattaggttcatgagatatctctcgtcatcagagaaatgtttagatatgcacttaacatgaaattgattgactgcctatgtaagcatttctttggcaatttgcagagtgttatatatgtttttttttatgtattactgtagttgttgtttttttgttgggggtttatatcgttgttaatgctagtgcacgtacatgttctaaataatgttgtattgttttgcttcgttaaattatgaattgggcaagcttgtttgccttaatttgtcttctagcttgtatgtatcatgaaatattgtctaattttatcattatgtccatattcgtggtgaaaagttgtttctatttttttt

SEQ ID NO: 964 - DNA, 516 bp, Glycine max var. Williams 82
atgtgcatggtggaatttggaaactatgaagggaaaatgagcagaccaggagattggaactgcaggacatgcaaccacctgaacttccagagaagagagtcgtgccagcgatgcggggagcctaggagtggtggcggcggcgactacggcggaggcttcggtggtggcagaggctcttcctcctttggcttcaccactggcccggatgttcgccccggtgactggtactgcaccgtcggaaactgtggagcccacaacttcgccagccgctccagctgcttcaagtgcggtgcccccaaggaggactcctccgccggaccattcgacgccgacatgcctcgaatgagaccatacggcttcggcggcggctcctccgcccgtcctggctggaagtccggcgactggatatgcaccaggtctggatgcaacgagcataacttcgccaatagaatggagtgttaccgatgcaatgcaccgagggactctagtagtgccaggtctccctattcatcgtag

SEQ ID NO: 965 - DNA, 453 bp, Glycine max var. Williams 82
atgaggaccacttgcttactaagccttccccctcttacttcaaaccaaccctccaacgcttctttcaaccccgcaaagccacctcaactttcatcggtgaaaaacgaaacatgttggaagaggcaatgcgttatgatgggagtggcatccataattggactagaaatgtgcaatttagtggcactggcccacgaagcaattgaaatcacaactatgccaattggtaaccaagtagtatcaaatagcaattcttatggtggcgccaaatggagccagaaaagaacgtgctcaccttggcaaggcaactcgctcgaaaccatcatgccggagaaccttccccggccgtcggcacggcggcgatacgaggctgttcgttcctccaccaagactgtgccaccgtcctcagccccgatcatagtccaaagcaacaagggcagctgcttctccatgtga

SEQ ID NO: 966 - DNA, 815 bp, Glycine max var. Williams 82
acgggtccaacctataactctaaccattttctcctatttactccttttacatttcaagcttttctgcttcctcatagtatctctctctatattccttcctttagttctaagtcgagagactttataatttaagtaagagggtgttcgtggaaggtttttaattgtctcaactctcaccatgaggaccacttgcttactaagccttccccctcttacttcaaaccaaccctccaacgcttctttcaaccccgcaaagccacctcaactttcatcggtgaaaaacgaaacatgttggaagaggcaatgcgttatgatgggagtggcatccataattggactagaaatgtgcaatttagtggcactggcccacgaagcaattgaaatcacaactatgccaattggtaaccaagtagtatcaaatagcaattcttatggtggcgccaaatggagccagaaaagaacgtgctcaccttggcaaggcaactcgctcgaaaccatcatgccggagaaccttccccggccgtcggcacggcggcgatacgaggctgttcgttcctccaccaagactgtgccaccgtcctcagccccgatcatagtccaaagcaacaagggcagctgcttctccatgtgaaaaatacgcaatcaaatcaattacttgtacataactattgttaacttaattgcttgcccttttacacaaatttaatttcataatcatattgatatgtcacgttttttttttgttttttttcatttatgaaaactccaaaaatatctaacgaattattgtatgtaatgaatagtagtactcgatt

SEQ ID NO: 967 - DNA, 2358 bp, Glycine max var. Williams 82
atgtggctgtcaaagcatcactcagagaagaaggatggtgtgaatggattagtagcagtggcaattgataaagaaaaagggggccaaaatgcactaaaatgggcagttgacaatctcctcacaagaagttcaactgtaattctcatccatgtcaagcttctcgcgccaactctatctccgtcaccttctcttttcaccccaaggataagtgctctccttggcgatgatacttcactggtatctaaagaaccagaaggcaataacaaaaacgttttcctcccatatcgtgtcttctgtacacggaaagatatacaatgcaaggacgttctactagaagattcagatatatccaaagcactaattgaatatgcttcacaggcgggaattgagcatctggttcttggctcttcaacaaaaactagcttgctcaaaagattcaaggtatcagatattccaggagcagtttcaaaaggggcaccagatttctgtacagtctatgttattgctaaaggaaagattcaaacagtgcgatctgcttctcgacctgcgccggccattgtccctaacctgctcagtcaagcaagtgtcaggacagaccattcagacccaaatgtgccattgactcaaagcataaaagaacaagaaagacattcctttgatgctgcagcaccgcgtagatcactggatgaatcagaaccattcaggtcaccattcacttggaaaggttacaatggaagacaatatggggacactcccaagccagataaggacatatcctttgtaagtaccggaagaaaaagcatagaaaacttgttcccttcgttgaactcagattcaggattttccaaccatcgactatcattgggctcagacatagatggaagcttcagcttagagtcaatgcatgatggaaggaagtctacggaaactggcactcctcctgaattcccatccctctcatttgagagtgaccagcattcatcttctacatcacaagccgtggatgacatggaggctgaaatgaggagattgaagttggaactgaagcaaaccatggaactgtataacacagcctgtaaagaagcagtcacagcacaacagaaggcagtggaacttcagaagtggaaactagaagaagagaggagattggaagaggcaaggcttgctgaggaaacagcattggcgattgccgaaaaggagagagcaaagtctaaagcagccattgaggctgctgaagcacaaaagaggattgcagaactggaagcacagaagagactcaatgcagaaatgaaagcacttagagaatcagaagagaaaaaaaaattgcttgatgctttggtaaatgtagatgtgaggtatagaaggtacacaatcgaggagattgaagctgcaacagatttttttgcagaatccctgaaaattggagaagggggatatggtccagtttttaagtgccttttggatcacacacctgttgcagtcaaggttctacgccctgatgcacaacaaggaagatcacagtttcaacgagaggttgaggtgttgagctgcatacggcatccaaacatggttctcctcctaggtgcgtgtccagaatacgggtgtctagtgtatgagtacatggcaaatggaagcttggatgattgcctctttcgaaaaggcagcactcccccacttccttggcagctaaggttcaaaatagcagctgaaataggcacaggcttgctgttcctgcaccagacaaaaccagaacctctggtgcacagagacttgaaaccagccaacatcttgctagacagaaactatgtggccaaaatcagtgacgtaggtttggccaggctagttccaccgtctgtggcggacagtgtcacgcaatatcacatgacatccacagcaggaaccttctgctacatagatcctgagtatcagcagacaggtatgttaggggtgaagtcagacatatactcccttgggatcatttttttgcaaattttgacagcaaaatcaccaatgggtttgacccatcatgttgaaagggccatagagaatggaatttttactgagatgttggatccatcagtgcttgattggccagtggaggatgccttgaagcttgctaagatgggactgcagtgtgccgaattaaggcgcagagacagacctgatcttggcaaggttatcctaccagaactcaacaggctaagagaccttgctgaagataataatctaatttcagttatgggtaactctatggatgcccaccttgagaaacaactttctgtgcatttggatggaggtgtccatcatttactcggtcgggggaaattagagcaaacaattcagtcggttttttactag

SEQ ID NO: 968 - DNA, 1980 bp, Glycine max var. Williams 82
atgcacataatgcctatcatttctcaattttcctcactctctatacttcctaacccaccaaccaaaacccgtttcagttttcatcttcaaagtattatgccacataaaagagaatatttctgtcttttcatgctcttcacttgttttttgccatcattggccgacaatgctcaagttctgatgaacttcaaaagtaacttgtccaatgctgatgctttaaagaactggggggatccatcgactggtctgtgcagctggactggtatattatgcttcgatcaaaaatttcatggcttgagattagagaatatgggactaagtggcactattgacgtagacacgctgcttgagttgtccaatttgaatagttttagtgtcataaacaacaactttgagggtccaatgcctgcattcaagaagcttgtgagtttaagggcattgtttctgtccaataacaagttctctggtgaaattccggatgatgcttttgaaggcatgaagcgtctcaggaaagtatttttggctgaaaatgggttcacgggtcatattcctgcatcccttgttaaattgcctaaactttatgatgtggacatacatggaaatagctttaatggcaatataccagaatttcaacagagggatttcagagtgtttaatttgtctcacaaccacttagagggtccaataccagaaagcttaagcaacagggatccaagctcatttgctggcaatcaaggtctatgtgggaaacctctaaccccttgcgtcggaagccctccctcaccttctgatcaaaacccaatttcaactctttcacatcaagaaaaaaaacagaaaaaaaaccgcatccttttaatcgttatcgtagtggtggcggtgattgtgttggctttaatactagcacttgtgttcatccgttaccgtcgaaagaaagccgtgttggtcacggatgcacaaccccagaacgttatgagtccagtttctagtgagtccaaatccattgtaatggcagccgagtccaagaaaagtgaagatggaagtttgagcttcgtgaggaacgaaagggaggagtttgacttgcaagacttgcttagagcctcagctgaggttctggggagtggcagttttggatccacgtacaaggccatgcttctgaacggaccagctgtggtggtgaagagattcaagcacatgaacaacgttggaaagaaagagttctttgagcacatgagaaggcttggaaggttgtcacaccccaacctagttcctcttgttgcattttactatggaagagaagagaagcttttggtttatgactttgctgaaaatggcagtttggctagtcatcttcatggcagaggtggttgtgtgttggactggggaagtcgtttgaggatcataaaaggagtggcaaggggattaggatacctctacagagagttcccggagcaagacttagcgcacggtcatctaaaatcgtcgaacgtagtgttggaccattcattcgaggctcgtttggcggagtacgggctggcggcagtggtggacaagaggcacgcgcagcagttcatggtggcgtacaagtctccggaggtgaggcagttggagaggcccagcgagaagagtgatgtttggtgtttggggattctgatattggagcttttgacggggaagtttccagctaattatctgaggcacgggaagggtgcgagcgaggatttggcgtcgtgggttgagtcgatagtgagggaagggtggagcggggaggtgcttgataaggagattcctgggagagggagtggagagggtgagatgctgaagctgttgaggattgggatggggtgctgtgaatggactttggagactaggtgggattggagggaggctgtggccaagattgaggacttgaaggagactgataatggaactcaaggggatcattcctactcatcggatcacttgtctatctctctcaattaa

SEQ ID NO: 969 - DNA, 348 bp, Glycine max var. Williams 82
atggatgtgaagaagtactggttcggttcaagaagtcaaaggacacaaaacataaggttaggtcgaaactacacaaaaccccactataggagctattctccaagcagctgtgatggcacaaaaacaacagtgtggcagatgctttggagaaagctgaaaagatcttcagataagaagaaagtgttcagttctcacactacaatggagggtgtctatgatcaagaaacatactcaatgaacttcgatcaaggaacgggatggatggagccagacaatcttcctcgttccttctcagctcggtttgctgatccatctaggatcttaccaccaaaacatttattgagttga

SEQ ID NO: 970 - DNA, 237 bp, Glycine max var. Williams 82
atgaaaaacagtaaaaccttcggcttgccaagtttcaggtcctcgatatatggtttccatttacaccctttagctgaaatgaaatgcttctttgctcagttcttccccgatttgatatatgccatcctatttggggtgataacttcccttgtgactggttctgctaattgctggagtccagacaaaatttactggttgataatttattgcaatggttggaagttcaaccaaatttaa

SEQ ID NO: 971 - DNA, 1242 bp, Glycine max var. Williams 82
atgagcccaagcgcctctaactctatatgctcagttcatcagctggagaacatagatgagaatgctcctgcagattggcctgcatcatcctgtccccctcctgatactccaactgaatctatggagttccttgcgagatcatggagtctttcagccatggaactctccaaagcactgcacagcaccaacgttacaatctccaccggtatagagatgccactttcgtgcccttcaggccaccaatttgataccaagagttccactgcttccaaagctttatctaacgggtgtttccctccatttttgccaaaagacagtaatgaaaagaaggatttacttttactccaccaagcactcaatccagaattcctttccagtcaaaacttgctcagaaatgggctttacaggagcttgctaagaggtaggacaatgggtaggtggttgaaagatcaaaaggagaggaaaaagcaggaaattagaacccataatgctcatttacacgctgcagtatctgtggctggtgttgctgctgctattgctgcagttgcagcttcaacagcatcacctgaaatgccttatgcaaaccaaaagaaccctcccccagcttcttctgcaattgcatctgcagcagctttagtagcctcacactgcattgagattgcagaagatatgggagctgagcatgaccaaatattaacagtagtcaactctgccattaatgcaaaaaccaatggagatattatgactttaacagccggagcagccacagccttgcgaggagcggctactctaaaggcaaggctgcagaaggggcctggagctacttcaattcctctagttgaggaaaagtgtgatgaaaggaaagaagcaaacatcttgacagcactggattatgtctttagaggtggagaacttctcaaacgtacaagaaaaggagctcttcactggaagcaagtgtctttcaatataaattcaaatttgcaggttgtagtcaaaatgaaaagcaagcatatggcaggaacattcacgaaaaagaagaaatatatagtcaccggagtttgcaatgatatcccagcttggcccggaagggagaaggaagacatcagtgaaaagagggcatattttggaataaaaacaacagacaggacaatagaatttgaatgtggaagtaaaggagacaaacagttctggcttgaggggatccagtatatgttgaattgccgtgtcaaagtaacattataa

SEQ ID NO: 972 - DNA, 1041 bp, Glycine max var. Williams 82
atgtcatcatccttaatgttaccagctgcttcaatgctgagaccatgtaccacttcatcatcatcatgtacttcatcaagaagacttgctctctttcaccttgtctccactggtagcattgctctcccacaagctcagttatttggtgcaaaaggaccagagttgttaagagtagtagaggcttctgctgcagaaaaactagcccaaccagagaaagatttgtttgactgggtcaaaaatgacaacagaaggtttctccatgttgtgtaccgtgttggagacttggagaagactataaagttttacactgaatgccttggcatgaagctattgagacaacgtgatatacctgaagacagatattctaatgcttttcttggatatgggcctgaagattccaattttacagttgaacttacctacaattatggagtggataactatgacattggaagtggctttggtcattttggtgttgcagttgaagatatttacaaaagagtagatctagtaaaggcaaaaggaggaaaggttacaagggaacccgggcctgttaaagatggcagtgcagttattgctttcattgaagatcctgatggttataagtttgaacttttggagagaagacctacatctgaacccctatgccaagtgatgcttcgagtaggtgatcttgatcgtgccatagccttttatgaaaaagctgttggaatgaaacttctccgcaagagggacaaccccgagcagaagtacacagtagcttttatgggctatggtcctgaagacaagaatactgttctagaactgacatataactatggtgtcactaattatgacaaaggaaatggttatgcacagattgccataggcacaaatgatgtctataagactgcagaagcaatcaaattatgtggagggaagattatccgtgaacctgggcccttgccaggtatcaacaccaagattgtagcttgcttagaccctgatggttggaaattggcatttgttgataatgttgattttctgaaggaattagagtga

SEQ ID NO: 973 - DNA, 741 bp, Glycine max var. Williams 82
atggccaaaatcgcacttggaagcacccgagaggccactcagccagactgcattcaggccctcatcgttgaattcatagccaccttcctctttgtctttgttggcgttggttcttccatggtcgttgacaagcttggtggggatgcactagtgggattgtttgctgtggccgtggcacatgcacttgtggtggctgtaatgatctccgccgcccacatttccggtggccacctcaaccccgccgtcacccttggcctcctcgccggtggtcacatcactatctttcgttccatgctctattggattgatcaattagtagcagccgcaacagcttcttatctcctttactacctctcaggaggacaggcaactccagttcatacgctggccagtggagtggggtatggtcaaggagtagtttgggagattgtgttgacgttttctttgttgttcactgtgtatgcgaccatggtggatcccaagaagggagcacttgctgggcttgggccaacgctggttgggtttgtggttggggccaacatcctcgcaggtggggcttactctgctgcttctatgaacccagcaaggtcttttgggcctgccttggtcgctggaaactggaccgatcattgggtttactgggttgggcctctcattggtggtggccttgctggttacatctatgagactttcttcattgaccgatctcatgttccacttcctcgtgatgaagaaaactaa

SEQ ID NO: 974 - DNA, 1132 bp, Glycine max var. Williams 82
tgagatgtgaaaggtgattatgaatatgcttttttctttgcattattgcatataaattggcaacatatggtaccacttatgttcaatgtgggaaccaagtaattttggtcattgattaattctgcaattgagcagaggagccatggccaaaatcgcacttggaagcacccgagaggccactcagccagactgcattcaggccctcatcgttgaattcatagccaccttcctctttgtctttgttggcgttggttcttccatggtcgttgacaagcttggtggggatgcactagtgggattgtttgctgtggccgtggcacatgcacttgtggtggctgtaatgatctccgccgcccacatttccggtggccacctcaaccccgccgtcacccttggcctcctcgccggtggtcacatcactatctttcgttccatgctctattggattgatcaattagtagcagccgcaacagcttcttatctcctttactacctctcaggaggacaggcaactccagttcatacgctggccagtggagtggggtatggtcaaggagtagtttgggagattgtgttgacgttttctttgttgttcactgtgtatgcgaccatggtggatcccaagaagggagcacttgctgggcttgggccaacgctggttgggtttgtggttggggccaacatcctcgcaggtggggcttactctgctgcttctatgaacccagcaaggtcttttgggcctgccttggtcgctggaaactggaccgatcattgggtttactgggttgggcctctcattggtggtggccttgctggttacatctatgagactttcttcattgaccgatctcatgttccacttcctcgtgatgaagaaaactaaacaataggattgacaacttgcactttcatcccttcttaaaaaatgctgcattattgtagttaatttaatctaataataatctttttttttgcgtgttatgtatgtttgaaaaggtctatttatgtataatatatcgttaaatgatcttccccaaaataagatcaacgatttagttgagatctggcaccctgtgtagactttgtggacaggaatgaatgaataaatatatatttcaatggcttctgcttt

SEQ ID NO: 975 - DNA, 252 bp, Glycine max var. Williams 82
atgttattttactttgtaattatttatactagattttcaagacattcaggctttcaatgcttccatttcctctgcacctactccatcgatttcacaacagtgtcagcagaaatgatgctaagcccggctcgtatttcctttccttatgatcttttgccccaacaatccattctcatactgagactcatacctctctcctttatattttatcaaccatggttttcaaaactacagatcaagagagtatattag

SEQ ID NO: 976 - DNA, 1359 bp, Glycine max var. Williams 82
atgagagagtgcatttcgatccacattggccaggccggtatccaggttggaaacgcctgctgggaactctattgccttgaacacggcattcagcccgatggacagatgccgagtgacaagaccgttggcggaggagacgacgccttcaacacatttttcagcgagaccggcgccggaaagcacgtgccccgcgccgtcttcgtggatcttgaacccaccgtgatcgacgaagtccgaaccggtgcgtaccggcagctcttccacccggagcagctgatcagcggcaaggaagacgccgccaacaacttcgcgcgtggccactacaccatcgggaaggagatcgtcgatctctgcctcgacaggatccgaaagctcgccgacaactgcaccggtctccagggtttcctcgtcttcaacgccgtcggtggcggcaccggttctggcttgggctcgcttctcttggagcgtctctccgttgactatggaaaaaagtcaaagctcggtttcaccgtttatccatcccctcaggtttcgacctcggtcgtggaaccctacaacagcgtcctttcaacgcattctctcctcgaacacaccgatgttgctgtgcttctcgacaacgaggcaatctacgacatttgcaggagatctcttgacatcgaacgccctacctacaccaacctgaaccgtctcgtttcccaggtgatatcatccctcactgcctctttgaggtttgatggagcactgaatgttgatgtgactgagtttcaaaccaacttggttccttacccaaggatccatttcatgctttcctcgtatgcccctgttatctctgccgagaaagcataccatgagcagctttccgttgctgagatcaccaacagtgccttcgagccatcctccatgatggcaaagtgtgaccctcgccacggcaagtacatggcgtgttgtttgatgtaccggggcgatgtcgtgcccaaggatgtgaatgctgctgtggccaccatcaagaccaagagaaccatccagtttgtggattggtgccccactgggttcaagtgtggtataaactatcagcctcctactgttgttcctggaggtgaccttgccaaggtgcagagggctgtgtgcatgatttcgaactccactagtgtggctgaagtgttctccaggattgatcataagtttgacctcatgtatgcgaagagggccttcgtgcactggtatgtgggtgaaggtatggaagagggtgagttctcagaggctcgtgaggaccttgctgctcttgagaaggattatgaggaggttggtgccgagtctggtgatggagatgatgatggtgaaggagatgatgattattag

SEQ ID NO: 977 - DNA, 252 bp, Glycine max var. Williams 82
atggaaaaaagttcatctcctggaagcaaaacaaacggagggtggctttcatgttgggggcgtctcaagttgaagcttccatgggcgaagagaacaagcacttataaatccattggtggttttaaatatgaccctttaagctatgctcaaaactttgacgagggatgggtagaggatgatgaagaatctttacatcgcgggttctctgctagatatgcagcaccctcctcacataaattgttcaagcaatga

SEQ ID NO: 978 - DNA, 775 bp, Glycine max var. Williams 82
cacgaataatgttctttatactttcagattcatgagcaaattgcccccccccacactcggttttactaagagaatgaaaatctaagtgagccatttatattctgagattctcttcacatctgcacacagtcaatataaaaaggacaaaaatagattcttccatacatattatctagctactaccaacccaaaaagggttttttcttaagttatacattattctctaccacacacttaaaattcttagcaaataaattgagaattaagataacacccccaccaggcacaaacactagaagctagattaaagtttcgttccatgaatgaagctatctcgaagtcatggaaaaaagttcatctcctggaagcaaaacaaacggagggtggctttcatgttgggggcgtctcaagttgaagcttccatgggcgaagagaacaagcacttataaatccattggtggttttaaatatgaccctttaagctatgctcaaaactttgacgagggatgggtagaggatgatgaagaatctttacatcgcgggttctctgctagatatgcagcaccctcctcacataaattgttcaagcaatgataaggttcaacgtttaaggtcagctaatatatatgtacaaacaaaaaaaaaaccattcgtacgtatatttcttggctcattttactttaccttctagttatattgattgtataaaatataaattattacttatgtttatgcagcaaataagtatatttataatcagtttgtacactaatag

SEQ ID NO: 979 - DNA, 508 bp, Glycine max var. Williams 82
cgtttgattcaaaatgagacaccactgtctccttctcctctccctcgtcttggtctcctacgctgcccggcggtcggaatctgcgctgggcggctggagccccatcaaggacgtgaacgacagccacgtggcggagatcgcgaactacgcggtgagcgagtacgacaagcgttctggggcaaagctgacgctggtcaaggtatcaaagggcgagactcaggtcgtggccggcaccaactaccgcctggtcctcaaggtcaagaatggatccaccacggccagttaccaagccaccgtgctggagaagccttggctccatttcaggaatctcacttccttcaaaccccttcgttcttagatccatactttctctctctctctctttctctgttatcaactacacattctcatgtgtgtcttgtcctgcttttctcaataaaattggggaccccgaagaagtggtgttttctgatatgaatttgggccagagcctgggcaattgcccagg

SEQ ID NO: 980 - DNA, 1512 bp, Glycine max var. Williams 82
atggggagcttgaaaggagacagtggacatgccaatggcgaaaatcttaccgaagctcttttgccaacacgagatgcacaacaacaacatcaaacagacgacgaggaacaaagatttggtgacaagctctggcttgaaaccaggaagttatggctcattgtggggccctctatattcagccgcctcgcgtcgttcaccatgaatgttgtcacccaagccttcgccggtcacttgggtgatgtcgaactcgctgccatttctatcgccaacaacgttcttgttggcttcaatttcggcctccttttggggatggcgagcgcgttggagacactgtgcgggcaagcgtttggggcgaagagataccacttgttggggatatacatgcagaggtcatggattgttctgttcatgtgctgtttcctgctgttgccgttttatgtttttgcaacgccgcttctgaaattcctaggacagccagatgacgtggcagagtggagcggggtggtggcagtgtggctcattcccctgcacttcagtttcgcgtttcagtttcctatgcagagattcctacagtgccagctcaagacagcagttattgcttgggtttctctgctgggtttggtggttaatgtggtcacaagctggctcttcatttatgtctgggattttggactttatggcgcagctatttctttggacatttcttggtgggttttggtttttggcatgtatgcttacattgcctatggtggctgccctttgacttggaatggtttctcccttgaagctttttctggactctgggaattcctcacactctcttccgcttctggggtcatgttatgcttagagaactggtactacaagatattgctacttatgactggccagttggagaatgccactatcgctgtcgatgccttgtctgtatgtatgaccatcaacgggtgggaaatgatgattcccctggctttcttcgcgggtactggggtaagggtggcgaacgagttaggcgcaggaaatggcaaagcagcaaaatttgcaacgcaagtatcagtggcacaatcaacaatcattgggcttatattttgcgttctgataatgatattccatgagcatatagcatacatattcaccaccagcacttccgtcctacaagccgttgacaacatgtcattactcttagctatcaccattcttctcaacagtgtacaacccgttttgtcaggagtggctgttggatccggatggcaagcatacgttgcatatataaatataggatgctactaccttatcgggttcccactcggaattataatgggatgggtcttcaaaagtggtgtaattggcatttgggggggcatgatttttggtggcacagcaattcaaacgctgatactgatcatagtaacgatacgatgtgattgggaaaaggaggaggagaaagcttgctttcgtgtaagtaagtggtcaaaatctaactccaatggcaatctggaagcctccaattaa

SEQ ID NO: 981 - DNA, 618 bp, Glycine max var. Williams 82
atggccaacaacagcgaagaacaacagaacaactcaacaagatcatcgatcatggagtggaagcagatgcatccacttcaccaaatcgcagaaacacccacccacaagctcctcctgaagcaatggctgaaggaggaagaactcatcaacagccgcatagcgttgaaagagacccaaatagattcaacccgcaaagagatcaccaccctctacatcttcttcttcctcttccactccaccaccctcatgctcctcttcaactcctcgtcaccctcttcctgtcacagatcgtgggtcccttcgctgtgctctctgttattctcgctgggcctaatatgggccttgcgttacaagagcgacgtggaggcccacgtggagaagatgctgcagcgggagaaggaggacaaagggttgctggggaagtgcgtggaggagttgaagaagaaagggttggagtttgatttgctgaaggaggttgatgcgttgaggagggccaagagtttgagggtggagaacaaagaggttaggaagtggtcttccagggactttgtttctttgttcttcttctctatggcttgcttctctcttgctctcatgagggtcatcttgtgcacttag

SEQ ID NO: 982 - DNA, 600 bp, Glycine max var. Williams 82
atgactcacattccaaacgacaatgtagccttcaacattattatggcaagccttagaattagaccaccttcgaaggacaaagacatcattgggaggttcatgcccaataatggttgctgcaagaagcaccccaaccaccgccaatctcctggtgtctgttctctttgtttgagacacaagctttctcaactatcctcagcttctatgcgtaaaacaacattgatttcttcgtgccgttcgtcttccacctcttcttctttgtcctcctattgctcctcttcctcctcttcttgcgcctctcctacgcttcccttcccttttcacaaagattctaagagtggctccaattctgtttccatctttttattgagcgcaaagcatggtggagtactcaaaactgggtcaatgagcgttcttgcaacaaggagaagaacaaaaggtggtggtggtggtgatggtgatggtgatgatcgtaataagaagaaaactgggttttggtccaagttgcttcatcccaaaaccaaaagcaagagaatggatgagatcaaaggcactaagctggttcattctaggtctctaatagaaactagacatagctag

SEQ ID NO: 983 - DNA, 1524 bp, Glycine max var. Williams 82
atggccggagggggattagccgtcgttgatgcaccgccctgtggcttcgacggcaagataacactctcagttgtcatcacttgcatcgttgctgcatccagtggactcattttcggatatgacatcggtgtttcaggaggtgtcacaacgatggtaccgtttcttgaaaaattcttcccatcaatactgagaaatggagctggtgcgaagaacatgtactgtgtgtatgacagccaattgttgacgttattcacgtcttctttgtaccttgctgggttagtgtcatctcttgcggctagccgagtcacggcggcgttgggtcggagaaacaccatcatgttgggcggtgtcattttttttgctggtggcgctcttaatggaggtgcggaaaatattgctatgctcattttgggtcgtatccttctgggccttggggtcggtttcactaatcaagctgcgccactatacctctctgaaatcgcaccaccaaaatggcgaggggctttcaacacaggcttccaatttttcctaggagttggagtgcttgccgccggctgcataaactacgccaccgcgaagcacccgtgggggtggcgaatctcccttggcctcgccgtggtgcccgcaaccgttatgacagttggcgcattcctcataaccgacacccccagcagcttggttgagcgcgggaaaatagaccaagccagaaacgccttgagcaaagtcagagggtccaacatcgacgttgaacccgagttggaagagctaattaattggtcgcataatgcgaaatctatggtgcaggagtccttcatgaccatatttgagagacgctatcgaccccacttggtcatggcaattgctatcccactttttcagcagcttacgggcatcaacatcgtcgcattctattcacctaacctctttcagtctgtgggtatgggacacgatgctgctttactttcaactgtaatacttggaattgtcaaccttgcttctctcatcttatccactgctgttgttgatcgctttggtcgaaggttcttgttcattactggtggcattctcatgcttttctgtcagattgcggtgtctgctttgctagctatggtgactggtgttcatggtacaaaggacatatcaaagggtaacgcaatgttggtattggtcctactgtgcttttatgatgcaggttttggttggtcatggggccctctcacctggctaattccaagtgaaattttccccttgaaaatcagaaccaccgggcaaagcatagcagttggggtgcagtttatagcactatttgcgttatcccagacatttttgacaatgctgtgccacttcaagttcggcgccttcttgttctatactgtttggattgcagtgatgactctctttattatgtttttcttgcccgagacgaaaggaattccattggagtcaatgtacaccatatggggcaaacactggttttgggggaggtttgttggaggagcagttaagcaagataatcttccatga

SEQ ID NO: 984 - DNA, 711 bp, Glycine max var. Williams 82
atgcactacctcaagcaaggagttgttgttaaggatccatctgctccccatggagttcgacttttgatcaaggactatccttatgcttctgatgggctagagatatgggatgctatcaagtcttgggtggaagaatatgtctcattctactacaagttagatgaggaacttcaaaaagaccccgagctccaagcttggtggaaagaacttgtagaggtgggtcatggggatttgaaggataagccatggtggcaaaagatgcaaactcgtgaagagttggttgaagcttacgctaccctcatatggattgcttcagctcttcatgttgttgttaactttggacagtatccaccatatggaggtttaatcctgaataggccaactattagcaggagattcatgcctgagaaagggtctcctaaatatgatgcgttggctaagaaccatgagaaggagtttttgaagactattactggcaagaaagagaccctcattgaccttacaattatagaaattttatcaaggcacgcatctgatgagttctaccttgggcagagagatggtggtgactactggacttctaatgccggtccattaaagacctttaagagaaaccactatgggccggctaaaatgccttacactttgctctatccttctagtgaggagggattgactttcagaggaattcccaacagtatctctatctaa

SEQ ID NO: 985 - DNA, 492 bp, Glycine max var. Williams 82
atggcagcagcctcagcctcatccatgatatcaacaccagccttatctccaaccatccaaaagcaccatcatttgaagccatccaacgtgtgcttccaaggtcttagacccctcgcaaggttcaccaaagcctcatcaaccaaagtgagcaccaccaccaaaagggttattccaaagggtggtgttagagctgaactcaactcagcccttgtgataagcctcagcactggcctctccctcttcttgggaaggtttgtgttcttcaacttccaaagggagaacgtggcaaagcaagtgcctgagcagaacggcctcacacactttgaggctggtgatacacgtgccaaggagtatgtcagcctcctcaaatccaatgaccctgttggattcaacattgttgatgtcttggcttggggctccattggccatgttgttgcttactacatcttggccaccactagcaatggctatgaccctgcattctttggctga

SEQ ID NO: 986 - DNA, 1806 bp, Glycine max var. Williams 82
atggcttcaatctctcctatatccttcgtgagtgcaatcaataatgtctcttccaactcatccaattccccttcttccttgcatcatcccttttcacaaattcaatccgctaaatatcgaaaaccaaaacgccatcatcatattcctagagtgacatgcagtgacaaccaaaaaccaaacacatctggagaactagtactcccacataggaggaacattctacttggcctaggagggctttgtggtgctgctgctactcttaacaacatcccttttgccaatgctgccccaatacttggtccagacctaaccacatgtgttcaagcagaactacccgaaggtgtagaacccaccaattgttgtcccccaatttccacaaacatcatagatttcaagttccctccctccaaccaacccttgcgtgtacgatccgctgctcatctggtcaacaaagactatctagctaaatacgagaaagccgttaacctgatgaaaaatctcccgtcagatgatccacgtagtttcgcgcaacaagccaaagttcattgtgcttattgcgacggtggatatcaccaactaggcttccctgaccttgatctcgaagtgcacttctcttggctcttctttccttaccacagatggtatctctatttccatgaaaggatattggcgagcttgatcaatgatccaacctttgctcttccattttggaactgggatgctcctgggggcatgcaacttccttccatgtacgcagatcccaaatcacccctttatgattctctacgcaatgccaaccatcaaccaccaacacttgtaaaccttgactttactatcgaggatcctaatgcagaggcaaatatctccaccaacctcaccacaatgtataggcagcttgtgtctaacgcaaagactccaacattgttcttcggaaatccttatcgtgctggggatcagcctaaccctggtggtggctccgtagagagcactccacatggtcctgttcatgcatggaccggtgatatcaaccaccctacaatggaggacatggggaatttatatgcagctgcaagagaccccattttctattgccaccattccaatgttgataggatgtggtccatatggaaaacacttggtgggaaaagaagggatttaacagacccggattggttagaatccgcgtttctcttctacgatgagaataagaaccttgtgcgtgtgaagactaaggattgtcttgacacgagaaagttagggtatgtttaccaagatgttgacattccatggttaaaatctaagcctacgccattaaggtcaagggctcaaaaggtagaactgacaccactttttggtggtgttgctgcagcacatgctgctgagacttcaaggaatgtgaagttcccattggtgttggattcagttgtgagtacagtggtgaagaggccaaagaagtctaggagcaaaaaggagaaggaagagaaggaggagattctggtggttgaagggattgagtttgagagcagcacaggtgtgaagtttgatgtgtttattaatgatgaagatgataagttggtcaagccagataatacggagtttgcaggaagctttgtgagtgtgcctcattcgcatgagcatcacaaaaacaacaagaagattgttacttgtttgaggttgggactaacggatttgttggaagaattgggagcagaagatgatgatagtgttctagtaacattggttcccaagtatgggaaagggcgagttaacatccgaggcatcaagatagattttgtttcagattga

SEQ ID NO: 987 - DNA, 966 bp, Glycine max var. Williams 82
atgatgatgatgatgagccgcagcggcgccaaccgggtagcgaacaccgcaatgtttgtggcgaagggtttaagcggcgaagttggtggtttaagagcattatatggcggtggtgtgaggagtgagagcactttggctttgtcagagaaggaaaagattgagaagaaggttggtttgtcttctgctggtgggaacaaagaagaaaaagtgatcgtgagttattggggcattcaaccctccaagatcacaaaaaaagatggcacagaatggaagtggaattgctttaggccatgggagacatacaaagcagatctttccattgatctggagaagcaccatgctccaaccacgtttctggacaaaatggctttttggactgtcaaggttctcagataccccaccgatgtgtttttccagaggcgatatggatgccgagcaatgatgctagaaacagtggctgcagtccctgggatggtagcaggcatgctacttcactgcaaatccctaagaagatttgagcacagtggtggttggatcaaagcactgctggaagaagcagagaacgagcgtatgcacctaatgaccttcatggaagtggcaaagccaaagtggtatgagcgtgcactagtgataactgtgcaaggtgttttcttcaatgcatacttcttggggtatttgttgtcacctaaattcgcacaccgcatggttggttacctggaggaggaagcaattcactcctacacagagttccttaaggagctggacaagggcaatatcgaaaatgtgccggctccagccattgccattgactactggcagctcccaccaggctccactttaagggatgttgtcatggttgtaagagctgatgaggcacaccatcgtgatgtcaaccactttgcatcggacattcactatcaagggcgagagttacgagaggctgctgctccaattggttatcactaa

SEQ ID NO: 988 - DNA, 2097 bp, Glycine max var. Williams 82
atgacaacagaagctgagactgagagggtggtggtgatccaggatgcatcaagagatgttaattcaaatgcaatcctaggggccctggaatggttttctgttaaagctggagatcagcttataattgttgctatccttgattggatgagcagtcctatgggttacatggtcagagttgattccagttcaatgatttcaacaaacaagaaaataattgaaaaaaggcttaccaaaaaaaaggaagaatatcttatgaaccagaacatccaggagatctccaactactgtaaattgaatgagattggattccaattagaagtgcttgtaggctctactgcagaggttgcttctaatgctgccaaggaatttcaggcgacaaggttgatactagttagacaaattcacaaagatatgaagcatttcgtgcgcaacctcccttgtggtatgtataggataacaagtgacaattcaattgagaggttgaaagatccaaaatcagcagtcagtaccaaaacatttgccctcaggcaagaaaatgtaagctataaagaaatgtttccaggaagtgaagaggaggaacgttctcttctgatgtccaggtcttcatctagtgatctgttgacatcaactggaatttcaagtcagtggagtacagaggtctccacttctagtttcggaagcttgcggtatggttgtcaataccaagagggaaagttttattcaaataaagaacaagaaacaacagggaatcaatcactgtttcacatttcggagaatgaagagacgagccaattacaagtaaataaaaaagagcagcatagtagaaataatgaaacatctcatatggaggaagaatttacaaatccactttgttctgtgtgcaaaaatagacgaccaaacattggattgaagagagatttcagttatgctgagctccatactgctacacaaggattttctccgaagaactttctgtcagaaggtggatttggatctgtctacaaaggactgctgaatggaatgaagattgctgttaagcaacataaatatgcaagcttccaaggagagaaggaatttaagtctgaagtgaatgtacttagcaaagcaagacatgagaatgtggttgtgctgctaggttcatgctcagaaaaaaataataggcttcttgtgtatgaatatgtctgcaatggctcacttgaccaacatctatcagaacactctcgatcacctcttagttgggaagataggatcaatgtagctattggagctgccaaaggcttactatacttgcacaagaacaacatgatacacagagatgtgagaccaaacaatatccttataacacatgattatcatccattgctgggagactttggattagcaagaaatcaaaatcaagactcgatacactcaacggaagttgttggaactttggggtatttggctccagaatatgcagaacttggcaaagtgtctaccaaaacagatgtatattcttttggggtggttctactgcaactaataacaggaatgagaactacagataaaagacttggaggaagaagtcttgtgggatgggcgaggccacttttaagagagaggaactatccagatttaattgatgaaaggatcattaactctcatgatgtccatcaactattttggatggttcgaatagcagagaaatgtctaagcagggagcctcagaggagactaaatatgattcaggttgttgatgctctaactgacatagtggagggcagaacatgtgacataatactaagggattactcccctgcaagatcagattcaacctatagtgcatcagactctgatgaatctgaagacgaaatgcaggaacccttgaggtttgaaagcgagttactaagtcacagttcagaatccatagaaagtaacaacataagtcagatgatgcacatgattgtaagacagccaccatcccctccaattcagagcatctcttcgtctagctcaagctcatataagcttcattatgagtcaactagtgatggtgaagcacacaatgaaggggaaatagaaatatcaaattccaattgggggttactcaattcttag

SEQ ID NO: 989 - DNA, 2097 bp, Glycine max var. Williams 82; identical to SEQ ID NO: 988

SEQ ID NO: 990 - DNA, 2016 bp, Glycine max var. Williams 82
atgttgatcatacacagcggtgattgcagcaaaagaagaatggtttatcaatggttttttattatcaaattcatgtgccttctttgcttcgttgctggtcagaacagtagcaatacacaaccacttgattatagatatgcttgtttggaccaaacttctgttcctccttctactacataccaaaccaatctcgacgatttgatctcttccctctcatctgattctgctaccagcaatggttttgggaatggaacttcaggtattgatgaaaacatggtttatggactctatctttgtcgtggcgatgtgaacaccagcctttgccactcatgtgttcaaaactctagcatattgctcaagcagcactgccccaacactgcctcagctattttgtggtaccccttttgtcttctgaggtactcaaaccagaatttctttggcaacctcaccttaacgcctaggattccgatgtttgacgccacgcaaaattttactagtgctggagagtttgacagtgatgccagggttttgatgaatggtttaatacaaatggggtcagaggaacccttgatgtttgggacacatatgttcaatataaatggcactcaaagaaggtatggttgggtacagtgcagcagagatattacaactgaggaatgcagaacatgtttgagcaatatgcttgaagatgttgagaattgctgtgaggagaagaaggtgtggcgtgtcttttctccaagttgtattgtgatgtatgaaactcagccattttttttgaatggaacttctgagccaacgcctcagcaagacgaagatggggataacagaaggtggttgattatagtaatcatttctgtatctggagttgtggtagtagctctattgtctatcagcacatactacttctggtgtttgaaatggaaaaaagacaaacaagctattcaagaggatggactaaattcaatgttttctcaagatcaaacggacaaggaggagagtatgaatgctgaccttcctatgatgcctctgagtactattctaaaaagtacaaataatttttctgatgagcataaactagggaaaggtggatttggccctgtctataagggagttttaccagatggaaggcaaattgctgttaaaaggctttcaaaaacttctgttcaaggtgtggaggaattcaaaaatgaagtaatattgatagcaaaattacagcatcgcaaccttgtgagactgttggcttgctgcattgagcaaaatgaaaagcttcttgtctatgaattcatgccaaattcaagccttgatttccacttatttgatatggagaagggtgaacatctggaatggaaaaaccgattaaacattattaatgggattgctaaagggcttctatatctacatgaagactctaggctaagggttattcacagagacctgaaagctagtaacattctattagatcatgaaatgaatccaaaaatttcagactttggattggcaagaacatttggaggagaccagaagcaggcaaatacaattagagttgtgggaacttatggatacatggctcctgagtatgctatggaaggcttgttttcagtaaagtcagatgttttcagctttggtgttcttttgttagagatcatcagtggaaaaaggagtagtaaattctatctgtcagaccaaggccaaagccttctcatatatgcatggaacctctggtgtgagaggaaaggtttggaattgatggatccaataatagaaaagtcatgcgtacgtagtgaagttctgaagtgtatgcacattggactattgtgtgtacaagaagatgcagcagatagaccaaaaatgtcaagtgttgttcatatgcttgcaagtgacacagtgagtctttccgtccccacacgccctgcattttctgttggaagagctgtcactgaacgcgagtgttcatcaaacacttctatgcattactctgtcaatgaagcaacagtctctgaagtgataccaaggtga

SEQ ID NO: 991 - DNA, 2010 bp, Glycine max var. Williams 82
atgggtgcaactgaagatcttgtgaacagcacacagggtgcagcagaatgtcaggaaaaccgcaccacaggtccttcagaaaatccaataaaggacaacaccagtagtacttcagaaaatcttgtacagtacaaagcactagatgcagaaaatcctgtaagtgatcaacaaggtggtgcagaaattcctgaaactggaggtgctgaaaatcctgcaagtgaccaaaaaaatgtggaacaaattcctgcaagtgagcaagtgggtattgcagaaaatatggtaaatgaccaagcaggtggtgcagaagatcccacaaaggaccgaacagcaggtggtgcagaaaatcctttaaatgacctaatatttcttgcacaaaattctgaaagtgaacaagcaggtagtgtggaaaatctgttaagcgaccaagcaggtgttgcagaagatcacacaaagaaccgtgcagcaggtagtgccgaaaatccttcaaatgacctaatagatcttgcacaaaatcctgaaagtgaacaagcaggtagtgaggaaaatctgttaaactaccaagcaggtggtgtagaaaattctgcaaagaaccatgcagcagctggtgcaggagatcctccaaatgaccaagctgcagatggtgcagagaattctgcaaaaaacctatcagcacgtagtgcaggagatcctccacatgaccaagcagcagatgctatagaaaattctttaaacaaccaaacagaagctacagagaaacttgtaaaggatgaacagggtactgcagaaagttttgtagaagatgtagcagatgctgttgaaatgcctgaaaacagccaaagaaatggtgttgaaacccctgtaagcaacaaagcagatcgcctcccagaagaagcaaaggagatactgaaatcattggcaagtaaatgggaggatgtacttgatgcaaatgcattgcaggtgatccctctcaaaggggcaatgacgaatgaggtattccagataaagtggccaactatgacaggggaattgtcacgaaaggttcttgttagaatgtatggtgagggtgtggacgtgttctttgatagggataatgagatccacacatttgaattcatgtcaaagaatgggcaaggtcctcgtctactaggacgatttacgaatggccgtgttgaagagtttatccatgcacggacattatcagcatctgatctacgtgatccatctatttctgctcttatagcagccaaaatgaaggagttccatgatctagatatgcctggtgaaaagaaagtccatctttgggatagattgcgaaattggcttagtgaagccaaacgtttatcgtcccctaaagaagttgaagctttttatttggatacaatcgacaaagaaatctctattttggaaaaggaactatcaggctctcaccaacaaataaaattttgccacaatgatttacaatatggtaacataatgcttgatgaagagacaaattctgtgaccatcatagactatgaatatgctagttataatcctgtagcatttgatatagcaaaccacttctgtgagatggctgctaactatcatacagaagagcctcatatccttgactacaataaatatcctgattttgaggagcgtcaaagatttgtgcaggcatatctgagtacctccggtgagcagcctagtgacagtgaagtggagcagctacttcaagaaattgagaagtatacacttgcaaatcatctattctggggcgtttggggaataatttcggcacaagtaaacactatcgactttgactacaaggagtatgctaaacagagatttcaagagtactgggcaaggaaaccttatcttctaataaactctgaagcgccttctccttataatgtgcctgagggtacaggagagctagcttcagcagtgcccactaaatcgaagaactctggtatctttaggaagatgaagagagttttgggtctcggcttgttcaggtctaagagctag

SEQ ID NO: 992 - DNA, 999 bp, Glycine max var. Williams 82
atgagcatgttaggcctgagagacctagttctcatagctcaaaccccttcttcccttcaccaccaacaccaaggccaacccatttcagaaaaccagactcacactcacactccaaaccttcctttgccttcttcagcagcttctctcagtgttggctttggaattttccctctcctcactgccacaccatgtgtgccacagcctcatcaaaacaatgaggttcaagagtgtggtggtggtggtgccaatagtaacactaccaccaccaattattggaacctcaagatgtgccaagaagtgaataatcctccaaagaagggtgtgatcaacgtggctgatcatgatgatgagaagggtgtgatggagagtgaggaaaacggggtctatgggcctgactttagggtgtgccaagattgtggcaacagggctaagaaagattgcgtctttagaagatgcaggacttgctgcaagggacgtgggtatgattgtaacactcacgtgaagagcacgtggatcccctccgttcgccgccgcgagcgcgagatcacggtggcttccggtggcggtgttggcggcaatggtggttgtaagaggccaagagctgtggtggggtcatctcaaaatgccacttctcatagttccaactctaatgctacaactcctaagagcttagctactagctcttttcatcaagatgctagcttcaagcagtctttaccgggtcatgttcgtgcaccagcagtgttcaagtgccatagagtctctgccattgggaatggtgaagatgagtttgcatacttggcaacggtccagattagtgggcatgtgttcaaagggtttctctatgaccatggtgttgatgggaaaaccgcaaatgtagtcccttgtgtctcggaactgcagctgggaaacaattgcagtgggaagaacagagaatgttcctctgcaattgcaattggggttgcaaataacaatgcataccctgcttctgcgagttga

SEQ ID NO: 993 - DNA, 177 bp, Glycine max var. Williams 82
atggcttacttgaaggttgtcataaacatattcgttttgctattcgtgcttctcttatcaatgattctggcaacagcaagggtgcccctttggatatccgaacctcatcacaaagcacatggacgcctccttgctatggatgatccacgtgaccaccattataaatttacaccataa

SEQ ID NO: 994 - DNA, 1332 bp, Glycine max var. Williams 82
atggatggattaggttcgccatcccagtggctgagggagctgagatgggactcccagggcttaaatccaataagccttcttattgactgtgccaaatgtgttgcatctggaagcatcaagaatgcagatattggccttgagtacatatatcagatttcatctcctgatggtaatgcagtgcaaaggatggtcacttatttcagtgaagcacttggttacaggataataaaaaatttgcctggtgtatataagtctctcaatccatcaaaaacatcattatcttctgaagatatccttgttcagaaatacttctatgaactgtgtccatttttgaagttctcatacctgatcacaaaccatgccattgctgaggccatggagtgcgaaaaggtggttcacattattgatcttcactgttgtgagccaactcaatggatagatcttctactaactttcaaaaaccgtcagggaggtccaccccatctgaaaattacaggaattcacgagaagaaagaagtattagaccaaatgaactttcatttgacaactgaagctgggaaattggattttcctttgcagttctatccagttgttagcaaactggaagatgttgactttgagaagttgcctgtaaagataggagatgctcttgcaatcacttctgttcttcagctgcattctcttcttgccactgatgatgatatggcagggaggatctcaccggctgcggcagcatctatgaatgtgcagagagcactgcatatgggtcaaaggacttttgcagagtggcttgagagagatatgatcaatgcatataccttgagtcctgattctgctttgtcaccgctttccttgggtgcctcacctaagatggggatctttctcaatgctattagaaaacttcaaccaaaactagtagtgattactgaacaagaatcaaatctgaatggttccaatttgatggagagagttgatagagcattgtacttttacagtgcattgtttgactgcttggactctactgttatgaaaacatcagtagagaggcaaaaacttgagagcaagcttcttggagagcagataaagaacatcattgcttgtgagggtgttgatagaaaggagagacatgagaaactcgagaaatggattcgaagacttgaaatggctggttttgaaaaggtacctttgagctacaatgggaggttagaagcaaagaatctgttgcagagatatagtaataaatacaaatttcgagaagagaatgattgtttacttgtctgctggagtgacagaccattgttttctgtatcagcttggagttttaggagatga

SEQ ID NO: 995 - DNA, 945 bp, Glycine max var. Williams 82
atggctacgctgattgctccttccaaccactctcctgtggaagatgccgaatctctccggaaggctgtcaaaggttggggagctgatggaaaagccatcatagcaatactaggccatagaaatgccacccaaaggaccctaatcagagaagcataccagaatctcttccaagaggatctcatcaaacgccttgagtctgagctctctggtgactttgagagggcaatgtaccgttggatattggaacctgcagaacgtgaggctttgttggccaatatagccattaagagtgctgacaaaaactaccaagtgattgtggaaatttcctgtgtcctttcacctgaagagctttttgctgtgaggcgtgcctaccacaacaaatacaagcgttgcttggaggaagatgtggccgctaataccagtggccatcttcgccagctattggtagggttggttagctcatttaggtatgggggcagtgaaattaatgcaaaattggcacaatctgaagctgatgctcttcatgaggctataaaaaacaagaataaaagtaatgacgaaattattaggatccttactactaggagcaagacccaacttgtggctactttcaatcgctacagggatgatcatggcattgccatcactaagaaattgtccgatgaaggatctgatgaatttcataaggcagcaaatttagccattagttgcatcaatgatcataagaagtactacgaaaaggttcttcgcaatgccatggaacatcttggaactgctgaggatgccctcacacgtgtgattgtcaccagggctgagaaggacctgaaggagatcaaagaggtgtattacaagagaaacagtgttcaccttgagcatgcagtggccaaggaaacttctggagactacaagaagttcctcctctctttgatggggaaagaagagtaa

SEQ ID NO: 996 - DNA, 684 bp, Glycine max var. Williams 82
atggcaaaaaatattctctcaacctcaaaccccatcctactacctagttcatcaccatcctcatcctcatcctcatttgtaaaaccaatacatgtttgctccaatccgataatcaaaagcacttcgaagagggaattaactctttgcaaagcaacaccacactctccaattgttgtgacaaagagaggcttgtccatcagcttcatcaccagctttgtgctttcattggctggtaagaagaatgcaaatgcagcaatactcgaggcagatgatgatgaagaactcttggagaaagtaaagcgtgacagaaagaagagacttgagaagcaaggtgtgatcagttcttccaaacaagaaacagggtatcttcaagatctggtgtacaagctaagcgcagttggtcaagcacttgaaaagaatgatctatctgctgctggttctgtccttggaggaagcaccgatgcagattgggtccaaagagctaatatagcattcaataaactgagctccagttcagaagagaagactgaggtggacgcattcaattcctcattagcttcactaatttcatcagtttctaagaaagatgttgagtcctccaaaattgcctttgtctcttcggccactgcatttgagaagtggacttctatgacaggccttgctgctcagcttaagggcctttga

SEQ ID NO: 997 - DNA, 399 bp, Glycine max var. Williams 82
atggactcgccgaagcggcaggcgcaaaagtttctggtgacggtgacagcggtggtggcggtggtggcgaagcgggcgagccggctgcagcggaagctggcggcgagggaggagtggaggatcgagcttctgcgatcaccgaagaagcttctgagcaacataagcagcaaaacgctgccgtttaggaagaagaagaggggggaggaggattggggaaagggtggggtgtggcagaaggcgatcctgatgggagacaagtgcgagccgttggatttctcgggagtgatttattacgatagtaacgggaagcaggtgaacgagatgcccctcaggtcgccacgtgccagtcccgtgccgcccgggtactatttcatccaccaccgcgaccgccacctctga

SEQ ID NO: 998 - DNA, 1953 bp, Glycine max var. Williams 82
atgcctacccttgtcaattatagtggtgatgatgagctctatcatgggggttccttctgtcaaaatcccattgatttgggtcgcctgtgtacttatggttcaattgtggatgagtactactacactcctagcaagcgagctcgaatcaatgccctggatgcgttcgaatttctagggcgagagcaagatcaaaagcctaccattgatgtccttcctgatgaatgcctttttgaggttttcagatggctctctagtggcaaagagaggagctcttgtgcctacgtgtctaagcggtggcttatgctcatgagcagtatctgcaaagctgaaattcacaagtctgataagatgattgaggggtctgcttccggttatgttgaaatggcctcagtggatgaggatcaaggtattgaagacaatggctacttaacgcggtgtttggaagggaagaaggcaactaatgtaaggcttgctgcaattgcagttgggactagtgcccgcgggggacttggaaagctgtctatcagaggaagcaattctgttcgcggtgtcacagacgttggcctctcagcagttgctcatggttgcccttcacttagatcattttctttgtggaatgtgtcttctgttggtgatgagggtctgtctgagatagcaaaaggatgccatatgttggagaaacttgacatatgccaggcctccttcattagcaacaaaagtctaattgcaatagctaagggctgccccaacttgaccaccttaaatatcgaatcgtgtccgaagattggaaacgaggggttgcaagctattgccaggtcttgccccaagttacaatgcatctctatcaaggattgtcctcttgttggggatcatggagtatcaagtctattatcctcagctattcacctttcaaaggtaaagcttcaggatttaaacattacagatttctctctggctgtcattggccactatggaaaggcaattttaaatttggtcctctgtggtcttcaaaatgtcactgaaaggggcttttgggtcatgggtgttgctcaaagtctgcagaaactgatgtcacttacagtttcttcctgccgagggataacagatgcaagcattgaagccatgggtaaaggttgtgtcaacctaaagcagatgtttctgcgcagatgctgctttgtatccgacaatggtttggtagcatttagcaaagttgcaagctctcttgagagcttgcacttggaggagtgtaacaacatcaaccagtttggcattatttgtgccctttcaaacttcaaatcgactttaaagtctctcacccttcttaagtgcaagggagttaaagatatagatctggaagtatctatgtttcctccttgcgagtctctccgacatttatccattcataactgccctggtgttggaaatgctagcctggctatggttgggaaattgtgcccccaacttcagcatgttgatctgaccggactttatggtctaactgatgccggccttgttcctcttttggagaattgtgaggcgggacttgtcaaggtgaaccttgtcggctgctggaatttgacggataacatagtttcagtattggccacactacacggaggaaccctcgaattgctaaatcttgatggatgcaggaagattaccgacgcaagcttggttgcaatcgcggataactgccttctgcttaatgatctagatgtgtcaaagtgtgcaatcactgatgccggtatagctgttctttctagtgccaaacagcttactttgcaagtgctttctttgtcaaactgttctggtgtaacaaacaagagtgcgccttccctaaaaaagttgggccagaccttggtggggttgaatcttcaaaactgcaattcaattggctgcaacacagttgagttcctagtggagaacttgtggagatgtgatattctggcttaa

SEQ ID NO: 999 - DNA, 657 bp, Glycine max var. Williams 82
atggtgcaaacaaggaagttcagaggtgtcaggcagcgccattggggttcatgggtatcggaaattcgccaccctcttctcaagaggagggtgtggctaggcacgttcgaaacagcagaagaagcggcacgagcttacgaccaagccgcgatattgatgagcgggcgtaacgcgaaaaccaatttcccaatactccaaaccccggagggtgacccaaagacgacgctaacacccatcgatcacgaaacctcatcatcgtcgacgaccacctcgaaggaactggaagagattcttcacgccaagctccgaaagtgcgggaagcttccgtccccttccatgacctgcctgaggctcgaccccgagaattctcacatcggagtgtggcagaagcgcgccggccagcgttccgattccaactgggtcatgatggttcctcccctcggaaaaaaaggtggtgctaatgaaggaggtactggaggagatgcttcttgttctaactcctttccgttctccgagtgcgatccgaccccgcaagtggcaaggcaggagcttctgaggacggagatggacgaggaagaaagaattgcgctgcaaatgatagaagaactcctcagcaggaactgccccactagcccttcattcaataacttatattaa

SEQ ID NO: 1000 - DNA, 1260 bp, Glycine max var. Williams 82
atgagggagaggaacaaaggtgtggaagatcagtcttacaccaatgacatggattgctactactactccacctctgaattcacaccatgtaagaaacacccttcttcttcttcttcttctgttggtatatgtgcttattgtctcaaggaccgtttggtcaagcttgtgtgttctgattgtggggagcaaaggctttcttcatgtccttgctctgatgagatggcctcttcgcaccgcaactcatgcactgttgaggtggggagtgttgggagggtctcattcctcattgagaatgagaataacaatgagagtaccccagtggttcttcagcgtttgaatcacaataacaaggccgaggaggataataataatgacgaggatgaggttgtggtgctgaggaggagcagcagcagctgtgttgagatcaagaggcatcatcatggtggtgatgggttttggagaattgggaagctttttcggaagaaaaaggatcagaagggttgtcgcagaagtgttgttgggtttgacgagaggaatagtgagatgtgggtggtggatcatcaagggggggtgtctaggtcaaggtcactatgcagcttcaggggtggagggctatttggatctgaggatggtggtgattcagtgttgtcaggtgctagaagctcaatttctgcagctaggagttctggtgttaatatgttggaatctggaagaagaagtggatacagtgaagctgagccaagaaggagtggttttgatggagtagagaggagggatttcttgtttgatagttatgaaagtggaaatgatctcaaaggtggtgtgaaaaagggtggactaatggatggtggtggagatggtggtggattctacggtggggtaaataggcgtgtgttttcactcagagagagtgatttcaaaggcatggatgagtcaagctttattgacttgaagcttgattactcatcagaatcaaagcacgagttttctgctgcaaagatgagcaacaatatggggggtgatactttctcttctttcagaaatgggaatttcatgccacatgatgttggtggaggttcttatggagggttggtaggggatggagttttaaccaatggagggtcatgtagactcactgtgaatgacagaggaatcaagaggggaaggaaaagcatgaagggttggaggtggattttcagataccattcaaattggggaagctcaaggaaaagagatgaagactttatgttcaaagcatga

SEQ ID NO: 1001 - DNA, 1044 bp, Glycine max var. Williams 82
atggcgaagcagcaaacacacaaaatcaatgcaagcactaacaataacattagcacaactaacactgtcaccgccaaggtgaaacgaacaaggagaagcgtccctagagattccccacctcaacgcagctcaatatacagaggagtcactaggcaccgatggactggccgatacgaagctcatttgtgggacaagaattgctggaatgagtcacagaacaagaaaggacgacaaggtgcttatgacgatgaagaggcggcagcacatgcttacgatctagcagcattgaaatactggggtcaagataccattcttaattttccgttatcgacctaccagaatgaactgaaagaaatggagggtcaatctagggaagagtatattggatcactaaggaggaaaagcagcggtttttctcgtggagtttctaaatacagaggtgttgcaagacaccatcataacggaagatgggaggctcggattggcagggttttcggcaacaaatatctttacctcggaacttacgcaacccaagaagaagctgccacagcatatgacatggcagctattgaatatcgaggagtcaacgctgtgaccaatttcgacctcagccgctatatcaagtggcttaagcccaataataacaacaccacagtcaactctaatcttattgactctaaccctaattgtgagacgaactttacctcaaactctaatcaacaacaaggattcaattttttcaacagacaagagtcattcaataatgaagaagcggcaatgactcagcctcggccagctgttgccacgtcagccctaggacttttgcttcagtcatccaagtttaaggaaatgatggagatgacttctgctacagatttgtcaacaccgccgtcggagtctgagttgccgtcatgcacatttcccgatgacattcaaacatattttgagtgtgaagattcccatagatatggagaaggggatgatattatgttcagcgtgctcaacggctttgtgccccctatgttccattgtgatgacttttga

SEQ ID NO: 1002 - DNA, 1371 bp, Glycine max var. Williams 82
atgaaacataccatgttacctgccattggatctgttgtccctcgtggtgcctttgcagcagtcttgctcctgttactgttttctttctccactttctcttctacagaagcctatgatccgcttgatccaaccggaaatataacaatcaaatgggatgtcattagctggaccccagatggctatgttgctgttgtgacaatgtacaactttcaacaatatcgccacattcaggcccccggatggtcattagggtggacatgggctaaaaaggaagtgatttggagcatgatgggagcgcaaaccacagagcaaggggactgttcaaagttcaaagcaggcattccacattgttgtaagaaggaccctacagttgtggatttgctgccaggaactccttacaaccagcagattgcaaattgttgcaaagggggtgtcctaaattcatggggtcaggacgccagcactgcagtaagttctttccaggttagtgttggttctgccggaacaacaaatagaacggtcaaaatgcctaaaaatttcaccctcaaagcaccgggacctggctatacttgtggtcctgccaaagttggaaaaccaactgtatttattaccaatgacaagaggagaaccactcaagccatgatgacctggaatattacctgcacttattctcaattcctggctcaaaagacaccaagttgctgtgtttccctctcatccttctataatgacaccgttgtaaactgcccaacctgcacctgtggttgccgaaacaaaacagaacctggcagctgtgtagatccaaattccccacatttagattcagttgtatcatcatctggcaaagctgcaaacacgcctctagtccagtgtacaagccatatgtgtcctattcgagtgcattggcatgtgaagctaaattacaaagagtactggagggtcaagatcacaatcacaaatttcaattacagaatgaactattcacaatggaaccttgttgtgcagcatcctaatttagataatattacccagctcttcagttttaattacaagtcactaacaccctatgagggcttgaatgatacaagtatgctgtggggagtcaagttctacaatgattttctttcttcagctggatctcttggtaatgttcagtcagaaatcttacttagaaaagacaaatcaaccttcacatttgataagggatgggccttccctagaaggatttatttcaatggggataactgtgttatgcctcctccagatgcctacccctggcttccaaatgcaagttctaaactagttttctctttactaagtacagtcatagtcactttagcttctttgttaatcttattgaatcaatcatag

SEQ ID NO: 1003 - DNA, 1967 bp, Glycine max var. Williams 82
cagatcttcccactagttttgcttacagttacacaataaagtcagtgactgactacatggtgtttcataacactctaagttcatttcaaaaccaaagcttctgctttgtgatggaactagagagctgagaggcctaaacctctgtttgctctctctccttttttggtgcagatcttgaacttgagctgcattgtcatagaaaatctgcaccaagaaatgaaacataccatgttacctgccattggatctgttgtccctcgtggtgcctttgcagcagtcttgctcctgttactgttttctttctccactttctcttctacagaagcctatgatccgcttgatccaaccggaaatataacaatcaaatgggatgtcattagctggaccccagatggctatgttgctgttgtgacaatgtacaactttcaacaatatcgccacattcaggcccccggatggtcattagggtggacatgggctaaaaaggaagtgatttggagcatgatgggagcgcaaaccacagagcaaggggactgttcaaagttcaaagcaggcattccacattgttgtaagaaggaccctacagttgtggatttgctgccaggaactccttacaaccagcagattgcaaattgttgcaaagggggtgtcctaaattcatggggtcaggacgccagcactgcagtaagttctttccaggttagtgttggttctgccggaacaacaaatagaacggtcaaaatgcctaaaaatttcaccctcaaagcaccgggacctggctatacttgtggtcctgccaaagttggaaaaccaactgtatttattaccaatgacaagaggagaaccactcaagccatgatgacctggaatattacctgcacttattctcaattcctggctcaaaagacaccaagttgctgtgtttccctctcatccttctataatgacaccgttgtaaactgcccaacctgcacctgtggttgccgaaacaaaacagaacctggcagctgtgtagatccaaattccccacatttagattcagttgtatcatcatctggcaaagctgcaaacacgcctctagtccagtgtacaagccatatgtgtcctattcgagtgcattggcatgtgaagctaaattacaaagagtactggagggtcaagatcacaatcacaaatttcaattacagaatgaactattcacaatggaaccttgttgtgcagcatcctaatttagataatattacccagctcttcagttttaattacaagtcactaacaccctatgagggcttgaatgatacaagtatgctgtggggagtcaagttctacaatgattttctttcttcagctggatctcttggtaatgttcagtcagaaatcttacttagaaaagacaaatcaaccttcacatttgataagggatgggccttccctagaaggatttatttcaatggggataactgtgttatgcctcctccagatgcctacccctggcttccaaatgcaagttctaaactagttttctctttactaagtacagtcatagtcactttagcttctttgttaatcttattgaatcaatcatagagataccatctactcttttggagtagtgtacctttctcttctgcacaagctttttaaagctgaagtcaaccccattgtcaggaatgcatagaagctgtcactgaagcaataaaaagtgtcacagatgcataaatgcatgccacaagaattctgtcctttatcatcctggggatagaattttaccccccatgtaacacatctttttagcctgagttgtataattattttaagtcactcgattggatgattatatttttaagcttatagaatatccaatttgattgttttatccttgaaatcatgaatccaagaaattctaggtagcacttgctgcttttgaagtcatttgttaatcatatgtatactcatttcccattttc

SEQ ID NO: 1004 - DNA, 591 bp, Glycine max var. Williams 82
atggttatggaggcctcggcatccatttgcaacaacagacccttcatcttctcttcctctcgtgccataacacaaaaatcttgcactctctcatcacctatgcttgtcaaatccatggccactcccaagcctcttccctcggtctctagaactgtaggctctagaaagaactcaactgtgttcccacttggggaacaacctaggagcagtcccgccacagccacgcctcccataaaacttctgacaaggatggagcagctgaagctgctgagcaaagcagagaaagcagggttgctatctgcagcagagaagtttgggttctccctctcaacaatagagaggcttggactcctctcaaaagcagaagagttgggtgtgctatctgctgccactgatcctggaactccagggacactcttaaccctcagcttagggttgttgatccttggaccgttgtttgtttacttggttcctgaggacaaccttggagaggtggggttgcaggttgtggttgccttggccggtgtaattgggggttctgctggttttgctgcatcaaattttgtatccaacttgcagaaattgaaataa

SEQ ID NO: 1005 - DNA, 1380 bp, Glycine max var. Williams 82
atggtttctgagacactccaaagccaaaccaagaacgtgtgcgtgattggagcaggaccatcagggctagtggcagcaagagagttgagaaaagagggtcacagggtggttttgttggagcagaatcatgatgttggaggacagtggctatatgaatcaaatgtggaaggagaggaccctttagggaaaaagccttttctaaaggttcatagcagcatctatgaatctttgaggctcacatctccacgtgagatcatggggttcactgatttcccttttttggtcaagaagggtagagacatgaggaggttccctagccacacagagctgcttatgtacttaagggacttttgtgaacattttggcttgggagagatgataaggttcaacacaagggtggattatgtgggaatgttggattatggtgtctgtagtaatgatttgaagtgggttgttagaagtgaagataagaagagtgaaaagacggtggaagaggtgtttgatgcagttgttgttgccactggtcattactctcaaccaagattgccctccattcaaggaatggatacatggaaaaggaaacaaatgcacagtcacatttacaggaccccagaaccattccgcaatgagattgtagtggtggttggaaattccttgagcgggcaagacatatcaatagagcttgtggatgtagcaaaggaagtccatatgagttccagatctcttaacatctctgagggtttgtctaaagtcatatccaaacatgccaactttcatcttcatccacagatagagacccttcaagaggatggacgggtaacattcgtggatggttcttccattttggcagactccattttgtactgtacagggtactcctatgcattcccctttcttgacaccaaagaaatggtggttgtagatgatgacagagtggggccattgtatgagcacacttttcccccatcacttgctccatccctttcttttataggcatccctagaaagatcatagggttccctttctttgagtcacaagcaatatggatagctcaactgctttccgggaaaaaagtattgccatcatgggaggaaatgatgaaatccatcaaggaattctaccaatcaagagaagcagcaggcattcccaagcactgtactcatgaaattgcaaactttgggtactgtgacaaatacggggataatgtggggttcccacgtatagaagaatggaggaaacagctatgcctatcagccttaattaactctgatgccaacttggagacatatcgagattcatgggacgatcatgagctgctccaagaggccctccagagcccacacttcactcaacttggacttgaagattctcccatgtaa

SEQ ID NO: 1006 - DNA, 552 bp, Glycine max var. Williams 82
atggctgaagcaattatgggtttcacccctttcaaatcacacactcttagctcatgtctacaaacaaacaagtttcaagtgaaccagtcttcaagattgccaaagcaacattcaaactctagtcttatcaacagaccgtggcaggtcttagagggcaagagcaaaaaaagaggatctttgtgtaaagtgaatggcttgccagattggccactgatggccattatagtagagcaaatggaagggcagagagatttgatcactgagaaaacagtttcccatcttagtgatcaggcaataaaaaatgtttactcttggtacataatgttcaccgtttgggggtgcttattctttggtgccatgaaggatccatattacgactcagaaacatataggggagatggaggagatggaactggcaactggatttatgaaaagcaagatgctatggaagcagaagccagagaagctctgtggcgggaggagttgattgaggagatagaacaaaaggttgaagggttgagagaacttgaagaggctggcaagaagaactag

SEQ ID NO: 1007 - DNA, 747 bp, Glycine max var. Williams 82
atggtgcttttgggacttctcatggtgggatttctttctctgggttcatttgtctcagcttctggttatggttggatggatgctcatgcaaccttctatggagggggtgatgcctcaggcaccatgggtggagcatgtggatatgggaacttgtacagccagggctatggaacaaacactgctgctttgagcacagctttgttcaacaatggtttaagctgtggggcatgttttgagataaagtgtgttaacgaccaaaggtggtgccttccacgctcagttattgtcactgcaaccaatttctgtcccccaaacaatgcactccctaataatgcaggtggatggtgtaaccctccccttcaccacttcgacctttcccaacctattttccaacaaattgctcaatacaaagctggaatagtacccgtggcttaccgaagggtcccttgccgaaagagagagggcatcagattcaccatcaacggtcactcatacttcaacctagtcctaatttccaacgttggaggtgcaggtgatgttcacgcagtttccatcaaaggatcaagaacaaattggcaaccaatgaccagaaactggggtcagaactggcaaagcaacgcctatctcaacggacaaagcctctccttcaaggtcaccactagcgacggacacaccgtggtctctaataatgttgcaccctcaagctggtcctttggccaaaccttcaatggccaccaattcatttaa

SEQ ID NO: 1008 - DNA, 1509 bp, Glycine max var. Williams 82
agaccctttctcttagagccaagaggtttaagttataacattacttgaagagattaccaattgatagaaaaaatatgaagttccatttggtgctagttgttctaataggcaccatatttggaattgggcttgaagggtgccaatgcaaggttgtgcagttcatttttggagactccctctcggatgttggaaataacaagtacctctctaagagccttgctcaggcaagtttaccttggtatggtattgatttgggtaatggtctacctaatggtaggttctcaaatggtcgcacggttgctgatataataggtgacaatatgggccttccgaggcctccagcattccttgatccttctctatctgaagatgttatattggaaaatggagtgaattatgcttctgggggtggaggcatcttgaatgaaactggcagttattttattcaaaggttttctctctacaagcaaattgagctgtttcaggggacacaagaactgattagaagcagaattgggaaagaggaggcagaaacgtttttccaggaagctcattatgttgttgctttaggcagcaatgacttcatcaacaactacttgatgcctgtttacagtgattcgtggacatataacgatcaaaccttcatagactacttgataggaactctacgagaacaattgaagctactgcatggtctaggagcaaggcagttgatggtgtttgggctgggcccaatgggatgcattccacttcaaagggtgcttagtacatctggggaatgtcaagatagaacaaacaatcttgctattagctttaataaggctacaaccaagttagtagttgacttgggaaagcaacttcccaattcaagctatagatttggagatgcatatgacgttgttaatgatgtgattagcaacccgaataaatatgggtttcaaaactcagactcaccctgttgctcctttggaaatattcgaccggctcttacatgtatacctgcatcaaaactgtgcaaagatagaagcaagtacgttttttgggacgagtatcatccctcagacagagctaatgagctaattgccaatgagctcatcaagaaatttgggtttgtgcgtgttgatcaaacaacacctccttcaccatcacccgctcttgctccatcttcagacgattaatcatgcatgtgaaggtgggtcagcctatttaatccaccaacccataatgggttgggtcaagccataaattgttaggactcaacaaaaaagtgggtcaagttgggccaacccgtttataaggtgggttgggcccaacaatttgggttgacctgtttttgatagcattagcgagaatacatgaccccaagttgttctcaacaatatccttgactccgtggagaacggtgttgccaatgtgacaacattggttgtagagcatgatgtggttgaccgtcaacttgagtctcaagagcttggatacatagtgattgtggtcgagaacggtgtcaac

SEQ ID NO: 1009 - DNA, 321 bp, Glycine max var. Williams 82
atggccatggctaaggttttctgtgttctgcttctggcactccttggcatttccatgatcacaactcaggttatggcaacagattctgcttatcacttggatggaaggaattatggacctgggagtctcaagagctcacagtgcccttctgaatgcacaagaagatgtagccagacacagtaccacaagccctgcatggtcttctgcaaacaatgctgcaaaaggtgcctttgtgttcctcctggctactatgggaacaagtctgtgtgcccctgctacaataactggaagaccaagcgtggaggacccaaatgcccctga

SEQ ID NO: 1010 - DNA, 896 bp, Glycine max var. Williams 82
ctgaatcaaaccaaacttataaaccatttaggctctcttaaaacaaaggtccctcaaaccactttccccacactctttagtgtgtcatttttttttttgctctttccccacaaagaggtcttggacccttcttctgtgtagtgcaatggccatggctaaggttttctgtgttctgcttctggcactccttggcatttccatgatcacaactcaggttatggcaacagattctgcttatcacttggatggaaggaattatggacctgggagtctcaagagctcacagtgcccttctgaatgcacaagaagatgtagccagacacagtaccacaagccctgcatggtcttctgcaaacaatgctgcaaaaggtgcctttgtgttcctcctggctactatgggaacaagtctgtgtgcccctgctacaataactggaagaccaagcgtggaggacccaaatgcccctgaaaattgaaaatataagcataatttcacctacaatttcatatatactactcaaagtggaactataaactatatatatatatatatatatatggccatttctatgttttgggcagcacctactacagttgggttgtcactagactaataccatcttgttctctaccatgaaattagttcaattattaatttcatgaagaaacctatatgttactccctttcctaaacaggtatgagaggggtgttctactaattagtcaattatctttgtcattgtactttttttagttttatatataatgaagttattttataatttttgtctgatataatataatgtattacgacagacatgtcatgtaggtaagaggatctatagatccaacctatgtcagcaaaaagaaagaaaaatatgtagatccaaccttatttt

SEQ ID NO: 1011 - DNA, 945 bp, Glycine max var. Williams 82
atgggtgaggcgtgcattccaacagttgatctctctcctttcctgagagaggatgaagatggaaaaaagagagccatagaagcaatcacccaagcctgttctgaatatggcttcttccaaattgtgaaccatggagtttcccttgatttggttaaagaggccatgcagcaatctaagaccttttttgattactctgatgaagaaaagagcaagagtagtccttcctctgatgcaccacttcctgctggctacagtaggcagcctctgcactccccagacaagaatgaatactttctgtttttttccccaggttccagcttcaatgtcatccctcagatccctcccaagttcagggatgtacttgaagaaatgtttgtgcaaatgagcaagatgggtgtgctgttggagagcattataaacgagtgtttgggtctccctaccaacttcttgaaggaattcaatcatgatagaagttgggatttccttgtggccttgcgttactttccagcttctaacaatgagaataatggaatcacagagcatgaagatggcaacatagttacctttgttgtccaggatggagtgggaggcctgcaagtccttaagaatggagattgggtccctgttgttcctgcagagggaactattgtggtcaatgttggtgatgttatacaggtcttgagtaacaacaaattcaagagtgcaactcaccgagttgtgagagcagaaggacgaagccgatactcttacgtgttctttcataacttaagaggagacaagtgggttgaaccactgccacaatttacctcagacattggggagccacccaagtatagaggattcctatataaggagtatcaggaactgagaatgaggaacaagagccatccaccttctcggcctgaggatgagatccacattactcattatgccattgataactag

SEQ ID NO: 1012 - DNA, 888 bp, Glycine max var. Williams 82
atggcttacataaacaggagttcttcatggaggaacctttatctgtggacatccatttcaaccatgttctactgcatactggtgaagttgttcgttacggagtcccctagatggcttctagtgcgaggtaaaacagaagaagcggtggaaacactaaagtgcatcacatcaatcacccaaagcaacctcaatttggccataaataacatgtcccacaaggaagaaacatggaacgtggacatattctcagccctcaaaatcttgctacaaaaaaaatggtcttcgagaaggctgtcattaattatggcaatgggaataggcattggattggtgtattacggaatgccactgggcctccaaaatctatccttcaacctctacttgagtgtcacattcaacgccttatcggagttaccatcagcattgattgtgctcttcttcgtagacaagttcaataggagagttgcactcctcctcttcacaatcctaagtggtgttttcagtgtgatgtcaatcatggaaatgaagacatcatcgtggaccaacaacatccaaatagtgtttgagttagtatcgttcttcagcgcttgttcttcgttcaacgtgtacctaatttacaccacggagctgttcccgacctgcgtgaggaactcggcgctgtcgatggcgaggctggcagtggtgctcggtggcacgttcagcccgttgctggtgagtgctgcaagagggaacaagtttatgtgttatggggtttttgggttggtgatagggtttagcggggtcttcggaatattcttgcctgagacaaaaggaagggcactgtgtgatacaatggatgaagaagaaaacaaagagaaaaacatgacttgtgacatgttcctggcttga

SEQ ID NO: 1013 - DNA, 234 bp, Glycine max var. Williams 82
atggagctggttctgcaatacttgaagcgcaaggtcttctcttaccctttgccagcctctatcattcctgagcttcatgtttgcaagtctgatccttgggatttgccaggtgatttggagcaagagagatacttctttagcaccaaagtggccaaatatcccaacggaaatcgctccaacagagccacaaattcgggttattggaaggcaactggcttggacaaacaaattgtt

SEQ ID NO: 1014 - DNA, 1674 bp, Glycine max var. Williams 82
atgatggggtgggtggcgaatcggtggacgggcgtcgccgccgccatatggatccagtggagctgcggcgcatcgtacaccttcagcatctactcctccgtgctcaagtccacgcagggctacgaccaatccacgctcgacaccgtctctgtcttcaaggacatcggcgccaacttcggcgttctctccggcctcctctactccgccgtcgccccctacacaacccaccgcgcctccccctccaagtccatatggacctcgctcagcgggccctgggtcgtcgtcgcggccggcgccgtccagtgcttcgctggcttcatcttcatctgggcctccgtcgtgggcctcgtgagcccgccgcccgtgccggtcatgtgcttcttcgcgtggctcgcgtctaacggtcagaccttcttgaacaccaccaatgtcgttaccggcttgcgcaatttccctgagtacagcggcaccatcattggtatcatgaagggatttctgggactgagtggagctatcttgatccaaatctaccatacgttttttgatggggacccagcaacctaccttttgatgcttgctgtgttgccttcgttgatctgtgtgttgcttatgttctttctgaggatttatgaagtgcatggcagtgattacaagaagcatttggatggtttctctgtcgttactgtgattattgtagcctatcttatgttcataataattttacagaacttagttagtttaccgaactggggacggatgtttgcatttgtgattcttatggttctgctagcaacaccttttggaattgctataaaggcccattgggaagagtcacggaagttttcgcaatcctacacaattgagaggggttcttctactaataagggtaccacttcctccagtcattctgcatcagtggatcaagtggagtaccatgaattgcctagtgatgaggggcaggtacaagtgacttcagatgacaaattgccccgtgaagaagaaaagaatctcttgcaagctatgtgcacggttgatttttggatgctgtttgtgatcatgatatcagggttgggttctgggcttgcaactataaataatatgagccaaataggacaatcccttggatatagcgccattgagattaataatttggtgtcactgtggagtatgtggaacttccttggtcgttttggaggtggccatgtatcagattatatcatgcacagaaaaggttggcctaggcccctgttgatgacagtgactctggggataatgattcttggccatttaattatagcatctggtttccagggaaatttgtatttgggtcctgtcctggtgggcatctgctatggtgcacattggtccttgatgcccacaatcacttctgagatatttggtgtaaagcatatgggtaccattttcaatactattgctgcagcaagtccacttggatcgtatatactttctgtgagagttgttggatatatttacgacaagcaagccgataaagaagatcattcgtgctttggcatcaactgtttcatgccgtcattttttatcctggcagctgttgcttttcttgcgtttttggttggtttggcattattcttccggacccggaggttctataagcaagttgtgcttagaagattaaaacattatgcaagatga

SEQ ID NO: 1015 - DNA, 660 bp, Glycine max var. Williams 82
atggctctgagattcgcagcagctgcttctgcttctgtctcacgaatatcaaggccacaaaacccaccattcttttcacttcaacaccgcaacaacggtactctcaaattccatagcccaccttttcatcatccacttcccacaccctcaaaacgctgcaacgttcgagccataagcgaggtagctgtggaacctgaaatttcaaagaaagaacaaaatgagtcacctaaagattggaagattaaaatgctctatgacggagattgccccctctgcatgcgcgaggtgaatatgctaagagagaggaataagagttacggcacaatcaagtttgttgatataggttctgatgaatactctcccgaggagaatcaaggccttgattatgaaactgttatgggaagaattcatgctattctctcagatggaactgtggctacagatgttgaagcatttaggagattatatgaacatgttggtcttggttgggtttatgccattacaaaatatgaaccaattgcaaaaattgctgattccttatatggtgtttgggctaaatatcgtcttcaaattacaggacgacctcctatagaagaaatattagaagcacgaaagaataagggtgaagtatgcaaagacagcgatgcttgcaagatgtaa

SEQ ID NO: 1016 - DNA, 522 bp, Glycine max var. Williams 82
atgggaaattgccaagccatcgatgcagcaacactagtgattcagcatacaaatgggaaagtagacaagttctatgcacctttgagtgccacacatgtcatgaaaaccaaccctggtcactacgttgctcttctcatctccaccacattgtgtccaaccaaagacattcaaaattgctccaacgccaacaacccggttcgaataactcgaatcaagcttctcaagcccactgatactcttgttcttggccaagtttatagactcatcacaactcaagaggtaatgaagggattgagggaaaagcaaaaggcaaagatgaggcaaaacgtgccagagtcagctctcaagctagaattggagaaggagaaagtagcaaggaggtctgaaatggaggacaataaggcaattaccaatcctgaaagagctcgaccaaggataacagcaacaactaataatggtgccactgctaagacaagattttggcaaccctctttacaaagtatctcagaggctgccagctga

SEQ ID NO: 1017 - DNA, 1896 bp, Glycine max var. Williams 82
atgagcattcacttcttcttctgcttcttgtcgctctcatctttccatgtttctctagcaattaagggaatgcctgtgtctcagtctcagtctcaacctcaaacaacacttgaactcataaacccattcagccccaaagcctcactcattcgctattggaacactcgcgtttccaataaccttccaatccctcaccttcttctctcaaaagcttcaactctcacaccacaccattacgctattctcagcaaacttctgaaccaaaaacctaaacctaatgaaaaccttcaccactctctctgctcctcaccgaacttactttgttccttcgacgacacaccgttcgctcaaacacacaaaaacgacgacgggaacttcgccgtttacagcaacaagcgcttcgccaactacggatcctcccgagtcggcggagtcgactcgttcaagaactactccaacggcctaaacgcgaacaacgacgcgttccggcggtacagcgccgcctccacacgccgcggcgagcagttcaagaactacgccgacaacggcaacgtcgccaacacgaacttctccagctacggctccaccgcgaatcaagcctccgccgagttcagcaactacgacaaaacggtgaacgttccgaatctcggattcaccacctacgactccggcgcaagtaatcacaaactctcattctctagctacgggaacgaaacgaactctggatcgcaaactttcacgagctacggaaaacgcgttcgcggcggaacgagcgagttcgcgaactacgccgacgacgcgaacattctgcagtcggagttcagcagctacggagacttgaccaccggagcgagcaacgactccttcaagttctacagcttcaacggcaacaatccgcgacacgttttcaaaagctacggcgacggatccgccgccggagttgacagtttcatcagctaccggaatcgcgccaacgtcggcgacgactcgttccagagctacgcggtgaggtcgaagtccggcgccgccacgttcgcgaactacggcatgtcgtttaacgtcggaaacgacagtttcactgagtacggaaagggagcaatggggaaaacgtctttcggttttaaatcatatgggttaggccgcgcgtttaaggtttacaacaaagacggcgcgtcgttttcggagtatcgaaatttcagcgcagccaggggcaaagttgtaaataagtgggtggagccgggtaagttttttagagaatctatggtaaaagaaggaaacgtgattccaatgcctgatattaaagataaaatgcctgcaaggtcgtttttacccctggcgatcgcgtcgaaattaccgttctcgtcttcaaggattaatgaaatgagggaagtgttccacacgcgggaggggtcttctacagagcgcgtgatggtaaaagcgctgaaagagtgcgagagggcgccgagtaaaggcgagacaaaacggtgcgtttcatccgcggaagaaatgatagggtttgcggtttcggttctgggtcccaatgttgcggttcggagcaccgagaatttgaacgggtctggatcgagtgtgatgattgggaaggttcactcaatcgacggtggaaaagtgaccaagtcagtgtcgtgtcatcagagcttgtacccttacttactgtattattgccacagtgtacccaaagtgagagtttacgaagctgaaattcttgacgtggacactctggagaagatcaatcatggggttgccatctgtcaccttgacacgtcagcatggggcccacaacatggggcgttcttggcgttggggtttggccctgggaaaattgaagtgtgccattggatattcgagaacgacttgacgtggaccactgccagttga

SEQ ID NO: 1018 - DNA, 1422 bp, Glycine max var. Williams 82
atggccaatgatccattttttgaagctcaccacagaacaagacaacaacaacaccaatgcatgatgatgatacaacaaccaaacaatgatgatgatgttgtcccagaacacacatgtgcacaacaacaacaacaagagcaacaaaaccaatctccaaaattggctgcttcttccacttcccaaaatgctacacctgtgctacctgcttttgttgccttgctgctccttgttacttcaattgccccagcagcactctgccaccctttgcaaggtagtaaccacacttttaggccaaatcatgagttgctcaagttgaggagagtcagagcacacttgaagaaaatcaacaagccttctgtcaagacaattcagagtccagatggtgatttgatagattgtgttttatctcaccaacaacatgcttttgaccatcctaagcttagaggccacatagtattggatccaccagagagaccaaaggggaaccacaccaatggtgaagctgaaagggtaattgagagctttcagctgtggagtgattctggtgaagcatgcccagaaggaactgttccaatcagaagaactacagaagaggatattctcagagcaagttctatccaaagatttggaagaaaaccaagacctgtacggagagactctactggcagtggtcacgagcatgcagtagtttttgtaaatggggatcaatattatggagcaaaagctagcataaacgtgtgggcaccccgtgtaactgatgaatttgaattcagtttgtcacaaatgtgggttattgctggctcctttggtaaagatctcaacaccatagaagctggttggcaggtaagtccacaactatatggagacaactatccaaggttcttcacttattggactactgatgcatatcaaacaactgggtgctacaacttactctgttcaggctttatccaaatcaacaataggatagcaataggtgcagcaatttcgccaagatccgctttcaacagaagacaatttgatattggcttaatgatttggaaggatccaaagcatggacactggtggctggaattcgggtcaggactactagttgggtactggccagcaaacatgttcagtcacttgaggaaccatgcaagcatggtgcaatttggaggagaaattgtgaacactcgttcaaggggttaccacactgacacccaaatggggagtggccattttgctgaagaagggtttagaaaatcagcatattttagaaacttacaagtggttgattgggacaatagcttgcttcctcttagaaatattcaccttttggctgatcattccaactgctataacatatggcagggaaccaacaatgtttgggggacttacttttactatggagggcctggaaggaatgtgagatgcccttga

SEQ ID NO: 1019 - DNA, 1080 bp, Glycine max var. Williams 82
atgggtcgccattcctgttgtttaaagcaaaaactaaggaaaggcttatggtcccccgaagaagatgagaagcttttcaactacataaccagatttggcgttggctgctggagctccgttcccaaacaagccggactccaaaggtgtggaaagagttgcagattgagatggataaactatttgaggcctgatttgaagagaggaatgttctctcaacaagaggaggatcttataattagtcttcatgaagttctaggaaataggtgggctcaaattgcagctcaattaccagggagaacagataatgagattaagaacttttggaattcatgtttgaagaagaagctaatgaagcaagggattgaccctgcaacacacaagcctctcctcagtgctcaagaacacataattataaaggaagagaaggaaaccattttggagacaccaccacctatgttattaccaatgtctcaagggattttagcttcctcacaagagtcaccacttgtagtgaacaattcaagttactgtgatggtggattaaatgtaacagaagctgcttcaagggaagttttcatgagcaagaatgctgctttagaccctttgtcctactttgaattccaaatgggttacaacccaataagacaatttgatcagaaccatgtggggaccaactcaagctatggattctcctcattgccgtgtctgaatagttcttctgatcacgggaacgtgtcggtggcggcggagttttcagataacaactcagcttcaaaaatcagttctttgatgaaggaaagttccagcaatagctcaagtatgagtgtttatccagctgggggagggtgtcaaatgatggaaaatgcagggttctcatgggatggtgagaacaataatactaagatcgatcctttgttacagttccatgtcaatgtgctaaaatctgaagagttcaagacaagttcgtggcaagaagagcagattctgactcagaatttgatagatttcactaactatccgttaatgtcactgtctgaggatctaaccggagcaaattttgatgtgttccagcagatgtga

SEQ ID NO: 1020 - DNA, 258 bp, Glycine max var. Williams 82
atgttcagatccggagactaccgcacccacgtttcagaagttgagagggagtctagtactactgaattccctaatgcttatgtttccctcaacaaaaaggttgtttacgaggaaagtgagcatgagggatcccatcaccaccacctcttccataggcatcaccaccctgagactcgtgagagtgttaaggtggtcgagtatgaacaagtgcctcagaggcgtgtcggtgaagttgtctacgaagagaacagcaggaca

SEQ ID NO: 1021 - DNA, 423 bp, Glycine max var. Williams 82
atggggaagcaagttggttttgaggatgttcttagatatttcgacgaagatggtgatggaaaggtttcaccttcagagctgaagcacgggctgcgaatgatgggtggggagcttttgatgaaggaagctgagatggcaattgcggcattggattctgatggagatgggttgctgagtttggaggatttgattgctcttatggaagctgggggagaggagcagaagttgaatgacttgaaggtggcttttgagatgtatgacactgaagggtgtgggtttataacccccaagagcttgaagaggatgcttaagaagatgggcgagtccaagtccattgatgagtgcaaagccatgatcaaacagtttgatttgaatggggatggtgtgctaagcattgaagaattcagaattatgatgcagtga

SEQ ID NO: 1022 - DNA, 1920 bp, Glycine max var. Williams 82
atggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccagaaaccccgatcggtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagtgggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactga

SEQ ID NO: 1023 - DNA, 666 bp, Glycine max var. Williams 82
atgagtctgatgagtcttctacctcctcttgctgctgcttcttacacaaacacagttcctaaactgaaaactcacagtccaaaccttgtacttggacaaagggtcctacctaatctcctctcattggcccttgctgtaaccttagcctctcctttaccttcatatgcaatcccatcccttaattctcaatcccctccaatctctttcaccactcctttttctcaatccaagaacttggagcttggactagaaaatggaaaaattagaccttgcccatcaatcaatccaggttgtatatcaacaaatcccaagtcatcatcttttgcgtttccttggcttattccctcaaattccttggacgatgcaattcagaaactacgtgaagcaatcctaaagacccagaaaaatgtgaaatttcagcctgtggaagatagcccagatggtcaatatctacaagctgaagttgatggaggatttggtagagatgttattgagtttctggtgaaaggtgatgtggttgcatacaggtgtgtggcaatgaaagtgacttatgtgtaccctttcactactgcattaggagattcaaagggtcaagaagcaagactgaagcaaattaatgaccacttgggatggtatgctccaagttttgattccatggaggaatag

SEQ ID NO: 1024 - DNA, 603 bp, Glycine max var. Williams 82
atggaagcgccttcggttcgacgaatcgctgtcgtcgtcttcgtaaccgtctccgtcttctccatcgcactcgttgccgttttgacagattttggcggcggcggcggtgggactctcaccgataccatggcggcggtgtccttgtcgcgtggtttggatgaagtaaccaacacgttcctccctaattcgcatcgcaaactccttaccagtggcaatggcaatgaaagagtggaaccaaaccgaatatggggcgagaagtgcagcaaaagtgatgtagtgataaaccagggccccacagcacctctcccaagtggcattccgacctacacagtagagataatgaacatgtgcgtgagtggatgcgacatctctggcatacacctcagatgcggctggttcagctctgcacgcctaatcaaccctaagctcttcaagcgcctccgttacaacgactgcctcgtcaatgatggcaggcccttgatcaacggtgccaccatttcattccagtatatgaatatgtgggcgtctatcacttgtgcacgtgatgggaatgaggatgcgaatggaaatgggaatgtgtttttacatttttttaacagatag

SEQ ID NO: 1025 - DNA, 1174 bp, Glycine max var. Williams 82
ttcattcctacccatatacataaacacgcccaaaaccaaaacctccccgacacgaaaaagacgaaaagccagcgtccccgtagcatcgacgcttccatttacaacaccaacaaaaaaagaaaaagccaccaaaacctacccaacactcacaaccactgtaacaatctgtgaaaacttaaaaaaacactattatctttttctctctttctctccttccatgccgtgactactagttagttccaaccatttcaacttccgaacgacgagccgtggtgttcttagtttcatggaagcgccttcggttcgacgaatcgctgtcgtcgtcttcgtaaccgtctccgtcttctccatcgcactcgttgccgttttgacagattttggcggcggcggcggtgggactctcaccgataccatggcggcggtgtccttgtcgcgtggtttggatgaagtaaccaacacgttcctccctaattcgcatcgcaaactccttaccagtggcaatggcaatgaaagagtggaaccaaaccgaatatggggcgagaagtgcagcaaaagtgatgtagtgataaaccagggccccacagcacctctcccaagtggcattccgacctacacagtagagataatgaacatgtgcgtgagtggatgcgacatctctggcatacacctcagatgcggctggttcagctctgcacgcctaatcaaccctaagctcttcaagcgcctccgttacaacgactgcctcgtcaatgatggcaggcccttgatcaacggtgccaccatttcattccagtatgccaacaccttcctctaccctctctcagtttcctctgttgtctgtgtatgaactctgaaatcatgcatgcatgattacatcacaccccttaattctttttacttgtatatactacacactataggtatatgaatatgtgggcgtctatcacttgtgcacgtgatgggaatgaggatgcgaatggaaatgggaatgtgtttttacatttttttaacagataggaaatgtggagagtgaggacatggctacaaacaaccaaaacccaatttgcctttgctttttttttcttcttatgtttctggttgttttgggtatgatgatgagatgatgatgatatactagtactacttaaaagtcgttttccattttttagtttgt

SEQ ID NO: 1026 - DNA, 1680 bp, Glycine max var. Williams 82
atgggttgcgtgctcgggacgccggccggtgccggagatcagcgccttcgccggagcgagaagcgcaacggtgcagtcgacgaaggcaataatgcagttgggcttcgagagaaggagagaaaccggcataccggcgattttccggggactcttccggcgccggggcgccggaagcctagactcgatccgtgtgccgtcacgcagcagggatggccgtcgtggctgatggccgtagccggcgaagccatcggcgattggactcctcgtcgcgccaacactttcgagaagctcgctaagattgggcaaggaacgtatagtaatgtgtataaggcgagggacctggtgacggggaagattgtggcattgaagaaagtgagatttgataatttggagccagagagtgtgaagttcatggcaagagaaatacttgttttgaggaggcttgatcaccccaatgttgtgaagcttgagggtttggttacttctagaatgtcgtgcagtctttatttggtttttgagtatatggagcatgatcttgcagggcttgctgctggtcaaggtgttaagttcactgaacctcaggttaaatgctttatgaagcaattactatctggtcttgagcattgccacagtcgaggggtgttgcaccgtgatatcaagggttccaatctgcttattgacaatgaagggatccttaaaattgcagattttggactggcaactttttatgatcctaagataaaacaggcaatgacaagcagagttgtgaccctttggtatcgccctcctgagctgcttcttggggctactgtttatggtgttggtattgacctttggagtgctggttgcatcttggcagagctgcttgctggaaagccaataatgcctggccgaacagaggttgaacaactgcacaaaatatttaagttgtgcggctctccatctgaggaatactggaggaagtatagattgccaaatgctactatctttaagccccagcagccatataaacgttgcatcttagaaacatacaaggactttcctccatcttcactacctctaattgaaacccttctcgcaatagatcccgaggatcgtggcactgcctcagcaacactaaatagtgaattctttaccacagagccttatgcttgtgaaccatcaagtttgccaaagtatcctcccagcaaagaattggatgtaaaactgagagatgaagaagcaagaaggcaaaaggctctaaatgggaaagctagtgcagttgatggtgcaaaaaaagtcagagtacgtgagcgtgaacgtggtcgggctgttccagcccctgaagccaacgcagagatccaaacaaacttagataggtggagagttgtgacccatgcaaatgcaaaaagcaagagtgagaaatttccacctcctcatcaagatggagctgttggatacccacaagatgcatcaaataaaggacctgtttcatttggcgccccagacacttccttctcttcagggatatttaattcaaaaccttctggacatgttaggaatcatgctgctgcagggcttaacagagggaggaaaactaagaaagatgagtcccagatggcatcatcatggaaattcatgcgtccattcaaaccatcaacagctggactttccatggatttattatttaggagcaaataa

SEQ ID NO: 1027 - DNA, 1998 bp, Glycine max var. Williams 82
atggggttgccacaggtggcttcaggctgcactgccgaggaagtggcagcatcactaggcacatttgtgcaaactgcacctagaatggccagcataggcagctatgaggtgaacttgttggctggagaagacctaggtaattgcatgcacattgatgtgcttaaatctgaaaaaaaaaatgttctagagctttcaaaagaaacacatatttcaagtatgtgtagtgatagtaagttgaagaatgaccccatggaacaaattagcaagttgtttgtcaattcagagaaaactaggcagacacctgtttctaggactgtaggttttcaaattagagcatcaactcctcgtgttaatggtttcggaggaaatggatattcatcacctgtgtttaatgtcatcagtgatgcaactgaggcttctgagtcacaacttagaaagcagttattgtcacctttgaatgggatgctgcttgcagatcattttaaaggtgatccactagacataggtgctggtatttatcaaagtcgttcaaaggctggtgatgataattctaatgctttacatgagtataagaaggatcatattggaaacaacaatcagattcactcaatgatctggtctacatcttgtttccaggaatttacaaattcattctgtaatgactctactataaaccatattgtatctagtcatcaccaacgtgcagagccatggtcttataagcattttaaatcatctccagtacgtaatgtttctgaagaaacaactaaaacaaggtcccaaacagctgcattgtctataccacaaaaaaatgtgtcatcacctcccttccctttgtctcctctgggtaaaaaatcttctaaaaatgaaaatttgggagaatgcagaaatattgatgttatcttggatgatggcaattttacttttaatagtgtggaacagtcacttgatagaacttgtcaaggcattttatcagctcaggagataccaggtaaatcacagctcaatttgaacaatatgcagcaaaagtctgacctgtttactcctgacaacatgattgatatgaaagaatactggactcattctggtagctttcctcctcgggatgccaagttatgtggaactatgagtagactgccaattagaaggtccttggttggttcatttgaggaatctttgttatctggtcgcctactatctgggaaagttagtccgaaaattgaaggctttcttgcattgctgaatgtaactggtggcaatttctcacctcaatcacaaaaaataccatttgcagtaaccagcgtggatggagacaagtacttactttattattcatcaattaatctttcaggaaagctattatcaggcaagtctagagttgctaaatttcagagaacccttagcatggatgaatcacgatctgaaaagcctcgtatacgtatacctatgaaaggacgtattcaactggttctcagcaatccagagaggacacctatccatacctttttttgcaattatgatttgagtgacatgccaactggtaccaagacattcttgcggcaaaaggtcactttaactgcgtctagatcaaagtctatgatgggtaaggaaagccaaacagattctgacaccagagctgatgccaagtcttcgttgatctcagtcaccagtcacagagataaagatcttctcacctcaaaatgtggagagtttgatagttttacatgttcaaaagctggcattttgctttatgctcttcaccttcgctttatgtgccccttgcctaagagacgttcaaggtctgttcataagtgcaaatctggccctgtctctgctgatatgagaaatattgtggacattgaacaagaaagaagcttctacttgtatgatgatatgagggtagtgtttcctcaacgtcattcagattctgatgagggcaagttacatgtggaatatcatttcccttcaaatccaaaatacttcgacatcagctgctga

SEQ ID NO: 1028 - DNA, 498 bp, Glycine max var. Williams 82
atggccatgcatatgcaagcacccacaatcagtcttaacactgcaaggtccccatcttcattagctccagctgccaatgctggcctgcgaccacacctcaaccctttggctttaaagtcatctttcttctctggttcccttaacctcttacttcatccaatgcaacagtatcttacttctggagctcccaggatttccatgcgtgtggcctccaagcaagcctatatctgtcgtgattgcgggtatatttacaacgacaggatcccctttgagaaattgcctgataaattcttctgtcctgtttgtggtgctccaaaacgaaggtttaggccctacgctccaactgttgcaagaaatgcaaatgataaagatgttagaaaggcacgaaaatccgaaatcaagaaagaagaagcaattgggaacgcacttcctattgcagctgccgtgggaattgcagtgcttgcgggaatatacttctatctgaacaacaaattttag

SEQ ID NO: 1029 - DNA, 693 bp, Glycine max var. Williams 82
atggcatctgcaagagaacaaatgtatttgatggcaatcctccttatattctccccttcaaaattaacgttatcaaatgctggtgcagtaacagggcaaccaattccacctgagtggccgcaccagttccacgcgtttatgttcatgaacgaaagcggaattcttcagaaactggacttgtggtacgactggcccaacggccgaaacttcaacatcattcagaatcagctggaccacgtcgtctcctacgacctcgaatggaccaacggcacctccttcgtctacaccctcgacccttccgacccgacatgcaaagttgtggactttggagtgggtattctccgacccaattggctcgacggtgcaacctatttgggtcagcaacacgttgataacttcctctgcaacgtttgggcgaaggttgatttcattgtctactacgaggaggtcctcactcgtaggcctgttaggtgggacttctcctcaggatacactggtcacgtgatgacatttgaggttggtgcagtgcttgaggatgcaaattggcaggctccagtgtattgttttgatgagaatgagaaggaaaagaatatccccattttgggatctgctgttcgtggtggttctcttgggagtttgatgagagagatacccactggggaaactatgtacactctcgtaagagaggcataa

SEQ ID NO: 1030 - DNA, 2841 bp, Glycine max var. Williams 82
atgcaagtttcatcctcatggttcggaacattagtaccttccaaccgtttctcacacgttcgctctctccctctggaaccgtgttccaccacatcggtttctgctacctcgtaccctctatccacgcgcccctatagttctctttcgtttctcgtctctcaaagaaaaggcttctccctcgcctcgctggcccccatcagaactaataagaagagaagaagagcgtcgtcgttgagggtttctgcggtgttcgagaggttcacggagagagcgataaaggccatagttttgtcgcagagggaagccaaagcgcttggaagcgaattggtttacacgcagcatcttcttctggggctcatagccgaggaggatcgttcctccgatgggtttctcgcgtctggtgtcaccgtcgagaaggcgcgtgaggttgtgcgcagcgtctggcatcggaatagcttcgcacgtgccggctctggtgccgcacgtgccggggttgatggtgatagcaaagtgagtgccacgcaggttcccttttctgttaacgcaaagcgcgtgtttgaggctgcgtttgagtattcgaagtctttgggacacaagttcgttggccccgaacacattatcgttggtttggtcaaagtagatgatggaagtgttagtagggtcctttacagattggggacaaatggaagccagttggcatctgtggcattctccagactacaaaaagagattgccaaagatggtagagaaccgaatgtgttgtccaagggggtgcctaaccaatcgatttctagaaacggttctgatgctggagcctctgccaccacaggagaggggagtgctctatcacaattttgtgtggatctcactgcccgtgcgagtgaaggacgaatcgatccagttgtcggccgagaagttgaggttcagagaattattcaaattatatgccgaaaaaccaaaagcaatcccattcttcttggtgaagctggggttggaaaaactgctattgcagaggggctggcgcttcgcattgctaaggcagatgtttctccttttttattgacaaagcgtgtgatgtccttggatatagccctattaatggctggagcaaaagaaagaggagaactagaggaacgtgttacaaaattaattaaagacataataaagtcaggtgatgtcattctcttcattgatgaagttcacatacttgttcaggcagggacaattgggagaggaaataagggatctggccttgacatagctaatttacttaaacctgcacttggaaggggtcaatttcagtgtattgcatcaaccaccttagatgaatacagactttattttgagaaagatacggcattggctcgacggtttcaacctgtttgggttgatgagccgagtgaggatgacacaattaagatacttacgggtctacgtgagaaatatgaggcacatcacaaatgcagatacacagcagaggctataaaggctgcagttgatttgtcagctagatacatagttgataggtatctacctgataaagctattgacctcatagatgaagcaggaagtagagctcgtattgaagcctttaagaagaaaaaggaacatgaaactggaatcctttctaagtgcccagctgattactggcaagaaattaaagatgttaagtccatgcatgaaatggagaataaacttaaatactatggcgcttctagcattgacgatactaatgaactcatactagactcatatttatcttctgcaaccaccaataatgaacctatagaagttgggccagaagatatagcagcagttgcttccctctggtcaggaattcctgtacagaagctcacagctgatcaaagaattcttctgttacatcttgagaatcaacttcggaagcgtgtgattggacaagaggaggctgttgctgccatttctagagctgtgaagagatcccgggttggccttaaggatcctgatagacccatagctgctatgttattctgtggcccaaccggtgttgggaaaacagaacttgcaaaatctttggcagcgtgttactttggatcggaggcagccatggtacgattagacatgagtgaatatatggaacggcatacagtgagcaaattgataggatctcccccaggttatgttggttatggagagggtggcgttttaacagaagcaattagaagaaaaccattcacactgttattgcttgacgaaatagaaaaagctcatccagatatattcaacattcttcttcaaattttagaagatggacaacttactgattctcagggtcggagagtttcatttaaaaatgcattggtggtgatgacttcaaatgtggggtctagtgccattgctaagggtcgacacaactccataggtttcttgattccagatgataaaaaaacatcatacaatggcttgaaatcaatggtaattgaagaactgaggacatattttcgtccagaattgctcaacaggatagatgaagtggtagtgtttcaacctcttgaaaagtctcagttgctccagatattggatgtgctgctgcaagacatgaagaaaagggtattgtccctaggaatccatgtaaaggtgtctgaagcagtgaagaaccttgtctgccaacaaggctataaccccacatatggtgctcgccctcttagaagggccattacatcactaattgaagaccctttgagtgaggcattactttatggagagtgcaagcaaggagacactgtcctcgttgatttggatgctaatggtaacccctttgttacaaatcagctcgatcagattgtcaacttatctgactga

SEQ ID NO: 1031 - DNA, 2148 bp, Glycine max var. Williams 82
atgatcgcctccacctccacttccaccaatgttgtacctcaccctctgcgctttctgtccaaaccaacctcacattccactacgaggtttctgtctctcacactccactctcggggcatcgctgttgcactttcctcgtccagtagaaccacccccttgaagcccacgtgccacttcaacagcaaagatggaagctttgagctgcatgaggatgaggatgagcgtgatgtgcattgtgaggtccaagtgatttcgtggagggagcgcaaagttaacgcccaaatcacggttgatgctgacactgagtccgtttggaatgctctcactgattatgagcatcttgctgacttcatcccaaatcttgtgtggagtgggagaattccttgtccgtacccaggaaggatatggttagagcaaaggggattccaaagggcaatgtattggcatatagaagctcgtgttgtgttggatcttcgagaagtcatcaattcagcatgggatcgagaacttcacttttccatggttgatggggactttaagaagttcgatggtaaatggtccgtaaaatctggaacaaggtcatcaactgctattttatcttatgaagttgatgtgataccaaggttcaatttcccagctatttttttggaaaggattatcagatccgatcttcctgtgaaccttcgagctttggcatacagagctgaaaggaactttgtgggatatcagaaacttccagtgtcagaaaaccacttgcgcaaaacttatgcggccattaacgggtcatctgttaaaaagataaatggtgcttcgtctgaaagttttaaaaagataaatggtgctttgtgtggaagtgataagttgcctcctgcagagaacaaaaaagaaattgccacctcagtttctggttccatgctcacatcttccagtgaggtgagaagcaactggggtgtatttggaaaagtttgcaggcttgacagacctcggatggtggatgaagaaaatggaggtgttcatcgctgtgttgttgcaagcataacagttaaagctcctgttcgtgaagtatggaatattctaactgcctacgagactcttcctgagatagttccaaatttagcaatcagtaaggtggtatcacgagataatagtaaagttcgcattcttcaggaagggtgtaagggtcttctttatatggtgcttcatgctcgtgtagtgctggacttgtgtgaatatttagaacaggagatcagttttgaacaagttgaaggggactttgattcattccggggaaaatggatttttgagcaactaggaaatcatcacacactgctaaagtactctgtggagtcaaaaatgcgcaaagatactttcctttccgaagccataatggaggaggtcatttatgaagatctcccatcaaacttgtctgcaataagagactatattgagaacatgaatgcatcaaaatcttctgaagtttgtgagcagaatacgaattcagggcaacaaattgtttcatcaggctctcaaaaagatgacaactctggttcaactgaggaagttcctcattgcgacgttcgatgttcatctcagcaaagatctaaagtgccaggcttacagaggaatattaaagtactagaatctgaactactgaaattcattgcagaacatggacaggaaggatttatgccaatgaggaagcaactccgtttgcatggaagagtggatattgagaaggctataactcgcatgggtggattcagaaagattgcaaccatattgaacctttctttggcttacaaacaccggaaacctaagggttactgggacaatcttgaaaatttgcaggaagagataagtcggtttcaaaggagctggggcatagacccttcatttatgcccagtagaaagtcatttgaacgtgcagggcgatatgatattgcacgtgcactggaaaagtggggtggactacacgaggtttctcgccttctgtcgctcaaggtaagacaacggagcagacaggacaaccttgctaaggataagaggagtgatcatacagatagtgaaatgaagacaccatgtattcctcaagacacacaaaagtggcttacaaaactaaaacagtttgacatgaattggtttgagtaa

SEQ ID NO: 1032 - DNA, 834 bp, Glycine max var. Williams 82
atgtcaggtgtgtctctagcagtgtctcatccaccggcatcagtgggagaacaaaacgtgcctcaagcaggcacaaagcctaaaccgcgaacagaacaggcaccaattggtggcatgatgggttcacttcgcgtgatagagcttcagcttgtcgctttcatcttggtgttctcagcaagtggccttgtcccactccttgacctagtgttccctgcacttgcctctgcatacatcttggcactctcgctattcgcatttccatcgtcatcttcttcttcaacgcgttcgttacacgactcggggactgagatcttcaaagggggcagattgttccgaatgtatgtcgttgttgggatcactgtgggactcttcttgccgctggcttacgtgcttggagggtttgcaagaggggatgagcatgctgttcgttctgccaccccgcacttgttcttgctgtcgtttcagatacttactgagaacatcatcggtgggttgtctatgttttccccaccggtgagggcgttggtgccgatgatctatacagtgcggaggatctttgtggatattgattggattcatgatgtctggctcaacaagactctgcctgtcaatgccacatttcaggacctggcatggtattggttcgggaagggtctggcagtggcaaatctggcttatttctccatcaatctgtttgggttcttgatacccaggttccttccaagagcttttgagaggtatttccaagacaagggagagatctatgctaagtctgcagaggataaaagacctgtggttgtcaacaaaactcaattatcagaaaagaaagattaa

SEQ ID NO: 1033 - DNA, 1461 bp, Glycine max var. Williams 82
atggttgaaaaatcttccagaaccaaccttggccaccatcaagattttggcatggaggcttactccatagatggtgtttcttcacaaagtgagtccaaattctacgatgatgatggtcatgttaaacgaacagggaacgtttggactacaagctcgcacataataacagcagtggtgggttctggggtgctgtctttggcatgggccatggctcaaatgggttgggttgctgggcctgtagttatgatcttcttcagtgctgttacgttgtatacgacgtcgcttctggctgattgttatcggtgcggtgaccccgttacggggaagagaaactatactttcatggatgcagttcaatccattcttggcgggtattatgatacgttttgtggggtagttcagtactcaaatctttacggaaccgctgtaggatacacaattgcagcttctattagcatgatggcgataaaaaggtccaactgtttccattcttcaggcgtaaaaaatccatgtcacgtttcaagcaacccatacatgatcggttttggcataatccaaattttattttctcaaattccagattttcataaaacatggtggctctccatagttgcagcaatcatgtcatttgcctattccacaattggcctcgctcttggaattgctaaagttgcagaaacgggtactttcaagggtagtctcacaggagtaaggattggaactgtgactgaggccacaaaagtatggggggttttccaaggtcttggtgacatagcctttgcctactcatattctcaaatcctcattgaaattcaggacaccataaaatcaccaccatctgaagcaaagacaatgaagaagtctgctaagataagtattggagtaaccacaacattttatatgctttgtggcttcatgggctatgctgcttttggagattcagctcctgggaacctgctcacaggatttggtttttttaacccatattggctcatagatattgccaatgctgctatcgtaattcaccttgtgggagcataccaagtttatgcccagccactctttgcctttgtggagaaatgggcttcaaaaagatggcccgaagttgacacggaatacaaagttccaattcctggtttttcaccttacaatctaagcccatttagattagtttggagaacggtgtttgttatcataaccactattgtagcaatgttaattccattcttcaatgacgttttgggacttcttggagcactggggttttggcctttaagtgtttttctcccagtgcagatgagtatcaaacaaaagaggacccctaggtggagtagtagatggattggtatgcaaatcttaagtgttgtttgtctcatagtatcagttgcagctgctgttggctcagttgccagtatcgtgcttgacctacagaaatacaaaccgtttcatgtagactattaa

SEQ ID NO: 1034 - DNA, 2007 bp, Glycine max var. Williams 82
atgctgatctctgatgaaggagatagtgatttgttctttgactcagtggattgtttctcaccaacccgagagtctcttttgacaaaacaagagtttggctatgagatttgggtgaatgagcctgtgagtgtgatggaaagaagggaaaagtttttgcaggggttgggattgggtgatggatcatcttccaaggtttgttctcaagagaataatatgatgagttctgatgattcatcagtgagattgggactagagaggatcagggatagtggggcagcttcaaatgcttgtagttgtattttgcctgatgatcaagtttctgagttggttctctcgggcagcgaagccacttctgaggcacaagccttgtttgatgaacataagggatgccccaaagatgaatcatgttttgaagggaaggtttatgaggtttcttgtacagatcaagaggttagacatagaaaagtcgaggttccagaaaagtgtcttggttttgatatgggtgaaaaggagaagaaaaactggtggaagcactttataagcagcaagaaaggaggtggaggtaaattcagatcaaaattgaattcaacgacaaataaaactcgaagaataaatgtaaggcagaataagaagaggtggatggagttcagtgcactgtatattggacaagagattagagctcacgaaggcctaatttggactatgaaatttagtcccaatggccaatatctagctagtggaggagaagatggtgtcatacgcatatggcgtgtaaaaacactgaatacatctagtatttgcttgaatgcagaagacagtgcagctagcaaagtgaaacatgacttctctagttctcagaagaaacactcaagccaatcatccttcatcgttcttccaaataagattttcaaaatcgaggaatcaccgttgcatgaattttatggtcatgcaagtgatgtcttggatttggcttggtccagttcagatactctcctttcatcttcttcggataaaactgttcgcttgtggaaaattggttgtagtcaatgtctaagtgttttctatcacaaagactatgtgacttgtattcaattcaatcccgttgatgaaaattacttcatcagtggttccatagatggcaaagttcgaatatgggggatacatgaagaacgagttgttgactgggcagacataagagatgtgataagtgctataagttaccgaccagatgcaaaagggtttgtagtcggttccctcacaggcacttgccgtttttatgttgcctcaggcaaatatttccagcttgagacgaagattcgtgtcaatggaaagaagagaacatctggcaacaagattacaggcattcagttttctcagaaaaaccatcagagagttatgattacatctgacgattccaaagttagaatattggaaggcattgaacttgttcagacatataaaggcctttcaagatccggaagccagatgtctggttcatttacctctggtggagaacatataatttcagttggaggggactctcgggtgtatatttggaacttcaatgactcgggaaatgcctcttccaaacagacaaaatccaattattcctgtgagcactttggctctgagggggttactattgcaataccttggtctggcatgagtgcagaagaacgaagtggctcttccaatgattttacccactattcttcacaacaccaactagaggcctctcatggtgttagggagtcggaacgattttctttcggaagttggttctcgattgatggttcatgccgcggttcagtcacatggcccgaggagaagcttccaagttgggatctacctcttgtagaagttgaatttgatcaccagaagctatgtaccaaagatccttcccatgaaaaacatgtatcagaaacatggggactatccattgtggcagctggttgtgatggaaccatcaagacattccacaactttggacttcccattaggctttag

SEQ ID NO: 1035 - DNA, 657 bp, Glycine max var. Williams 82
atggtgccgaaacccattttgtgtgtaacccttttgtcattaataatttctctgaccactctttccttggttgccgccgatcccacatatggcttcacccgtcttccactaagtaactcaaacttccaagtccaaaggccttacgacgttccagtcagccaacgctacagcttttcaaatggagtgcacagatttttggtatactcctcggacaagcctcacatgcaaggcagtgcaacggagccacgaactgagattcgtatcactggatacgattatacatctggtgtgtggcaatttgaagggtatttttacgtgccaagtggcacaaccgggacgtgcatccaacaagtgtttggtggagtatcctcagccacaacctcgcagagtagagtctatggtggttctctcactcattaccaatcgattacactggaacaaaacatctacaataggtggattcggtttaacgtgatccatgatgtgggtgctaacaacgtgaagatttatattaatggggggaatgctcccaggtacaatggacctggccgtggagctagcactcactacttcaagtttggggtttatgcacaacctggtgctgcttccaactacatggaatctcaatggcgggatatcaagattttaagaaaatag

SEQ ID NO: 1036 - DNA, 846 bp, Glycine max var. Williams 82
atgatgaacaaccctgcattattgtcaaggctgtttccgggtatcaatagggagagggagatgtctgccatggtctcagctttgacccacgttgtctccggagaggttccaaccggtgattcttcttcagttcttcatcatcaacctcatgatgatgatgctgttactgttaaaccaaacatgccttctacaacacccttttcatctacttatgttgttgccacctcttctctcaagagaagtagacaacatgatacatatacaccatccttctcacatccaccttcatcattccctgctatgccaacaagtgcagaatgttcaaagagtggaatgggaaatgctgtgtacgaatacagaacaagaggaacagagaatgtaaagaaggaggagggaaggagaaaatatagaggggtgaggcagaggccgtggggaaaatgggcagcggagataagagacccattcaaagcagcaagagtatggttaggaacatttgagacggcagaggcagcagctagagcctacgatgaagctgcccttcgttttaggggcagcaaggccaaactcaacttccccgagaatgtcactctccgacaacctcaattcactgtttccacatcaacagacccatttcaactctcgggtaccaacctttatgatcataggatgtttctgacttctaataccatggcttctcatcatcttcaatcttctttgccgctgccaccagcaacctcctcttctctaacttctcctcctcagaacatcacttcactttcttccttgtattctgcccagttgcccccatggtcggcctctggtcatagctcttcttcctccccatga

SEQ ID NO: 1037 - DNA, 1503 bp, Glycine max var. Williams 82
atggccagatatgaattcgtggaagggtggccaaagtggttgctcgataatatccctgcaaatgttttggctaatattgttcccaagagtgctgattcctatgaaaaacttgccaagataggacgtggaacatatagcaacgtgtacaaagctagagaaaagggcacaagaaagattgttgctttgaagaaggtaaggtttgacacgtcggattctgaaagcatcaagtttatggcaagagagatcatgatgctgcagatgctggatcatcccaatgtgatcaaacttaaaggactagcaacatcaaggatgcaatacagtctttatctagtttttgacttcatgcagtctgatctcacccgcattatctcgcgacccggggagaaactcaccgaagcacagatcaagtgctatatgcagcagctactttctggcctgcagcactgtcatgagaagggaataatgcaccgagatattaaggcttctaacttgttaatagacagaaatggggtgctgaaaattgcagattttgggcttgcaacttccattgaagctgaagggcctctaacaaatagagtggtgacactttggtatagggcaccagaacttcttttgggttcaaccgattatggatatagcattgatctctggagtgcagggtgcttgttggctgagatgtttgttggaagaccaattatgcctggcaggacagaggttgaacagattcacatgatattcaaactgtgtggttctccttcaccggattattttaaaaaactgaagctaacaacaagctaccggcctacacaacattacaaacctagtttccatgaaaacttccagaagtttccttcctcttccctgggtctcttggctacatttcttgatctcaaccctgcccatcgtggtaatgctgcctctgctctccaaagtgatttcttcaaatgtagtccattagcatgtgacccttcagctttgccagtaatccccaaagacgaggatgaacgcttacaaactaagagaggcaaaaggcaaagggtttctaaaagagagcaatcatctcaaacaagtagaagtgatgctagtcagtcagaaaagaaccaaattgctgaacaaccccgtgaagacacagaatcgtcaaaagagaataatatggaacaacacaagcagggtcaagaaacggggcatagtgccagcagcacatcatccggttcaagactcttcatgatgaccgaagggagcatgaatgcatctatgtccccagtttttctctctagtggtagtgtcagaaaatcccccaaaactgagggccaccctaatgctcttaagaacataatgaactatagtgctctcttacaacaggcctctataattgatatgatcaaccgcaatgaaggcaaagaattccctcagcttcgtaaatccttctccgcgttggattttcgacttgattctgacaagctattatcaaatctctatgccttacataataaacatatttaa

SEQ ID NO: 1038 - DNA, 591 bp, Glycine max var. Williams 82
atggattactattttggaaaccctaatcctaaaccttatgataaccgtcactctgccgtagtgaacacggaatctccttcctccgagttcatgctatctgattatctcgtgttggaagatgctgtcgataatcaagagtcttggtcacaaagcactgaaactgaatcatcggagaaaggaaactccagcgatgtcagtcatgggtttggtgatgcaaccttcagcaacaccaacatgcatataaagtgcgaaaataatgggataaagcgaaagaaggaagaagtgagtcaaatgatcacgtttagaaccagatcgcagcttgaggttatggatgatggatataaatggaggaaatacggaaagaagacagtgaagaacaatcccaacccaaggaactactacaagtgttcaggtgaaggatgcaatgtgaagaaaagggtggaaagagacagggatgactcgaactatgttttaacaacgtacgacggtgtccacaatcatgagagcccgtcgactgcctactacagccaaattcccttggtgcattctaaccatgattggccccagctgcacccttctgcaaactcatga

SEQ ID NO: 1039 - DNA, 1797 bp, Glycine max var. Williams 82
atggaggctgaaaggcccccacttccacaacacaactctcacacaaacaagaagcccttctctcgactaaaccaatacgtagccacaaccagagttgggaaatggttcaagctctcccaacgcaactccaccttcaccaccgagctccgtgccggcaccgccaccttcctcaccatggcctacatcctcgccgtcaacgcctccatcctctccgactccggcggcacctgctccgtctccgattgcgtccctctctgctccgacccatccacccctctctccgcctgctcaggcccatccctccgcgtcatccagcccgacgtctcatgcaaattcagcccagttaacccgggctacgcggcctgcctcgaaaacacgcgcaaggacttaatcgtggccactatagcctcctccctcattggctgcttcatcatgggcaccttcgcgaacctccctttgggcctcgccccgggcatgggctctaacgcgtattttgcttacaccgtcgtgggcttccacggctccggcaacgtctcctaccaaagcgccctcgccgcagtcttcatcgaaggaacaatcttcctcctcgtctcggcaatcgggcttcgcgccaagctcgccaaactcgtccccaagcccgtgagaataagctcctcggccggaatcgggtttttcttagccttcatcgggcttcaaaacaaccaaggtatcgggctcatcgggtacagcccatccaccttagtcaccctcggcgcctgtccaagctcctcacgtgcctccctctcacccgtcttaacggcggctaacggcaccgttagtttactacccggcgggagcgtctcgggtgatatcctctgcctgaaagacaggatggaaagcccaaccctctggctgggcctcgtgggcttcgttataatcgcgtactgtctggcgaagaacatcaaaggcgcgatgatatacggcatcgttttcgtcacggttgtgtcgtggttccgtggcaccaaagtgacggcgtttccgaacacggacgcgggtaactccgcgcacgagtacttgaagaaggtggtggatgttcacacgataaaaaccactgcaggggcactgagcttcaagaacattggaaaagggtatttttgggaggccgtggtgactttcttgtacgttgacattctcgacacgacaggaacgttgtactccatggcgcgtttcgcgggcttcaccgacgagaagggggacttcgagggacagtacttcgccttcatgtcggacgccacgtcgatcgtggtgggctccttgctcggaacctcgccggtgacagcgtttatcgagtcgtcaacggggatcagggagggtgggagaacggggatcacggcgttgacggtggcggcgtatttctttttagcgtttttcttcacgccgttgctggcgtcgataccggcgtgggcggtggggccgccgttgattctggtgggggttttgatgatgagatcggtggtggagattgattgggaggacatgagagaagcgataccggcgttcgtgacgctcattctgatgccgttgacgtattcgattgcttatgggcttattggtgggattgggacatacattgtgttgaacctttgggattggggatgggagggtttggggcactttgggcttgggaagaaaacaactacagcagcagcaatggcttcggatgaggattcccatcatcatcatggggtcaatgggatactacaaaatcaacattctccacaaaatccaactgctaaagcactacaactagagccttag

SEQ ID NO: 1040 - DNA, 753 bp, Glycine max var. Williams 82
atggtcattgcagcaacccctcttctcttctttcttcttaatttatgcctaagaggcacttatgctgactatggaggtggatggcaaggtggtcatgctacattttatggtgggggtgatgcatctggcacaatgggaggggcttgtggttatggaaatttgtacagccaaggctatggaaccaacactgcagcactcagcactgctctattcaacaatggcatgagctgcgggtcttgctatgagatgaaatgtgacactgaccccaaatggtgcctccccggtagcataatcgtcactgccacaaacttctgcccccctaactttgcattggctaataacaatggtggttggtgcaaccctcctttgcaacacttcgatcttgctgagcctgctttcttgcaaattgctcagtacaaagctggaattgttcctgtttccttcagaagagtcccctgtgtgaagaaaggagggatcaggttcaccatcaatggtcactcttacttcaacttggttctcatcacaaatgttggtggagcaggagatgttcattctgtgtccatcaaaggctcaaggactgggtggcaaaccatgtctagaaactgggggcagaattggcaaagcaattcttacctcaatgggcaaagcctctcttttcaggtcactacaagtgatggcaggactctcactagcaacaacattgtgcctgctaactggcaatttggacaaacatttgaaggggcacagttctag

SEQ ID NO: 1041 - DNA, 1169 bp, Glycine max var. Williams 82
taagcctctcctactatctttaaatccttttgtaccctcaacttccctaagcactagcaccacacaatggtcattgcagcaacccctcttctcttctttcttcttaatttatgcctaagaggcacttatgctgactatggaggtggatggcaaggtggtcatgctacattttatggtgggggtgatgcatctggcacaatgggaggggcttgtggttatggaaatttgtacagccaaggctatggaaccaacactgcagcactcagcactgctctattcaacaatggcatgagctgcgggtcttgctatgagatgaaatgtgacactgaccccaaatggtgcctccccggtagcataatcgtcactgccacaaacttctgcccccctaactttgcattggctaataacaatggtggttggtgcaaccctcctttgcaacacttcgatcttgctgagcctgctttcttgcaaattgctcagtacaaagctggaattgttcctgtttccttcagaagagtcccctgtgtgaagaaaggagggatcaggttcaccatcaatggtcactcttacttcaacttggttctcatcacaaatgttggtggagcaggagatgttcattctgtgtccatcaaaggctcaaggactgggtggcaaaccatgtctagaaactgggggcagaattggcaaagcaattcttacctcaatgggcaaagcctctcttttcaggtcactacaagtgatggcaggactctcactagcaacaacattgtgcctgctaactggcaatttggacaaacatttgaaggggcacagttctaggaaccataataatttttaagttcacattttgtgtgtaatatatgatggcattgttcacttgtttttgttatagttggaaagggtggggaaagagaagaaaaggtagattagtaggagtttcaggccaacatggcccctaatgctgtggtggctatatggcacccgctaggactaatataatataacgtctttaattttatatctgtcacattgatcgatgccttttgatgaactaaaaggtgttgatgatctcaattgccttgtattttttatcccccacaatggtacaaaaaccaatttgggggccatttaatatcaagttgaatatgctttctgattacaggtctttt

SEQ ID NO: 1042 - DNA, 441 bp, Glycine max var. Williams 82
atggctgcaagttcttcttcaaattgggtcatggaaagtggtgatgttcctcatgttttggccgttgatgacaaccttattgatcgcaaactcgttgagaaactcctgaggaattcttcttgcaaagttacaactgcagaaaatgggccaagggcattggagttattgggcttgacaagtggtggacagaacaacatgaacggtagatccaaagtaaatatgataatcacagactattgcatgccagggatgacaggctacgagctacttaagaaaattaaggaatcgtctgtaatgaaggaggttccagtagtgatcatgtcatctgagaacataccaacacggattaacaagtgtctggaagaaggagctcagatgttcatcctaaagcccctcaaacaatctgatgtaagaaaactgacatgtcagttaatgaattga

SEQ ID NO: 1043 - DNA, 237 bp, Glycine max var. Williams 82
atggatcaacaagttgagaggcagaagcgtagcaaggagatgaagaggaagagtagtagtaaagtgaacaagcgcaacaagttaatgatatgttgtcgttgcccctgtcgtgcagcaacgtgcatgttccgaggtatagggaggtgcatgtttgtcacatgttaccctgttgtgcagtgcttgggcttggatgaacatagacatcgccaccatcattgcaagcactttgattggtga

SEQ ID NO: 1044 - DNA, 1677 bp, Glycine max var. Williams 82
atggaacatgtgcactatcacttggtaatgaaggaggaggaacaacaacaacaacaactgcaagataatgctgctttgaaaggaaggcaatccctgcaacatgggaaggttcatagtagtattgtcactgctgtgccaccttcctttctttcattggaaaaacaacctcttcttcagaaggaggaattatttcatactcaaaaagaacagaaagaacaacctactcagaaagttgaagaaacaagcaatgttgttgctgaaaatgacaataacttgaacggtgaaagtgaaacagctgggcttggaagcatagatgagtttgtagaaaatgcagtgaatggagaggctaaaagaagcgctaccataaatgttgatgcatcgcagaataagaatagtgtttactttgacaaacaacaaggcaatgatattgatggtgcaaactctattcttccaaaaaatcttggggagggagactttgatgcacgggttgaaaattctgacattcaatgtaatccatgcaatgaagtcaacaatcaatgcatggaaactgttgatgaaaaagaacctttacttaattcatctgaaatactggctgcaactgtagacaattgtggtgatgaaaacagtgcaaaagtatatcctaacttgggagaagaaatagaccagcaactaaaagactacgatgttgaggcagtgttggcaaaacaagagacacatgacttgttttgtcctaattgcaaatcttgcattactaaaagggttatcctccggaagagaaaaaggagtactattcctattcctaatttagacaccaaagcaaagcgtgacaagtcagccactgaggtggttaatggttccatagacgtaaccaatcaaggtgatgagacaattgcaacacctgatgttggtagagtagagacacctgctgataattatgaacctgaaagagaaccagaagtgttcagatgtttatcatgcttcagcttctttattcctatgagaaatggaatcaaactgttccccagttttggtggtacccgtgagcctgaaacttcacaaaaacctttggtcacaccttcatccaatgtggaagatccttcaatcgtagtagcggcttccaatgcaaattggttcttcaatctgtttacttcaatcaagggaagaaaagatagtgcgcaagttgatgcttcaattgaagattctagaacagatcctgcttcaattgaagattctagagttgataatccagaaagtccacttgctaatacagctataagtcagagtgtgaatctgtcagcagatattaagcctggacatggaggtgtaaattcttcaattccctcaatacttaagtcggtaataaagattgaatcatggatagaaaaaagcaagaaatccaatgtggcattgcagaatgagccattggttgatcagaatgattcctgggatttttcagcaaaggaacagcttctgactgaaaatgttaaaaccgatgtgggagacaaaaatcgtgattcagtggttgggataaagacagatactgttgcagatatatccaagcgtgatagtgttttattaacaactgttgctaccactgaaaatgtgagaaccgatttgggagagaaaaatcgtgatccagtggaggtgataaagacaggcaggaaaggtattaattga

SEQ ID NO: 1045 - DNA, 201 bp, Glycine max var. Williams 82
atggccctcctcctcttccgtgcctccaaattgatgtcatttgctgctcttttagcaatacttttactgcttatgtcctccacaatgggaagtgctgctcagcctagttttaagctcgtgcgaaagcttctccaaactaaatacccgcctgcttatcctggatatcctggtggtggaggatatagcccaaaaacaccatga

SEQ ID NO: 1046 - DNA, 2982 bp, Glycine max var. Williams 82
atgatctacaatattcgacatattttgctcctatttttcttacttcataattttcatgacatactatgcaacaatgacacagacaaagatgtccttctttcattcaaatcccaagtgagtgaccccaaaaatgttctgtctgggtggtcttcagattccaatcactgcacctggtatggtgtcacatgctccaaagttggcaagagggtccaatctctcactctaccaggacttgccctctctggcaaacttcccgctcgtctttccaacctcacttacctacactcccttgacctttccaacaactattttcatggccaaatacccctagaattcggccatctcctacttctcaatgtcattgaattaccttacaacaatctcagtggtacacttccaccacagctgggtaatcttcaccgtctacaaattttagacttttcagtcaataatctcacaggtaaaattcctccatcatttggcaatctctcttctcttaaaaaattttccttggcaaggaacggtttggggggtgagattccaactgaacttggtaatctccacaatctttccactcttcaactctctgagaacaatttctctggcgagtttccctcttctatcttcaacatctcttccttggtcttcttatccgtgacaagcaacaatttatcaggcaagttaacacaaaattttggaactgatcttccaaatatagaaaatctatttctggctagcaatagattcgaaggggtaattcctaattccatatccaatgcctcacatcttcaatacattgaccttgctcacaataaatttcacggttccatacctctattccacaacttgaaaaaccttaccaaactcattcttggtaataactttttcacttccacgacctcactgaattctaagttctttgaatcccttagaaactccaccatgttgcaaattctgatgatcaatgataaccatttgactgggggccttccaagctctgttgctaatctgtctggcaatcttcaacaattctgtgttgctaacaatttgctagctggtacccttcctcaaggaatggagaaatttaaaaatcttatatccttgtcttttgaaaacaattctttcactggagagttaccatcagaaataggagcactacataatctagagcgacttgcaatatacagcaacagattgtcaggggaaattccagacatttttggcaatttcacaaatatgtttttccttgcaatgggaaataatcagttctcgggtagaatttacccaagtattggacaatgcaagagattaacttttcttgacttgggaatgaatcggctaggtgggtccataccagaggagatttttcagctttctggtttaacagccttgtatttagaaggaaactctctgcatggttcgcttcctcatgaggtcaaaatcatgacacagcttgagaccatggtcctctctggcaaccagttgtcagggaatatttctaaggaaatagagggtttgtctagcttgaagtggcttctgatggcaggaaacaaattcaatggttcaatcccaaccaatctagggaatttagcatcccttgagactttggatttatcatcaaacaatctcaccggtcctattcctcaaagtttagaaaagctccagtatatacagacattaaatttgtctttcaaccatttggaaggggaggttccaatgaaaggtgtttttatgaaccttaccaagtttgatcttcgaggtaacaaccaactgtgcagccttaacaaggaaatagtgcagaatttgggagttctcctgtgcgttgttggcaaaaagaaaagaaatagcttactccacatcatccttccagttgttggtgctactgctttgttcatttcaatgctcgttgtgttttgcacaatcaagaagaaaagaaaggagacgaaaatcagtgcgtcattgacccctctcagagggttgcctcaaaacatatcttatgctgatattctgattgccacaaacaattttgcagctgaaaacttgattggaaaaggaggctttggctcagtgtacaagggtgcgttcaggttcagcactggtgaaaccgccacccttgctgtcaaagtcctggatctgcaacaaagcaaagcttctcagagtttcagttctgaatgtcaagctttaaaaaatgttcgacaccgaaacctagtgaaggttatcacttcttgctccagccttgattataagggagaggaattcaaggcccttgttatggaattcatgcccaatggtaacttggacgtgagtctataccccgaagatgttgagtcaggatcctctctaaccttgttgcaaagattgaacattgccattgatgttgcctctgctatggactacttgcaccatgactgtaatccaccggtagtgcattgtgatatgaaacctgccaatgtccttctagatgaaaatatggtagcacatgttgcagattttggattggcaaggtttctatctcaaagtacatcagagatgcagagtagcactctaggactgaaaggatcaataggctatattgcccctgaatatggtctaggagccaaggcttcaactcggggcgatgtgtatagttttgggatcctactgctagagatgttcacagccaaaagaccaactgatgaaatcttcaaagaaggattaagcctaagcaaatttgtctcagccatggatgagaatgaagtactaaaggttgccgatcgaagtcttattgttgattatgaatattcaactcaaagctctatcaccggtgatcaaagcagtggcattggcagcaacacacattggattcgtaaagctgaggagtgcatagctggtgtgataagagttgggttgtgttgcacagctcaagaacctaaagatcgatggagcatgagagaggccataacaaaattgcaagcaattaagcactctatgttggccttgtga

SEQ ID NO: 1047 - DNA, 969 bp, Glycine max var. Williams 82
atgttgttcacgctttcattaccactcctcaactcagctttcgacctcatcaccgtaatcttcatctccgggttaataatcctctccgttttgtccctatgcttcatcttccaccttcgcttcaaatcaaaatccatcacacacttacaaggcttcaactcgctctggaccgtacggttcctccttgtgttattcatattcttatggtccatcaccgaacttctccggttacctttttttcgccgaaaatatctgtacccttttgtaccctcttttagtatatcccaacaagccaacctctgcaaagtccacatcgtactctccctcggattcttcgaacccgcgttcctcgtaaccctattattccttctcaatgcttcgataaaaaggaagacaccgaataatgacaagtgggccatcacgtccgtgctcctcacgtgcctccccgttgcgacgctccaagcattgctcatattcttcgcccctttcaagaaccgtgtgccggcggaaagctcggtggttctgaacgacggttacggcttcgagaccgtgctctgcgcgtacccttttctgagtagtgttctttttgcggtgtttggtgttgcgtactcgtcgtggttcttgttctcgtgttggagggttttgttgcttgtcatcaacaaaggcttgagggtgaggatttacgtgttggcttcgattgtgctcgtggcgattccgctgcagattgtgtctttagggttcagcgttctgtggagcccgcaccaggaggtttacggagttgtttcgctcgtggggttcctcgccgcgttcggctgcgccaccgccggggagggcattctcgtcattaagcctatctccgatgcgttggacgctgggggaaactgttgcgtgtcgaccccgcagccgggggcaaggcaaagtgaagaaaccgaagaatcaggtgtcgtcgttcgtttggagggagggtaa

SEQ ID NO: 1048 - DNA, 1443 bp, Glycine max var. Williams 82
atgatttctcaaattagcatgctttcccttttcttcttcctcttctcctcttttctaatcgttttcttcttccgcaaaacctctgcacttcacatcctcaaccaatggttcctttccttcgaaaaccgtctccaccttcaccagtccttcaaaatccctcgctataatcttcactctctggacaatagcctctaccggaaaatcctcacttacctcgattctcttccctccgttgaagattccgattacaccaacctcttctccggccccaatccctccgacatcttcctccacctcgaccctaaccacaccgttcatgacaccttcctcggcgccaggctctcctggaccaacgcctccggcgacgcgctcgtccttcgactaaagaagaaagacaagcgcagagtcttccggcagtacttccagcacattctctccgtcgcggacgagatcgagcaacgaagaaaaaaggacgtcaagctgtacgtgaactccgactccggcgagtggcgctcggcgccgttcacgcatccggcgagctttgagacggtggcgatggacgcggagctgaagaacaaggtgaagtccgatctggaccagttcctgaagtcgaagcagtactaccaccggctaggccgcgtttggaagcggagctacctcctctacggcgcgcctggcaccggaaaatcctccttcgtcgccgcgatggcgaagttcctctgctacgacgtctacgacgtggacgtttcgaagttcaccgatggcgccgattggaaggtgatgctgatgcagacgacggcgaagtctctgatcgtgatcgaagacctagatcgcttgctgacggagaagtcaaagtcaaacacaacgagcttatcgagcgtgttgaacttcatggacggaatcgtatcgtgctgcggagaagagcgcgtgatggtgttcacgatgaacgaaactaaagaggaggttgatcaagcggttctgaggcctgggaggattgacgtgcacatacacttccccttatgtgatttctccacctttaagattctcgcgagtagttacttagggttgaaggagcacaagcttttccctcaggttgaggaggtttttcagaccggggcccggctcagcccggccgagcttggtgagattatgatatcgaaccggaattcgcccacgcgggccttgaaaaccgttatttcggccctgcaggtgcaatccaacggcccgagagagggacagaggttgagccatagcgggtcgggtcggaatagcgatgataacgaaccgggtgcggttatatgtagggagagtgttcacacggtgagggagttccggaagctgtatgggcttttgcgtttgggaagtaggaggaaggaggagtcttattcggggcccatagagaaagagcctccacgtattgagagtcgggtcggatataactaa

SEQ ID NO: 1049 - DNA, 6576 bp, Glycine max var. Williams 82
atgtcgtgttctctctcgttttcaaggctttcggctcggtcagcgagaactcttccgcgcgaaaacgagaagccacgtctcaacgcacgatgtcccgtgagagtgacgaagtttctgggaacgcggctgcgttcgagtgggaggagcctccgttcggagagatttcacgtttggcagtcggagggtccgggtcggacgccgaagctcagggtcgcagttcggtcggctctttccgccgtgccgaacaagccgctcgggctttacgatccggctatggacaaggactcgtgcggagtgggattcgtggcagaactgtccggcgaaagtagccgccaaacggtgaccgatgctttggagatgctggtgcgcatgacgcacagaggtgcttgcgggtgtgaagccaacactggagatggagcagggatcatggtcgctctacctcaccagttttacaaggaggttgtggattttgagcttccgccaccaggaaaatatgcagttggcatgcttttcttgcctacatccaatagtcgcagggaagagagcaaaaatgtatttcaaaaggttgccgaatctctggggcattctgttcttggttggcgttctgtgcccacagataacacaggattgggcaaatcggccgtgctaactgaaccagtgattgaacaagtgtttcttactccaagtactcagtcaaaagttgatttggaaagacagatgtatatattaaggaagctgtccatggttgctatatcatctgcattaaacctcgataatgatggcattatagatttctatatctgttcgctttcatcaaggactgttgtttacaaaggtcagttaacaccagctcagttgaaggattactattttgcagaccttggcaatgaaaggtttacgagctacatggccctgatacattcacgattttctacaaatacttttcctagttgggatcgtgctcaacctatgcgtgtattgggccacaatggagaaatcaacacacttagagggaatgtaaactggatgaaggcacgcgagggcctactgaagtgcaaggagcttggtctatccgagaatgagttaaagaagcttttgcctattgtggatgcaaattcatctgattcaggagcttttgatggtgtgcttgagtttttgattcagtctggaaaaagtctccctgaagctgttatgttgatgattcctgaagcatggcaaaatgacaacaacatggatcctcagcgtaaagcattttatgaatacttctcagctctcatggagccatgggatgggccagctcttatagcatttactgatgggcactatcttggagcaaccttggacaggaatgggctgcgaccaggccgcttttatgtcacccacagtggacgagttgtaatggcgagtgaagttggggttgtagacattcctcttgaagacgtgagtcagaaaggaagactaaatcctggcatgatgcttctagtggattttgagaagcatattgttgtgaatgatgatgccttaaaggaacagtattcattggcaaggccatatggggaatggctcaaaaagcagaagttagaactcaaagacatagttgattctgttcatgaatctgaaagagttcctccatcaataacaggagtgatgccagcatctggtgatgatgtggatatggaaaatatgggaattcatggtttactggctccattgaaagcttttggatataccgtcgaatccttggaaatgttgttacttcccatggcaaaagatggtacggaagcccttgggtcaatgggaaatgatactccattagccatcatgtctaatagagaaaaactcacttttgagtactttaagcaaatgtttgcccaagtgacaaacccaccgattgatcctattcgagagaaaatagtcacgtccacagaatgtatggttggtccagaaggtgacttaacagaaatcactgaggaacagtgccaccgtctttccctaaaaggtccccttttatccattgaggaaatggaagccattaaaaaaatgaattacaggggatggcggagcaaagttatagatataacatactcaaagggccgtggtaagaaagggttggaggaagccttggacaggatatgtgcagaagcacatgatgcaattagtgatggctacactacccttgtgctgtctgatagagctttctcaaggaaacgtgttgctgtgagctccctgctggctgttggtgctgtccatcaacatctagtgaaaacacttgagcgtactagagttgccttagtaatagaatctgccgagccacgtgaagtgcaccatttctgcacacttgttggcttcggtgctgatgctatatgtccatatttggctgtagaggcaatttggcgactacaggttgatggaaagatcccaccaaaagcaaatggtgaattctactcaaaagatgagctggttaagaagtacttcaaagcaagcaactatggaatgatgaaggtgcttgcgaagatgggaatatccactttggcctcttacaaaggtgctcagatttttgaagctctgggtctttcatcagaagtgattgaaaggtgctttgctggaaccccaagtcgagttgagggtgcaacatttaagatgcttgctcgtgatgctcttcaattgcatggattagcatttccttctcgggttttctctcctggaagtgctgaagcaaaggcattaccaaatcctggggattatcattggagaaaaggtggggaaattcacttgaatgatccacttgcaatatcaaagcttcaagaggctgccagaactaacagcatagatgcatataaacagtactctaagctcattcacgagttaaataaagcttgcaatttgcggggacttctgaaatttaaagaggcagctgtgaaagttccccttgatgaagtagaacctgctagtgagattgttaaacggttttgcactggtgccatgagttatgggtctatatcattggaggcacacacagcattggcaactgctatgaataagattggagggaaatcgaacacaggtgagggaggtgagcagccatctcgtatggagcctctttctgatggctcaaagaacccgaaaaggagtgctattaagcaggttgctagtgggagatttggagttacaagttactatcttacaaatgctgatgaattgcagataaagatggcccagggagcaaaacctggtgagggtggcgaacttcccggccacaaggttgtaggagacattgctgtcacaaggaattcaacccctggtgtaggacttatcagcccacctcctcatcatgatatttactccattgaagatcttgcccaactaattcatgatctaaagaatgccaaccctgctgctcgagttagtgtgaagttggtatctgaagctggagttggtgtagttgccagtggagttgttaaaggccatgctgatcatgtcttgatctctggccacgacggaggtacaggggcgtccagatggactggcataaagaatgctggtctcccttgggaacttggcttggctgagacccatcaaactttggttgctaatgacctccggggtcgcactgttctccaaactgatgggcaaattaaaacaggaagagatgtggccatagccactcttcttggtgccgaagagtttggtttcagtacagctccactcattactcttggttgcatcatgatgcgcaagtgtcacaagaatacctgccctgttggcattgctacccaagatccagtactaagagaaaagtttgctggagaacctgagcatgtcattaacttttttttcatgatagcagaagaaatgagagaaattatgtcccagcttgggtttcgtactgtcaatgagatggttggccgttcagatatgctcgaagttgataaggaagtaattaaaagtaatgagaaactagagaacattgacctctctttattgcttagacctgcagctgaactgcgaccagaagctgctcaatactgtgttcaaaaacaagatcatggtttggacatggcattggataataagcttataggtctgtccaatgctgctttggtaaagggtctcccggtatacattgaaagtccaatccataatgtaaaccgtgcagtgggaactatgctaagccatgaggtgacaaaaaagtaccacttaaatggtcttcctactgacactattcatatcagatttaatggcagtgcaggccagagctttggcgcattcctttgtcctggcatcactttggaacttgaaggtgatggcaatgactatgttggtaaaggactgtcaggtggaaagattgtagtatttcctccaaaggggagtacctttgaccctaagcagaatattgtaattggtaatgtggctctatatggggccacatctggtgaggcatatttcaatgggatggcagctgaaaggttttgtgtgcgtaattctggagccaaggcagtagtggaaggtgttggcgatcatggatgtgagtacatgactggtgggatagtagttgtgcttggaaacacaggcagaaattttgctgcaggtatgagtggtgggattgcttacgttcttgatatggatggcaaattcctatctcggtgcaaccatgagcttgtagatctggataaggttgaagaggaagaggatattactactcttagaatgttgatacaacaacatcagcgccacacaaatagtgtgcttaccaaagaagtgctcgctgactttgagaatcttgttccaaaatttatcaaggtgttccccaaggagtataaacgagttttggcaagtattaaatcgaaggaagcttccaaagatgcagcggagtctgcttctaaacatggagaggagcaagatgaaattgaattggtggagaaagatgcttttgaagagcttaagaaactggctactgcatcggtgaatgggaagcctattgaggctgaatcattcaagaggcctagtcaagtcattgatcctgttaaacacagaggttttgttgcttatgagcgggaaggtgttcagtacagggatcccaatgctcgaataaatgactggaatgaagtgatgaaggaaacaaagcctggtccacttttgaaaacccaatcagcccgttgcatggactgtggtactcctttctgtcatcaggaaaactctgggtgccctcttggaaataaaataccagaatttaatgagttagtataccaaaataggtggcgtgaagcattagagaggcttcttgagacaaataacttcccagagtttactggtagggtatgcccagcaccttgtgaaggttcttgtgtccttggtattattgagaatccagtatctattaaaagcatagaatgtgctatcatagacaaagcttttgaggaggggtggatggtgccacgacctccagctaggagaactgggaaaagagtggccgttgttggaagtggaccgtctggcctggcagctgctgaccaactgaataaaatgggccatacagtaactgtgtatgaaagagctgataggattggagggcttatgatgtatggtgttcccaacatgaaagctgacaaagtggatatagttcaacggcgggtcaaccttatggcagaggagggaattaactttgtggtgaatgctaatatcgggcatgatcctttacattctctcgataggcttcgggaggaaaataatgctattgtcttggctgtaggagccacaaaaccaagggatctcccagtacctgggcgggagctgtcaggagttcattttgctatggagtttcttcatgcaaacactaaaagcttgcttgatagcaatctccaggatggtaacttcatttctgctaagggaaagaaagttgtggttattggtgggggtgacacgggcacagattgcatagggacatccattcggcatgggtgtagtagcattgtaaatctggaacttctccctcagccaccacaaactagggccccaggcaacccttggccacagtggcctcgcatataccgagtagattatgggcaccaagaaggtgcggcgaaatttgggaaagatccaagatcttatgaggtattgactaagcggtttgtgggagatgaaaatggagttgtgaagggacttgaagtaatacgtgttcgctgggagaaggatgaaactgggaggtttcaatttaaggaaattgagggctccgaggagattattgaggctgacctagttttactggccatgggattccttggccctgagtctacaattgcagagaagttgggtatagagcgagacaataggtcaaacttcaaggcagagtatggtcgcttctcaaccagtcttaaaggggtgtttgcagctggagattgtcgacgtggtcagtccttggtggtatgggcaatttcagagggacgacaagctgcagcacaagttgacagtttcctcacaaatgaagatttagagcacaatgttgccgggagtccagacgaacttatcaagaagaagcagcaaccaagggacactgtggcagtggcaaacaaacagtga

SEQ ID NO: 1050 - DNA, 525 bp, Glycine max var. Williams 82
atggcagagaccattcgcttgggtgttgctgttcttggcaatgcagcctcagttgccctttatgctgcaccaatggttacctttagaagagttataaggaagaaaagcacagaggagttttcatgctttccttacatcattggcctcttgaactgtctccttttcacttggtacggtttgcctattgttagctacaagtgggaaaatttccctcttgtcacagttaatggagttggtattcttctcgagttatcctatgttctcatttacttctggtatgcttcagccaaaggaaaggtgaaggtagccatgactgcaataccagttttgcttgtgttctccataattgctgcagtatcagcttttgcattccatgataatcatcaccgaaagcttctcgtaggtagcatcggtttaggtgtttcagtagcaatgtatggatcccctttgattgtaatgaagaaagttatacaaaccaagagtgtggaattcatgccactcccattatccatgtgctcattctag

SEQ ID NO: 1051 - DNA, 192 bp, Glycine max var. Williams 82
atggccatttccagtgcttcattcagggtggttgccttccttagcctcttgcttgcagctcttatgacactggcttcttcacaagtcactgctccggctcccgctccagcaagcgatggcaccacaatcgaccaagcggttgcatatgttctaatgcttgcggctttggtgctgacctacatcatgcattga

SEQ ID NO: 1052 - DNA, 1698 bp, Glycine max var. Williams 82
atggatagccctccagcttctgcatcttacgtagtggttgcatgtgatgccactagggagcgcactgaacacgagatcaaactcgttgttgatcatgttcaggaaaggcatgtctttctcccttctgtggggtaccagacattaacatgtcccgagtcttttgctggaaccaactttcgtgcaagggaggatgaagtcaagaagaaagttgatgcatatgcaactaagcttttgccaagttatgaagattttgaaagtgaaggggttaaagtcaccgcgggatttccaattaaacaggttgttttacaagaggttacaaaatataatgcatcttgggtaatacttgacagacatcttcggcgagacctgaggtaccaccttaataagatgccatgcaagattgcattggttaaatatgacttgtctctggatatctggagatctcattatgtacatgagacaaagatcacagaaacaaaatgcgtatattctttgccaaagtttgtgtcgctagcagattgtcatagtgttgaagacattgaggattctattatctcttgcaaaagttatccccattctatattttcttctgatagctctagtacgattaggagctacacaaagcagtcatcatatggtaacaggtcacgggagaacagttccttatcagattttggatcttcttctaagcaagatagatcaggcataagcatcaaaggagaatgtaggctaattacttctcagattgaccaaaaacaaaatcaaagtggctttctgccaaaacattcagatgctccgcttctttgtactggctgtggtacaagattgtctatcaaggagtcaatgaggttcagctattctgacattcaaagtgcaacaaatgatttttcaaaggataaattattaggtgaaggtggatatggtcacgtatataacggtgttcttaaagatggacagcaaattgccgcaaaggtaaggaaagaagaaagttcacacgggccgggttttctgaatttcattctgaggtgtgtcttaagtttttctcgacacaagaacatagtgatgctgttgggttactgttgcaaagaaaagaaaaacatcctgatttatgaatatatttgcaacaagtctctccattggcatttatttgtggcaccaaaggtatgccatcgccattgggactgcaaggaattgcgttttctacatgaggaatgtcgtggtggtcctattattcatcgggacatgcgaccaagcaatagacttctcacccatgattttgttcccatgctaggtgactttggccttgccaaatggaagactggtgatgatactctacaaacaaggataatgggcacattaggatcatataattttggaattccaaacttaaaatatgctgaagacggaattgtttctgtgggaacagatgtgtattcttatggcattattctattgatatcagggcgccaggttggcaattccaaaaatccagaacaacaacaatctctccgactatgggctgagcctatgatagagaagttggctttacatgaactgattgacactcgtctaggggaatcatatgacacgtatgaactctacctcatggctaaagacgcatacttctgtgtgcaaaggaaacctgagatgcgtccttcaatgggagagatgcacatgataaacactcgtgtgacgtaa

SEQ ID NO: 1053 - DNA, 471 bp, Glycine max var. Williams 82
atgttatttgcaaatatgtgtctcctaacagcaactgacttgaagcgtatttttgagaaagtggacgtgaatggcgacggattggtgagccttgaggaactgaatcgattgcttcagatgacgggcaattcccaatatagcatagaagagttggaatcacttgtggaaaagaaaagtcttggtttcagtgatttcttgttcttttacaactcaatatcggagcagaacaagggagagagcaaaggaagtgagttggagagcgacctggccaagacgtttgaggtgtttgacttggacggagatggtttcatcacaagccaagaccttgagtctgtcttgaagaggcttggcttctgggatcaaacacatgccaaggattgcagaaccatgattcgtttctatgacaccaatttcgatggtcgccttgattttcaggaattcaagaccatgatgttgctcaccaaagcttga

SEQ ID NO: 1054 - DNA, 927 bp, Glycine max var. Williams 82
atggcagttccagtgattgatttttcaaagctcaatggtgaagaaagagccaaaactatggcacagattgctaatggatgtgaagagtggggattttttcagttgatcaaccatggcattcctgaggaactccttgagagggtgaagaaggttgctgctgagttctataagctggaaagagaggagaatttcaagaactccaaatcagtgaagctactaagcgatttagtcgaaaagaagagcagcgaaaagctggagcatgcggattgggaggatgttatcactctccttgatgataacgaatggccagaaaaaacaccaggcttcagggaaaccatggcgaaatatcgggccgagctaaagaaattggcagagaaagtgatggaggtgatggatgagaatcttggcttaaccaaagggtacatcaagaaggcactgaatggtggagatggagacaatgccttctttggcaccaaggtgagccactaccctccatgtccccatccagggcttgtgaagggtctgcgagctcacaccgacgcaggaggcgtcatcctactcctccaagatgacaaggttggtggccttcagatgctgaaagatgggcaatggattgatgtgcagcctttgccaaatgccattgtcatcaacactggtgaccagattgaggtcctgagcaatggtagatacaagagttgctggcacagggttctggccacaccagatgggaacagaagatcaattgcctccttctataacccttcattcaaagccaccatatgtcctgcaccacaacttgtggagaaagaagaccaacaagtgaatcaaacttatcctaagtttgtttttggtgactacatgtctgtctatgctgagcagaagttccttcccaaggaaccaaggttccaagctgttagggccatgtga

SEQ ID NO: 1055 - DNA, 708 bp, Glycine max var. Williams 82
atggagtttgtggataccagaaaactacaattacaacatcaacaacaactgcaacaacagccgcaacattttcatgtgttggcagtggacgacagtgtcatagataggaagctattggagaggctccttagaggttcttcatgcaaagttacctgtgtggactctggagacaaggctttgaaatatcttgggctaatagatgagcttgatgatacttcttcaacctctttagaatcagaatcttctcatcctccacctcaaccattacaacgagagggaatcaaagtgaatttgatcatgacagactattgcatgcctgggatgagtggctatgatttactcaaacgagtcaagggatcttcttggaaagatgttccagtcgtgattatgtcatcagaaaatgtaccttccagaatcagcatgtgcttagaagaaggggcagaagagtttctattgaagcctcttcagttatcggatttggataagcttcagccgtactttctgaaatccgttgataattcctgtgaaaaagaatctgctaacagttccatagattcagacaatgacaatgtcatcaacaacaacagcaataacagtaacagtaacaataacaacaacaatagcatcagcaaaaggaaggccatgtctcctgagcctcatcgggaggagagatcaagacccaaaatgaaagagttagcggtggtgtaa

SEQ ID NO: 1056 - DNA, 2034 bp, Glycine max var. Williams 82
atgatggagaaaaacatatgtaaatcttctgaggacagccctagtgaaactgaaagtttagggtctgaattgtctcattctgagaagcaaccggatgaacagcatcaggcattgaatgaatctcctattggacataaccagtcccctaaagttacctcagaagctgtggccatcgctgaagatattaatgacatgtcatttatcaatgcacaatcagctgaagtcatctcacatacaacacacaagggacatgatggtttattggaggaagatgaaaatggagcaaatgatagtataattaaggatggagatgtaactgatggattgaggaatatgtcaaaaaatctatctgcagaggttgtgaatgtaagtgccaaagaagatttggtcaagcaacatgccaaagtcgctgaagaagctattgcaggctgggagaaggccgaaaatgaagtgacaagtttaaagaagcaagtcgaggcactgactctccgaaattcaacacttgaagatagagtcacccatctagatagtgcacttaaggagtgtgttaggcagctaagacaaacaagggaagagcaggagcaaaatgttcatgatgcagtgctaaagaaaacacaagagttggaatcagccaaaactaaacttgagaagcagctcaaggagctccatagcaaatcagatgcttcaaatgctagttctcattcatcaattgaatttgatatgatccagaaggttgaatatttggagaatgagaacatggctctcaaacatgagctcaaagcccaatctgaaaagctgaaactcaggacaatagagagggatttaagcacccaaacagctgagatggctagcaagcaacatctagaaagcatcaataaagtggctaagcttgaggctgagtgtcggagactgaaaaacatggcttgtagagcttccattacatcatcctcattttgtgctgaatctttcaaagatggtcaatcagaaagtggagagaggactaatgcaacggagattgataccaccaggaagagtggctcagaaccagacatgtgtgagttaagttgttccgattcatgggcatctgcactaattgctgagcctgatcagttcaagaatgaaaagtataaacaaattccgtctggttctgttaacattgatctcatggatgattttcttgaaatggaacgacttgcatcactgcctgatactaagaatgaaagccttatcaaggactcacttgttgccaatcaatgcattcatgaagaaagttcaatggatgaactaaaagagaagttagagaaagccaaagaagagaaagaggaagtgaagatatgtttaatgaaaactgagtctgttattgaggcatcacagctacaaatgagggaggcagaaacaaaattggaggagttgcaaatagagctagagaatgcctacaaatcaaggcaagtgtttgaaaatgaactaatgagcatgcaggctgaggctcaatcaattactgcaaaagttcacttattagaagaagagattgataaggaaaaggctatgtctgttgaaattgaaagtaggtgtaaagaattggaggaagagctagaaagaatgaagcaggaagaaaaacttggatcagtaaccggctcatacacggaaatgaagctaaagcaggaggacctggcactagctgcaggaaagcttgctgagtgccagaaaaccatagcatctttggggaatcaattaagttcactagcaacgctagaagatttcctgattgacactaccagcattccagagttctctgcaagtccatcactaattgcaagagctggtggagatatgctgcagaagttgcattcaaatgacacatacttacctaaaagagattccggttcttcaaggtctggtccacccttaaacaaaaatgaagaaacttcaccaccctcttcaaccaacttgccaaatcatgagagttctaagagtagaaatggttttgcaaaatttttctctcaaactgagagtggaatccaactaggaatctag

SEQ ID NO: 1057 - DNA, 822 bp, Glycine max var. Williams 82
atggctcaaaccatgttgctcatgtctagtgtctctagcagttattccgtggatttgaagaaagaccttttcctccaattgcagagtcaaagtttaaggcctaagttctctcagctctcattcaacccacttccatcatcaacttcttccttttcttcaccccgtacattcacaactctggccctcttcaaatctaagaccaaagccgctcctgctaagactaaggttacaaagccaaagcaaaaggttgaagatggtatctttggcacttctggaggatttggttttactaagcagaacgagctctttgtgggtcgtgttgctatgcttggttttgcagcatcactgttgggtgaaggaataactgggaaaggaattctagcacaattgaatctggaaactggaattcccctttatgaagcggagcctcttcttctgtttttcatcctcttcaccctgctaggagccattggaggtttaggtgaccgtggaaaatttgttgatgacgaacctactactggaggtgttattcctccaggcaaaggcttcagggaagctcttggtcttggttcaggtcctttatttggattcacgaaagcaaacgagctatttgtgggaagattggctcaattgggtttcgttttctcattgattggagaaattataaccggaaagggagcactagcccaactcaacattgagactggggtaccaatcaacgaaatcgagcccctagtgttgttcaatgttcttttcttcttcattgctgctttgaatcctggaactggcaaattcgttacagatgagggggaggatgattag

SEQ ID NO: 1058 - DNA, 1281 bp, Glycine max var. Williams 82
atgagcaaacccaaaactcaaagaaaaccaaccattaccaaacatgtcagccaaaaccaaaaccaagaggcacagaaaacagagaaacaaccttcatgggtggtgagaggcctactagcttgtagaaatgtgcaaatccaacaaaatcagccgcagcagaaggaagcaaaatcacccccagaagcaaaagaaaacaggaaaaaacaggaacatagaaagctgcaagaggaacgagtcccagaagaaaacagcaagaaatccaagaagatgaaatgctcaggatcgctttgtaacaacaccaagatcactgcaaagcctgacacagcaaccccagatgttcacaagaaaaggttgttactaagtgggtgcaacaacaagaacgatgcttccagcagatccatgaaagcacctcttaatgaactcaatggaaccgtgtcagcctcttcttcttctttgtcagcatcttcaacttcttctggcggtggttctttcaggggaatgccattcaggagactctccggttgttatgagtgtagaatggtggtagacccagttcttggcttcactagagacccttctctaaggagtagcatttgttcttgccctgactgtggtgagatcatgaaagctgaaagcttggaacatcaccaggctgtcaaacatgcagtttcagaactgggtccagaagacaccagcaaaaacatagttgagataatattccactccagctggctgaagaagcaatctccagtgtgcaaaatagaccgcatcctcaaggtccacaacactcagaaaacaataaccaaattcgaagagtacagagactccataaaagccaaggccacaaagctctccaagaagcaccctcgttgcatagcagacggcaacgagcttctcaggttccactgcacctccttcaattgctccctgggcctaaacggttcctccaacttgtgcaactcgataccacagtgtaacgtgtgcagcataatcaagcacgggttcaaggtcaccggaggagccggtatcttgacgacggcgacgagtggaaaggctcacgacaaggcggcgtgtgtggaggagagtgaggagaagagggcaatgctggtttgtagagtgatagcaggcagggtgaagaagaatgcagaaggtggcatggaggagtatgattctgttgctgttgccggtgctgttggagcttattctaatttggatgagttgcttgtgttcaaccctaaagctatattgccttgctttgttgtaatctatagaggcttttga

SEQ ID NO: 1059 - DNA, 324 bp, Glycine max var. Williams 82
atgatgtcgacggccaggttgcagcagcgggtggcggcggagatcgggcacatgggcggctcgccggggatgcttctgcacgagtttcggaggtcgaaggtggccatggaggagctgagaggggagttagagagaagagggtcagggtctcagggagtggagtgggagagtgaggttgctattagagagagagtggagaatctcagaacgtgttttggggttctcagatctggggcagacaacattgttgctcagcttgatgatttctttgacgagattgtggaagggaggaagaggcttttggacttttgcagtcataggtga

SEQ ID NO: 1060 - DNA, 2100 bp, Glycine max var. Williams 82
atggcaacgttcacataccacgtagaaacagttcaatcattcttagccctaagcagacttcacatactcatccacttagtggcagtgttgtctctctgttactaccgcatcacccacttcttcctccaacctccaacagcgccatggcttctcatgactgctgcggagcttcttctctcgctgctctggttcttcaaccaagccttccggtggcgaccggtgtcgcggagcgtcatgactgagaagcttccgagtgaggagaagctgccggggcttgacatcttcgtgtgcacgctcgatcccgagaaggagcccaccgtggaggtcattgacaccatcatctccgccgtgtccatggattacccctccgacaagctttccgtctatctctccgacgacggcgggtgcgacgtgactctctatgggatccgagaggctgctgagttcgccaaggagtgggttccgttctgtaaaaagtatggggtgaagtcaaggtgtcccaaagtcttcttctctccctttggggatgaggatcaagagactcttcgggacgatcaattcagaacacagagagacctcgtcaaggctaaatacgagaaaatgcagaaaaatatcgagaaatttggttcagaccctaaaagtcgtcgtactgtgagtgacagacaacctcgtattgagattataaatgaccaaccgggaatgccacttattgtttatgtgtctcgcgaaagaaggccatcccttcctcacaaattcaaaggaggagccgtcaacacattgctcagagtctcaggtttaatcagtaatggaccttatgttctagtaatggactgtgatatgtatagcaatgatccaacctctgccaaacaagccatgtgcttctttcttgatcctgaaacgtccaaatatattgcatttgttcaattccctcaaatgtttcacaaccttagcaaaaaggacatttatgatagtcaagctagaactgcttttaagacaatgtggcaaggcatggatggactaagaggtccaggtctttctggcagcggcaattacttaagtagaagtgctttactatttggaagtccaaaccaaaaagatgactatctgcaagatgcacaaaagtacttcggcaagtctaccgcctacattgaatcactgaaggccatccgtggacagaaaagtagcaaaaagaatatttcaagagatgaaatgttaagagaagctcaagtagtggcctcttgttcctacgaaaataacacaaattggggcacagaggtgggattctcatatggcatattactagagagttctattactggctatattcttcacagcagaggatggaaatcagcatatctttacccgaaaacaccatgtttcttaggttgtgctcccactgacatcaaggaaggcatgcttcagttggttaagtggttgtctgaacttttgttgcttggtgtctcctccaaatacagcccattcacttatggattttcaagaatgtccatacttcacaccttcacttattgcttcatgacaatgtcatccctttatgctgttgtcttcatcctctatggcattgtacctcaagtatgcctcctcaaaggaatccctgtgtttccaaaggccacagacccttggtttgccgtgtttgcatttgtgtatgtatctactcagattcaacatttgattgaggttctctctggggatggatctgtgacaatgtggtgggatgaacaaagaatttggattctgaagtcagttaccagcatatttgcaattatagatggaatcaagaagtggttggggttgagcaaggtgaaattcaacttgtcaaacaaagcaattgacaaagagaagctcaagaaatatgagcaaggtagattcgatttccaaggtgcagctgtgttcatggctccattggttctattactcacagccaacattgttagcttcttagttggtatatggagactatttaatttcaatgtgaaggattttgaagaaatgtttggtcaacttttcctagttacctatgtaatggttcttagttatccacttcttgaggccatggtaacaatgaaaagcaagagtggatag

SEQ ID NO: 1061 - DNA, 1134 bp, Glycine max var. Williams 82
atggcagacgctgaggatattcaaccccttgtttgcgacaatggaactggaatggtgaaggcaggatttgcaggagacgatgccccacgtgcagtgtttcctagcattgttggtcgtcctcgtcacactggtgtgatggttggtatgggccagaaagatgcatatgttggtgatgaggcacaatctaaacgtggtattctgactctcaagtatcccattgagcatggtattgttagcaactgggatgatatggaaaagatttggcatcataccttctataatgagcttcgtgtggccccagaagagcatccagttctgttgacagaggctcctcttaaccctaaggctaaccgtgagaagatgacccaaattatgtttgagacctttaatgcccctgctatgtatgttgctattcaggctgttctttcactgtatgccagtggtcgtacaactggtattgtgttggattctggggatggtgtcagccacacagtccctatctatgagggttatgccctcccacatgcaatccttcgtcttgatttggctggccgtgacctcacagatttcttgatgaagattttgactgaacgtggatattcttttaccacctcagcagagcgtgaaattgtgagggatatgaaggaaaagctggcttacatagccctcgactatgagcaagagctagagacatccaagaccagctcttcagtggagaagagctatgagttgcctgatgggcaggttatcactattggcgctgagcgtttcaggtgtccggaggtcttgtaccaaccatccatggtaggaatggaagcatcaggcattcatgaaacgacatacaactccataatgaaatgtgatgttgacatcaggaaagacctgtacggtaacattgtcctttcaggaggtacaaccatgttccctggcatcgctgatagaatgagcaaggaaatctctgctttagccccaagcagcatgaagatcaaggtggtagcacctcctgagagaaagtatagtgtctggattggaggttctatcttggcatccctgagcaccttccaacagatgtggattgcgaaggcagagtacgacgagtctggaccatcaattgttcatagaaagtgcttctaa

SEQ ID NO: 1062 - DNA, 1074 bp, Glycine max var. Williams 82
atgggcattgatagtgaatacgtgatatctcacaaggcctatgcgagggtgggattgcttgggaacccgagcgatgtctactacggcaaaacgatagcgttaagcgtcgccaacttcttcgccaccgtcacgctgcgtccctccgaccagttaatcctccaaccccaccccctccacgatctccttcatttctcatcgctccctcaattggtcaacaggttgagctcccaaggttactatggaggcgtgcgattgcttatggctatttgcaatgtcttctacgcgtattgcagagagaacgccatcgatcttggcgacgacaatttcactctctcctacgacaccaatatccctcgccaggctggtctttcgggttctagcgggatcgtgtgtgctgcgttgaactgtttgttggatttctacaacgtcaggcatctggtcaaggtggaggtcaggcctaacctcatcctcgctgccgagaaagaactcgggattgtggccggtcttcaggatcgggtcgcacaagtttacggtggccttgtttacatggactttagcaaggaaaacatgaatgagctgggccatggagtttatgtaccagtggatttgagtctcctccctcctctgtatctcatctatgcggaaaatcctagtgattctggcaaggttcatagtaaagtacggcagaggtggcttgatggtgatgagttcattgtgtcttccatgcttgaaattgctaatatcgcccaagaaggaaagactgcattagaagaaaaggactactccaaatttgcagctctcatgaatcgaaattttgacctgcgaaggttaatgtttggagatgatgccctcggtgatttgaacctaaaaatggtagaggttgccagaaaggttggagctgcgtcaaaatttaccggtagcggaggagctgttgttgcattttgtcctgaggggacttctcaagtgaagcttctcgaggacgaatgtcaaaaagaaggatttgtgatactacctattgaacctcttccttctcgtctaaatgaaattgacttgaaaaccttgcaaataaagtaa

SEQ ID NO: 1063 - DNA, 2277 bp, Glycine max var. Williams 82
atgggtccaagctcgaagaaagcttcacctaaatcaggtgtgacaaagcacatgaagggcttcagcctctgcaactcaaccctaaaagtaaatgggcaagtcatcctctcccaagtccccaagaacgtaaccctcaccccatgcacctacgacactcacaccaccggatgcttcctcggtttccacgccacctccccaaaatcccgccacgtggcacccttaggacagcttaaaaacataagcttcacttccatcttccggttcaaggtttggtggaccactctctggaccggctccaacggccgcgacctggaaaccgaaacccaattcctcatgctccaatcccacccttatgttctcttcctacccatcctccaacccccatttcgcgcctcgctgcagcctcactcagacgacaacgttgcggtgtgtgtggagagcggctccagccacgtaacagcctcatcattcgacactgtcgtctacttgcacgcaggggacaaccccttcacgctggtcaaggaagccatgcgcgtcgtccgggcccacttggggagcttcaagcttctggaagagaaaaccgttccgggaatggtggacaagttcggttggtgcacgtgggacgccttttacctgacggtgcaccctgagggcgtcagagagggcgtgaagggcctggttgacggcggttgtcctccgggattcgtcctgatcgacgacggctggcagtgcatcagccacgattccgatccggagaaggaggggatgaatcagacggtggccggggagcaaatgccctgcaggttgattagttacgaggagaattacaagtttaggagctataaggaagggaaggggttgaaggggtttgtgagagaattgaaggaggagtttgggtcggtggagtacgtgtacgtgtggcacgcgctgtgcgggtattggggaggggtgaggccgggggtggcggggatggcggaggcggcggtggagaagccaaagctgacggaggggttgaagggaacgatggaggatctggcggtggacaagattgtgaataatggggtcggggtggtgccgccggagctggtgggggaaatgtacgagcgccttcacgcgcacttggagagtgcgggtattgatggggtcaaagttgatgtcatccacttgctagaaatggtgtgtgagaaatatggagggcgagtggatatggcgaaagcatattacaaagctctcactgcttccgtgagaaaacattttaagggcaacggcgtcattgccagcatggagcattgcaacgatttcatgttgctgggaactgaagcaatatcccttggtcgtgttggggatgatttctggtgcactgacccttatggtgatccaaatggtacattttggctacaagggtgtcacatggtgcattgtgcatacaacagcttgtggatgggcaatttcatccacccagattgggacatgttccaatctactcatccttgtgctgccttccatgctgcctcaagagccatatctggtggccccatttacatcagtgacacagttgggaaccacaactttgagctgcttaagaccttggccttgccagatgggtccatcctcagatgtgagcactatgcactcccaaccagggactgtctctttgctgaccctctccatgatggcaaaacaatgctcaagatatggaacctcaacaagtacactggagttcttggggtgtttaactgccagggaggaggttggttccgtgagattaggtccaacaaatgtgctgctgagttttctcatagggtatcaaccaagaccaatatcaaagacattgaatgggatagtggaaagaatccaatttccattgaaggggtgcaacttttcgcttcgtatttcagccaagccaagaaactcatcctctcagcaccatctgatgacagtgaagagatttccttggagccattcaatttcgagcttataacagtttcccctgtgactgtcttgcctggcaagtcagtgaagtttgctcctattggtttggtgaatatgctaaacactggtggagcagtccagtctttagcttttgatgagggtcagaatttggttgaagttggtttaagaggcactggggagatgagagtctatgcctcagagaaaccaagaacttgtagaattgatggcaaagaagttgattttgaatatgaagggtctatggtcaacattcaagtaccatggcctggttcttcaaaattgtccactgttcagtatgtattttaa

SEQ ID NO: 1064 - DNA, 2004 bp, Glycine max var. Williams 82
atggcttccaaatatgataacaagtacaacaatccatcatttgttgttgttatcttcacagtggccaccctattgtgttttttctcccactcagcactatctgatccaagaatctcagaagtggggcactactgcagcacacagaagtcaccaacaagtggtgattacttccccatattcaccaaagaaatggaaaaacttcaagaagttgtgacaaaacaaaactggggaactcactctgagggcatgtcatcaaccactcctatctatggcttggcacaatgcttccaagacctttccagcattgattgccttcagtgctttgcatccagccgcaccaagctccctcgctgcctcccttcggtttcggctcgaatttaccttgatggctgcttccttcgctatgacaactacagtttctacactgaggacactgaccctttgagggacacagtgaactgcacctcacagtatggtgctgtggttggtgatggtgagaagttggtgtttgctgagagtgttgccaaagtggttgagagtgtggtgagggtggctgtgaatgagggaagaggcatttttgcagtgggagaaggtgggggagtttatgccttggcacagtgctggaaaactgttggggtaaaagggtgtagtgattgcttaaggaaagctgaaaatgaagttaaagggtgtttgcctaagagggaagggagggccttgaatactgggtgttatttgagatattcaactgttaagttctacaatcaaggaggtgaagatggccaaggagatgattcttccagaaaacgagccatcgtagcagcagggtcagtcttggctgcagctgttgtagtgctcacgctcgcggcctcttatgtggccttcaccaaaaagagaaaaaaaaacaattttatcgaggctcctccttccttaaagaattctagcttgaattacaaatatgaaactcttgagaaggccacagattatttcagctcttcaagaaaaataggccaaggaggagctggttctgtatacaaagggactttgccaaatgggaatgatgttgctgttaagagattggtcttcaataataggcaatgggtggatgatttcttcaatgaagtgaatttgattagtggaatgcaacacaagaaccttgtcaaactattgggctgtagcattgaaggccctgagagcctcattgtgtatgagtacctacctaacaagagcttagatcaattcatttttgaaaaggacataacaaggattcttaaatggaagcagcggtttgaaataattcttggaactgcagaaggacttgcatatcttcatggaggctctgaaataagaatcattcatcgagacataaagagtagcaatgttcttctggatgagaatcttaaccccaagattgcagattttggtcttgcccggtgtttcggtactgataaaacgcatctaagcactggaattgctggaacattaggttacatggctcctgagtatctcattcaaggacaacttacagataaagcagatgtctatagttttggagtacttgttctggagattgcaagtggaaggaagaataatgtcttccgtgaggattctggttcccttttgcaaacagtttggaaactttaccaatcaaacagattgggtgaagctgttgatcctggcttgggagaagattttcctgcaagagaagcatcaagggtgtttcaaattggattgctatgcacacaagcttctgcttccctgaggccatccatgactcaagttgttagcatcttaagtaattcaaatttggatgcccctataccaaaacaacctccatttttgaactctagattgctagatcaagcatctccattaggttttagcataggcagctcctcatcaaacacatttaagaagactggtgtgtcctacagcccctctgagttctctagcacatgcagcttaattgggccaacaagaaatgaagaaacaattatggaagcttga

SEQ ID NO: 1065 - DNA, 1020 bp, Glycine max var. Williams 82
atgtcaacctcttccataaacgggtggtgcctctcttccatctccccagccaaaacctctctcaggaaggccacattacgcccttccgtcttcgcaacccttaacactccttcttctccttcctcttcatcttccttcccctctctcattcaagacaggcctgtttttgctgcccctgcccccatcatcaccccaactgtgagagaggatatggcaaaggaatacgagaaagctattgaagaacttcagaaattgttgagggagaagagtgaactcaaagcgacagctgctgaaaaagtggagcagataacagcttctctagggacatcatcatctgatggcatcccatcatcagaagcctcagacaggatcaaagctggtttcattcacttcaagaaggagaaatacgacaagaatccagctttgtatggtgaacttgccaaaggccagagccccaagttcatggtgtttgcttgctcagactcaagggtgtgcccatctcatgtgctagatttccaaccaggagaggcctttgtggtcagaaatgttgccaacattgtcccaccatatgaccagtcaaaatacgctggaactggggctgcagttgagtatgctgttttgcatcttaaggtgtcggagattgtggtcattggacacagtgcttgtggtggtattaaggggcttctgtctttcccatatgatggaacctactctactgattttattgaggagtgggtcaaaattggcttgcctgcaaaggcaaaggtgaagacacagcatggggatgccccttttgctgagttgtgctcacactgtgagaaggaatctgtgaatgtttcccttggaaacctgctaacttacccatttgttagagatggcttggtgaacaaaacattgtcactgaaaggaggatactatgactttgttaaaggatcttttgagctctggggccttcagtttggccttgcatcctctttctccgttaaagatgtggccaccattctccattggaagctatag

SEQ ID NO: 1066 - DNA, 1498 bp, Glycine max var. Williams 82
cacacaccccattgctacatagggctatatagcataaacatttgagtcttcattgcacaatgtcaacctcttccataaacgggtggtgcctctcttccatctccccagccaaaacctctctcaggaaggccacattacgcccttccgtcttcgcaacccttaacactccttcttctccttcctcttcatcttccttcccctctctcattcaagacaggcctgtttttgctgcccctgcccccatcatcaccccaactgtgagagaggatatggcaaaggaatacgagaaagctattgaagaacttcagaaattgttgagggagaagagtgaactcaaagcgacagctgctgaaaaagtggagcagataacagcttctctagggacatcatcatctgatggcatcccatcatcagaagcctcagacaggatcaaagctggtttcattcacttcaagaaggagaaatacgacaagaatccagctttgtatggtgaacttgccaaaggccagagccccaagttcatggtgtttgcttgctcagactcaagggtgtgcccatctcatgtgctagatttccaaccaggagaggcctttgtggtcagaaatgttgccaacattgtcccaccatatgaccagtcaaaatacgctggaactggggctgcagttgagtatgctgttttgcatcttaaggtgtcggagattgtggtcattggacacagtgcttgtggtggtattaaggggcttctgtctttcccatatgatggaacctactctactgattttattgaggagtgggtcaaaattggcttgcctgcaaaggcaaaggtgaagacacagcatggggatgccccttttgctgagttgtgctcacactgtgagaaggaatctgtgaatgtttcccttggaaacctgctaacttacccatttgttagagatggcttggtgaacaaaacattgtcactgaaaggaggatactatgactttgttaaaggatcttttgagctctggggccttcagtttggccttgcatcctctttctccgtatgaacatcaaccattatcaatgacctcatcttggttccctaagtattctcctatctaaaatgtactctgtaattaattgctcttgttataatgcatgcatgtgctgaatttcctaataataaaagtggatatggagatttctccacatatcaccctctattccaaattgaagttcaatccgttttgttcaaggaacgtgtaatatttttatggtctttcaccactgcatttttcttctttgttaggttaaagatgtggccaccattctccattggaagctataggggccatgcttagaggtcgtgtgtatctgcaatgaagaggcctagccaccttcatcaccatatgatatttataaagatatatatgaaactatgaactgcgtttatgcatgtcggaaaatcttcttttaataagagttggaaatcctcttgttataaaattttcatttttca

SEQ ID NO: 1067 - DNA, 1314 bp, Glycine max var. Williams 82
cacacaccccattgctacatagggctatatagcataaacatttgagtcttcattgcacaatgtcaacctcttccataaacgggtggtgcctctcttccatctccccagccaaaacctctctcaggaaggccacattacgcccttccgtcttcgcaacccttaacactccttcttctccttcctcttcatcttccttcccctctctcattcaagacaggcctgtttttgctgcccctgcccccatcatcaccccaactgtgagagaggatatggcaaaggaatacgagaaagctattgaagaacttcagaaattgttgagggagaagagtgaactcaaagcgacagctgctgaaaaagtggagcagataacagcttctctagggacatcatcatctgatggcatcccatcatcagaagcctcagacaggatcaaagctggtttcattcacttcaagaaggagaaatacgacaagaatccagctttgtatggtgaacttgccaaaggccagagccccaagttcatggtgtttgcttgctcagactcaagggtgtgcccatctcatgtgctagatttccaaccaggagaggcctttgtggtcagaaatgttgccaacattgtcccaccatatgaccagtcaaaatacgctggaactggggctgcagttgagtatgctgttttgcatcttaaggtgtcggagattgtggtcattggacacagtgcttgtggtggtattaaggggcttctgtctttcccatatgatggaacctactctactgattttattgaggagtgggtcaaaattggcttgcctgcaaaggcaaaggtgaagacacagcatggggatgccccttttgctgagttgtgctcacactgtgagaaggaatctgtgaatgtttcccttggaaacctgctaacttacccatttgttagagatggcttggtgaacaaaacattgtcactgaaaggaggatactatgactttgttaaaggatcttttgagctctggggccttcagtttggccttgcatcctctttctccgtatgaacatcaaccattatcaatgacctcatcttggttccctaagtattctcctatctaaaatgttaaagatgtggccaccattctccattggaagctataggggccatgcttagaggtcgtgtgtatctgcaatgaagaggcctagccaccttcatcaccatatgatatttataaagatatatatgaaactatgaactgcgtttatgcatgtcggaaaatcttcttttaataagagttggaaatcctcttgttataaaattttcatttttca

SEQ ID NO: 1068 - DNA, 803 bp, Glycine max var. Williams 82
cacacaccccattgctacatagggctatatagcataaacatttgagtcttcattgcacaatgtcaacctcttccataaacgggtggtgcctctcttccatctccccagccaaaacctctctcaggaaggccacattacgcccttccgtcttcgcaacccttaacactccttcttctccttcctcttcatcttccttcccctctctcattcaagacaggcctgtttttgctgcccctgcccccatcatcaccccaactgtgagagaggatatggcaaaggaatacgagaaagctattgaagaacttcagaaattgttgagggagaagagtgaactcaaagcgacagctgctgaaaaagtggagcagataacagcttctctagggacatcatcatctgatggcatcccatcatcagaagcctcagacaggatcaaagctggtttcattcacttcaagaaggagaaatacgacaagaatccagctttgtatggtgaacttgccaaaggccagagccccaagttcatggtgtttgcttgctcagactcaagggtgtgcccatctcatgtgctagatttccaaccaggagaggcctttgtggtcagaaatgttgccaacattgtcccaccatatgaccagtcaaaatacgctggaactggggctgcagttgagtatgctgttttgcatcttaaggtgtcggagattgtggtcattggacacagtgcttgtggtggtattaaggggcttctgtctttcccatatgatggaacctactctacgtaagtcattttgctctacataaaaatt

SEQ ID NO: 1069 - DNA, 1065 bp, Glycine max var. Williams 82
atgtttgtaattgagaggagaaaaaaaatatcctttagaaactgggttgttgttatattagagatgctagaaaggggcatattgatgtctatgcagacactgaatcaccctccatttctgactggagatgcctttagaaagaggactcagactcggtgcagagggagagcaaattcaaccacagctttgcagttatcttctgatgagagtggaaactttgcagaaccaggtacttcccttatgagatgtaaaaactctggttcccttctaagccaaccaaacactgttggtgttataggaggggtatcacttctatcaactctgattttcttggagaaacttgcttgttggggttcaagaaatggtaaagaatgtccaccttttgttgtttccagtgatcctgagttgagcaaagtgctttcattacgtggtcctcttccttctgcaaggagcagatttgatcgtatcaaattgaatcaggaccttgtgattgagaatttgcggagcaaaaggaactttctgcagcagtctggagctcgtggtttggccatgccttgccatctctcacatgcgtggcacagtgaaatttctgaggatagttcactaccctttcttcatgatggtgattgtgttgccatggaactcaagaacgccatgttgaagccaattcatgctgctgttactgtggggattggacttctgactacagattcaaattttgtagctagttattaccaggagaagcttcaaagtcagggatttgaagtagtgtttctagacaaagcaaccgaagaacatgtattggttcctgcaatggaggcgttgtacagaaaggacgtggaaggggcaaggaatttattgagaattgcaatccatgttcttttggttagggcagtgaatgtggtgcttctggcatctgatgatttgctgggggttctccctcacaatgatcctcttctacggaaatgcatagacccaatggatgctttggccaggtcaactatacattgggcagaaacaacggcagagggaagaatgcaatttcctaatccatccaattggtga

SEQ ID NO: 1070 - DNA, 252 bp, Glycine max var. Williams 82
atgatagtggaattgcttggtatctttaacggtctcaacattgctaaggctgctagtttttgcactgttgcttgcgagacaaattctcaaatagcgttgcagatgatctctcaaggaaatgcttgctccgattggttggctaagacgggagcaaacccacaagataaccttcgtttgattagttcttgtccttcacctatgcattatttgctcattgctaatgccatgggttctgtttttcttagagtttag

SEQ ID NO: 1071 - DNA, 369 bp, Glycine max var. Williams 82
atgtcatatcctccctattcctgtgaactatgcattcatagttgtcataaaaatacaatgagcataatcctaagttcagcctttttggtcaaaattgcagctgctttgtgcagctgtctacttcctgaaagtcttcaagtaacaagtgttaaacagctacctgaatatcatgaatgctcggaagataaatttgtcgaatctctttctcctgccacaccccgtgagtcaacagaaatagatgaggagcaagaaaagcaccttctatcgccatcagatggaactgaggatgctcatttcgttaaagaggacgcaagtgaaataagtggtgtctttgaggtgagaaataacacaggcccgtcttcggtttga

SEQ ID NO: 1072 - DNA, 213 bp, Glycine max var. Williams 82
atgtcattcacttccaaggtcattgctctgtggtgcaagaaacatgggaatgatgatggtgtcgatgtgtatgatgctcctgctgccactgcttgcattgaaggaaatgtttgcaattggcatggagattttgtaagttttgtcccagttgcattggtggagggtgacgatgacgacgatgacggaggttatgactacgctcccgcagcataa

SEQ ID NO: 1073 - DNA, 429 bp, Glycine max var. Williams 82
atggttgacgtcgacgttggaacctcggactcgccgaagcgccaccacaacaacggcttcctcgtaacaatatcggcggttctggcgctgctaacaaagcgcagagcagcgaagccgaccaaagaggatgagtggaagaaggaattgaagaagtcgcggccgaagaagcttctcagcaacataagaagcaaagcgcttttcggtcacaaccacaacaacaagaagaagctgcgaagcgtggaagagacacaacaagggtggggaaacggcggcgtttggcagaaggagattctcatgggtggcaagtgcgagccgttggatttctcgggtgtgatttattacgatggaaacgggaagcagctcagcgaaatccctctcaggtcgccacgcgctagccccatgcccggttacctcacgcgccgcctctga

SEQ ID NO: 1074 - DNA, 642 bp, Glycine max var. Williams 82
atgtatacccttactaatgcaaaaaatattagcttttctctacttactctaaacccttttgttaaaactgctgtaggtgctacatggtgcgtttgcaaggatggaagcgacgcgatcctgcagaagacgttagactatgcttgtggagctggtgctgactgtaaccctcttcacctaaacgggccttgttttcagcccaacaccgtcagggcccactgtaactacgccgtgaacagctacttccaaaagaagggtcaagctcaagggtcatgcgagtttgcgggaacagccactgttactgcatctgaccccagctctagcggttgtgtctacccttctagcgtcagcgctgcaggcactggtacaactcctgtgactactacaccaacaatgggcactactcctacaactggaactccatcaacaagcaccggcaccggcactggcaccggcaccaccactggtaccactccatacagcacaacacctggagtattaggaggcattggcagtggcatgggaccttcaggatccggcatgaacgatgaaagtcacggtggcattagatttgttcacagcagtagtttcttctcgatcgcgatcgccctcatctctgccttcatgatgctctgctggggttga

SEQ ID NO: 1075 - DNA, 1710 bp, Glycine max var. Williams 82
atggaaggagatcatcgaattcatcaagaattgaaacacgcgtgcaagttctgcggcaagtgcttcccttgtggcagatccttggggggtcacatgaggtctcatataaccaacttttcatctgagatgaatgaaaaagaaaagctttcatcttcacacaacaatggtggagacaaggattctgaagctgctgctgcagctaacactgctggctatggtctcagagagaaacccaagaagacttggagaatctcagattattcaagcgaagaccctttggtgtttgacaagttctgcaaagagtgtggcaaagggttccagtcttggaaggccttgtttggccacatgaaatgccattctgagaaagagagagtttccaacagcttggaagatcaagattcttggactaatgctaaggtggttatggatagccaatctgataacgaagcaactgctccgaataagagaagaaggtccaagagaagaacaaggtacacggtggttgcttcttctgcagcagcagcagcagcaacaacaacttcttctgttgtatcttttgccaatccttcttcttctctctctgaggctgagcaagagcaagaagaggttgctatgagcttgatgatgcttagtagggatgtgagtccttggagtggtcctcattctgttgccgagtcctctgacaataactctgcttatttcgaagctcgatcttcggttcgaactaatttgatcaccaaatttgatcaagcaaaactgatcaagcaaagtgataacaagtgggaggttggcaattcagaaaatcccaactcaaccagaggtaagagttcacaacttttgacgactactactgctactactattactactgagattcctgaaaatggatttagagtgaacaaaaatggagtttccaataaagggtacgaaaaggcctacaagtctgagcttgagtatgtatcggcattggaggattctgaaggtgaacataggaggagcagaagagtcaatggaacagaatcagctttatcaaagtcggttacaactactggcaaaaagtacagctcaatcaagacaaagttttcaggttctgaattgaagtcaaataagaactggatggacaaggcttcagaagctgaatctagcaagaactctaacaagagaggcaagtttgagtgtaccacttgcaacaaaattttccactcataccaagcacttggaggccatagagctagccacaagaagatcaaaggatgctttgcttcaaggaatgagagcagtgagaacagcattgaaactgatctctctcctgacccaataataactgaaaacaagctcatgaagaacggtgacagtgagtgtgtggtggaacatcaacatggtgctagttttcataatgaggtggaaacagttaatgagtccaagaagagcaaggggcatgagtgcccaatttgcctcaaggtttttccatctggccaagccttgggtggccataagagatctcatatggttggtgggtctgagagtagaagctttcaaacaattgtgcttcaggaaccagtggcagaaattagggacttccttgatcttaatcttcctgctgctactgaggaagaaagcaatagccatgctgactctaacagtaacagaccctggtggatagtagaagacaaccacaaacaggaggcactggtaggccttatctcatag

SEQ ID NO: 1076 - DNA, 675 bp, Glycine max var. Williams 82
atgtctctcaccattccctccaacctctccaagcccgccgccctccgccccaaactaagcccaaagctaaggtccgccgccacaaccaccatcgtctgcagcaccaccaacaacaacaacaacaacaacgtgtcctccgacctgaaggcgttctccgccgcgctggccctctcctccatcctcctctccgcccctctccccgccggcgccgacatctcggggctcaccccatgcaaggagtcgaagcagttcgcgaagcgtgagaagcagtcgataaagaagctggagtcgtcgctgaagctctacgaggcgggcagcgcccccgcactggccattaaggcgagcgtggagaagacgaagaggaggttcgacaactacgcgaagcaggggttgctgtgcggcggcgatgggttgccgcacctgatcgtgagcggagaccagaggcactggggtgagttcatcacacccggaatactattcctgtacatctcgggatggatcggctgggtgggtcggagctacctgattgcgatcagggacgagaagaaacccaccatgaaggagatcatcatcgatgttcctctggcttctcgcttgctcttcaggggtttcagctggcccgttgctgcctacagagaactcatcaacggcgacctcattgccaaggatgtctag

SEQ ID NO: 1077 - DNA, 1386 bp, Glycine max var. Williams 82
atggtttccgaaacaaaccagtccaagaatgtgtgtgtaattggagctggaccatcagggctagtggcagcgagggagctgaaaagagaaggtcataaggtggttgtgttggagcagaaccatgatattggaggtcaatggctatataacccaaatgtacaagaggaggaccctttgggaagagacccttggctaaaggtgcatagcagcatctatgagtctttaaggctcatgtcccccagagaggtcatgggcttcactgatttcccctttttagtcaagaaaggtagagatccaaggaggtttcctagtcatagagagctccttctctaccttaaggacttttgtgaatggtttgagttgagagacatgatcaagttcaatacaaaggtgcattatgtgggaccattaaattatggtgtccctagtgaggatttgaaatgggttgttagaagcaaagacaagaacagcgaggaggaagttgaacaagtgtttgacgctgtggttgttgccactggccattactctaaccccagattgccatgcattcaaggaatggccatatggaaaaggaaacaaatgcacagtcacatttacaggtcgccagagccattccgtggggagatagtggtggtggttggaaattcttttagtggacaagaaatatcaatggaacttgtgaaagtagtgaaggaactccacctcagttcaaaatcacttgacatttatgagggtttatctaaagtcatatccaaacacgagaactttcatcttcgtccacagatagagacccttcgagaggatgggacggtcattttcaacgatggctccagcattatcgcagacactattttatactgcactgggtacacctattccttcccctttcttgacaccaaaggaatggttgttgtggatgataacagagtgggtcctttgtatgaacacacgttccccccagcacttgctccttctctttctcttgtaggcatccccagaagaatcctggggctccctttctttgagtcgcaaggaaaatgggtagctcaactgctttctgggaaaaaggctttgccatcatatgaggaaatgatgaaatcgatcaaggagttttatcattcaaaagaagaagctggcattcctaaacattatacccatgaaattgaaggctttgattattgtgataaatacgcagaaaatgtaggactcccaaagttacaagaatggaggaaagatctgtgtgtatcagctgtagtgaacttatttatcaacttggagacatatcgtgattcgtggaatgatgatattgatgagaagcttcaagaagcccttcgaagtccttacttcactcaactaggagttgaacctgaagatccttctctgtaa

SEQ ID NO: 1078 - DNA, 1706 bp, Glycine max var. Williams 82
tctccaatcaattattctacgtgaaaaaaaaaataaaatttgggctataaaactccccgtcacggcgtcaccctttactcatttttccaatattcacacaatacctctatcttgtgccacttatatagtacgtccatcctagtgaaacaaaccatggtttccgaaacaaaccagtccaagaatgtgtgtgtaattggagctggaccatcagggctagtggcagcgagggagctgaaaagagaaggtcataaggtggttgtgttggagcagaaccatgatattggaggtcaatggctatataacccaaatgtacaagaggaggaccctttgggaagagacccttggctaaaggtgcatagcagcatctatgagtctttaaggctcatgtcccccagagaggtcatgggcttcactgatttcccctttttagtcaagaaaggtagagatccaaggaggtttcctagtcatagagagctccttctctaccttaaggacttttgtgaatggtttgagttgagagacatgatcaagttcaatacaaaggtgcattatgtgggaccattaaattatggtgtccctagtgaggatttgaaatgggttgttagaagcaaagacaagaacagcgaggaggaagttgaacaagtgtttgacgctgtggttgttgccactggccattactctaaccccagattgccatgcattcaaggaatggccatatggaaaaggaaacaaatgcacagtcacatttacaggtcgccagagccattccgtggggagatagtggtggtggttggaaattcttttagtggacaagaaatatcaatggaacttgtgaaagtagtgaaggaactccacctcagttcaaaatcacttgacatttatgagggtttatctaaagtcatatccaaacacgagaactttcatcttcgtccacagatagagacccttcgagaggatgggacggtcattttcaacgatggctccagcattatcgcagacactattttatactgcactgggtacacctattccttcccctttcttgacaccaaaggaatggttgttgtggatgataacagagtgggtcctttgtatgaacacacgttccccccagcacttgctccttctctttctcttgtaggcatccccagaagaatcctggggctccctttctttgagtcgcaaggaaaatgggtagctcaactgctttctgggaaaaaggctttgccatcatatgaggaaatgatgaaatcgatcaaggagttttatcattcaaaagaagaagctggcattcctaaacattatacccatgaaattgaaggctttgattattgtgataaatacgcagaaaatgtaggactcccaaagttacaagaatggaggaaagatctgtgtgtatcagctgtagtgaacttatttatcaacttggagacatatcgtgattcgtggaatgatgatattgatgagaagcttcaagaagcccttcgaagtccttacttcactcaactaggagttgaacctgaagatccttctctgtaaaactcaaattaattagcgattacttgtatttctatgttgagaacttcaatctttgtggctcaataatctcaaccttggttcctccaaatttgtggactcttattgtttgattcaaatgatcataaaatgcgacgaagttcatgtaagagtttagaagtacaaattga

SEQ ID NO: 1079 - DNA, 1074 bp, Glycine max var. Williams 82
atgagtattatagagtccatattggtgagaactgagaagccacacaactcttttccacatcccctctccctcttgtggcaatcttccaaaagatcaattccaatggaagtttcatgcaagattctcagaagatcaactcacacttttctccaaaactatcatcacttcacctcaacagcagcttttctagcttttcctttctcggcttcaatactcctctctcaagcattagtcccttcaccttcatccctcttgccccaaatctatagccgcctaaggactctctttgatgctgcaggcttcccttcttcacacttgtttaccattctcaacctcaaggtctctcaaacaatcacttcttcaatcctcgcccttcctttcaccctcacttttcttctcattgcaaaagcatccataatccaggctctcaatcaccacaagccaacttttccaccttccttcaaatcaatactatccctttacaagcctctcctccacacctatttttgcaactgtttcttgattctctcagcaaatgcaactgcttttggtctcatgtttttggccttcagcttcattgaaagacttggctactcttcccctactggcctcaccctcttcatatcagtaactggggcaattctcttttctgtgattcttgccaatgctcttgtcatatgcagcatggcactggctctatctggcatggagggacatggtggatacttggcaattctgaaagcttgtcttctcttaaggggaaggacatcaatggctttgttcctggcacttcctgtcaacgtggccttggctgccattgaggccttgttccaatttcgggtcgtaaggccctatcatattgctggaatagcaaggccttgtgtggctttggaggggattttcattgcttacctctactcaatcttcatcatccttgacacaattgtgagctgcatcttctacaaaagccttaagacaggatcatggatcagtcaagaggacaaacattcgttaaggattgaattcccagaggaaggcaagtacggttacatgggcaccaaggatctaccttaa

SEQ ID NO: 1080 - DNA, 1746 bp, Glycine max var. Williams 82
atgttttcttggtgtgggtgtgtggctaaaccaaaccaaacaacgcctactcgaacactcagtcactcagtcactgcacttgttgtgatgaagaaactctcactcttaccctcggatttggacactaaatgttccactccctcgttgatgagcatgatgggcttttttgtcgcttccttcgtcctctgctctgtggttttctcagtctccattgttcttcgagaccctccctcagatgccgccctgcacgaaccctcgtcactcgcacccctcttgcaaatcacacaaactctacgagatttggtcaatgaaacctctgattctgttgagctgcaacaagataaactgcttggtggccttctagctgatggatttgatgaaaaatcttgtctcagcaggtatcactttcacaaagggctatcagaaaagccttcttcttacctcatttctaggttaagaaaatatgaagctcagcacaaacaatgtggaccttacactgattcctataacaaaacagttgaacaacttaggtctggtggtcaatttactgagtcctcagagtgtaaatatgttgtatggatttcgtttagtggcttagggaataggattttgaccctagcttctgcttttctctatgctctcctcactaaccgtgttctactggttgaccctggagcggatatggttgatctcttttgtgagccatttccagattcttcctggcttcttcctagtgactttcctcttaatgctcagtttaataatttcagtcagaattctgatcattgttatgggaaaatgctgaaaagtaaagcagttacagattccactgttgcatcttttgtctaccttcatatagcccatgattatgatgatcatgataagcttttcttctgcgatgaagaacaacgttttctccagatcgtgccatggttaataatgaaaacagataactactttgtcccttctgtattcttaatgccatcttttgagcaggaactgaatgatctcttcccaaataaggaaacagtgttccatttcttgagtaggtatctgttccaccctacaaacagtgtgtggggacttgtggtcagatactatcaagcttatttatctaaagctgatgaaagagtgggcatacaaattagagtgtttgacactgaacctggtccgtttcaacatgtattggatcagatcttagcttgtactttgaagaagaatattttgcctgatgttaaccaccagcaggatgctaccaattcatcaggaattcccaagtcaaaagcggtactgatgacatccttaaactctggttattttgaaaaggtgagagacatgtattgggaatatcctacggtgacgggagaagtggttggcgtttaccagccgagccacgaaggatatcaacaaacacagaagcagatgcacaaccaaaaagcttgggcagaaatgtatctcttaagcttaactgatgtgttggttactagctcatggtctacttttgggtatgtggctcaggggcttggaggtttaaaaccgtggattctgtacaaacctgagaatcgaacagccccagatcctccctgtcgacgtgccatgtcaatggagccgtgtttccatgctcctcccttctatgactgcaaggccaagagaggaactgacacaggtgaacttgttccatatgtaaggcactgtgaagatatgagctggggccttaagcttgtggacagtgatagttatcgctag

SEQ ID NO: 1081 - DNA, 234 bp, Glycine max var. Williams 82
atgaagcatcttatgagcaagctgtggctgggaacatgcacacacactcttgactctacagtctacaccttgaaattagtaaagggtttgctgatgctagaatttggcttatttattttcaccatatatgagaatgaaataacgacacggcaaagctcaattaatcattattcatgctttcaggtcaactctgggacagttcccacaaaggcacacaccatgatgctgacttaa

SEQ ID NO: 1082 - DNA, 2207 bp, Glycine max var. Williams 82
gtttgaagacttagaagaagaagaaagcacatcaagaagggctagcttgcggagaagaaagagaaactacctttttccatatatggagcttgcttcggagagatctggtgatggaggtaatggactcaaggaagaagatagtgctggtgatgatgatggtcatcataaacaagagattattgtcgaggaaccacccgtgactaataccgaaagttccatactggaggctccgcctagcacatccccaaacaaaaaagaagaggttgttaatcagcttgagactgccaaagctgaaatgggtgtagcgagagaagaaaatcaactgctaaagacgtgtttgaacaaaataatgaatgaatatcggacactagagatgcaatttcaggatatactaaagcaacaagggacaaaaaagaacgctgataaaggaaatgatgataagcatgaagaaatattagaggaagcggatcttgtttccctctgccttggaagagttccaagaagtgatgagaaaatcaaagtttctaataagccattgaaggatgatgaagggttgactcttggactagagtgcaaatttgaaacatcaaagtcaggaagcacaaatgaagctttacctaataatccaagcccagaaaatagttgtgaagtagtaccaaaggaagaaggtggggaaagtaaggaggcactaaagacaatgagatcagacacagaggatgaagttgctcagcaaaatcctacaaagaaacctcgagtttgtgttagagcaagatgtgacactccaacaatgaacgacggatgccaatggaggaaatatggacaaaagatttcaaagggaaatccttgccctcgagcttactatcgttgcacaattgcaccatcatgcccagttagaaaacaggtgcaaagatgtgttgacgacatgtccattttattcaccacttacgagggaacccacaaccacactcttccaccatcagctactgctatggcatccacaacttccgcagctgcatccatgttattgtctggttcatcaacctctaactctgcctcaataccttcaacagcaaccacaaatctccaaggcctcaacttttatctctcagacggttcaaaaccaaggcaactatacctctccaaccctgcactatcatcttcactttcacatccaaccatcactctcgacctcactacttcacacccttcagcctcttcctcatcatcatcaccctttgtcagattcaattcaaactacaacaacaatcaccaacccagatacccctcttcctcatcaagcctaagcttcagtactagtaattcctccgaaattgctaatgctatatcttggagcaacggcttcctcaacaataataggaacatccttagcagtgtgaactttggaagacaacaaatggaaaacatgaaccagtcctacatgcaaaagaacaacaacaacacaagccttcttcctcaagctgatactatatctgcagcaacgaaagtgatcacagcggaccccgcttttcagtcagctttggcagcagcacttacttcgtttattggcggtggtggtgttggaaacacgcgaggaagtcaaggtggtaatgttgttggagaaagtttgagtttgggtcagaaaatgaaatggggtgaggtgtttccagcgtctaataattctaattcttcaatttcgaacaataaagtcaatggttgtgcatccagcttcttgaacaaaacgccggcagcgaatacacagacgaaaaatttgatgtttctgccgccgtcgtcattgccgttttcttctactcccaaaagtgcatctgcatctcctgctgctgataatagcgacaccaccaccaattgaccattaaactggagatcatggaggataaaaggaaaactcatcttgcgggtttgccaatgaatttcctggggaggggcgttatgatactagctagatataaagcaagttcagaatcaagttatatataacacgtttggttgcatatctcaatctagtttttcacgtgaaaaagtcgtaactatatatagcttctacattttagacattatttattgcttctcagctgttttatgagagcaaggtacgttgggatttatgataagacaaatgctaactaagtcttaaggacactaattaaaaaggtaaaagagaatgatagttaagcagcacaatcatagca

SEQ ID NO: 1083 - DNA, 738 bp, Glycine max var. Williams 82
atgagcacctgtccggggatatattttgatattggcaagaaggctaaagatgttcttcacaaggactattcaaatctatctccaattcactttcactaccaattcatggactataatgtagacctctcttgtaaagtagatgaacttgtacctggattcaagagccttttcaaatgcaccatacctgattctgggaaggtggaactacagcacttgagcaactacactgggattactggatgcattggattagaaggaaacctagaaaaaggatatgaccctgttctaaacttatcaggtcttgtaggaacaaacattctgtctcttggaggcaatgttgctcttgacctaccaacaagaacaatcagcaagctgaatgctggcttaggcctcaacactgacttccttgttgcttccttgaccatgcatgacagctttgacattgtgaaagcctcctgttatcatgaagtgaaccccctaaccaagactgccattgcagcagagctgaatcatagcttgtcaatgggggagactagtgccacagttggtgctcagcatgcatttttaccgcaaacgttggtaaaggctcgatttgacacctttggcagggcaggtgctcttattcaacaagggttctgggagagatgttttgtaactatggctggagaagtggagtttaatacctcggataataatttgcatcccaaggttggagtctctgtggctttaaaaccctag

SEQ ID NO: 1084 - DNA, 1752 bp, Glycine max var. Williams 82
atggaagaagcacaggtgcaggtatgggaagggtatgtagattggaggaacaggccaaccataaaaggacgtcatggtggcatgcttgctgcctcctttgttttggccgctgaggtattggagaacctagcatttcttgccaatgcaagcaaccttgttttatatctgtccaagtttatgcacttttcaccatccacctctgccaacattgtcactaacttcatgggaactgccttcctccttgctattcttggtggatttctagctgatgcgtttatcaccacttactccctctatctcataagtgccggaatagaattcatgggtttattaatgctcacaatacaagctcacaagccgtcactcaaaccaccaaactgcgtaattggaaacaccgacagtccatgcgataaaattcatggtgcggacgccgttatgctatttgcaggcctctatcttgtggctctgggcgtaggaggtataaaaggttcacttcctcctcatggagctgagcagtttgatgagaatacaccagagggaaggaagcagagatctgcatttttcaactactttgttttcagcctgtcatgtggagcattaattgcagtaacttttgtggtatggattgaagacaacaagggatggaagtggggtttagtagtctcaactgcatcaattcttctctccattccagtttttattcttggctcacacaagtacaggaccaagattccagcaggaagccccatcacatccatgttcaaggttcttgttgcagcaatttgcaacaactgcaaagctaagaattcaaccaatgctgtcagaagcatgactacaagtccatctcatgcaactgaaagggaagatggagaagaagaaagtaagactacaaaagaggttgttcaaggccaaactctaactgagaaccttaaattcctaaacaaagcagtgatggagccagcagttcacccaatgttagagtgcacagtaaaggaagtggaagaggtgaagattgtgacaaggattcttcccatattcatgtccaccataatgctaaactgttgcctagctcagctatctaccttctcagtccaacagtcagccacaatgagcaccatgcttggttccttcaaggtcccaccagcttctctacctgtgttccctgtcctcttcgtcatgatccttgccccactctacaaccacatcattgtcccatttgctagaaaagcaaccaaaactgaaatggggatcacacacctacaaagaatagggacaggcctgtttctctccattgtggcaatggctgtggcagcattggttgaaaccaagagaaagaaaacagcttttaagtttggtttgttggactcagccaaaccactccccataacattcctttgggtggcattgcaatacatttttcttggctctgctgatctcttcactttggctggcatgatggagttcttcttcacagaggcaccatggagcatgaggtctttggccacagcactttcatgggcctcactggccatggggtacttcctcagcactgttcttgtgtccaccatcaataaggtgactggtgcttttggacacacgccatggctcttgggtgccaacttgaaccattatcaccttgagaggttttactggttgatgtgtgtacttagtggactcaacttcgttcattttctcttctgggccaattcctacaaatacagatgttcaaccaaaccgggatatactagctag

SEQ ID NO: 1085 - DNA, 1950 bp, Glycine max var. Williams 82
atggaaatggggactgtagcatggattttcttggtgattatggtcacatttttctgcccttcctctcttgctctcactcaggatggtatggcgttgttggaaatcaaaagcactttgaatgatactaagaatgttctgagcaactggcaagagtttgatgaatctccttgtgcatggactggtatctcttgtcaccctggtgatgaacaaagagttcgctcaataaatctgccatacatgcaacttggagggattatatctcccagcattggtaaactcagtagactacagagattggcacttcatcagaacagcttgcatggaaccattcctaatgaacttaccaattgtactgagctaagagcactgtacttgaggggtaattatttccaaggaggcataccatcaaatattggaaatctttcatatttaaatatactggatttatcaagcaactcattaaaaggtgctataccttcctctattggccgtctctcacatttgcaaattatgaacttgtctaccaatttcttttctggtgaaattcccgacattggagtattaagcacctttgacaagagctcgttcattggcaatgtagatctttgtgggcgacaagtccaaaagccatgtcggacatcatttggtttccctgtggtgctaccacatgctgaaagtgatgaagctgcaggccctaccaaaagaccttcacattacatgaagggggtgcttattggtgcaatggcaattttgggtctcgtacttgtcataatcctttcattcctttggactcgtttgttatcaaagaaggaacgagcagcaaagagatacacagaagtcaagaaacaagttgatccaaaagcaagcacaaaacttattaccttccatggtgatctaccatacacatcatctgagatcatagagaagctggagtctcttgatgaagagaatctagtaggatcaggaggatttggtactgtttaccgaatggtgatgaatgactgtggtacatttgctgttaagcagattgatcgaagttgtgaagggtctgatcaagtgttcgaaagggaactagagatcctcgggagcatcaagcacataaatttagtaaatctgcgtggttactgcaggctcccttcttcaaggctccttatctatgactatgtagcccttggcagcttagatgatctcttgcatgaaaatactcaacaaagacaactattgaattggaatgatcgcctaaagatagctcttggttctgcccagggtttggcatacctgcaccatgaatgcagcccaaaagttgttcattgtaacataaaatccagcaacatactgcttgatgaaaacatggagcctcatatatctgattttggtcttgcaaagcttttggttgatgaaaatgcccatgttaccacagtggttgcaggcacatttggttatttggcacctgagtatctacaaagtgggagagcaactgagaagtcagatgtatatagctttggagttctattgctggaacttgtaacaggaaagaggcctacagatccttcctttgtaaaaagaggtttaaatgttgttggttggatgaacacgttactgagagaaaacagaatggaggatgtggttgacaaaagatgcactgatgcagatgcaggaactcttgaagtaattcttgagctggctgcaagatgcaccgatggaaatgcagacgatcgtccttcaatgaaccaggtgttgcagttgctggaacaagagaagtacaatgtgttcatggcccaaataggctgtgctgcaattggagttttggcattgacaatatttggacctggatggctggccaggagtgctagtattggagcctccgttgcttacatgatcatcacaaatcccgttcaccccccagcatgccgttgcttttcattgatggtcctaagttccatcacttga

SEQ ID NO: 1086 - DNA, 1791 bp, Glycine max var. Williams 82
atgacaggagtagaggctatggaaaaaaatgagaaaagtgtgacagatgaggagccaaagattaactacagaggatggaaagtcatgccctttatcattgggaatgaaacttttgagaagctaggaaccattggaaccttggccaacctcttagtctatcttacaaccgtcttcaacttgagcagtcttgcagctacaaatattgtcaacatctttaatggcagcgccagtttatctaccttgctcggggcttttctttgtgacacttattttggccgctacaagacactgggattctccacaatggcttcttttctggggttgcttgttatacaactaacagcatggattaagaaaatgcatccacctcactgtggaagagatagcatcacatgcataggcccaaccacagggcaaatgggatttctacttgctggatttggacttctaattgtgggagctgcagggattagaccttgtaacttagcatttggagttgatcagttcaaccccaacactgagtctggaaagaagggaatcaatagcttcttcaattggtacttctttaccttcacatttgctcagatggtgtctttgtcactaattgtctacatacagtcaaacgtgagctgggcaatagggttgggaattcctgcggctttgatgttagtctcttgcacactctactacatgggaagcaattattacgtaaaagttaaagcaactggtccagctccactaacaagtatagctcaagctatagttgtggctgtaaagaaaagaagactgaatctatcagaatatccattggattcgctctttacctatatttctccccagtctattaactccaagcttcctcatacgtctcagttcaggttactggacaaagctgcaattataaccccacaagatggcataaacccagacgggtctgcatcagatccttggagtctttgcagcatgcagcaagtggaagagctgaaatgcttgctgagagtgatccccatttgggttgcaggcattatcttctacgttgcaattgtccaacagaacacaatgttggtcttccaagcccttcaatctgatagacgcgttctcaacaccaacttcaagatccctgcagcctcctacaccatcttccagatgctaagcctaaccatatggttaccaatctacgaccgaatcctcgtgccttcgctccaaagggtcaccaaaaaagagggtggcatcacagttcttcaaaggatgggctttggcatgttcctctctatactatgcacaatggtgtctggtgtggtagaagaacggagaagaacactagctttaactaatcctataggagtagagccaagaaaaggtgctatttcttcaatgtcaggtctatggttggttcctcagttaacactggcagggctatctgatgcattcacgattgtgggacaagttgaatttttctacaaacagttccctgagaacatgaaaagccttgcagggtctctatttttctgtggtcttgcgggatcaagttatttgagtagtttgctgatttctattatcaatagggtgacggctaaatccttaactgggaattggttgcctcaggatctcaaccaggggaggttggattatttttattacatgataactgctatagaagtcgttaatttcggttactttatattgtgtgccaagtggtatagatacaaagggactggtcctagcagaagtggtgaccttgaactcgatcaagtatccaaaccatatgaaagaactgttaacagtgtctaa

SEQ ID NO: 1087 - DNA, 1620 bp, Glycine max var. Williams 82
atggggaactgcaacgcctgcgttcgagtcgatgacgtggcagactcaaaccgcggcaaaaagaataagaaaaccaaaccgaacccctacgcggaggaagagatacgctccggcgttccgatccgtgtgctgaaggacgtgacgtcacggagcctcatcggcgacaagtacgtgataggccgggagctaggtcgtggcgagttcgggataacgtacctctgcacggaccgcgaaacgaagcaggagctcgcgtgcaagtcgatctcgaagcggaagctgagaaccgcgatcgacgtggaggacgtgcggcgagaggtggcgatcatgtcgacgctgccggagcacgctaacgtggtgaagctgaaggcgacttacgaggacgaagagaacgttcatctcgttatggagctctgcgccggcggggagctcttcgaccggatcgtcgcgcgggggcactacagcgagcgtgccgccgcgaacgtggcgaggaccattgctgaggttgttaggatgtgtcacgccaatggtgttatgcatcgagaccttaaacctgagaattttctctttgcgaataagaaggagaattctgttctcaaggctattgactttggactctccgtgtttttcaagccaggggagaggttttcggagattgtggggagtccttactacatggcgccggaggtattgaaaaggaattatgggccagaggtggatgtgtggagtgctggggtgattctttatattttgttgtgtggagttcctccgttttgggcagaggacgaacgaggggtggctttggcaatattgaggggagtgattgacttcaagagagaaccgtggcctcagatttcagatagtgctaagagtcttgtgcgccagatgttggagcatgatcctaagaagcgcttgacggctgaacaggtgcttgagcattcctggttacaaaatgcaaagaaagcttcaaatgttccattaggagatattgtgagaacaaggcttaggcaattctctttgatgaatagattaaaaaagagagcacttcgggtaattgcagagcatttgtctgttgaagaggtagaaataatcaaagacatgtttacattgatggacacaaacaaagatggcaaagtaacatatgaggagctgaaggttgggttacggaaggttggttcacaattggctgagccagagataaagatgctgatggaagtggctgatgttgatgggaatggagtacttgactatggagagtttgtagccgtgacaattcacttgcaaagaatggagaatgatgagcatttccgcaaagcattcatgtattttgacaaagatgggagtgggtatatcgagttaggtgagctggagaaagcattaacagatgagtcgggagatactgatactgctgtattgaatgacatcatgcgtgaagttgacactgacagggatggtcgtatcagttatgaagagtttgtggccatgatgaaaactggaactgactggagaaaagcatctaggcagtattcaagggagagattcaagagcttgagcataaatttgatgaaggatggctcacttcagcttcatgatgatattagtggtcaagctgtagtggtttga

SEQ ID NO: 1088 - DNA, 243 bp, Glycine max var. Williams 82
atggatgggaacaactacaattcctgggctgatcagtgggatgatgggccagaccctgtgatggttggttccaataacaaaaacagcaacgacaacaccgccaaatacaagcaaaagctcggtgagggttttggcaagaccaaagcagtggcctccaccggtgtgaagaagttgaaggatggtacctccgttggcctccactggatcaagaccaagtattccaaagccacacagaaacattga

SEQ ID NO: 1089 - DNA, 543 bp, Glycine max var. Williams 82
atgggaaattgccaagccgttgacactgcaactctagtgattcagcaacccaatgggaaagtagaaaggttgtattggcctgtgagtgctagtgaagtgatgaagaccaaccctgatcactatgttgctcttcttatctccaccacattgtgctcatccaaggacaatgaaaattgctcgagtaagagtgacaataccaccaaccctgttcgccttacccgcatcaagcttctcaaaccaactgatacccttatgcttggccaagtttatagactaatctcagctcaagaggttatgaagggtctttgggaaaagaaacaagcaaagatgaagagaaacttgtcggaatcagcacaaaagccaaatctgatgaaggaaaggacagacaaatcaacaaggaggtccgagccggaggacaaccaggaaaccaaagctgaaagacacgggtcaaggacagcatcaactaataatgcttctagtgccacagctaagtcaagaacatggcaaccctctttacaaagcatctcagaggcagccagctga

SEQ ID NO: 1090 - DNA, 576 bp, Glycine max var. Williams 82
atgaaaaaaccaaacactagtactagtggttcaccaaaacttgatcgcaaaactatcgaaaggaaccgcaggattcacatgaaatctctctgcttcaagcttgtttccactattccttccaatgacctcaaacccaccaaggacatgctttcccagcaggatcagcttgatctagcaaccacgtacataaagcgtctgaaggaaagaatagagaaactgaagggggagaaggagaaaatcatgaacatgatgatgagctcaaaccaaaacaacaatagcattttcaatattggctcacagttgcctctacttgagataaaggacttgggttcgggcattgaagtgatgttgataagtgggttaaataagaacttcatgctctatgaagtaattagtgtcctcgaggaagagggtgctgaagttgtcactgccaacttctctacagttgctgataagattttttacacggttcatgctcaggttaaaatatcaagagttggtgttgagccaacgagggtatatcaaaggcttcaggagttgattgcaccactagaaatctgggagtacataccatga

SEQ ID NO: 1091 - DNA, 900 bp, Glycine max var. Williams 82
tatatcaccaccctcaaccaaaccatagtggctcaagcactctatagcatatacttgcctttgtgaaattgaaaagatgaaaaaaccaaacactagtactagtggttcaccaaaacttgatcgcaaaactatcgaaaggaaccgcaggattcacatgaaatctctctgcttcaagcttgtttccactattccttccaatgacctcaaacccaccaaggacatgctttcccagcaggatcagcttgatctagcaaccacgtacataaagcgtctgaaggaaagaatagagaaactgaagggggagaaggagaaaatcatgaacatgatgatgagctcaaaccaaaacaacaatagcattttcaatattggctcacagttgcctctacttgagataaaggacttgggttcgggcattgaagtgatgttgataagtgggttaaataagaacttcatgctctatgaagtaattagtgtcctcgaggaagagggtgctgaagttgtcactgccaacttctctacagttgctgataagattttttacacggttcatgctcaggttaaaatatcaagagttggtgttgagccaacgagggtatatcaaaggcttcaggagttgattgcaccactagaaatctgggagtacataccatgatcaaattaaagagccactatcgctagccgtattgctggccaattagaaaatgacaacatgcaatattgagagtagctagttataatagtgaatcaatatctcaagtattagcaagcttaggttgcatatgttttaggaaatttattggtttaaagaagtctcttctcttcacgtattcagacaattgttacttgtttttttatctttggtaatttcagataatgtgttacttctttcatgtgtttaaa

SEQ ID NO: 1092 - DNA, 903 bp, Glycine max var. Williams 82
atgttggcaccaaaaactcacacgtgcgaggctctttctctttctctgccacaaccgtcatctcctcctccggagcccgtgaacatcctcttccgccgccgccaactcctcagcgccaccgcatccaccatttccttcaatttcactgtccctttcacaacctctctgtccatgtcagagccggtagccagtgccggcggcctcttccaaatgcccccaccacgcctcatcaaccggtattttctggtgagagcgggtgagtcggagttcgagagcatgggagttatcaacacaaacccagtggagaagacttctgtggatagcggcttatctgaaagagggaagaaacagtctataaaatcagcttttgatttgaaagaaatgggagcgtgtgacaagggctgttggatctggtctgctattactcagagagcttaccagactgctgagattattgcttctgttaatggagttacccgtagttatatagtcccagaatacagctttctggatgcccgtggattaggtgcctttgaaggaaaaaagttggaatatgtttcagaagtgtatgcatcagatggtatatctccgaacatcaagcctcctcccattaatgacggaactccgaatgagagtgttgcagatgtttttgttcgtgtgacacagctcatgtcaattcttgaaactcagtattcgggtgacaccgttattattgtgtcgccagattctgacaacttgacaatccttcaggcaggtttgataggactagaccttcgaaggcacagggaactgtcttttgcacctggtgaagttcgctttgttgatcccaatgacattcccgtatataagcagcctgcatctgctatatataaatgttccaagaacccaccaaattgtaactaa

SEQ ID NO: 1093 - DNA, 2010 bp, Glycine max var. Williams 82
tttgatgaaaatcgcgtcccaaaagaacttttctagagtggaatgaaaaatgcttattatgttggtgggtcaattggcgtgttgcgtagctgaagaggatatgcttggagaaggagaagagcaaataaaacgattctgttattttttttttttctttctttcgctaatccactcattcacttggtcctcatctatacaactatagtctcatcccctgtttttccctttggcttaggaattgcaactcagcagtgagttgcgaacatggccacccaatctccgcctcctcccactcccaccgccaccgaccaaaaccaaggtgtaggttctgaagttgtgcaagcaacaaatgtggatcagcaaaatgccagagaagagccagctaaacagagttcaactacatcagtctttgtgaactcacaaccaatgcgggaagaacaaattcagaatgctgtgaaatttctatcacacccaaaagttagaggttcacctgtcatgtataggcgatcatttctagagaagaagggccttacgaaggaggagattgatgaagcctttcagcgtgttccagattcagctccaactgtgcagacaggtggtgtaaatcaagatgggcaattgaaatcatcatcaaacattcagcaacaagcccaacaacaaactttgcagccgggtttacctgcttctactggtgttaatacttcatcgggaaccttatcacgctccagatttcactggtcccatgcccttattgcagttggattactggctgcttcaggtgctggaacagctataataattaagaattctgttctccctcggttaaaatcttggatacgtaaggttgtcttagacagtgatgatgaacaattaaagaaaactgacaacaaaccaacaccgatggaagaagctgtgcaagctgcaaaatcagctgcagctgcagctgcagatgtggcaaaagcgagccaagaaatgctggcttcaaaaggcgaagagaggagatactttgtggaagttgtgagccttttagataagcaagtacaagaaatgaagtcaatgaccaatgccataagaaggttggaagggcaagaagatcttcgaatcagtcaaacaagttcaaagcaactgattgtgaatggaaaagcagactacgacatgagttcagtgagatcttcatccccacctacatctgttgaaccatcaagtggtcttcatccaaaggcatatgcggagataatggccatggtccaaagaggagagaagtcttctaatattaagcatcgggaggttagtcaggtgcaaagcacatctacccagatgcttcagtctcaagtaaatggtgaagacttgaataccaaggccctggatgcccctctattaaatggggatgacccattaccctggtggcagaggaaaaatgtcagaattagagagattgataatgaaaatgagtctaatggagtacccaatggtgctgcatccagtcagcagccaatccaacagccagttcaacgcgtatgggttcctcctcaacctccccccatagctatgccggaggctgcagaagcaatcaggcggccaaagccagcggcccaaaaggaacagatgtctgataatcagtcagtagctcattctttagacggttccgatgatgtacatatggacccaaaactattggaatctgaaggtgcagttgagggaagcagtgtcagctcggttcccacttctagtgagatacaagaggagcatgaagtcaaatatgatgagaaatgaaggtgaatcatgcatgatctatcatgaaaaacatgatttggaataagcttgtcacacaatctgtttcataatcatattagttgtactttgaactggacatcaatacaatatgcaaacgcacgtatctttctatgcaataaatttgtttactaatgtaaaaaggtttaattactctgccgtccctgaacttttactaaattctgtgatgatgtgcattttaatatattttttattcag

SEQ ID NO: 1094 - DNA, 984 bp, Glycine max var. Williams 82
atggatccattggggaaacgccctgctgccgaggacgattccctaatttccgattgcgagagcggggtttccgctggagacacgccgccgccgttcgtcgaaaacgccgacctcgtccggaccagattcgttcgtggcctcgtcgcgcactgcttcaaacccgaggttctggcagttcgcagaaacgtgtgttcctccgtcatggccctggcgcgtcaacattcctttcacgtcttcgcgcgtgccgtggccgaattgcgcggcggcaatgccaacgtgaagttcgcctggtacggtgcgtccagtaaggaagagataaatgacatcattcagcacggtttcggtcacgctcacagtaacggcctgcgtctctctccacaagattctccacttgaaagtgtgaagagttccgttgtggacgaagacggtttgaggcacttgttgctgtgccgcgttatcttggggaagacggaggtggttccacgtggctcctaccaatgccgttcgagttctcaagagtttgattctggggtggatgatctttccaatcccaaggagtatgttatttggtgtaaccagatcaacactcatgttttgcccgaatatgttttgagtttcagacttccttcaccattgaaagggattgtgaagattggggaacctttgaggccttcttcgccgtggatggcattcccagctttgatttcgatgctttcgaagattttgcctccgtccgaggttgcctccattgccaagtttcacaaggattatagagaaaagaggatttctcgacatgagctgatacagaaagtgagagtaatagcaggcgacaaattgctactttccgtcatcaaatctttcagagccaagaaaatacctgcaaactttaaagatgacaaggcgaaagaatggcaagcggacagccagcagcttgaacggaatgattgttcatatgggagttctattagctattacaggaagtga

SEQ ID NO: 1095 - DNA, 2112 bp, Glycine max var. Williams 82
atggctgcctacaccactttctccttcttttcaaccccgcagaaccaaaaaaccttttttcttcaaccctttaaacgccacgtttcgtttcttaaaccattcaaatgcgtccgacctggttcagcttcaacccgattcagaccgaaccctgttatttccagctccgcgctccgtacctcggcactggtcgttccctctaaactcgagcacctagcggaggagttcggctccctgcgggagccggtggagcgtgtgaagcggctgctgcactacgcggcggcgatggcgccgatgccggagtccaaccgggtcgacgcgaaccgggtgatggggtgcaccgcgcgcgtgtgggtggaggtggggatcgacgaagagggaaaagtgcgcgtggcggcggacagcgattcggagattacgagggggttctgcgcgtgtctggtttgggtgctcgatggttcggagccggacgaggttatgaaagtgaccaccgatgatttaacggctctgaatgtcgggttgccggggggcagtgggcgttccagggtgaacacgtggcacaatgtgctcgtcagcatgcagaagaggaccaaacagttgctggctcagagagaagggaaggttccctttgagtcttttccttcgttggttatttcttctgatggggttttccccaaaggtacctacgctgaagcacaggcaaaatatctgttccctaatgagttaaaagttgatgaactagtcaatgtgctgaaggagaagaaaattggtgttgttgcacacttttacatggatcctgaggtccaaggcattttaactgctgctcagaagcagtggccacatatccatatatctgattcactggtcatggcagattcagcagtcaaaatggcaaaagccggatgccagttcataacagttctaggtgtggattttatgtcagaaaatgtgcgtgccatccttgatcaagctggtttcagtgaggttggcgtgtataggatgtcaaatgagcaaattggatgttctctggctgatgcggcagctactcgtacttacatggaatatcttacagctgcttctaggtctacttctttgcatgtcatatacattaacactaagttagagacaaaggcatatgctcatgaacttgtgcctacaataacctgtacttcatcaaatgttgtccagactatcctacaggcatttgctcaagttccagatttgagcatattttatggacctgattcttacatgggtgcaaatatcaaagatttgttccaacaaatgacaaaaatgactgatgaagagattgctgcaatacatcctgagcacagtcaagactctattagatcattactacctcgacttcactattttcaggatggaacgtgcattgttcaccatctatttggccatgaggttgtggagaagataaaagaaatgtactgtgatgcattccttactgcccatcttgaggtacctggagagatgttttcattggcaatggaagcaaagagaaggggaatgggtgtagtaggctccacaaagaatattttggatttcataaaggacagggttcaggaagctttggatagaaatatagatgatcatctccaatttgttttaggaacagaatctgggatggtgacttcaattgtggcaacagttcgtagtttgttggagcctgtgaagtcttcttctgaaagagcaaaagttactgttgaaatagtctttccagtttcatcagactcaatctcaacgaccacctcaagtttatcctccggccttcagactgccaaagtgggtgatatcatacttcctgttgtaccaggaatagctagcggggagggctgttcaattcatggtggctgtgcatcttgtccatacatgaagatgaattctcttggctcactcctgaaagttagcaatcacctacccgatgaagaaaatatcctttctgcatacaaggcagagcgatttaagttgcaaacaccgaatggcagatcagtggcagatgttggatgtgaacctatattgcacatgaggaacttccaggctactaaaaagcttccagagaagcttgttgatcagattcttcgtccccaacacagttga

SEQ ID NO: 1096 - DNA, 1143 bp, Glycine max var. Williams 82
atggcttcttgtgtgtcatccatgtcttctaccatcctcatcctaattgccatctgcacactgtcctcacttctgtcagctgcatctgcagcaacagaggagggacgaacaaggcccttcaaaagggtctatgcctttggagactctttcacagacactggcaacaccaaaaatgccgaaggtccaagtggctttggtcatgtttcaaactctccctacggcaccactttcttcaaccactccacaaacaggtactcagatggtaggcttgtgattgattttgtagctgaagcactttcactgccttacttgcccccctaccgtcacagcaaaggcaatgacacttttggtgttaactttgctgttgctggctccacagccataaaccatttgttctttgtgaagcacaacctctcccttgatatcactgctcagtccatccaaacccagatgatatggttcaacaggtacctagagagccaggaatgtcaagaatcaaagtgtaatgattttgatgacactctgttttggtttggggagattggagtcaatgactatgcctacactcttggatctactgtctcagatgagaccataaggaagcttgcaatcagcagtgtctcaggagctttacagacgttgcttgagaagggtgccaagtacctagttgtgcagggtatgcctctaactgggtgcttgacattgtccatgtacctggctcctccagatgatagggatgacattagatgtgttaaaagtgttaacaaccaaagctactaccacaatcttgtgctacaagacaaattacaagaattcaggaaacagtaccctcaagctgtcatactttatgctgattactatgatgcctaccgcactgtcatgaagaatccaagcaaatacggattcaaagagaccttcaacgtttgctgtggatcaggagaaccaccttataacttcactgtgtttgccacatgtggcacacctaatgccactgtgtgttcaagcccttctcagtacatcaattgggatggtgttcatctcacggaggccatgtacaaagtaatttctagtatgtttttgcaaggaaatttcacccaacctccgtttaattttttgttggaaaaaaaggagagggtggggtga

SEQ ID NO: 1097 - DNA, 678 bp, Glycine max var. Williams 82
atggaagctgtgtgtggaagtgtttgggtcacatcctctcttccacgctcacccaagtccactctctctctattccgctctactcatcaacacctaacagcatttccttcacaatcccatcttttcttatatcaccctcctccctatgctaatgctaaaaccctccgcgccagaacctcctccaaacccgccattttccttccccacttaattgcttctctggaacaagttgaccagacttacataatggtcaagcccgacggcgtgcaacgtggcctcgtgggagaaattatttctaggtttgagaagaaagggtttaagttaactggcttgaagctcttccagtgctcaaaggaattggctgaggagcattacaaggacctaaaacaaaagtcattcttccccaagctgattgactatattacttcaggtcctgttgtgtgtatggcttgggagggtgttggggtagtcgcatcggcccgtaagcttataggggctacagatcctcttcaagctgaaccaggcacaataagaggagaccttgctgttcagacaggaaggaatgttgttcatggcagtgacagtcctgagaatggcaagcgtgaaatagctctatggttcaaggaaggcgaagtatgcgaatggaccccagtccaagcaccatggctgagagaataa

SEQ ID NO: 1098 - DNA, 1536 bp, Glycine max var. Williams 82
atggcccctcctccttatagtgcctacaacggagaaatcgatggggaaaatctacctctagcttttgatatctgggaaaatctatgggcctatggctattaccctcatcaacctatttcggagatcaatagcacttctacattggttgatttccccttttgcgatggcaccatcgtcagggataacaaaagggtaaagagaaccgtgtgcttccctatttataacagcattaattgccatagtttcttcaacaccaacaacagcagtagtaggaatagcataccaaagctccacttcagagatcacatacggacttacactcaaagatatctcgcagctgaacccgtagaagatacaaacagttcagaaagtagtggaggcgaagaagatgggtgtgcagatggagtgaggcttgttcagcttctaatagcatgtgcggaagcggtggcttgtcgtgacaaatcacacgcttccatattactatccgaacttaaagcgaatgctttagtgttcggatcctcattccaaagagttgcttcctgtttcgtccaaggcctgatcgagaggctcaatctgattcagcccatcgggcctgctggccccatgatgccctccatgatgaacatcatggacgtggcctcagacgaaatggaggaagcattcaggttggtttatgaactgtgtccgcacatccagttcggacactatttggctaattccacaatattggaagcctttgagggtgagagttttgtccatgtcgtggacctaggcatgagcctgggtctacgacacggacaccaatggagaggtctgatccagaatcttgccggtcgtgtaggcggcgaacgtgttcgtcgcctgcggatcacgggggtggggctctgtgagaggcttcaaaccattggagaagaactctccgtttatgcaaacaatttgggcgtcaacttggagttctccgtggtggagaagaatttggaaaatctgaaaccagaggacattaaagtgagggaagaagaggttcttgtggtgaacagcattctgcagctgcattgcgtggtgaaggaaagccgcggggctttgaattcggtgctgcagatgattcacgggcttggacccaaagtgttggtgatggtggagcaggactcgagtcataatggacccttttttctagggaggtttatggaatcattgcactattactcttcaatttttgactcgttggatgttatgctgccaaagtatgacactaagagggcgaagatggagcagttttactttgctgaggaaataaagaacattgtgagttgtgaggggcctttgaggatggagagacacgagagagtggaccagtggaggaggagaatgagcagggctgggtttcaggctgcgcctattaagatggtggctcaggcgaagcagtggcttctcaagaacaaggtttgtgaggggtatactgttgtggaagagaaggggtgtttggttcttggatggaaatcgaggcctattgttgcagtttcttgctggaaatgctga

SEQ ID NO: 1099 - DNA, 1215 bp, Glycine max var. Williams 82
atggctcagttgaaagcatcccctgttactgctccttcccttcatacaacaggtgttgccctacgtggaaaattgagtaaggttgtgctggcttacagtggtggcttagacacatcagtcattgttccatggctcagagagaattatggttgtgaagtcgtttgcttcactgctgatgttggccaaggtatacaagaattggaaggtttagaagcgaaagctaaagccagtggggctagtcaattagtggtaaaagacttgaaggaggaatttgttagtgactatgtatttccttgcctacgtgctggtgcagtttatgagaggaagtatttgcttgggacctcaatggcccgccctgtaattgcaaaggccatggttgatgttgccaaagaagttggagctgatgccgtttcccatgggtgtacagggaaagggaatgatcaggttcgttttgagctcactttctttgctctgaaccccaagctcaacgttgtggctccgtggagggagtgggatattacagggagggaagacgctattgagtatgctaaaaagcataatattcctgttcctgtgacaaagacatccatatatagcagggataggaatctttggcaccttagccatgagggagatattttggaagacccagctaatgagcctaaaaaggacatgtacataatgtctgtagaccctgaggatgctcctgatcaaccagaatatgtggaaattgggatagagtcagggcttcctgtttcagtgaatgggaggaggctttcaccagcatctttacttgctgagctcaatgagattggtggaaagcatggaattggcagggtcgacatggttgagaatcggcttgtagcacgcgagttggagtctttgacacttgatcgtgaaacaatacaagtcaaagattcattagcccttaaatatgcagagttagtgtatgctggcagatggtttgatccgcttcgggagtccatggatgcctttatgcagaagatcacggagaccacaacaggttctgtgactttgaaactttacaaaggttctgttactgcaaccagccgaacgagtccctttagcctgtataggcaagacatttcatcgtttgaaagtgggcagatatatgatcaagctgatgctgctgggttcatcaggctttatggtcttccaatgcgggtccgagcaatgcttgaacatggcatctaa

SEQ ID NO: 1100 - DNA, 879 bp, Glycine max var. Williams 82
atgaaagggatgaatctcaccaaaaagaaactcatccctatccttgttttgatcctttcagtcatatcaatcctcagacttctgagcctcaatgtcaagactttgcctttttcggctaggatatctgttttgtccccagctcctcaacacaattgttctcaacctttgtccacctgcaacaaaactgcatcacatgcacctgaatcctcagatcagcctataaatactcccaacatcaccaccaccctgactgagaaagaattcaaagttctttctgatctcattgctcttaaatccccatgcaacctcctcatatttggctttcaaccccagtaccttatcctctcttccatgaatgcagctggtagcaccatctttctcgacgaagaccctgataaaataagcaaggtaagaaaaatctccaacaacactcaaatatacaaacttgagtataacatgccagcaaaagcaggttacaaacttctcaagaacgcaaggctgaacccagcgacatgtgtaccaaatcctagattccttcaaaaatcaaaatgcaagcttgcattgaaaaacttgccatcgcaagtgtatgagaagaaatgggatgtcatggtggtagatggtcccaatggggattcaccagagtcaccaggaaggatggggtccatttacactgctagtgtactagctagatctggaaatacttcagatgtagtagtacatgatgtagatcgtatgatagaaaaatggttttcatgggagttcttgtgtgatgggaatttgttgtattctaaagggaagttatggcatttcagaatcaaagttcactcaaattccacaagattctgccctgctgaggaaggtagtactatagggaaatag

SEQ ID NO: 1101 - DNA, 1746 bp, Glycine max var. Williams 82
atgggtgtttggtggtggaagctgtttgttgctgctcttgctgggattctcttctcaacccaacattgtgcttcccaaaaagttccaaactacacatttatgcacaatgcaacgacagcaccagacgtatcatactacgactacatcgtaattggcggcggcaccgcagggtgtcctttagctgcgacactgtcccaaaattacagcgtgttgctccttgaacgcggtggttcaccctacggcaaccctaacatctccgacttagctgctttcggtgctgccctctcagacacctcccctacctctcccgctcagcgtttcatctccgaagacggtgtcatcaactcaagagctcgcgtcctcggtggtggaagttgcttgaacgctggcttttacactcgcgctagccctcaatatgtaagggaagcggggtgggatggaagggtagtgaatgagtcgtacgaatgggtggagaagatagtggcatttgagccacaattgaagcagtggcagtcatctgtgcgggatggactaatagagataggtgtggtgcctaataatggcttcacttatgaccatattgatgggactaaagtagggggcaccatctttgaccagaatggcttcaggcacactgctgctgatcttctgcaatatgccaaacccactggaattaccctgcttttggatgccactgtgcataggatcttgtttagagtcaaagatagatcaaaaccaatggcccatggagtggtgtttagagattcattgggtcgtaggcacaaggcgtacctgaagcccgatccaaggaacgagataatcgtttcggccggtgcacttggaagcccacaacttctaatgttgagtggaattgggccggaagagcaccttaaagcccacaacatcagaataacattggatcagccattagtaggacaaggaatgtcagataaccccatgaacgccatctttgtcccatctcctgtccccgtagagatctctctgattgaggtggtgggcatcaccacttttggcacctacattgaagctgccagtggtgaaaactttgccggtggttccccaaaagactacggaatgttctcccccaagattgggcaactctcaacggtgcctccgaagcaaagaactccggaggccctagccaaggcaatagaagtgatggaaactctggaccaagcagcattcagaggtggattcatcctggaaaaaatcatgggtccaatatcaagcgggcatttggagctccgaagccgtgatccgaacgacaacccctcagtgaccttcaactacttccaggacccgcgagacttgcagagatgcgtgcagggcctgagcaccgtggagaagataatcgagtccaaggcattctctcccttcagataccccaacatgcctgttcctgtgctgctcaacatgaccgcaagtgcccccgttaacttgttgcccaagcacaccaattcttcactatctttggaacagtactgcaaagacactgtcatgaccatttggcactaccatggaggctgccaagttgctaaggttgttgatagggactacaaggttcttggtgtggacgctctgcgtgttattgatggctccacctttaactactcccctggaactaatcctcaggccactgtcatgatgcttggcaggtatatgggagtgaaaatattgagcgagagactaggtggtgcggctgctgctgatgaaacagagcaataa

SEQ ID NO: 1102 - DNA, 2070 bp, Glycine max var. Williams 82
atgccacctactattatgagctctgaggaacagccacgaatgatttattcataccggaatgtgatgagtggttttgctgcaagactcactgaagaagagctgagatcagtgcaaaagaagaatggctttatttctgcgcatcccgaaaggatgctgcatcgtcaaaccacacataccccacaatttttggggttgcagcaagacatgggattttggaaggaatcaaacttcggaaagggagtaattgttggggtggtggactctggaatcgagcctgatcatccttcattcagtgatgcaggaatgccaccaccaccactcaaatggaaagggagatgcgaacttaatgcaacattttgtaacaacaaactaattggagcaagatctttcaacctggctgcgacggcaatgaaaggagcagattcaccaattgatgaggatggacatgggacgcacacatcaagcacagctgccggtgcttttgttgatcatgcagaagtactaggaaatgccaaaggaacagcagctgggattgccccttacgctcacctggcaatgtacagagtatgctttggagaagactgcgctgagagtgatatattggcggcattggatgcagctgtggaggatggcgtggatgtaatatcaatatccctcggcctaagtgagccacctccatttttcaatgatagcattgcaataggtgcatttgcagcaatgcagaagggaatctttgtaagttgtgcagcaggaaactctggccctttccatggctccttagttaacggagccccttgggtcctcacagttggagcaagcaatattgacagaagcattgcagcaacagcgaagctgggaaatgggcaagaatttgatggggaatctgttttccagccttctgatttttctccaacattgctacccttggcatatgctggaaagaatggcaaacaagaagctgcattttgtgctaatgggtccttgaatgattgtgatttcagaggcaaggttgttttgtgtgagagaggaggaggtataggaagaattgccaaaggagaggaagtaaaaagagtaggtggtgcagccatgattctcatgaatgatgaaagcaatggcttcagtgtcttagctgatgtgcatgttctacctgcaacacatttaagctacgattctggactgaagattaaagcctatataaattccactgcaatacctacagccaccattttattcaagggaactataattggaaactccttagctcctgctgttacatccttctcttcaagaggtcccaacttgccaagtcctggtattttgaaaccagacatcataggaccaggcgtgaacatcctagctgcctggccattccccctgaataacgatactgattcaaaatccactttcaacattatgtctggcacatcaatgtcatgcccacatcttagtggcgtagctgctttgctcaaaagctctcatcctcactggtcaccagctgccataaaatctgccataatgacttctgcagacataatcaattttgaacacaaactcattgttgatgaaacactttaccctgcagatgtctttgccacaggttctggtcatgtgaatccatcaagagcaaatgatcccggattagtttatgatattcaacctgatgattatataccttatctgtgtggtctaggctatggtgatactgaagttgggatcattgcacacaaaacaattacgtgctctgagacttcaagcattcccgaaggagagctcaactatccctcattttctgttgtgcttggttccccacagacattcacaaggactgtgacaaatgtgggtgaggccaactcatcttatgttgtcatggttatggcaccagaaggggttgaagtgaaggtccgaccaaataaccttaccttttcagaagcaaaccagaaagagacatattcagtgtccttcagccgcatagagtctggtaatgaaactgccgaatatgctcaaggatttttacaatgggtctctgccaaacacactgtaaggagccctatcttggtcgactttgtataa

SEQ ID NO: 1103 - DNA, 2070 bp, Glycine max var. Williams 82; identical to SEQ ID NO: 1102

SEQ ID NO: 1104 - DNA, 651 bp, Glycine max var. Williams 82
atgaaactagtttggtccccagagacagcatccaaagcatacatcgaaacagttcaatcttgtcggattttccgggaatcgggggtggcggagctagtgtcggcaatggcggcggggtggaacgcgcagctgattgtggaaacgtggtcggaggggggagtgatggcgacgagcgtggggttggccgtggcgaggacgcacacgggagggaggcacgtgtgcgtggtgccggacgagaggtcgagatcgaagtacgcggagagaatgggggaggcggggatgtcggcggagatagtggtgggggaggcggaggaggtgatggaggggttggccggcgggatagacgtcatggtggtggattccacgcgcgtgaacttctcgagagtgctgaggctcgcgaagctgagtaacaaaggtgcagttttgataagcaagaacgtgaactccgccaccaatagtgctacttccggtttcagatggcggagcgtgctggaagaagggtcgcgtcgtgttgttcgttcggtgtatctaccagtggggaaggggcttgagatagcacacgtgtcggccattgggggaggctcggctgctaagaaatggttcaagcatgttgaccaacaatcaggggaggtgcacgttattagacgatga

SEQ ID NO: 1105 - DNA, 1434 bp, Glycine max var. Williams 82
atggcgtgggcgaagaagccaggtgactcaaataatgtaggctttatgagatggttagcgttggtgttggtgttggtgttgttatcgggcttttggtgtgtttcgggtgtgaaagaaggaaaaaggaatgcgtacgcgacaatgatgtacgtaggtacgccgagggactacgaattctacatagccatacgcgtgcttctgaaatcgctggctacgctcgacgctcaagccgatcttgttgtcattgcttcccttgatgttcctcctcgctggattcgtgctcttgaaaaggaagatggtgcgaaagtagtgagagtggaaaatctggacaacccctacaagcatcaagataattttgacaagaggttcaagttatcgttgaacaaactctacgcatggagcttagtggactatgacagggtggtgatgttggacgctgataacctcttccttcaaaacacggacgagttgtttcaatgtggacaattctgtgcggtctttatcaatccttgtgtgttccacacaggactcttcgtcttgcagccatcgatgaccgtgttcaaggacatggttcatgaattacgtaatgggagagaaaatcctgatggtgcagaccagggtttcatagctagctatttcccagagttacttgataagccaatgtttcacccaccacctaatggcaccaagcttgatggaacatataggcttcctttgggttatcagatggatgcttcttactattatcttaaacttcgctggagcataccctgtggaccaaatagtgtgatcacattcccaggggcaccatggttgaagccatggtattggtggtcctggcctgttctgccattaggcctccagtggcatgataaacgtcgccaaactttagggtatggtgcggagatggctgtgatacttattcaatcggcaatatatttgggaataatagcaatgactcgttttgcaaggccaagtctctcaaagctatgctataggcgctctgacaagagcatcaacttggtgcagaacatcctcaaattggtggcattgtggagcatccttgcggcttacacaacacccttcttcatcattcctcacacggttcaccctttgttaggatggcctctctacttgcttggtgtctttgcattgtgctctattgcagtcaatgcctttctgctgccaatgttgccggttctgatgccgtggctcgggatcaccggtgctttgattgtcatggcttttccttggtattcagatggggtggtgagagcattgtgcgtttttggttatgcattctgtgctgcaccgtgtgtgtgggcatctatgactaggataatggcagggcttcaccagtctctagaaagggaagcttttttgccaagattaggagaatcttcaccaccctcttggtttaacaagttatattga

SEQ ID NO: 1106 - DNA, 997 bp, Glycine max var. Williams 82
gagttcctcttcaccaaatccaattcaacatttgctctgacatttgtttttgacagaaatctcatttctggtttaaaagttttggatattgttactaattgcaacatcatgaactgactttagcttattgttttcatgaacagtgcatggtatggaatatggctttggagcacatgaatacccaacaagtggtatatttgaggtcgaacccagaagctgtcctggcttcatcttcagatgttcagtattgttaggcaggaatgatatgtcttattcagaatttcgttctttcatggagcgcctttctgtaaaatttcatggagacagctaccatctgattgctaagaattgcaaccattttactgatgaagtttgccaacagctaactggaaagcctattcctgcatgggtaaatcggctggctcgtgttggttctttctgcaattgtcttctgccagaaagccttcaggttgctgctgttagacatctccctgaacatcttgcactttctgacgatgaaggactggaatctgatggcctctcggattcagatgagagtgaagacgaggattccaatcaccatctgctaactacaccaagtggcggtgaactcaccattataaaggaaaaaccaatgactctagcacgagacctcctatgattttcattaattacttgccattcttattctttcttccttttactgtatgtgtgatattagctttcaagatgtaacaagctttctcaacagccatgttatgtattacaaagacgatagtctgtttatgtggtcctgtatgtttcaaaatggagtggctgtcttgtagatgtaatattaaggtacaaacaaaaatgttcagccataccgttaatctcattgtgtgtagtgatatttgatggatgatgggtgtcattaagtactggacaaatacgctccaaaaataactgttccatgtaaaattcgccatattctctatttttaagattatactgcatc

SEQ ID NO: 1107 - DNA, 1134 bp, Glycine max var. Williams 82
atgaagtgtttcttctttaaggagaagagcaaatccgccccggaactgcacaagaagaaaacccccgccgtgaaccgcgccgcaaactccaccggctcagtgtcttcaccgaagagcgtgaaggacttgtacagagagaaagagcacagcttcagagttttcactttgcaggagctgagagatgccaccaacggtttcaataggatgctcaagcttggagaagggggtttcgggagtgtgtataaaggatccattgcgcaacttgatggccaaggtgatccaattccagttgctatcaaaaggctcaacactcgtggcttccagggtcataaagaatggcttgctgaggttcaatttctcggcattgttaatcacccaaatttggttaaacttttgggatactgctctgtggatggagaaagaggaatccaacggctgttagtgtatgagttcatgcccaacaggagcttggaggatcaccttttcaacaaaaaattgccaaccctgccttggaaaacaagattggagatcatgcttggtgctgcacaaggattagcttatctacatgagggactggaaattcaggtgatctaccgagatttcaaatcttcaaacgttctattagatgcggatttccacccaaagctctcagatttcggtctagctagagaaggacctcagggtgatcagactcatgtatctactgcggtagttggaacacagggttatgctgcaccagagtacattgaaacgggccacctgaaagttcagagtgacatgtggagttttggtgtagtactatatgagatcctcacaggaaggaggtcattggaaagaaaccgtcccacagcagaacaaaagcttctagattgggtcaaacaataccctgctgacaccagccgattcgtcatcataatggaccctcgtctcagaaaccagtattctcttcctgcagctcgcaaaatagccaagttggctgatagctgcttgaagaagaatccagaagatagaccctccatgagtcagatagtggaatccttgaatcaagcattgcaatattcagacacttctctagacattgctgaatcctcctcctcctcctcatctcggtctaaattggtccgaaaaaagtaa

SEQ ID NO: 1108 - DNA, 1053 bp, Glycine max var. Williams 82
atggccgttcaagctcaatatccatccaatgtccttcttctaaacagcagaaacgggcaagaagagcatgagtattcttcattgcaaccacaaccaggaggagttgtactcttgaatcagcctcacatgttatacaacatcaatgacaatggaagtaacaataacaacaacaataccaattctcggaagagaggtagagaagacccgggtgttggcaacaacacaatcactgcagcttctaatgttatcgatcaattctctttacaatctcagcctccgcaacttgttcatctctctcagctccacaatcaccaccaacaacaaaataatgtggtgtccactggccttcgcttatccttcgatgaccaacactttcaacaacaacaaagactacaacttcatcaaaatgaatctcaacaacataggtcccactcttctgctttcttatctctattatcccaaggcttgggttctcaaatcaaacaacagcgcgatgagattgatcaattgctccatgcccagggagagcaactgcggcgggcattggcggagaagaggcagagacattaccgcgcgctgctgagcgcggcggaggaggcggtggcgcgacagctcagagagaaggaagcggaagtggaaatggccacgcgcaagaacgcggagttggaagcacgcgcggccaagctgagcgtggaggcccaggtgtggcaggctaaggcccgggcccaagaggctacggcagtctccctccagaccaaactgcagcagacgatactgtcccacggcggcgaagatcctgctgtcgtgggcgtttcatctgctgctgtagagggacaggcggaggacgcggagtccgcctacatcgaccccgaccgcgtggtggctgccacggcggcgcgtcccaaatgccgagggtgcgcaaagcgcgtggcctcggtggtcgttttgccgtgtcggcacttgtgcgtctgtacagaatgcgatgcgcatttccgagcgtgcccagtttgtctcaccccaaagaattcaaccgttgaagtttttctctcttaa

SEQ ID NO: 1109 - DNA, 588 bp, Glycine max var. Williams 82
atgatgttacagccttctttcttgtgcttctctttcatgtttctcatcacactccctcttggaaaaagctctaccaccttgaatgtacccaaggacataatcaatcaaacatgccaaaaatgtgccaaccaatccatcatcttgagctacaacctatgctccacttctcttccggcggttccggtgagtcactccgcgaatctcgaagggttggcgttggttgcaatggagctagcactagagaatgtgactagcactttggccaccatagagaagctattagacagcacaagccttgataactttgcgctggggtgcttggcagattgcttggagctgtactctgatgcagcatggacaatagtgaattctgtaggggttttcctctctgggaactatgatgtaactaggatttggatgagttcggttatggaagcagcatcaacgtgccaacaaggttttactgggagaggtgaagcttctcctttgacacaggagaactataatctctttcagttgtgtggtattgcactttgcattattcatttggccacacctggagtaccttctcaattaatccacagataa

SEQ ID NO: 1110 - DNA, 753 bp, Glycine max var. Williams 82
atggctctctctcttttgtgtcctcttcttgccacctttcttttcatgcaaactatggcagatacttcatttgttcaatctcgtgcagcattttacccaaactctcaagaaaatggcacagacgttggtgcatgtgaatttggttcctttggtgccactgttaatggtggggacgtatcagctgcatctaatctttatcgaaatggtgttggctgtggtgcctgttaccaggtgagatgtggcaatagtgctttatgctcaggcaatggtgtgactgtggttataactgaccaaggctcaggtcataacactgacttcattcttagccaacgagcctttgggagaatggctctgaacactgacgcagctgcttctctattagctcttggtgttgttgatattcagtatagacgtgtttcatgcagctacccaaacaaaaacattacagttaagatacatgagagcagcaacaaccctcactatttggcttttgtcatatggtttcaacaaggaaatagagacataactgctgtccagatttgtgagactcagaactttgtgtgcaagttactggaccggagtcatggggcagtttggaccactacagctccacctagtggacctttgtctttaaggatgttgtttagtcctgaagaagagggagaagaaacatgggtggttcctgttaacaagataccacaagactggaaggctggacaaacgtacgacttaggggtacaagtggaccaatag

SEQ ID NO: 1111 - DNA, 2064 bp, Glycine max var. Williams 82
atggaagacaccgcacaacaaatcaagcgtccttttggtgttcctgaaggaccagaattcactgttgggttggatgtacctttgagcgagttgaaggtggagcttcttaaagaaggtgtgtccatcattatgctgactggtttaggtggatcaggaaaaaccactttggctacaaagctttgttgggatgaacaagtcataggtaaattcaaggaaaatattttatttgtcaccttctcaaaaaagcctaagttgaagattattgtagaaagactatttgaacattgtggatatcaagtgcctgagtttcaaagcgatgaagatgcagtcaatcaattgggacttttgctgaggaaaattgatgcaagtcctatgttgctggtcctggatgatgtctggcctggctcagaagccttagttgagaaatttaaagttcagatatcagattataaaattttggtgacttcaagaatagcattccatagatttggcactccattcatcttaaaacctcttgttcacaatgatgcaataacccttttccgtcaccacgctctcttagaaaaaaacagttcaaacattcccgacgaagatcttgtccaaaaggttgtgagacattgcaagggtttaccgcttgccattaaagtgattggtagatcactaagtaatcgatcttatgagatgtggcaaaagatggtggaggaattttcacatggtcatactatacttgattctaacattgaattaattacttccctccaaaagatcttagatgtcttggaagataatcacatcatcaaagagtgcttcatggacttagctttatttcctgaaggccaaagaattcctgttgctgctcttgttgatatgtgggtagagttgtatggactagataatgatggcatagcaacggccattgtcaaaaaattagcttccatgaatctggctaatgtcttagtgacaaggaaaaatacaagtgatacagacagttactattacaataaccatttcatcattctccatgatattttaagagacttcgcaatttatcaaagcaaccaggaacaagttgaacagagaaaaagactgatgattgacataacagaaaataaacctaaatggtggcccagagaaaaacagcaaggcttgatgatccgcgtactgtcaaatatttttggatggcgtgttgaacaaaaaccccaacagatccctgcacgggcattgtctatatcgaccgatgaaacttgcacatcatattggtcccacctgcaaccagttcaagctgaggttctgattttaaactttcaaactaatcagtacacctttccaaagttcctgaaagaaatgagtaaactaaaagttctgacagtcatacatcatggtttccatccttctaaaatgaacaattttgagttacttggctcattatccaacctaaaacgaatcagattagagaggattttggttcctccctttgtcacattgaagaatctaaaaaagttatccctcttcttgtgtaatacaagacaggcttttgaaaatggaaacatgctaatttcagatgcttttccaaatctagaagatttgaatattgactattgcaaagatctgatagaattgcctaagggggtctgtgatatcacctccctgaagatgctcagcattactaattgccataagctttctgcattgcctcaacaatttggaaacttggagaatttgaaacttctaaggctaagttcctgtactgatttgcaagagataccaaattctattggaagactttcgaatctaagacatatggacatctcaaactgcattaaccttccaaatttaccagaggactttggtaatctttgtaatctaagaaatctgtacatgacaagttgtccaaggtgtgaattgccacccttaatcatcaatcttgagaatttaaaagaggtggtatgtgatgaagagacggctgcttcatgggaagcttttaaacctatgcttcccaatctaaagatagatgttcctcaacttgatgttaacttaaattggcttcatgaaattcgctcctaa

SEQ ID NO: 1112 - DNA, 2896 bp, Glycine max var. Williams 82
cttttatcccatacaagaacttctttcatatcgttaacaagaagaacacgtaacagaaagacacatccaaaggaagtctctggttatttcaattaattaagagaaaggactcgaatagttggttattcatggaagacaccgcacaacaaatcaagcgtccttttggtgttcctgaaggaccagaattcactgttgggttggatgtacctttgagcgagttgaaggtggagcttcttaaagaaggtgtgtccatcattatgctgactggtttaggtggatcaggaaaaaccactttggctacaaagctttgttgggatgaacaagtcataggtaaattcaaggaaaatattttatttgtcaccttctcaaaaaagcctaagttgaagattattgtagaaagactatttgaacattgtggatatcaagtgcctgagtttcaaagcgatgaagatgcagtcaatcaattgggacttttgctgaggaaaattgatgcaagtcctatgttgctggtcctggatgatgtctggcctggctcagaagccttagttgagaaatttaaagttcagatatcagattataaaattttggtgacttcaagaatagcattccatagatttggcactccattcatcttaaaacctcttgttcacaatgatgcaataacccttttccgtcaccacgctctcttagaaaaaaacagttcaaacattcccgacgaagatcttgtccaaaaggttgtgagacattgcaagggtttaccgcttgccattaaagtgattggtagatcactaagtaatcgatcttatgagatgtggcaaaagatggtggaggaattttcacatggtcatactatacttgattctaacattgaattaattacttccctccaaaagatcttagatgtcttggaagataatcacatcatcaaagagtgcttcatggacttagctttatttcctgaaggccaaagaattcctgttgctgctcttgttgatatgtgggtagagttgtatggactagataatgatggcatagcaacggccattgtcaaaaaattagcttccatgaatctggctaatgtcttagtgacaaggaaaaatacaagtgatacagacagttactattacaataaccatttcatcattctccatgatattttaagagacttcgcaatttatcaaagcaaccaggaacaagttgaacagagaaaaagactgatgattgacataacagaaaataaacctaaatggtggcccagagaaaaacagcaaggcttgatgatccgcgtactgtcaaatatttttggatggcgtgttgaacaaaaaccccaacagatccctgcacgggcattgtctatatcgaccgatgaaacttgcacatcatattggtcccacctgcaaccagttcaagctgaggttctgattttaaactttcaaactaatcagtacacctttccaaagttcctgaaagaaatgagtaaactaaaagttctgacagtcatacatcatggtttccatccttctaaaatgaacaattttgagttacttggctcattatccaacctaaaacgaatcagattagagaggattttggttcctccctttgtcacattgaagaatctaaaaaagttatccctcttcttgtgtaatacaagacaggcttttgaaaatggaaacatgctaatttcagatgcttttccaaatctagaagatttgaatattgactattgcaaagatctgatagaattgcctaagggggtctgtgatatcacctccctgaagatgctcagcattactaattgccataagctttctgcattgcctcaacaatttggaaacttggagaatttgaaacttctaaggctaagttcctgtactgatttgcaagagataccaaattctattggaagactttcgaatctaagacatatggacatctcaaactgcattaaccttccaaatttaccagaggactttggtaatctttgtaatctaagaaatctgtacatgacaagttgtccaaggtgtgaattgccacccttaatcatcaatcttgagaatttaaaagaggtggtatgtgatgaagagacggctgcttcatgggaagcttttaaacctatgcttcccaatctaaagatagatgttcctcaacttgatgttaacttaaattggcttcatgaaattcgctcctaagtcctaatacctgtttcatgctaatgtcattgtgttagtggctttcgggtttgattagcaatcttaggtttccacaggaaaaggccatcattttctgtgacaatctgagtgcaatctgtttagccaaggatcaagtccatcatgagaggactaagcacattgacattagataccacttcatccattttgagaaaagggtcaaagtccagaaagttgatacgagggagaatccaacagatatgttcacgaagccggttctaagaaacaagttcatgcattatctggatctacttactgtagattgctggaaatgaactgagttagttgtaattcagaaatattattgaatcaaggtggagattgatgattgttggacaatacatgatagacatagaatggacaacaatgatcgtctggtccagtacttttatcttttatataggtcatccaatcctatgtcacctggtggagcatccagtcacgtacgagggaccgtccaacatggtgattcactaacataagttgtgttgtaactgtaactattttctatttttttccgtttgtaaccattttcggttagatagatagtagttgtctcctttacaaggagctctgtattttgggtttagagagtttgagagtattttgaaccccttcattgtaaattttgttattcgtaataaacttaacaattttgcacaata

SEQ ID NO: 1113 - DNA, 1056 bp, Glycine max var. Williams 82
atggtactaaaagaagacatatgtttcttcaacaaggacattctggttatgaagcctcagaagaaatcgccactgttgttaaggatgtcggtgttgatcttttcaatggtgtgtggtgtttttatttgttctgtgtgtctaaagcagataagcacacacgcaaggactatgctcatggagttgcaaattgagaagccttctcggagtagtattagtagtattaatagattgaacctaacacatgatgttcctttgttgcattaccccgagcctgtgtctttcaacaggagtgagtgtgctggtaatcctgtgcggttctttgccatattgtcgaatcagagatctggcagtgggtggtttgagacccttttgaatagccatattaatgtgagctccaacggggagattttttcagttagagaaagaagagtaaatgtttctaccattgtgcagactctggacaaagtttacaacctggactggctcagtagtgcttccaagaatgaatgctcagctgcaattggatccaagtggatgcttaatcagggtttaatggatcaccctaaggaaattgcagattacttcaacagtagaagtgtttctgtaatatttcttttccgaagaaacttattacggagaatggtatcaatgcttgccaactcctatgatcgttatgctaaactatttagtggaactcataaatctcatgttcattctaaagaagaggctgatactctttcaaagtacaagcctaccattaattctacatcattgctggctgatttgaaggatatggaaatgagaactgcaaaagcgttggaatacttcaacaccactcggcatatgatcctgtactatgaggatcttatacaaaatcgtactaagctaaaagatgttcaagagtttttaggattgccacagatggaattaacaagccgtcaggttaagatacacagaggaccattgtcagatcacattaaaaattgggatgatgtgaacaggacactagcaggaactatttatgagagtttcctccatgccgattattcatcttag

SEQ ID NO: 1114 - DNA, 951 bp, Glycine max var. Williams 82
atgaagaacacaaacaccaacacgaaactgatcctcctccatccttatatccaaaaacaaggaagctccaatcgcttgtggcttctagcattggtatcaatcctcaccctcgcttttcttgttaccctcatttccacaagagaatccaccttcatcaccactgcaacttcttctgtgactccctcttcaaataatgctccagtttctggttttggaagtgctcctttgccagccacagtgatcaacactctcctccactatgcatcaaaatccaatgacaccttccacatgccacactcagacctcaaacccatctccgatgtgcttcgaaaatgctcctccccatgcaactttctcatcttcggcctcacacccgaaacccttctctggaaagccctcaaccacaacggaagaacggttttcatcgacgaaaaccgctactacgccgcgtattacgaagaactgcacccagaaattgatgcctatgatgttcaatacaccaccaaaaggagcgagatgaaggagctcatagcctccgcgaaagaacaagtagccaatgagtgcaagccggtgcagaatcttcttttctccgagtgcaagctgggcctcaatgacctccccaaccatgtgtacgaggttgactgggacgtcatattggttgacgggccacgcggggactggcccgatgctcctggcagaatgtcagcgatattcaccgttggtgttctcgccaggagcaaaaagggtgggaaccctaagactcatgtcttcttgcatgacttctctggggaagtggagaaggtttgtgggagtgagtttctgtgcaatgagaatttattggaggcaaatgggaatttggggcactatgtgttggaaaggatggatgagaatagtgtgcagtattgtaagaatcactcgtcttctgggtcaggggctgcttcatcagcataa

SEQ ID NO: 1115 - DNA, 1617 bp, Glycine max var. Williams 82
atggacaggctcataaggttagacccttcaaacacagtcctaatcagggttgagccagggcaaaagtgccacggcaggatcaccttacacaacgtgatgtacacaatgccagtggccttcaggcttcaaccactcatcaagacccgttacacagtgaagccccaatcagggatcatatcccctttagccacacttaccatagacatcacctaccatctcccacaaggctcgtctctcccccactctttccctcactcgaacgactctttcctcttacacagcgttttggttcccggcgccgccatcaaggaaccctcctccatgttcgatgctgtccccagtgacttgttcaagaagaaacaggtcttcatcgacagcgccatcagggtcatgtttgtggggcctcacattctggctcggctagtaacacaaggtgcaacggatgaaataagagaagttttagagaaaagtgacccatcatggagaaatgttaactcgacagacccacaaggccaaacgttgctccacttggcgatttcgcaaggtagagctgatctcgttcagttgctcctagaattcgaggctgacgtcgaagccttaaaccgttctggctcaaccccacttgaggctgcatcgtcctgcaacgaagccttaattgttgagcttcttttggcccacaaagccaacacagaacggtcggaattgtccatgttcggtccgatccaccacgcagccagaggaggacacgtggaggttatgagacttctcttgctcaaaggtgccaaagtggattcactcgctaaagatggcaacacagccttgcacgttgcagttgaagagcacacaaaggactgtgttagactccttctggcaaacggtgccagaacagacgctaaaaatacaagagaaggtgacacgcctttgcacgtggcatcagcaataggagatgagagcatggtgaagctcttgctgcaaaagggtggtgccaacaaagacgtgagaaacagacaagggagaaccgcgtatgatattgcagtggaaaacggccatgcacacctctacgacgccttgtgtttgggggacaaactgtgcgtggcagcaaggaaaggggaagtgaggagcatccacaagcttctagagaatggtgcagggatcaatgggagggaccaaaatggttggacatcgctgcacagggcctcgttcaaagggagaatcgacactgtgaagcttcttgtagagaagggggcggaggtggatgcaaaggacgaagaagggtacacggcgttgcactgtgctgctgagtcggggcatgctgacgtgactgagtttttggtgaagagaggtgctgatgttgaagccaggactaggaagggtgtgagtgcgttgcaaatagctgagtcgttgcactacgtggggattacgagggttcttgttaatggtggggccagtagggaaaattgtgatgtgggtaaagtggcggcacttggtgcaattgcgtttgggactaaaatggaagctaggggtgtcatgaataaaaagaagaggggtggtggtggcagagccagaatgctaaatggtgctagctttgatcgttcaatggctctggctgtgctctaa

SEQ ID NO: 1116 - DNA, 270 bp, Glycine max var. Williams 82
atggccccttctatgtcggacttcaacatcataaaaagctttgacattgttgggcacgctcccaaaccttactcgactactcaagtcatttggcatgatcctttattagagtggttgaagtgtaatacagattgggcttcccgtggcaaccccggtagagcgacgggggaggaggtattttcaggaattcccttggccttttcattggtgcttttgctgatttctatggggtttcatcctccctcatggctgagctgcttgcagcaatga

SEQ ID NO: 1117 - DNA, 408 bp, Glycine max var. Williams 82
atgacaagcatgctgaaaactcaggccttactagttctcgtgttattggtgaactttgcttttttcatgggcttagaagcccgtccattaagtatcattgagacggggaaatcagccactggaggggaagaggtggatttctttgattggttagctctgggagcaatgaaggattctgggccaagcccaggtgtgggacacaagttcaccaatagtgaaacccttggtgggattaaggactctggtcctagtcctggagggaaaggtcaccaatttacaaacagcgagacacttggtggaatcaagaactcgggtcctagcgtcggaggagagggtcacaaatttaccaacagtgagacccttggcgaaattaaggattcgggtccaagtcctggccaaggacactaa

SEQ ID NO: 1118 - DNA, 600 bp, Glycine max var. Williams 82
atgaccttcataagggaggaatatgatcaagttgatgatcatggatcacaaaacaatgccaacaacaacactgaaattgtgaccaccccagaaggggaaaacatgggagaatggcttagtctaggcctcacaggagacatcaacatgcctgtagaagcagcagcagaacaaaacttatcatcaaggcctctccacaacaaggaattctcatgcaacttctgcatgagaaagttttacagctcacaagccttagggggtcaccagaatgcacacaagagggagagagaagctgctagaagctaccaccaatctcatcatcacagaatggggcttgcttacacttctctggcatctaggtcactgggaattcagcctcactctcttgtgcacaaacctaacagagaaaggtctgctatggtggctagattcagtagtaatgatgccaataatggggttggaattggatcagtggcatcatcatggacaccctttatgcttgaacaagctgtggatttgtattggccaggtagctttcgggtggacttgccaaagcaagaatcatcagatgttaagaagattgacttagatcttcggctctga

SEQ ID NO: 1119 - DNA, 636 bp, Glycine max var. Williams 82
atggatcgcaacggtgttctctctcttgcattcatctgcattgtagtcgccggcgtcggaggccagtctcccgccgcagcgccctcgaacactccggcaacccccgccgccgccactcccgcccaagcaccttccacaccgaattcaccagccccagttgcttctcccaaatcatctccaccagcttcgtctcctaagcccgcaaccgcaacccctgcttcgtcgccggcggcatctcctaccaccacccccgccgcgcctgctccagcgaccaagccacctgcagcctctcctcctccggcgccggttcccgtgagctctccccccgctcccgtgccggtgagttctccacccgctcccgttccggtggcggcgccgaccacccctgtggctcccgctccggctccgagcaagcacaagaagaagggtaagaagcacggtgctccggctccttcaccgtcgttgctgggacctcctgcgccacccaccggggctcctggtcctagcgaggacgcttcttcccctggacctgccactgctgccaacgatgagagtggagcagagaccatcatgtgcttgaagaaggttctaggaggcttaggtttgggttgggctacccttgttttggtcttctag

SEQ ID NO: 1120 - DNA, 1986 bp, Glycine max var. Williams 82
atagaactcgtttcatatgtctctcattcttctctggtttttggcaaaatttttcggatttattcaatttctctctgtgtaaatacttcaacttttccaattctcaccttcgcatgttgattcgtagtcagattttttcttgttcaaagatgcactagtagaagagggaattaccctgtttccaagctttcctctagagtagaagcaattagtagagtgtcataaaaagctgtaggctttccttcaatgggtgctcctaagcagaaatggactgcggaagaagaagcggcgctgaaagctggagtactcaaacatggggcaggaaaatggcgcaccatacttacagatcctgagttcagtgccatcttgcgtatgcgttcgaatgtggatctcaaggataaatggaggaatataaatgtgacagcgatatggggatcccggcagaaggcaaagcttgctcttaaaaggaacctaccagcccccaaaattgataataaccatatggccttgagtaccatagttcgaaatgatgaagttcttgatactaagcccatagcagtttctggtggaccattgcaatcccccaatttgaaagaacaaatatcaaggttggtggataatcatatattagaggccattgtcaatatgaaggagcagaagggttctgacaaggttgccattgcttctttcatagaggaaaaatatcggtcaccacctaatctcagtaaattgctgtcaaccaaactgaagcatatggtggcaagtggcaaaatagtcaaggaaaagcataagtacagaattgcgccaagttcaactgtctctgagaaaagaagatgctcttcattggtacttttggaagagaagcccaaagatccttcagaagtacataagaatgatgatgtcaacatcctttcaaaatcccaaattgatgcagagatttcgaaagtgaagggcttgacagctcaagaggcagctgctgcagctgcaaaagcagttgcagaggcagaggctgcaattgcacaggctgaggcagcagctagggaggctgaggctgcagaagctgaggctgaggctgctcaagtgtttgcaaaagcagcaatgaaggcgctaaaatgcaaaatgcttcatatttgactactctccctgtgaaattgaggacttgtattaaaagctcaatttcatgtaaggtgacatccatagagacatagacatgacgactttgaaggtgataacacttatacccctttttgtttgagggataatcaataagaatacattcgatagcttgtggatctaactttccacggtggtgactgtgagagtgaaccaaggaaacacatccaaagacttgagttgggagactagacatgataggaggggaggaaaagaatgataacatgtgttgtaatgggctaataccactcaagacacaaggttacttgttcatcagatacgtagcagtcaagacagctacactcccgaataagttttgggaacaagcatctggaaaagtagagctccagcaatttctagaagatggtgtggacttacacatgctcatcatcagcagagttggcttgagatgatagttctgctgctgtgcttcctgccagtttttttcgtaactgtacataattttcggcttgtaaatctggaatatgcaggatgattcatgaaatattctgtcaggaatcaataacagcttttttttttcaattcatttttattttaaccttttcttataaaggaagacaatgaggggaaagctacaaagcagtaacggaagagtggaaatagcgatgtttttttgtaatggaataattgacatccgcgtagagtaaatgaaggaaacaatttttagtgttcaaatagcaatatggattgtcattgacatgcagatcatatattcaaggatgcttgttctaagacatcactatattacttttttttattattattatcagtaaatgttagttttattataaa

SEQ ID NO: 1121 - DNA, 957 bp, Glycine max var. Williams 82
atgtctttcgactcctcaaaccacccaattagtcctgacttgtattgcagtgaagtaactagcgaagtgattcacttggattccgatgatgaggctctgaagttcaatgttctatggggagactctgatcatgatgatagtgatgatgaaagcattctattgaacttgttagaatccgaacacaaccaagtgcaagaacaaacaaagttcctaggacaacaacttcgcaaaaaaacatggctgattaatgctcgagaagaggccataaattggatcctaaaggtgcatgcatactacagttttaaacccgagacagcgtatctttccgtagattacttcaatcgtttcctcttgtcacacacctttacgcaagataaagcatggcctctgcagctgctatcagtgacttgtctttcactagcagcaaaaatggaagaaagcaaagtgccacttcttttggacctgcaagtgatcgagtcaaggttcctgtttaagcccaaaacagttcagaggatggagcttttggttatggccagtctcaagtggcgattgcgcactataaccccttttgattttgtgcatcttttcatttccaagcttttgtgctctgcttccacatggggagatttaagttacattgtttctcttgtctcggatgttatcatcagaacatgtctagtcatggatttcttggagttttcaccatccacaatagcagcagcagcactgttatgggtaaccaatcaatgtgtagatgacaagaaatcatattgcctccacaagaatataagcattgaaatggtgaagaaatgttacaaactaatgaagcagaaactcatcattcgccgatcagaactttattggccaaagatttcacaattattgccccgaagtcccacctgtgtgcttgatcatgcagcagctatgcaagaaagcagtgatgctcacaagctctga

SEQ ID NO: 1122 - DNA, 1473 bp, Glycine max var. Williams 82
atggagataatttaccagtctcacatcgacagggagattgaatcgctcatagaaagaatccatccacccagggtctgtatagacaacgattccagcagagactgcacagtggtgaagattgatagcgcgaacaggcatgggatattattggagatggtccaggtgttgacagatcttgatcccgtcatttccaaatcatacatttcttccgacggtggatggttaatggatgtgttccacgtgacggaccatgatggaaacaagcttaccgacagaggactcgtccattacattcaacagacactgtgcgaggctagaagcaacagcaaagaaatttcaagtgacatagagctaacaagctgcaatgaaccaccacgactggtgaacttagcaatagagttgaccacagcgaaccagcatggcctgttctcggagatgtcagcggttctattgggcctgggcttcaacgtcacctccgccacggcctggacccacaacgacagggtggcctgcataatccacctggaggacgcaaagaaacttgggcccattaacgcagaacgtctggcccaggtccagcccgagctgcggaacgtagtgaaggcccgtgataggaacggggaagaagagagagtgaggttgaggctgaggagcttcggcgccgggcgcaatcacaccgagcggcggctccaccagatgatgtatgccgacggggactacgagaggtgccgtgcgtgccatgtcggagacagaaacggtgagaagaagaaggggtgtgaggagacccaggttactgtgggcagatacgaagagaaagggtactgggttgtgaacgtcaggagcagggatcgtcctaagcttttgtttgatactgtgtgtgtgctcaccgacatgcagtacgaggtgtttcatgcggctgttagctccaatggctccatggctgaccaggagtacttcgtaagacccaaaggtagttcaaatttggacaatgaaagcgagaagcaaaagctcagcctatgtttaatcgcagccatagagcgcagagtctcacatgtacgtcccatgagcttccctaccaaaggattgaaggtagacattcgcgctgaaaacacaacggggctactatcaaaagtcactcgtgtgattcgtgagaatggactatccataacaaaggttcagataggagtagagagtgatgagatggcagtaggatcattctgtgttgcaaattcttcaggtcaagaagtgaacccaaacatagcagagttggtgagaagagaaactggtgggtctgtagttgcaaattacaattcgccttacagggtccctaaatccttgtcatcgagtaaaaccatgcatgaaaccaagagtagcacagaggttggacaaaggttttccattggaagcatgctatggtctcagcttgagtgcctttccaataatttccgtcccattagatctcataagctttaa

SEQ ID NO: 1123 - DNA, 1834 bp, Glycine max var. Williams 82
tttcaccaatggaaaactctactccatctccatgcatcaccatgaatttcacatttgctgtgtcaatcaaccctaaggctttatcatcagataatatttcttaagaactcagtgtagatgcatgcacaactccacgataaatcgtcgaattaaacaacattcaacgacaactctgattgaggccttgttcgtggagaaattaagatggagataatttaccagtctcacatcgacagggagattgaatcgctcatagaaagaatccatccacccagggtctgtatagacaacgattccagcagagactgcacagtggtgaagattgatagcgcgaacaggcatgggatattattggagatggtccaggtgttgacagatcttgatcccgtcatttccaaatcatacatttcttccgacggtggatggttaatggatgtgttccacgtgacggaccatgatggaaacaagcttaccgacagaggactcgtccattacattcaacagacactgtgcgaggctagaagcaacagcaaagaaatttcaagtgacatagagctaacaagctgcaatgaaccaccacgactggtgaacttagcaatagagttgaccacagcgaaccagcatggcctgttctcggagatgtcagcggttctattgggcctgggcttcaacgtcacctccgccacggcctggacccacaacgacagggtggcctgcataatccacctggaggacgcaaagaaacttgggcccattaacgcagaacgtctggcccaggtccagcccgagctgcggaacgtagtgaaggcccgtgataggaacggggaagaagagagagtgaggttgaggctgaggagcttcggcgccgggcgcaatcacaccgagcggcggctccaccagatgatgtatgccgacggggactacgagaggtgccgtgcgtgccatgtcggagacagaaacggtgagaagaagaaggggtgtgaggagacccaggttactgtgggcagatacgaagagaaagggtactgggttgtgaacgtcaggagcagggatcgtcctaagcttttgtttgatactgtgtgtgtgctcaccgacatgcagtacgaggtgtttcatgcggctgttagctccaatggctccatggctgaccaggagtacttcgtaagacccaaaggtagttcaaatttggacaatgaaagcgagaagcaaaagctcagcctatgtttaatcgcagccatagagcgcagagtctcacatggattgaaggtagacattcgcgctgaaaacacaacggggctactatcaaaagtcactcgtgtgattcgtgagaatggactatccataacaaaggttcagataggagtagagagtgatgagatggcagtaggatcattctgtgttgcaaattcttcaggtcaagaagtgaacccaaacatagcagagttggtgagaagagaaactggtgggtctgtagttgcaaattacaattcgccttacagggtccctaaatccttgtcatcgagtaaaaccatgcatgaaaccaagagtagcacagaggttggacaaaggttttccattggaagcatgctatggtctcagcttgagtgcctttccaataatttccgtcccattagatctcataagctttaattaacaagccatagttatttattcctcaagaaataagcactctacatatgattctcgatatcgccttaaaattgcataccacttgatgtgagatgatatttgcagatcaattgtaaatatttatgataagataccgccgtggatctatgattaattatagggtaaataatgattttacttttca

SEQ ID NO: 1124 - DNA, 543 bp, Glycine max var. Williams 82
atgctctccgccctcactccttccgaccccttctctcccttctcccccttctccgccggcttcacgccgtgggatgacaacgacgattcccacgccctcttctcccccaaaccggtctctgcttctagctccgcctctgactataaatccgaaccgaacccaaccgaacacgtatgcgcctcgtcctcggtgatgatggacgagcggaaacggcgccgcatgatatcgaaccgggaatcggcccgcaggtccaggatgcggaaacagagacacctggagaatcttcggaaccagttgaacaagtgcagggtcgaaaaccgggaactcggtaaccggttgcagttcttcctgcaccacctgaaccgcctccgaaccgaaaacgaatggctccgctccgagcgaaccctgctacgccaaaaagtcgccaatttaacacaaattttgattttccaacaattccaaaccaccttctcccctgctgcatggaccacatgcaccaacaacaacaccacctcgctcatgacaattaatcaagttaattaa

SEQ ID NO: 1125 - DNA, 1393 bp, Glycine max var. Williams 82
ctcctctcctccatcacctctagtttcagaaaacccccgtcactctgctcccttaattaattagccaccatgctctccgccctcactccttccgaccccttctctcccttctcccccttctccgccggcttcacgccgtgggatgacaacgacgattcccacgccctcttctcccccaaaccggtctctgcttctagctccgcctctgactataaatccgaaccgaacccaaccgaacacgtatgcgcctcgtcctcggtgatgatggacgagcggaaacggcgccgcatgatatcgaaccgggaatcggcccgcaggtccaggatgcggaaacagagacacctggagaatcttcggaaccagttgaacaagtgcagggtcgaaaaccgggaactcggtaaccggttgcagttcttcctgcaccacctgaaccgcctccgaaccgaaaacgaatggctccgctccgagcgaaccctgctacgccaaaaagtcgccaatttaacacaaattttgattttccaacaattccaaaccaccttctcccctgctgcatggaccacatgcaccaacaacaacaccacctcgctcatgacaattaatcaagttaattaattaaataatatatatatatatatatatatatatatatatatatatatatatatatatatatataaaataaggtcttggtaaaaactctaagaggcctaaggtgtcctatgtaattatcattaaaagtttagataaagagatatattctagatggtaaagggtgggatttttggaaaaatattaggcctggttttggaaaatattagttcatttttttcaaaaccataagggttattatatattaccgattataatatatttgtgtaaaatagtagctttttctttttttgttattctggtatacgatttacttatttttttagttgttaactcgtgatagcttctttatcaaaatcgcttccctgactttctttatcatgcacgactcatactggtgcttcagagtccaaattaagtcaaaactaatgttaaatcaaactcactaattaacaatatactcctatatttttacaactacagcagttaatgataacataccgagaaaggaacgaaggaaaaaaaatggaaactaagtctgatcaatgcaggtaaaaaattcgtacaaagtatgaataaataatatataccaccgacatagtaaaagtaaaaaaaaaggtattgcttgtaaccgcagtccttctgtttcatttttatttgggccgatgatacaataatactatatcatattatttgctggcgaacgatagaagcgaaaataattggtcaagccatgaattccatatgatcgtccccttctaatgaagtttaattagggttttgg

SEQ ID NO: 1126 - DNA, 1041 bp, Glycine max var. Williams 82
atgagtgaccgcaaaatcgttctagtgactggctgtgccaaaggtggcattgggtatgaatactgcaaggcatttgctgagagaaattgccacgtcgttgcctctgacatctcaacgcggatgcaagacatgtcagacttggagtcagatcctaacatcgagacacttgagcttgatgtgtcttgtgatcaaagtgtgtcctcagcagtggccactgttatatcaaaacatggtcacatagatattttgattaataatgctggaataggtagcacagggccattggctgagttgccacttgatgcaatcagaaaggcttgggaaatcaacacacttgggcaactaagaatgacgcagcatgtggtgcctcacatggctatgagaagaagtggtagcatagtgaatgttggcagtgtggttggttatgtgtcaaccccttgggcagggtcttattgtgctagcaaggctgcagtgcaggccatgtcaaacagtttgaggctagaactaaggccttttggggtcaatttggttctagttttgcctggctctgtgaggtcaaatttagggagggccaatttggagagattgggtaattatgagtggaagctttataaggactttaaagaggtaattgaggagagagctagagcttctcagggtgacaaagctactgatggtagagtttttgctagacatgtggttaaaaaagttttaggccctaaaccaccaaagcaaattgtttttggtcacatgactggcttgtttgccttgctctcatggtctcccctatgggtgagagatctgtttttctcaacccgttttggcctaagtaaaaaaacctcatttgttaataatttcaacaccattcatagatatttggaaattaataagactaaagagttgaatctctcagatgatggtggtgaagagattatttctcaagctgtggacaagagtaatgaaaaaaagggtgaagaatctttgcctactaggaaaggcaaagaattagaagttcaccatgaacataatcaatcttcctag

SEQ ID NO: 1127 - DNA, 1096 bp, Glycine max var. Williams 82
tctgattccatccatataagaggatgagaacctaagtattcaaagcacaacaaaaatgagtgaccgcaaaatcgttctagtgactggctgtgccaaaggtggcattgggtatgaatactgcaaggcatttgctgagagaaattgccacgtcgttgcctctgacatctcaacgcggatgcaagacatgtcagacttggagtcagatcctaacatcgagacacttgagcttgatgtgtcttgtgatcaaagtgtgtcctcagcagtggccactgttatatcaaaacatggtcacatagatattttgattaataatgctggaataggtagcacagggccattggctgagttgccacttgatgcaatcagaaaggcttgggaaatcaacacacttgggcaactaagaatgacgcagcatgtggtgcctcacatggctatgagaagaagtggtagcatagtgaatgttggcagtgtggttggttatgtgtcaaccccttgggcagggtcttattgtgctagcaaggctgcagtgcaggccatgtcaaacagtttgaggctagaactaaggccttttggggtcaatttggttctagttttgcctggctctgtgaggtcaaatttagggagggccaatttggagagattgggtaattatgagtggaagctttataaggactttaaagaggtaattgaggagagagctagagcttctcagggtgacaaagctactgatggtagagtttttgctagacatgtggttaaaaaagttttaggccctaaaccaccaaagcaaattgtttttggtcacatgactggcttgtttgccttgctctcatggtctcccctatgggtgagagatctgtttttctcaacccgttttggcctaagtaaaaaaacctcatttgttaataatttcaacaccattcatagatatttggaaattaataagactaaagagttgaatctctcagatgatggtggtgaagagattatttctcaagctgtggacaagagtaatgaaaaaaagggtgaagaatctttgcctactaggaaaggcaaagaattagaagttcaccatgaacataatcaatcttcctag

SEQ ID NO: 1128 - DNA, 396 bp, Glycine max var. Williams 82
atgcaatcttcaaaggagaagctgaaaaacatgaccagtgctgccaaggagcaagtcgacatctataaagcaaaaatagacgagaagacagagaaagcaacggcaagaacagaagaggagagggtgattacccatgaacgtgcaaaggcaaaggaagctgaagcaaagatggagctgcatgaagcaaaagccaggcatgcagcagagaagctaagcaccaaccaatcacattatggtctccaccatggccacaaccctcccctggtaggaacaactgagactcactaccagcaagggcaccaccagccacttggggcagttcctatgcctggagccatttatccatcttatccgctaggagcaaaccctaaccctccaaggaacaaacatatataa

SEQ ID NO: 1129 - DNA, 309 bp, Glycine max var. Williams 82
atggcatattgcattccaaactcaccattactccagggttggaaagacaagcccatgaaggagcttaaatgttgctgtagggctacaattgatggattgagtgcaaccaatttccacgaatgctgtgacttcaagggaccatatgggcttctcattgggcccccattggccccagttatgggtggctttgctgggcctgataccaattctggcattggtgacttaagacaagccaagtctagatcgggattgacaacccttcgagaagtggaagtcttttgtagtcctcaaattgcaagcttatattag

SEQ ID NO: 1130 - DNA, 732 bp, Glycine max var. Williams 82
atggcagctgcaacatctagtgctgtgttaaatgggtttggatctcacttcttgtgtggaggaaagaggagccatgcccttcttgctgctggcattggaggcaaagttggtgctgttaagtcatggatcccagctgtaaaaggtggtgggaatttcattgacccagaatggcttgatggctcgctaccaggtgactacggtttcgacccattaggactaggaaaggacccagcattcctcaaatggtatagagaagctgaactcattcatgggaggtgggcaatggctgcagttgtaggcatctttatagggcaggcttggagtggagttccatggtttgaggctggagctgatcctaatgcaattgctcctttctcctttggttctcttctgggtacccagttactcctaatggggtgggttgagagcaagagatgggtggacttcttcaacccagattctcagtcagtggagtgggccactccatggtcaagaactgctgagaactttggcaactctactggcgaacaaggctaccctggaggaaaattctttgaccctttgggatttgctggcacaatcaaggatggtgtttacattccagataccgacaagctagagagactgaaattgactgagattaagcacgctaggattgctatgttggctatgctgattttctactttgaggctggccagggcaagacaccccttggtgctcttgggttgtaa

SEQ ID NO: 1131 - DNA, 501 bp, Glycine max var. Williams 82
atgagcctgaaaagcagtgaaaggaaaattatgagaaggggtttcatgtgccactctcaggcttcaacagctgtgtgcatgagtactcgtgaccctcgatctgtagttgtgcctaagaagcttgaaagaagagtgtttcttgatgatacaaggttgatcaactatgccaagtactccaaacttgttgaacctccaaggtctaatccagttccaaagatcaagcttagagggcaggatcaggttcaagccaatgaaccaagggaacttctgaaaacacagacagataataatgtctttcaggtggttgtgatgcgggttgcaattcattgtcaaggatgtgctggaaaggtgaaaaaacatctgtctaagatggaaggagttacatcattcagtatagatgtagaatctaagagggtgacagtgatggggcacatttcaccagtagaagtccttgagagtatttcaaaggtgaaaagagcagagttctggactgcttgttaa

SEQ ID NO: 1132 - DNA, 2083 bp, Glycine max var. Williams 82
tcgattacgtgtcagagctatgcgtggtaggttggaaggtgtgtgccttctgcgtccccaaacatggatttaacaaaatttacgattttttcgatcagtttctaagtggttcacttgtgaggatcaatgcattggacgaacgattggagtaggacatgagtttggaggattatatcagcttacacctccgattgcctgtgtctcatctgcatctccagctctcacacatctatgccttggggacccgagtctggagagattgcatctgttagttcccagtttttctaatgttaagtcctttcagtgcgacttgtgtcagctagattaatcttggaagtttgatgtgcttgcttgcttttggtttgaatttgaagtggtcttaatggggaatatactgaatctgaacaattccaagactagatggaaggattcctacggggttttacaaggtgaatcctgcaagagacagaggttgtcaccaaacccttgcgggtacaacgcaagactgattccgtcccttcctgatgagatatcaatacagattctagctagagttcctcgaatttattatttgaatctgaagttagtttgccgtgcttggaaggaaacccttgttagttctgaactattttgtgtgagaaaagagcttggaaccatggaggaatggctctacattttgacaaaggtcaaggatgataagcttttatggtatgcattggaccctctttccagaagatggcaaaggttgccgccaatgccaaaagttgggtttgaagatgaaacaaagaaaggtttgatttcctttccccttcggatgtggagcatgatgggtccaagtatcagaattgttgatgtcataatgagctggcttggtaggagagatgccctggactggatgccattttgtggttgctccataggagctgttgatggttgcatctatgcattaggaggattttcaagagcttcagcaatgaaatatgtttggcagtatgatcccattaaaaactcttggactgaggccagtccaatgtcagttggtagagcctattgcaagacaggtatattaaacaacaagctttatgttgtcggaggggttactaggggtcgtggtggactaagccctcttcaatctgcagaagtatatgaccctcatacaggcatgtggtcccaattacctagcatgccttttgcaagagctcaagtgttgcccactgcttttttggctgacttactcaagcctattgccacaggaatggcttcatacaggggaaggttattcgttcctcagagtttgtattgctggccattttttgttgatgttgggggtgaagtttatgatccaaatttaaattcatggcttgaaatgccaattggcatgggtgaaggctggcctgcaaggcaagctggaacgaaattgagtattactgtcaatgatgatctatatgcacttgatccttcaaattctcttgacagtgcaaagatcaaggtatatgattatgaaggtgatacttggaaagttgcagccggagatgttcctaatcatgatttcactgattcagaatctccttatctcttggctggcttacatggaaaacttcatgtaataactaaagatgctaatgataacattacagtgttgcaggctgacatgcaaaatgaacatgctgagtcagctttctcccaatcaatattctcatcaccagataactcattcagtgaagatgctgaatcttctgcagaagcccggagagaattttggaaggttcttgcaactaggagtggtagatctgctgaactagttaactgtcaatcccttaaaatatgaaaaaaaaaaaaaaaaatgggggtaggggtgtggtttagagtccttttgtggttatgatttgtgagtatatttctgttggttggcatgattgcttataagtcacactaggttgggaaatttccaaagttgtaaatgatttcctttacaaattattcataatatgtaaccaagaatacacagaattaaaactatacttagcaagaacatcattcaaacaccctacaatatatgaatgttttttaacattaagttggg

SEQ ID NO: 1133 - DNA, 1644 bp, Glycine max var. Williams 82
atgcacaacaacacaccatcaacaaaaatgatgcgtctaagctcgtattttgtcgtagccattgctcttctcttttcatttacaccttcttcgtcagcaaatactcatgaaaactttgttcaatgtctttacaattatccccataataacaatgtcacctcaatctccaacgtcgtttacacccaagccaactcttcatactcctctatacttgacttttccattcaaaaccttaggttctccaacgcaagctcaaaaccccttgtgattgtgacacctctcactgtttcccacattcaagccaccataatctgttcccaacgctatggcatgcagattcgaacccgaagtggaggccacgattacgagggtctctcctacgttgccaaggatccatttgtcgtccttgacctcataaaccttcgaaaaatcgaagtggacgcagaaaacagcactgcatgggttctagctggtgcaaccattggtgaactttactacagcattagccagaaaagcaaaacactagggtttccagcaggtgtgtgcccccctgtgggaactggtggccatttcagtggtggtggctatggattcttgatgcgtaagttcggtcttgctgctgataatgtgattgatgctcacatagttgatgtgaagggtaatcttcttgatagagaagccatgggtgaggatctgttttgggccattagaggaggtgggggagcaagctttggagtcatcgtggcttggaagataaaacttgtttcagttccatcaactgtgacagtgtttagggttccaaggacattggaacaaaatgcaaccgagattgttcataagtggcagcttgtggcgaataaacttgacgaggacctaaccataaggatcaactttggtagggcaacaagtgaaaatgggaacctaacagttcaggcacaatttgaatccatgtatcttggaggtgtggatcagctcattcctttgatgcaagagagcttcccagagttgggtttggtcagagaagattgtattgagacgagttggataggttcaattctctacatggctggatttacaaacggtgaatccactgatgttttgctgaacagaactcaagcaaacggtgtgtcgttcaacaaaggaaaatctgattatgtgagagatcccattcctgatgtagggttagaagggttatggcccttcttttttgaagatgagggtcaatcttcttttgttcaattcactccttatggttctaggatggatgagatttcggaatccgaaattccattcccacatagagctggaaacatattccatattcagtatggggtgtcttggcaagaggaaggggatgaggaagcacaaaggcacataaactggattagaagaatgtatagttatatggaaacttatgtttcaaagtctcctagggctgcatatttgaattatagagaccttgacattggggtaaataataacaagggctacactagctacagccaagccagcgtttggggccttaagtatttcaagaacaacttcaacagattggcaagagtgaagaccaacgttgatcctctaaacttcttcagaaacgagcagagcataccttctcttgtatccaagggacgcaaattatag

SEQ ID NO: 1134 - DNA, 1593 bp, Glycine max var. Williams 82
atggccaattcaatggtaaaactagttttcctttctgtcactgttttcatttcaattttccctgcaacttctacttttgctggccacgagaaaggtttccttcaatgttttcaaacaattttaggagctgacaacacaacttggcaagtaatattcaccaaaagtagttcttcttatgaaccccttttggagtcttctataagaaacgccagattcctaaacagtacttcagtcccaaaaccaaaccttattgttacaccacatagcctattccacatccaagtagcactgttctgctcaaagaaaagtggcttacaagtaagagttcgaagtggggggcatgactatgagggcctttcttatgtctctcactctcacattccattcttgatcattgatcttttcaaccttaggtccataaccattaatatggacgaagaaagtgcatgggttcagtcaggtgctacagtcggagaactctattatgcaattgcaaagaaaagtaaggttcatggtttccctgctggaagttgctccactattggtgttggagggcatttcagtggaggtgggtttggtacaattttcagaaaatatggcttagcttctgataatgtaattgatgctcagattatagatgttaatgggatgatactgaacagaacattgatgggggaagatctcttttgggccataagaggaggtggagggtctagctttggagtcattactgcatggaaaatcaagcttgtacctgttccttcaaaagtcacaacttttgatgtttcaaggaccctggatcaaggtgccactacccttttccacaagtggcaaactattgctccaaaactccccccagaacttttcttgcacagtcttgtgggagttaccaattcagcttctcaagaaggtggaaaaactgtggtggtttccttctcaggattgtatcttggtacacctgagaatctccttcctttaatgcaaaacagttttgcagaatttggtttgcggcgcgacaacttaaccgagatgacttggattcaatccgttcttcactatgcaggctattcaatagatgaatccttggaggtcttgcttaggagaaaccaatcatccccttctttcaaagcaaaatctgattatgtgaaggaaccaattccattgcatggcttagaagggctatggaagatgctactcttggagaactcaccactgttgatcctcacaccatatggtgggataatgagtgagatttcagaatcagaaactccttttccacatagaaaagggaacttatatggtatccagtatatggtgaattttgcttcaaatgaagaagcgccaaagcatatagattggataagaagattgtatgcatatatgacaccgtatgtgtcaaagtttccaagacaagcatatttgaactatagagaccttgatttgggagttaatcaagggaaaccgtggtatgaaaaagcaaagtcttggggtttgaaatatttcaattgcaattttgaaaggctggcactagtgaaggccagggttgatcctggaaattttttcagggatgagcagagcattcctccgttgtag

SEQ ID NO: 1135 - DNA, 720 bp, Glycine max var. Williams 82
atggttgctcagaaattcgttgtcgacttgaacaagccccttgtattccaggttgggcatcttggggaagcctacgatgattgggttcacgatcctatcgtaagcaaagaaggtcctcggtttttccaaagcggtttcctcgagttgttcacacgcactgcatggtgggtgattccaaccgtttgggtgccggttgcgagttggttcatttccaactctgtcaaatcaggcctcccttctcttgatgtagctctgctcgtctttctcggcatctttgtttggactttggctgaatacaccttgcaccgtttcctcttccatgttaaaaccaagagctactggggaaataccttgcattatcttctccatggctgccaccacaagcaccccatggatagctatagacttgttttcccccctgtagcagcagctatattagccctcccgatctggaacttggtgaagctgatatgcaccccttcagttgctcctgcggtgtttggaggtattttgttgggctatgtgatgtatgattgcacccattactacttacaccatggtcaaccaaagtctgatgtgcccaaaagtctcaagaaatatcacttgaatcatcattatcggctccagaactatggctttgggatcacatcaccactgtgggataaagtttttggaacggttcctcctcctcaatcaaagggggatgccaaacgtagataa

SEQ ID NO: 1136 - DNA, 648 bp, Glycine max var. Williams 82
atggtaactcgtgtacacttcttttgcctcttggctctcaccttcactctagccttggaagctgatcacagtccacttcaggatttctgtgtggcagacaccaaaagtcaagtactagtaaatggattctcttgcaaagaccctacactagtagaggctaatgacttcttcttcagaggacttgacatagagggaaacacatcaaacccagtaggatccaaggtgactccagttacagtttcacagctaccaggactaaacactttaggcatttcacttgcccgcattgactatgcaccgtggggcacaaaccctcctcacactcaccctcgtgccaccgaaatcctcaacgtgatccaaggcacacttgaagttggttttgtgacatcaaatcctggaaaccgtcatgttaccaaagtgctgcaaaagggtgatgtgtttgtcttccctgtgggacttgtgcactaccagagaaatgtgggttatggcaatgcggttgccgttgcagctctcagcagccaaaaccctggggttataactatcgctaatgctatattcggggccacgccagacattgccagtgatgttcttgtcaaggcttttcaagtggacaaagatgttgttgctaatttaaagtccaagttctag

SEQ ID NO: 1137 - DNA, 689 bp, Glycine max var. Williams 82
aaaacccctaaaatcatcaatatggtaactcgtgtacacttcttttgcctcttggctctcaccttcactctagccttggaagctgatcacagtccacttcaggatttctgtgtggcagacaccaaaagtcaagtactagtaaatggattctcttgcaaagaccctacactagtagaggctaatgacttcttcttcagaggacttgacatagagggaaacacatcaaacccagtaggatccaaggtgactccagttacagtttcacagctaccaggactaaacactttaggcatttcacttgcccgcattgactatgcaccgtggggcacaaaccctcctcacactcaccctcgtgccaccgaaatcctcaacgtgatccaaggcacacttgaagttggttttgtgacatcaaatcctggaaaccgtcatgttaccaaagtgctgcaaaagggtgatgtgtttgtcttccctgtgggacttgtgcactaccagagaaatgtgggttatggcaatgcggttgccgttgcagctctcagcagccaaaaccctggggttataactatcgctaatgctatattcggggccacgccagacattgccagtgatgttcttgtcaaggcttttcaagtggacaaagatgttgttgctaatttaaagtccaagttctaggatattatatggaacatgtt

SEQ ID NO: 1138 - DNA, 396 bp, Glycine max var. Williams 82
atgatcaaggtccatgccattgatacacgcggtttggtggataaaatggggtgcactgagtgtaagtgtgatctttataatgttacaaaggatgaaaatggagagcctctaagaccagactataaaggaggtatgttttgctgctatgatcaaatgcaatgcaggttgagggaaggctttgacggaacaaagaggagcctctacctaagatacacggttgaatcttgcagcactgaccacaaggatggtaatggatgtcttgatgtgaagagaacaagtctcccaatgaaaaagggtggttatgtcatctatggtgttgctcatcagcgttcaggatggaagggttatatgctcttcaataccaagatatggaaatggaaaagaagcaggaaatga

SEQ ID NO: 1139 - DNA, 1305 bp, Glycine max var. Williams 82
atggatattgtatcacgagctttgctatttccgttggctatacttgtgctcatattaagcacaccttgctcaggtgcttttgggaagagtggaactaatgtgaaaacagctatttttctgtcccccaagtttgaacttggaccaggatcggtagccaataaatatgattatgacgctgattttccaagaggtcatatagcacttaagagtttcaatgctgaagtagttgatgaagcagggaaccctgtgcctcttcatgaaacttatctccaccactgggttgttgtaagatactatcaacctaaatatgtgacgacacacacaaactatgatggacataggatacttcacaactctgaccatatatttgtgaggaacagcggcttatgccagagagatactctaggacaatactatggccttggatctgaaacacgaggaacagctacggatgttcctgatccttttgggatagttgtaggtgatcctgcagaaattccagagggatatgaggagaagtggatggttaatatccacgccattgatacgcgcggcgtggtggataggatggggtgcactgagtgtaggtgtgacctttacaatgttacaaagaaagaacatggggagcctctaagttcagactataaaggaggttattattgttgttatgatcaaacccagtgcaggttgagggaaggctttgagggcccaaagaggagcctctacctaagatacacagtgaagtgggttgaatggaacaagttcattgtgcctgtaaagatttatatacttgatgtcactgatactttaaaaatatcagatgattctagtggaatgatccctgagcatgattgcaagaccgagtatgaagttgaatcttgcagcactggccaaaagaatggtaatggctgtcttgatgtgaagagaacaagcctcccaatgcaaaagggtggttatgtcatatatggtgttgctcatcagcattcaggtgccactggatcaactctctatgcacaggatggaagggttatatgttcttcaataccaaggtatggaaagggaaaggaagcaggaaacgaagtagactacattgtaggaatgagcacatgttatcctcaaccaggttctgtaaagataattgatggtgaaactataactctagagtctaactacagcagcagccgtggccacactggagtaatggggcttttctacctattggtggcagaacagcttccacaccaacacttcagatattcttctcgttcttcattttttatgaatataaatagtataattcattga

SEQ ID NO: 1140 - DNA, 1964 bp, Glycine max var. Williams 82
gaaaatatttgaccaatgggcatgtattctgcatttgttgtcccatcatattacaggtgtctcaaatcccaataaatccaaggaagaacaaaacacgaaatgagaggccagagcctgaagtattctcttgtcttgtgatggtcttttgtctataaataaatccactttgaacctgttactatgtgcctcctcaaacacagccttgaacttgaactatcgtgtcttcttggctttctctgttcaggatcaacatggatattgtatcacgagctttgctatttccgttggctatacttgtgctcatattaagcacaccttgctcaggtgcttttgggaagagtggaactaatgtgaaaacagctatttttctgtcccccaagtttgaacttggaccaggatcggtagccaataaatatgattatgacgctgattttccaagaggtcatatagcacttaagagtttcaatgctgaagtagttgatgaagcagggaaccctgtgcctcttcatgaaacttatctccaccactgggttgttgtaagatactatcaacctaaatatgtgacgacacacacaaactatgatggacataggatacttcacaactctgaccatatatttgtgaggaacagcggcttatgccagagagatactctaggacaatactatggccttggatctgaaacacgaggaacagctacggatgttcctgatccttttgggatagttgtaggtgatcctgcagaaattccagagggatatgaggagaagtggatggttaatatccacgccattgatacgcgcggcgtggtggataggatggggtgcactgagtgtaggtgtgacctttacaatgttacaaagaaagaacatggggagcctctaagttcagactataaaggaggttattattgttgttatgatcaaacccagtgcaggttgagggaaggctttgagggcccaaagaggagcctctacctaagatacacagtgaagtgggttgaatggaacaagttcattgtgcctgtaaagatttatatacttgatgtcactgatactttaaaaatatcagatgattctagtggaatgatccctgagcatgattgcaagaccgagtatgaagttgaatcttgcagcactggccaaaagaatggtaatggctgtcttgatgtgaagagaacaagcctcccaatgcaaaagggtggttatgtcatatatggtgttgctcatcagcattcaggtgccactggatcaactctctatgcacaggatggaagggttatatgttcttcaataccaaggtatggaaagggaaaggaagcaggaaacgaagtagactacattgtaggaatgagcacatgttatcctcaaccaggttctgtaaagataattgatggtgaaactataactctagagtctaactacagcagcagccgtggccacactggagtaatggggcttttctacctattggtggcagaacagcttccacaccaacacttcagatattcttctcgttcttcattttttatgaatataaatagtataattcattgatagataagttgtgagatgcaaatataagttgagtgtcatatcgatggtatcacagtatgtatcacggttaaaagaaatacagaaatacatatcgatggaacatatacttctcatattcggcagcaataggacaacacacgcaagaaccggcaaagagcatattttcaagtttaaggattgtagtaatgtgattatcaattatttgtattggtgagggtttgtaatgtttgtcttaaaccagtcttgcttattatggttgtgtgatatgtaatactatatatatcatgtttgttgtaaataaagtggtcttatataactagaagagagaataaatcaagctgttcgacagggacatatgttctatcctacgtcaggccaaacgaggttttttttggaaaataaatcaaa

SEQ ID NO: 1141 - DNA, 1290 bp, Glycine max var. Williams 82
atggatttcttttttccattggcaatacttgtgatgatattaggcacaccatactctagtgcttctggaaagagtgaaagtaatgtgaaaacagctgtttttctgtctcctaagtttgaacttggaccgggatcggttgcaaataaatatgattatgatattgattttccaagaggtcatatagcacttaagagtttcaatgcagaggtagttgatgaagcagggaaccctgtgcctcttcatgaaacttatctccaccactgggttgttggaagatactatcaacctaaatatgtgacgacacacacaaactatgatggacataggatacttcacaactctgaccatatatttgtgaggaacagcggcatatgccagagagatattctaggacaatactatggccttggatctgaaacacgaggaacagctacggatgttcctgatccttttgggatagttgtaggtgatcatgcagaaattcctgaagggtatgaggagaagtggctggttaatatccacgccattgatacacgcggtgtagtggataagatggggtgcactgagtgtaggtgtgacctttacaatgttacaaaggatgaatatggggagtttctaaggccagattataaaggaggtttgaaatgttgctatgatcaaacacagtgcaggctgagggaaggctttgagggccctaagaggagcctctacctaagatacactgtaaagtgggttgagtgggacaagtttatagtgcctgtaaagatttatatacttgatgtcactgatactttaaaaatatcagatgattctggtgaaatgatccctgagcatgattgccgggttgagtatgaagttgaatattgcagcactggccaaaagaatggtaatggctgtcttgatgggaagagaacaagcctcccaatacaaaagggtggttatgtcatatatggggttgctcatcagcattcaggtggcactggatcaactctatatggacaggatggaagggttatatgttcctcaataccgagttatggaaagggaaaggaagcaggaaatgaagcagactacattgtaggaatgagcacatgttatcctcgaccaggttctgtaaagataattgatggtgagactttaactctagaatctaactatagcagcagccgtgagcacactggagtgatggggcttttctatctattggtggcagaacagcttccagaccaacacttcagacatacctctcgttcttcattctttatgaatataaatagtatatttcattga

SEQ ID NO: 1142 - DNA, 1077 bp, Glycine max var. Williams 82
atgtctgttgaacctaaggaactttactaccaggaccttgtcctagaccccaatattaataatcaacatcagggcacagaagcaggatctaataatactatgtacgaaaagcacttttcctctaccataattccttcagattcaacagcatatgattcatcacaagcctttgatccctcttacatgagtttaactgagtgtttgcaagggggcatggactacaattcacttgcaacttcttttggcctttctccttcctcgtctgaggttttttcttctgttgatgggaaccaaaagccagcagtagaaggaggagatggaggtggtggtggtggtggcagtgaaacccttgcgacccttaactcttcagtctcttcttcatcttctgaagccggggctgaggaagattctggaaagagcaaaaaagaaaggcaggtgaaaacagaagaaggagaagaaaactctaagaaagggaacaaggagaagaagaaaggagagaagaagcaaaaggagccaaggtttgccttcatgaccaagagtgaggttgatcaccttgaagatggatacagatggagaaaatatggacagaaagctgtcaagaatagcccttacccaaggagctactacaggtgcacaacacagaagtgcacagtgaagaaacgcgtggagaggtcatttcaggacccaaccactgtgataacaacgtatgaaggtcagcacaaccatccggtccccacttctctcagagggaatgcggctgcgggaatgttcacaccttcttctttgctagccacaccaactccacttgcagccgggtcaaacttcccccaagatctcttccttcacatgcatcaccctcaccaccaatatcacattcacaacaacctcttcaccacacagtcgactacaaacactactactgctactactaccactccatcctcgttttactcttcctataacaacattaacaactctcttcttcacaaccagtttcttcctccggaatacggcctccttcaagacatagtcccttccatgttccacaacaagaccggccaccatcaccagaattaa

SEQ ID NO: 1143 - DNA, 1080 bp, Glycine max var. Williams 82
atggaaccgacatctcttacagtgccctttgtccaagaaattgcaaaggatgccttgacgagggttccagagcgttatgttcgtccacttcatgagcgcccaatattattatcagccactactacacctttaccccaagttcctgtcattgacctaagcaaattgttgtcacaagatctcaaggaacctgagttggaaaagctgcactatgcctgcaaagaatggggattttttcagctgataaatcatggagtgagcacttcattggtggaaaaagtgaagagaggtgctcaagatttcttcaatcttccaatcgaagagaagaaaaagttagggcagagagaaggagaaggtgtggagggatatggtcaggcctttgtggtctccgaggagcagaaattagagtgggcagatatgtttttcatgctcactttgccaccacatataaggaaaccctacttattccccaacatccccttaccattcagagatgatttagagacatattctgccggattaaaaaaacttgcgatccaaatcgttgaacttatggcaaatgcccttaatgtggactccaaggaaattagagagttatttggtgaaggggttcaatcaatgaggatgaattactatcctccatgtccccaaccagagcttgtgatgggactcaatccccatactgatggtggaagcctcactatccttctccaactcaatgaagtggaaggtcttcaaattaaaatagatggatcatggattcctattaaacccctccccaatgctttcatcgttaaccttggagatatgatggagataatgacaaatggaatttatcgaagcatcgaacatcgagcaacagtgaacttagaaaaggaaaggctttccatagctacattttacaaccctggcatggaagtaaaattaggtccagcaccaagccttgttactccaacaacaccagcagtattcaaaacaattagtgtacccgaatactacaggggatacctctcaagagaactccgtgggagatcatatcttgacagcatgaagatccaaaatgaagatgagaacagctcttga

SEQ ID NO: 1144 - DNA, 1017 bp, Glycine max var. Williams 82
atggaggggtctcacatggggttgttgctcttcttttcttccatgctttttgctgccttcccttctgcctcctccagaaacttgcccgtcataccctttgatgaaggctacgcgcccttgtttggggacagcaacttggtcatccatagggatggcaaatcggtccatctttcactcgatgagagaacaggttcaggatttgtgtcgcatgatctttaccttcacgggtatttcagcgcttctattaagttgccttctgattacactgcaggagttgttgttgccttctatatgtcaaatggtgacatgttccagaataaccatgatgaaatcgactttgagtttttggggaacattagaggcaaagactggaggattcagaccaatgtttatggcaatggtagcaccaacattggcagagaggaaagatatggtctctggtttgaccctgcagatgatttccatcagtacactattgtctggacagactctcagatcatattttatgtggacaatgttcctattagagaagtgacgcgaacagaatctatgggaggagatttcccttctaagccaatgactttgtatgcaacaatatgggatgcatctgattgggctaccaatggaggcaaatacagggttaactacaagtatgcaccctatgttgctgaattctctgaccttgtcctgcacggttgtgcagtggatccaattgagcagcacgtggccacgtgtgacaatgctcaaagctctgaggcaacaattcctccttctggtgttacaccagcacaaagaatcaaaatggagaatttcaggaagaagcacatgacatactcctactgctatgacaaagtcagatacaaagtccctccttcagagtgtgtcatcaattcccaagaagctgagaggctgaggaggtttgatcccgtcacgttcggtggtggccgccgtcaccatggaaaacgacaccgtcgcagcagaggaagccagacagaaacttctgcttcatcattttaa

SEQ ID NO: 1145 - DNA, 1203 bp, Glycine max var. Williams 82
atggaaaaggacaagtctcacactcacagctttcttcacagtatcgtcaaacacttcaaattcggttcaccgaaagagcgaaacaatgaagctgacgtacaccaaatggctgcacaggagcagaagatctttgcctacgaaaccttgacagctgcaactaagaattttagtgctattcataagcttggtgagggaggttttggaccagtctacaaggggaagctgaatgatgggagagagattgctgtgaagaagttatcacacacgtcaaaccaagggaagaaggagttcatgaatgaggccaagttgttggcacgtgtgcagcatcggaatgtggtcaatttggtgggctattgtgtctatggcaccgagaagctacttgtttatgagtatgttgctcatgaaagcctagacaaacttctattcaaatcagaaaagagagaggagcttgattggaaacgtagggttggaataatcacaggcgtggcaaaggggttgctttatcttcacgaagactcgcacaattgcatcatccatcgcgatataaaggcgagtaacatcttgcttgatgagaaatggacgcccaagattgcagattttggcatggctcggctcttcccggaagatcaaacccaggtcaatacacgtgtggctggaaccaatgggtatatggctccggaatacgtgatgcatggaaatctatcggtgaaggcagatgtatttagctatggagttttggtattggagttgatcaccggccaacgaaactcatcttttaatttggacgtggacgcgcagaatctgctagattgggcatacaagatgttcaagaaagggaagagcctagaacttgtggattctgcattagcatctaggatggtagctgaagaagtagcaatgtgcgttcggctgggtttgttatgcactcaaggcgatcctcagctacgccccacgatgaggcgcgtggtggcgatgctgtcgaggaagcaagggaacatgcaagaacctacgagaccaggaataccaggttcaagatacagaagaccacctaggagacactccgcattgtcttccacattgggtacctctggttctgattctagtaataatgataataccacggttactactagtgccacagggactagctcagctactgcagaaacagaccccaaagggaaacgtccaatgcgggaggcttag

SEQ ID NO: 1146 - DNA, 1713 bp, Glycine max var. Williams 82
atggaaggaggagtacctgatgccgatgtctctgccttcagtgaatgcctctctctctcatggaagaatccctatgtccttcgcctcgctttttctgcaggaatcggtggccttctttttggctatgacaccggggtgatatctggagctcttttgtatataagggatgaattcaccgcggtagataggcagacttggcttcaggaagctatagtgagtacagcaattgcaggagcaatagtaggtgctgcagtgggtggatggatgaacgatcgatttggaagaagaacatcaatccttttagctgatatcctctttttaattgggtcagttataatggctgctgcacctagccctggtgttctcgtcctgggtcgagtttttgttggccttggtgttggaatggcttcaatggcatctcctttgtacatttctgaggcttcccccaccaaagttcgaggagcccttgtagctctcaacagtttcctcatcaccggtggacaatttctctcctacctcatcaacttggctttcactaaggcgccgggtacatggaggtggatgcttggagtggctgcggcacctgctataatacaagtggtgttaatgttcacgctcccagaatcaccacgttggctgttccgaaagggaaaggaggaggaagcaaaagcaatattgaggaaaatttatccacccaatgatgttgaagaagaaatccaagctttgcatgattcagttgctacggaactggagcaggcaggatcctcagaaaaaatcagcataatcaaactgttgaaaaccaaggcagtgaggagaggtttggtggcaggaatgggccttcaaatcttccagcaattcacgggcatcaacactgtcatgtactacagtcccacaattgttcagttagctggtgttgcatccaaccagacggcaatgctcctctccctgatcacttctgggcttaacgcgttcggttcgatcttgagcatatacttcattgacaagactgggagaaagaaacttgctttgcttagtttgtgtggctgtgttgtagccttggcccttttaacattcactttccgccaaaccgaaactcattctccaatgattagtgcggttgagaccgctcatttcaacaacacctgccctggtttcagccaagctgtgaatgctaatgaatgggattgcatgaagtgtctaaaggcagaatgtggcttttgtgcatccgacgtctctagcaaccgcttacctggcgcatgtttgatttctaatgatgctacaaagggtatgtgtcaaaaagaacatagagcatggtacacacaaggatgtcctagcaaaattgggtggcttgcaatagtgggacttgcactgtacatcatattcttctcaccagggatgggaactgttccatgggttgtcaattctgaaatctatcctctgaggtaccgtggagtatgtggaggaattgcttctacaacatgttgggtttcaaacctcattgtttcgcagtccttcttgactttgaccgtggctattgggacagcatggacattcatgttatttgggtttgttgctctcgttggcatcttattcgttctcatcttcgtgccagaaactaagggagttccaattgaagaagttgagcagatgctggaggaaagaggtctgcacttcaagttttgggagaagaggagtcctacccagaaggcttga

SEQ ID NO: 1147 - DNA, 270 bp, Glycine max var. Williams 82
atggcaaattctcgcattgctaggttcttcatggaggtggcaccaccacagtatgttactgtgatgaggcacagaacatcaaagatgttggacactattactgaagatgagagggagattagcaccagtgattctgtcatgtcaccccctaaaaaaagcaaatcagcagtagcagttgcagcttcatctgcttctgcttctgttaccaatgttaagggaaggtgcttcctcaaggaagtgcatagatccctctcaattttgaatcagtga

SEQ ID NO: 1148 - DNA, 1623 bp, Glycine max var. Williams 82
atggagtacgagaggatagagaaagttcaggctggaataatttctcccagtaaactaaggatgaagttattaggacctcaccatcataggaagaaagatggatccaacagtaactcatccagaacctccccctcaaggattgaggatgctgaatttgtgaatagcttacttgactcaaaaaatgacaaccttgatgatgaagtaacatctccgagcttggatgttctgtcattaaagccatctagtaatgccttgctggaccggaaacagaacggccagatttcttatgaacctaaggagacaatgcctaaggaaaatggcgacatggggcgtgcaaagacgcaccattttcccaaggttgacaccggaagttcaagcgcaattcatgcggtgagggcaatagaagatgaaaatcttgattatgacagcaatgctagctcgtccagctttgagtttgataaaggggagagaccagggaacaatcctgccactagatccctattcagacctattccttctaagtggaatgatgccgagaaatggataatgaataggcaaaatatacaggctaatcactcaaaaaagaagactgctcataaccaagcaaatcgcatgccaacaaatatggggagggttgctccagaatctggtaattgtgatcacaaactcccaacaggcaaagttacagaaacaaagcgagtcgatttctgtcagccaacatcacatatgggatttgagaaattctcttttgttccctccgatgctcattcggtttcaggtcaagcacacggaagaaatccagtggtggagtctcttccccaaagcaaagatctaaaagaagtcaatgaattaggtttatcttgctcaagaagtacagatgatcagtcagtgacgcctgggataagatctgttgccatgagagacatgggaactgaaatgacccctgtgccaagtcaagaaccttcccggactgctactcctgttgggtctgcgaccccactacggagcccagtttcctcaatgccgtcgactcctaggagaggtgcacctgctcccacaccgttggacaacacaacagatgaggattcccagtttccagttgaaaatggaaaaaggaatttgtctgaagaagaaatgaagatcaagacaaggagagagattgcagcccttggggtgcagcttggtaagatgaatattgctgcatgggcaagcaaagatgagcaggaaaagaacaaatcttcgcctcaggaggcgaatgtgaatgaacaggagagaattgaatttgaaaaacgtgcggctctgtgggaggaagctgagaaatctaaacatactgcaagatttaagcgtgaggaaatcaaaattcaagcatgggaaagtcaacaaaaggcaaaattagaagcagaaatgagaagaattgaggccaaagttgagcaaatgagagcccagacacatgcaaaaatggtgaaaaagattgctatggcgaggcaaagatcagaagaaaaacgtgcagcagctgaagctagaaaaaatcgagaagcagaaagaactgcggctcaaacagaatacattcgccaaacaggacgattgccctcttccaattacatttgctgtggttggctgtga

SEQ ID NO: 1149 - DNA, 1104 bp, Glycine max var. Williams 82
atgagatacgtggaggacaaagggtgctacaacaacaatggaccaacacaagagactccaaatagcagtgccatgtactcagagtttcacaaaggaaaagatgctactcgtgtctccaaccaccatcatcgagcaaccatgggaaaaccaaccccttccaagtgggatgatgcacaaaaatggctcgtggggttgtcaaaaggtggagagaaaagccactccaaaagcaagccaagaaactcaaacgcagatgatttgagactcatagctcctgtgccacagaaggagcatgattactcaagtagtgagaaggaagaggaggaaaatgatgcttgccatgatttcatgactaatattattagtgctaatgctattgctgctcaatatgaagctgaagccaaaagggtagaatgtgatgagtcaaattggggaagcaataataataataatgacaacaggttttcaggaaacacgatccaagtgcaaccaatatgtttcagagacatggggactgagatgacaccgattactagccaagagccttcaagaactgggacaccaattagagccacaactcctgctactagaagcccaattcattcagggacttcaactccaatgaggggtcaaaatgggttgcaacaagttgctgagggtggccatggcactactaggaagtgtggagatcaaggatcaacaagcccttgcaagaagactcatgaagatcatcaagctagaaaattgagtcctctagaaagccgtgcaatggcttgggatgaggcagaacgtgccaaatttatggccaggttcaagcgtgaagaggtgaagattcaagcctgggaaaatcaccagataagaaaagctgaaatggaaatgaagaaaatggaggtgaaagctgagaggatgaaagctttggcacaagaaaggtttgcaaataaactggcttcgactaagaggatagctgaagagaaacgagctaatgcacaagtgaagctgaatgacaaagctttgaggactactgaaagggttgagtatataagaaggacaggacatgtgccttcttctttctctttcagctttaagttgccttccatttgctggtag

SEQ ID NO: 1150 - DNA, 711 bp, Glycine max var. Williams 82
atgtctgctgctgtgtctgcaaccaaggatgttcccttcaatgctcatctggaggaagatatcaaaaacaaaggaagcaacaaggttgttggggaagcagaccggcttccttacaatgatgatgccgaaggaactgattcagagacagaggaagaccccaagttggaattggatcttggtcctcagttttccctcagggaacagcttgagaaagataaagatgatgagagtttgagaaaatggaaggagcaacttctgggaggtattgatgtgtctgctgttggagaaaacaaagagccagaagtgaagatagtgagcctcaccataatatgtccagggaggcctgacctcattctgccaattccatttacttctgaatctaagaatagtatcttcacccttaaggaaggaagtcaatatcgcttgaaattctccttcactgtctccaacaacattgtttctggcctcaaatacaccaatgttgtttggaaaactgggcttagagtggacaacacaaaaaagatgttgggaacttatagcccaagccaggaaccatatacatatgaattggaagaagaaactaccccttcggggttgtttgctaggggaacctattcagcaagaaccaagtttgtagatgatgatcacaaatgctacttggatactagttaccactttgaaattcagaagaattggtctacacccatctaa

SEQ ID NO: 1151 - DNA, 3513 bp, Glycine max var. Williams 82
atgcttccaaaaaatccaatctttcggtgtcgggacactccttccgcacatgctttcagaaaacccagacccacgcgaaaacaaaaatccaaggacaaagaaaaccatcctcctcctttcaagtcccccttgcccccaaaacctcccaaccctaaccctcttaagcgcaagctttccgaccattccgttccccccacccccggttccggcgtcaaggttattgtgagaatgaggcctgcatgcgatgacggggacgagggagattccatagttcagaggatttccagtgattccttgtccatcaacggtcagagcttcacatttgattccgttgctcacagcaatgctactcagttggatatttttgagcttgttggggcgcctcttgtagagaattgcttggctggatttaatagttctatatttgcatatgggcagactgggagtgggaaaacttataccatgtggggtcctgccaatgctttgtcagatggcaattcagcaagtgatcaacaaggccttgcgcctcgtgtttttgaaagactctttgcctgcataaatgaggagcaaattaagcattctgacaagcaactcaagtatcagtgccactgctcttttctcgagatatacaacgagcaaatagcagatctattagatccaaatcaaagaaacctacagattagagaagatgtcaaatctggtgtctatgttgaaaatcttacagaggagctagtgtgtacgaagaaagatgtgactcagcttttgataaagggtttgttaaacagaagaattggtgcaaccagtataaattctgaaagttcacgttctcatactgtttttacttgtgtggttgaatctcgatgcaagagtactgcaaatggtgtaagcagatttagaacaagtaaaataaatcttgttgatctagctgggtcagaacgacaaaaattaacgggtgcagcaggagaccgtttaaaggaagctggcaatattaatagatccctttcacagcttgggaatttgataaaaattctagctgaagtttctcagacaggaaagccgcgacatataccatatagagactccaggttaacatttttattgcaggagtctcttggtggaaatgcaaaattagctttggtttgtgctatttccccagcacaaagttgtaagagtgaaacttttagtacattgagatttgcacaatgtgtaaaggatatcaagaataaagcagttgtcaatgaagtaatgcacgatgatgtgaatcaattacgagatgtgatatgccaactcagggatgaactgcatcgaattaaagcaaatggttacagtccaagtgatggaagtcgaggtcattcagcagctttgatcagaagaagtttgaatttgttgaagcctaccctcaatcgcccattatcactacctcatgttgatgaggatggtgatgaggagatggagattgatgaggaaggtgtcgaggatcatgctgtagttctccacaactcaaatggaggttttgctggtttttcagcccctaatggatctattggttctcctagtgctgcaatgaatggtgacagccttgctggcggcatggttaaatgcaaaacatcccccatcctcaaatcccctccttccagcctttcaccaacaatcagcagcagcaggaaaagtttgaggacctcattaaagcagtctccttctgagaataatattcatggtgaaagtgatttaggcacaaacaccgttaaccagaaatgcttgtctactgctctctctagccagacagctccaaatttcgtaactaaaactgaaaatttagcagtaagcatccgccatggtcttgaaattattgatagccaccatcatggtacatcgttatcgagtctctcattgagacccaaagattccaggctaattattcctgtggaaaaagttgatgtcggagtccagacttttcttgatgataatgccaaaaaggaagattatgctatgcttacctgtaataactgtaaaagcagaatgcagcttgatgtcaatgagattgacaatagctcaaatgtgcagcagttactgattgattgcccgcagtcaactggtaaaccaaagaagcaaattctgaaagcagtagagaaggttttggcaggatcgataaggagagaaatggcactagaagagttttgtgcaaagcagacttctgatataatgcagctcaattgcttgttgcaaaagtacaggcaagagagggaatgcaatgccacaataacacagataagagaagataaaattctacgccttcagagccttattgatggtgttttatccaccaaggagtccatggatgaagagcttgtgtccctcacacatgaaaacaagcttttaaaggagaaccatgagcatcatttagaagttctgaagatgaagatagagttaaaaagagtacaagatgagttacaagagtatcagaatttttaccaatttggggagagggaagtgttgatggaagagatatgtagtttaagaaaccagcttcacttttatgttgactcttcatccacagccgcaacaaagcaatatcctccattgcaattgacttattcatctgaacctagtttggaagcaaacctcactgccattccagatttaacagaggctagcactaaggcaaacgcaaatccagaatcaactgaagacagtgccaaagtaaaacttgagcaggaaaaaagtcaatggaccgaggcagaaagcaggtggatttctctaactgaaaaactgagagctgaacttgaaactagcaggttactagctgaaaagaggaagcaggaactagatactgagaggaagtgtgcggaggaactgaatgaaacaatgcaaatggctatagaaggccatgcacgaattttagaacagtatgctgatttagaagagaaacacatccaattgcttgacaggcatagaaagatccaggatggaattgatgatgtcaaggaagcagcttccagagcagcaggagtaagaggtgcagactctaaattcataaatgcccttgcagcagaaatttcagcattaaaagcagaaaaagaaaaagaaatggaaatcctaagagatgaaaatagaggacttcgagctcaactgaaggatactgctgaagcagtgcaagctgcaggtgaacttcttgtgcaacttaatgaagcagaagaagctgtcattaccgcacagaagcgggcgatggatgcagagcaggaagctgcaaaggcctacaaacaaattgataaattgaagaagaaacatgacaaggagattagcacacttaataagctacttgccaaaacacatttgcctaatgaagaaatacgacctactttagatgaccttgtaatgcctacttgtgatgacaccaaggtgccgaacaatgttaatggtcaatttgagttattttgtagcgaagaggatattgaactagcaaatttggcagaccaatcatggttgtcttcttatgacacatgcaacatatag

SEQ ID NO: 1152 - DNA, 2971 bp, Glycine max var. Williams 82
gatgagatatattggggacaacacacaactcaagcacagaaacgcaaacaaatacccataacaagagagagaaaagaaaccaagcagagtggtaaacaaaggaacaaaacccagaatctagagagcaataacggctctagctttgtgaatagcataccatagcaacaacaacaacaacacacagaacacacaaagaaaaagtacttcccccaaaaccatatattatattatgatatgtacgtatagatatacatagttttgtgtatattgagatgagatttttgttctctctttcttctatttattcatgtgtgtgtgagagagagagagagatcttgtcctcctacaatagtcactttgtagcggactaggtgatcttatgcaacaaatttcacttggactccttcatcaatcgacgtttcacttttttttcccgttaacgcttcgaatcagagcttatttttccccttttgatcgatacccattattgcttagtaagaggcttatggaggaatattaaagctggaaatgaatgcggtgacatggtgcatggacaggagcatagttgctggttcgttccctttctggaacagggctactggaaactaattcaagcactctcaaatttagaagaattttacactaggcgtatttggattttgtgcaatgtcgcgctgttttccatttccaccaccaggatatggaaagaaggctataacagatgaagtggacttattaaaaaaggaaaagcagaaagaaaaaaaacataagaaagataagaaggacaaagagaagagggaaagcaaggaaaagagagagaaagaaggaagagatggaaagcataaggaaaagaaggacaaaaaagaaaaacacagagagaaaaagaaagataaggataaggacaaggacaagagcaaagatagagataaaagtaaaagcagttctgcagatgacaaagggttcccaagacaagccgagggtctcaacgcaggtaaaccccatcaaaaggaaattaagcaagatgataagaagggtatcttgtttgagaacagactcaccaaacagtatgctggtaacaatggggagaaggcaagagagaaaaatcatctggctgaagagaacaaggattcaaagttcctcctggagttggaccggaggattagggatgatgatggaggagctgacaatcaattggttcataaatttaccaatacaaaccatagaaaagatgaggggactgttaggttggtggctaaaggtccaggtggcaccaggtctgatggtaatgaaaaactcaaggatatgggtcttcatgttaagaagatggatgggcgaggaatacaggatgaggtccggccaattggaaacacaccaccagttcagaatcatgttggaaattttcatcctggagttggtggaatacccaaacttttgggaaagtattttgaaaggaatttggaagcaacagttgaaggtaaagaaaaggttaaggaaaagaaagatgaaaaaaaaaaggccaaggaaaagacagaagaaaggaaggttaaggaaaataaagatgaaggaaaggaaaaggttaaggaaaaaaaagatgataaacgaagagataaaaggaaagatagagagaaggagaagaaagggcatgggaaggacaaagacagggataaagagaagaaaaaggaggataaagctaaggagcatagtgaacttaaaacaacagagcaaaataaattaaaagaaagcaacaaagttggaattataaattcaaattctttcacacagccttttaggaacagccatgggaacgctgtcagtggagaaaatctcaagaagcggaaggacattgagtcaaatggagttccacatgtcaatgacagtttgcccaataagtttccgaaactgtcttcctctcatccattcactgaaaacggaagggtattggaaccttgccaggtttccattccaaatgcttcagataggccacgagaagccaccagtgttaaggtagaaaagaaagaaagcaagatgaatggcatcattgaaagtcagccatttgcagcttcttcaaacaagactcaaactgccaatgtgtcagctgatttggtaactgaagcatctgcaaagccccttcatccagataccaagtacctaggccaggtatattcagtacctaaggtggagcagtggtctgattttgacgatcaagagtggctatttggcagcaatgtttcacaagaaagaaaatctgtggtgaaatcttcagaggtttgggagacacctcaggtatgggcagaagctctgcacatagagccagcagatgtttttgctcttccatatgtcattccgtactgattaattatttaattgtcacacgatgcttcaaacaattatgatgtgtgcacaaggaaccctcctttgactttccgtgccggaggactgaagcatgggctggaaaatgattcctattttcttgatgcattcttttgttaattgcacactggcagcgagtaatgagtgactcattggttgccttgatcttaaactgtttggatggtgactcttgctgcaactgattgtcttgattttttactgattggaaggggaacatctgttggtactgccagattgggggtgcagctctcaccttgtgcgtcgtagtaattcatttagacaacagagaatttgtacaggttgtggagagggggaggggagaggtacaagcttgtgcaacttgtttttctttttttgctgaaagctgagctgctctttctaattgagaatgggaatttgtaagtgaaactgtggtctttgcaactccaccacaattttgatttgtaacatagaactcttattttacgagaatatgtatgatagagaaggggaaaaagaagtaatcggattcatttattcagtttcctgtaaattttattggtcattgaatcattttgctttagtgttaatgattattgaa

SEQ ID NO: 1153 - DNA, 3184 bp, Glycine max var. Williams 82
ggtggggggtgatgagagagaaactgaggcaagagacaaaagagacaaaagaacccaacattgtaagatgatgaaggtggtcggagagaggtttctctgagatcctcctcttcacaggcagcaatttaacgtaacaacattatattcatttcaatcttttaatttgctgccttttttttcttattcttccttccttgtctcagtttaatctccccaccgcccccccaacctgtcaccaccaactgcattgcattgcattgcatcatcaaaccaaacattgttgatccttcagtttcaacgcacaaagggacttcttttcctgcacccttttctcccatttgcatgccccagcccacattgtttggaatcattgagaggacgaattgagctgggtatgcttttgttgagcaaaaggttgtaaggaagagattgatacacaaaatgagggaccctgaaaccaagagcttcaattgtttttgctttccattgtaatgtataagtttttcatagttagtgaattttctgctgcttcatccaaataggtggaagggtttctatgtacagaaaaaaccttccaattttgtaaatttgatatgacatatcatatagcttcctgactttaaagagatatagatattgtcgctaccaaagtggcattgccttctcatagcaatggaaagcatatgggggccatttggattatggctccgaatttatgttggattgatttctctgtggggaactcgacagtgttggtctctgaacgatgaaggattaaccttgttggaatttcggggaagaataacttctgatccttttgctgctctggcaaattggaatccaaacgattgcaacccttgcaaatggctgggtgtacgttgtgttgatagtcaagtgcaaacgctggtcctacctgatctatctttggaagggacattggctcctgagcttgggaaacttcgtcatctaaaatcccttgtactatacaagaacagtttttctggtaccattcccaaagaacttggaggtctagacaagctggagttattggatttaagggggaatgacttgactggatgtatcccagcagaaattgtcagggtgttgttgtcaaaacatttgttggtttgtgacaataaatttgaaggcagtgattctcaagagctcagattgccctctcataacaatcatttaactcctttggcaactttatctcatggcaagaatagaaagtttgcacaccgtatacaacaacaagaacaacatggtgaaaaaagtatgtgccataaaaatttcaagcaatggaacatggaagattcatttgttattccacttaagggagcactcaaaaattacctcaaagctgtcattgctgtggcactgccactgttcaagctaggaaaggctactcctcatgcctatgaagagaaatactgtaaaaatctgactagctctgatgaatcagattttggccatgatgagtcagagtttggccagaatgtaccaaatataatcaattcagtacgacgtaagttgtttgatcagtccagtaaccttgcagctgcacctttcagtggtgggcctactatagagatcagttctgttccaattacccagagcagtggagctttcccagctgtgccagacaccaataagaaacaaaatcagtcacctgcaccattgccttcatcttctaattctccacctgtgaatcaagcaagtcaacaaaattcacctaatggtgcatctggaaaattatggaagtatattattataatcgcaggtgttgctgtcttggtcattgtttttgtgatcatgctttgcatttggcgtaaacgagcagcaaaagtaataaagccttggaagacaggaataagtggacagttgcagaaagcatttataacaggggtccccaaattgaatcagggagagctggaaacagcctgtgaagatttcagcaatattattaatagttttgatgagtgcactatatacaaaggaacactatccagtggagtcgagattgctgttgattcaactattgttacttctgcccgtgattggtcaaagaacatggagacagcctatcgcaaaaagattgctgctttgtcccgtgttaaccataagaactttaccaaccttattgggtactgtgacgaagaagaaccattcacaaggatgatggtgtttgagtatgctccgaatggaaacttatttgagcatctgcatgttaaggaagttgaacctcttgactggagcgcaaggatgagggttattatgggcacggcttattgtcttcagtatatgcaccatgatctaaatccaccagtagctcattccaacctcaattcaattgctatattattaacagatgactttgctgctaagatatcagagatctcttttggcaagcatgcaaaaaccaacacaactggagatgaatcacagaaatcttctgagttgccaccacaggctgatcctgaaactgatgtctataactttggagtattgttgcttgaaatcatttctgggaaactaccttactctgaagaacaaggccaccttgccaactgggctgctgagcacttgaatgataagcgaagcatcggctatctgatcgatcccacgctgcagtccttcaaagaggaagaacttgaggtcatctgtgaggtgatcaaagattgtcttcaatctgatccaaggttaagacctacaatgaaggacataactcccagattgagggaagttcttcatatatcacccgagcaagctgtcccaagactctctccactctggtgggctgaactggagatcttatcaatggaggccacttaaaaagttctatctaactctcttctgtgtattctaagtcaagtctctctctaacctttaccgtgctggaagagtacagctttctgataatgctatatggtatttgccactcaaattctttaattctatctgttctttcgtaagtccatataatcgaaataccatagttattcttgtcccagtggaagcgtgttgtgtaattttgcaagtggggtgttgtaaattgtacttttgttgatgaattattgggatgtaaaaaagtcttgacaaataaattggtgtttctgtcccaatgaacatgcaacttctataagggtctattcaattattattaatgaagcttttaagttgt

SEQ ID NO: 1154 - DNA, 3111 bp, Glycine max var. Williams 82
ggtggggggtgatgagagagaaactgaggcaagagacaaaagagacaaaagaacccaacattgtaagatgatgaaggtggtcggagagaggtttctctgagatcctcctcttcacaggcagcaatttaactttaatctccccaccgcccccccaacctgtcaccaccaactgcattgcattgcattgcatcatcaaaccaaacattgttgatccttcagtttcaacgcacaaagggacttcttttcctgcacccttttctcccatttgcatgccccagcccacattgtttggaatcattgagaggacgaattgagctgggtatgcttttgttgagcaaaaggttgtaaggaagagattgatacacaaaatgagggaccctgaaaccaagagcttcaattgtttttgctttccattgtaatgtataagtttttcatagttagtgaattttctgctgcttcatccaaataggtggaagggtttctatgtacagaaaaaaccttccaattttgtaaatttgatatgacatatcatatagcttcctgactttaaagagatatagatattgtcgctaccaaagtggcattgccttctcatagcaatggaaagcatatgggggccatttggattatggctccgaatttatgttggattgatttctctgtggggaactcgacagtgttggtctctgaacgatgaaggattaaccttgttggaatttcggggaagaataacttctgatccttttgctgctctggcaaattggaatccaaacgattgcaacccttgcaaatggctgggtgtacgttgtgttgatagtcaagtgcaaacgctggtcctacctgatctatctttggaagggacattggctcctgagcttgggaaacttcgtcatctaaaatcccttgtactatacaagaacagtttttctggtaccattcccaaagaacttggaggtctagacaagctggagttattggatttaagggggaatgacttgactggatgtatcccagcagaaattgtcagggtgttgttgtcaaaacatttgttggtttgtgacaataaatttgaaggcagtgattctcaagagctcagattgccctctcataacaatcatttaactcctttggcaactttatctcatggcaagaatagaaagtttgcacaccgtatacaacaacaagaacaacatggtgaaaaaagtatgtgccataaaaatttcaagcaatggaacatggaagattcatttgttattccacttaagggagcactcaaaaattacctcaaagctgtcattgctgtggcactgccactgttcaagctaggaaaggctactcctcatgcctatgaagagaaatactgtaaaaatctgactagctctgatgaatcagattttggccatgatgagtcagagtttggccagaatgtaccaaatataatcaattcagtacgacgtaagttgtttgatcagtccagtaaccttgcagctgcacctttcagtggtgggcctactatagagatcagttctgttccaattacccagagcagtggagctttcccagctgtgccagacaccaataagaaacaaaatcagtcacctgcaccattgccttcatcttctaattctccacctgtgaatcaagcaagtcaacaaaattcacctaatggtgcatctggaaaattatggaagtatattattataatcgcaggtgttgctgtcttggtcattgtttttgtgatcatgctttgcatttggcgtaaacgagcagcaaaagtaataaagccttggaagacaggaataagtggacagttgcagaaagcatttataacaggggtccccaaattgaatcagggagagctggaaacagcctgtgaagatttcagcaatattattaatagttttgatgagtgcactatatacaaaggaacactatccagtggagtcgagattgctgttgattcaactattgttacttctgcccgtgattggtcaaagaacatggagacagcctatcgcaaaaagattgctgctttgtcccgtgttaaccataagaactttaccaaccttattgggtactgtgacgaagaagaaccattcacaaggatgatggtgtttgagtatgctccgaatggaaacttatttgagcatctgcatgttaaggaagttgaacctcttgactggagcgcaaggatgagggttattatgggcacggcttattgtcttcagtatatgcaccatgatctaaatccaccagtagctcattccaacctcaattcaattgctatattattaacagatgactttgctgctaagatatcagagatctcttttggcaagcatgcaaaaaccaacacaactggagatgaatcacagaaatcttctgagttgccaccacaggctgatcctgaaactgatgtctataactttggagtattgttgcttgaaatcatttctgggaaactaccttactctgaagaacaaggccaccttgccaactgggctgctgagcacttgaatgataagcgaagcatcggctatctgatcgatcccacgctgcagtccttcaaagaggaagaacttgaggtcatctgtgaggtgatcaaagattgtcttcaatctgatccaaggttaagacctacaatgaaggacataactcccagattgagggaagttcttcatatatcacccgagcaagctgtcccaagactctctccactctggtgggctgaactggagatcttatcaatggaggccacttaaaaagttctatctaactctcttctgtgtattctaagtcaagtctctctctaacctttaccgtgctggaagagtacagctttctgataatgctatatggtatttgccactcaaattctttaattctatctgttctttcgtaagtccatataatcgaaataccatagttattcttgtcccagtggaagcgtgttgtgtaattttgcaagtggggtgttgtaaattgtacttttgttgatgaattattgggatgtaaaaaagtcttgacaaataaattggtgtttctgtcccaatgaacatgcaacttctataagggtctattcaattattattaatgaagcttttaagttgt

SEQ ID NO: 1155 - DNA, 495 bp, Glycine max var. Williams 82
atgatgataaaaaaatttgcgtgtaaggtttctacttctaggatgctgatacctcagatttgtctccatttcaaatgctacatcactcccaccctgtattctcactatctcacatgcaccacattggcgtgttatcaacaacaatatcattcaaatttttcttttaccatcatcactcataatatatctccgagtgaaatgcttgctaaaaccaacgtgccccatgagaccttatctccacagaagattcaggtccaacatgttccaaaatgtgtgtccgataggttgctagagaagttctatgatgagtcagagttcgattttgattatgagcaaagtgggttgtggtctcctccagttccccgcacggtgttcttgagctcaccgggaagaatattcactgagcaagaaatgcttgaaagactcagaagcaaaaatgcaccaagacgtggcaaaagattcagagtttgtttcagtgtgttctgttgtgcctga

SEQ ID NO: 1156 - DNA, 809 bp, Glycine max var. Williams 82
atgatgataaaaaaatttgcgtgtaaggtttctacttctaggatgctgatacctcagatttgtctccatttcaaatgctacatcactcccaccctgtattctcactatctcacatgcaccacattggcgtgttatcaacaacaatatcattcaaatttttcttttaccatcatcactcataatatatctccgagtgaaatgcttgctaaaaccaacgtgccccatgagaccttatctccacagaagattcaggtccaacatgttccaaaatgtgtgtccgataggttgctagagaagttctatgatgagtcagagttcgattttgattatgagcaaagtgggttgtggtctcctccagttccccgcacggtgttcttgagctcaccgggaagaatattcactgagcaagaaatgcttgaaagactcagaagcaaaaatgcaccaagacgtggcaaaagattcagagtttgtttcagtgtgttctgttgtgcctgatactgaatgtaaacaaaagtgggtaggtttttcagcaatgtttcttgttttagaatacaaagggaattaatccaaaaatttcctatgattattttatcatattcacaggaatttacatgtatttcttttctttttctctagccaaaagtcatgtatatgtgtgaatttatacatatacatacatatatatatatatatatatatatatatatatatattatcaatttcttacccattattttctgatgcgattcatacaatacctttgggtccctttgccatctctaatgtatgttgttcatcaattgattaag

SEQ ID NO: 1157 - DNA, 675 bp, Glycine max var. Williams 82
atgggaagcgaagaagtgaagctgttgagcttttgggtgagtccatttggtaaaaggattgagtgggctttgaaactgaagggtgtagagtatgagtatatagaagaagatatcttcaacaagagtagtctccttctggagttgaacccggttcacaagaaggttccggttcttgttcatgcagaaaaatccatcatcgctgaatcattcatcatccttgaatacatagatgaaaaatggaagcaatattcattgttacctcatcatccttatcaaagagcacttgctcgcttttgggctgctactgctgaagaaatgttcaggaaggtagtatggattgctttgcgcagccctaccagcggggatgaacgcgagaaggctcttaaggaatcgagagaagtaatggagagaatagaagaagagattagggggaagaaatatttcggaggggacaatattgggtaccttgacattgcacttggatggatctcttactggcttcctgttttggaggaagttggatcaatgcagataatagatccattgaaatttccagccaccactgcatggatgactaattttctcagcaatccagtgatcaaggacaacttgcccccaagagataagatgcttgtttacctcaaagatctaagaagcaaatatatagtcttataa

SEQ ID NO: 1158 - DNA, 675 bp, Glycine max var. Williams 82
atgggaagcgaagaagtgaagctgttgagcttttttgcgagtccatttggcaaaagggttgaatgggcattgaaactgaagggtgtggagtatgagtacatagaacaagatatcttcaacaagactagtctccttctccagttgaacccggttcacaagaaggttccggttcttgttcatgcccacaaacccatcgctgagtcattcgtcatcgttgaatacgttgatgaaacatggaagcagtatccactgttgcctcgagacccttatcaaagagcacttgctcgattttgggctaatttcgctgagcaaaagcttttagatgcagcatggattggtatgtatagcagcggggatgagcagcaaaacgctgtgaaagtagccagagaagcaatagagaagatagaagaagagattaaggggaagaaatattttggaggggagaatataggataccttgacattgcacttggatggatctcttactggcttcctatttgggaggaagttggatcgatacagataattgacccattgaaatttccagccatcactgcatggatcaccaattttcttagccatcctgtgatcaaggacaacttgcccccaagagacaagatgcttgtttacttccacagtcgcagaactgcgctttcttcaacttttcagggctga

SEQ ID NO: 1159 - DNA, 1785 bp, Glycine max var. Williams 82
atgcagcgggaggagagagcagatgagctggttgttcatggaaaagttgattggaaaggaagaaaagctttgaaacacaaacatggggggatgaaagtttcattgctcgtacttgcggcatttggtatggagaacttagcaactctgtctctagcagtgaactttgtgtcatacttcactggtattatgcattatgaactagcagatgcagctaacatggtcaccaattacatgggtgttaattacatgctctccattgtggtggccgttcttgctgacacttggattggtagatacaaatccgttgttatttctggaatcgtagagtctttgggactggcattgcttacgatacaggcacgcgtgggtagcctgacaccacccatttgcgacctgtacaatgtgagagatgcacattgtgaaaagcttagtgggaagcaagaagcatttctcttcattggcctctacttgttggcctttggcagtgcaggtttgaaggcttccctgccatcacatggtgctgatcaatttgatgaaagagaccccaaagaagcaatgcaaatgtcaagcttcttcaacggtctctttttagcactttgcgttggtggtgcagtcagcttaacatttaatgtgtatatacaagacaataatggatggatctggggctttgggatctccaccgttgctattgttttgggcaccattatctttgcctctggattgccactataccgaattcatgctgcacattcaacaaacggaatcttggagatcattcaggtctatgttgctgcaattcgcaacagaaaccttccccttcctgccaatcctatccaactatatgagattcaacaggacaaagaagccgcagtggaaatagagtatcaacctcatagagatattttcaggtttttggacaaagcagctatcaaaagtagatctgatgagcaacctgagaaccaagagactccaaacccgtggaaactatgcagagttacccaagtagaaaatgctaaaatcattctaagcatgctcccaatattctgctgctcaatcatcatgaccctttgcttagcacaacttcaaaccttctctattcaacaaggctccaccatgaacaccaggatcgccaagcattttaacatcccacctgcatctataccaatcatcccagttgccttcttaatcgttttcgtccctttctatgatcgcatttgtgttccttttctacgtaaattcaccggtattcccaccggcattacacacttgcaacgcataggagtaggcctgatactctcttccatctccatggcagttgcagcaatcatagaggtcaaaagaaaaggagttgctagagacaacaacatgcttaatgccttgccagtattacagcccttgccaattagtatattctggatttcttttcagtattttgtatttggcatagctgacatgtttacctatgttgggcttcttgagtttttctattcagaggcaccaaaaagccttaaatcaacagcaacatgctttctctggtgtgctatggcccttggctattttctaagttccataatggttaaaattgtgaatagtgcaaccaagaatattactgcaagtggaggttggttacaagggaacaatatcaacagaaaccatctgaacttgttctacttactcctttccatattgagcttgatcaacttctttgtctatttgttcgtttcaaagaggtacaagtacaggcctcaacaccctgcagttactggtggcaattcagaggagtga

SEQ ID NO: 1160 - DNA, 1785 bp, Glycine max var. Williams 82; identical to SEQ ID NO: 1159

SEQ ID NO: 1161 - DNA, 444 bp, Glycine max var. Williams 82
atggccaccacagcagctctatccggaaccatggtgagcacctccttcatgaggaggcaacctatgaccaccacaagcctaaagacattccccaacgttggtgaagctctttttggtctgaaaagtggacgaggtggtcgtgtcacttgcatggcctcgtacaaggtgaagctcataaccccagaaggagaagtggagtttgaatgcccagatgatgttttcattgttgacaaggcagaggacgaaggcattgaacttccctactcgtgcagggccggttcttgcgtttcctgtgttggcaaaattgtggaaggtaacgtggaccagtcagatggtagcttccttgatgatgagcaaatagatagtggctgggttctcacctgtgttgctcaacctaggtcagacgttgtcattgagacacacaaggagggagagatcgaatga

SEQ ID NO: 1162 - DNA, 564 bp, Glycine max var. Williams 82
atggcatcaacaatatcagcaatggccatgatcaacgccaaatgcgtcaacccaaagttccccaatcccaccaagctcgcaccatcaaaaccctcccttcagatcaaccttccaaagggcctcatagcctcacccgaaagcactaaactttcccccgcgacagcaatcgcaggagcaatattcacaaccctcggaacctgcgacgccgcattcgctgttcaacaaatagccgacatagcagaaggcgacaaccgcggactggcactgttgctgcccataatcccagcaatagggtgggttctgttcaacattctgcagccggcgctgaaccagctgaaccgaatgcgcagcaccaaaggcgtgatcattggcttggggcttggcggcttggctgggttggcggctgcgccgcatgcgtgggcggcggcttctgaagctgcggctgctgcgagcgacaacaggggacagcttctgctgtttgtggttacgccggctattgcttgggtgctttacaacatcttgcagcctgctctcaaccagctcaacaggatgagatcacagtga

SEQ ID NO: 1163 - DNA, 1923 bp, Glycine max var. Williams 82
atgatgaagtgtttctcggtgtccttatcctctttatgggttctccttgctctctgttctctgagtgtgttatcgcaaaatatatctcagagtggcctacagcaagctagcctcccaccaagaggttggaattcctatgattccttttgctggacgatttctgaagaagaattcttacaaagtgctgaaatagtttctcaacgtctcaaggctcatggatatcagtttgtcgtggtggattacctctggtataggaagaaagtcacgggtgcttatcctgattctcttggatttgacgtgattgatgaatggggaaggatgctccctgacccaggaaggtggccttcttccataggcgggaagggattcagtgatgtagctaatagagtacatagtttaggtttgaagtttgggattcatgttatgagagggataagcacacaagctgtcaatgcaaacacccctatcctagatacaacaaagggaggtgcttatcaagaatctggtcgagtgtggcgtgcaaaagacatagcaatgccagaaagggcttgtgcatggatgcctcacggtttcatgagtgtaaatacgaagttgggagctgggagagcttttttgaaatccctttatgagcagtatgctgcatggggtgttgatcttgtgaaacatgattgtgtgtttggtgatgacttggatttaaatgaaataagctatgtgtctgaggttctcagcgagcttaatcgccctattgtgtattctctatctcccggaaccagtgtgacaccagccatggccaaggatgtcagtggactagttaacatgtatagaataacaggagatgactgggatttatgggaggacgtcaaggctcattttgatgtaacaagggatttttctacagctaatatgataggaggaaaaggtttaaagggaaattcctggcctgatttggacatgctaccatttggatggctaactgatccaggatcaaatgaaggtccacacaggtttagtaaactcactctagaagaaaaaaggacacagatgactttgtggtctttggcgaagtctccccttatgtatgggggggatgtgaggaagattgatgcaaccacatatgaacttatcacaaatcctaccctgctagagattaattacttcagctcaaacaatatggagtttccttacgtcacaagctcaattaacttgaagcaccctggagggaaaaaaagaagacctaagaaaggaataaaagcatcatttacacattcattgggtttgactggctgcagtgaatcaaaggcgagtggttggtctattgaaagtcttaaccaagatcttgaaagaatctgttggaaaaatggtttagaaaacaagcatcaggccactttctgcgtacacaaaagagaacttcaattcagattagatggggtgagtatgtatccagcagactatcgagggaaacatcaattagttgcaactgacagaatgaaattttgcttggatgcttctccaaaacgaaaggttacttctagagagttcaggagaggtacattttctccatgcagatgggattcaaatcagatctgggaactgaactccaatgggaccatggtaaatagttactccggtctttgtgcaactgtagagtatgttgaagcaaatgttaattctggtgggattcgctcttggatcgcaacaggaagaacaggggaaatctatcttgctttcttcaatctaagcgaacagaagacggagatatatgcaaagacatcatatctggctaaggttcttcctgacaaaagcatcacttcatgcaagggcaaggaagtgtggagtggaacagatgtaataacgacgcaggggacgatatcaatgaacgtggaaattcatggatgtgcactatttcttctaaattgcaactag

SEQ ID NO: 1164 - DNA, 2776 bp, Glycine max var. Williams 82
gtgcccgcaatgatgaagtgtttctcggtgtccttatcctctttatgggttctccttgctctctgttctctgaggtatgcagccatggaatcttttacttctcttgctattgttttgttgattctgagtttcgcttgtgtagtcctttatgctacattttggatatttgttaagatatgcttgattggtaatttctggttaataaattggaggcttgaatccagatcctataaataaagtgttctgcttttttgttcattcacattgccattgcttgctgcttgagcttgtcaaatggactgattcacaatggtttcattactctggtggatcttgaagtgtgaacagaagtctgcctttgtgttatcgcaaaatatatctcagagtggcctacagcaagctagcctcccaccaagaggttggaattcctatgattccttttgctggacgatttctgaagaagaattcttacaaagtgctgaaatagtttctcaacgtctcaaggctcatggatatcagtttgtcgtggtggattacctctggtataggaagaaagtcacgggtgcttatcctgattctcttggatttgacgtgattgatgaatggggaaggatgctccctgacccaggaaggtggccttcttccataggcgggaagggattcagtgatgtagctaatagagtacatagtttaggtttgaagtttgggattcatgttatgagagggataagcacacaagctgtcaatgcaaacacccctatcctagatacaacaaagggaggtgcttatcaagaatctggtcgagtgtggcgtgcaaaagacatagcaatgccagaaagggcttgtgcatggatgcctcacggtttcatgagtgtaaatacgaagttgggagctgggagagcttttttgaaatccctttatgagcagtatgctgcatggggtgttgatcttgtgaaacatgattgtgtgtttggtgatgacttggatttaaatgaaataagctatgtgtctgaggttctcagcgagcttaatcgccctattgtgtattctctatctcccggaaccagtgtgacaccagccatggccaaggatgtcagtggactagttaacatgtatagaataacaggagatgactgggatttatgggaggacgtcaaggctcattttgatgtaacaagggatttttctacagctaatatgataggaggaaaaggtttaaagggaaattcctggcctgatttggacatgctaccatttggatggctaactgatccaggatcaaatgaaggtccacacaggtttagtaaactcactctagaagaaaaaaggacacagatgactttgtggtctttggcgaagtctccccttatgtatgggggggatgtgaggaagattgatgcaaccacatatgaacttatcacaaatcctaccctgctagagattaattacttcagctcaaacaatatggagtttccttacgtcacaagctcaattaacttgaagcaccctggagggaaaaaaagaagacctaagaaaggaataaaagcatcatttacacattcattgggtttgactggctgcagtgaatcaaaggcgagtggttggtctattgaaagtcttaaccaagatcttgaaagaatctgttggaaaaatggtttagaaaacaagcatcaggccactttctgcgtacacaaaagagaacttcaattcagattagatggggtgagtatgtatccagcagactatcgagggaaacatcaattagttgcaactgacagaatgaaattttgcttggatgcttctccaaaacgaaaggttacttctagagagttcaggagaggtacattttctccatgcagatgggattcaaatcagatctgggaactgaactccaatgggaccatggtaaatagttactccggtctttgtgcaactgtagagtatgttgaagcaaatgttaattctggtgggattcgctcttggatcgcaacaggaagaacaggtctctgtctactttctaacaaacacttgaatgaatttcaagagttttcttcttttctgcaactgcaaagcatcaaaattggaaaaatgctaattgcttaaataatcatgagtacataagaacttaaataacagaatttgcttaatcatgagtaccatctgactcttaaataagggtccaatcaattactataatttcatccacttcaccctctaagaggagtcaaagtcaaatcctatattaatcttatatctctattcaggggaaatctatcttgctttcttcaatctaagcgaacagaagacggagatatatgcaaagacatcatatctggctaaggttcttcctgacaaaagcatcacttcatgcaagggcaaggaagtgtggagtggaacagatgtaataacgacgcaggggacgatatcaatgaacgtggaaattcatggatgtgcactatttcttctaaattgcaactagtctggcatggcttccaattattttgaacagaaaaggaaaagaaaacagcatctcattgttgaggcttttttccccctctatttaattattactcttcccatggtgggggttaggtgaaatttgtatgtgttaatgcactgcagtgcggtacgtaactgttggatcgcaccgtgtttagacaaactacataggaaattatacttgttgtatgttacgattcttttggtaagagagaaagtgagaggaaataaattagagaaaaaaataataatacgactaattttgtttgtttgtttg

SEQ ID NO: 1165 - DNA, 1524 bp, Glycine max var. Williams 82
atggctttcgtcaattttcattgctcttccatgttcctgcacacatgttccaaaaggcagtatattgtgagtggcactcctccactcaatacaagcggatacaaatctgatttcatgttggctagtcccattagaaaagtgaaattcagtttcaaggttgataaaatgagggctgtaatatccggagaaggagatctgctatctcatcctaacaactataacagtccaagacaactagacaaactggcagaagaaccaattaaaatcagacagcaacttgatacatttgcttttggaacagtctctgatgagataaatcctactatcaatggcttctttgctgatagaaatgaatatgatctggattgtcctacacaagggttttcttctatcccagatgccattgcagatattcgtcagggaaagttaattattgttgttgatgatgaagatagagaaaacgagggagatttaataatggcagcttcaatggtgacaccaaaagcaattgcatttattgtcaagtatggaactgggatagtgtgtgtaagcatgaaagaagaagacttagagaggctgcaactcccactgatggtgacacagaaggacaatggagaaaaactttgcactgcattcacagtgacagtggatgcaaagcaaggcactacaacaggagtgtctgctcaagatagagcaacgacaatcctgaaacttgcatcaagaaattcgaggcctgatgatttcaatcgcccaggtcatatatttcccctgaagtacagagaaggaggggttcttaaaagaccaggacacacagaagcttcagttgaccttgctgtgttggctggcttggaacctgctacagttttatgtgagatagtagatgatgatggttcaatggctaggttaccaaagcttcggcaaatggcaaagaaggaaaacttgaaaatcatatccattgctgatttaataagatacaggagaaagagggagaagttggtagagtgtgcttcagctgcactgataccgatcatgtggggacctttcaaagcttattgctatcggtcatgtctggatgggattgagcatattgcgatggttaaaggtgagataggtgatgggcaggacgtacttgtgagagtacattcagaatgtctcattggtgacatttttggggcaacatgtcaatgtggaaaccaattagaacttgcattgaagcaaattgaagcagcaagtaggggtgtcttagtgtatctccgaggacatgaaggtagaggtattggcttaggccacatggtccgtggttacccctcggaagatgacaagtatgaggaattgcagttaccagttgattctaggaagttcggtattggagctcagatactacgagatcttggggttcaaacaataaggttaatgacaaaatatcctgctgagtacgacgggctcaaagcttatggcttagcaattgcaggaaaagttcctcttttgacaccactaactgggcaccgccaagagagatcatga

SEQ ID NO: 1166 - DNA, 177 bp, Glycine max var. Williams 82
atgaaatggtcaaggattgaagaagagagggaaattgaagagcttgagagagaggggatggggttgaagcacgcatggcgtggggtcggagatgagaggttgatgacgataaaaaaaaaggggggtaataataatcatcaacatccgtgcggggaaaggggagtaatttatgaataa

SEQ ID NO: 1167 - DNA, 948 bp, Glycine max var. Williams 82
atggcgacgttgaaggttcctgctcaacttccttctccagtggaagacagtgagcaattgcgaaaagcttttcaagggtggggaacgaatgaaggattgataatatcaatcctgggtcatagaaatgcagctcagcgtaagttgattcgtgaagcttatagtgcaactcatggagaagatctttttaaagatttagacaaagaactttcaagtgactttgagcgggctgtgttggtttggacattggatcctgctgagcgtgatgcctttttagctaatgaagccactaagatgttgacttcaaacaattgggtcattttggaaattgcttccactagatcttcacttgatctccttaaggcaaagcaagcatatcaagcccgtttcaaaaagtcccttgaagaagacgttgcctatcatactaaaggggacatccgcaagctattagttcctcttgtgagcatattccgttatgagggggatgaggtgaacatgacattggcaaaatctgaggctaaactgcttcacgagaagattgcagagaaggcctacaatgatgaggagctgatcaggattttgtcaacaaggagtaaagcacagttaacagcaacactaaatcagtacaacaatgagttcgggaatgccataaacaaggatctgaaaaccgatccaaaagatgaatatctgcaattattgagggcagccattaagtgcttgacttaccctgagaaatattttgcgaaagtcttgaggatggctataaacaagctgggaactgatgaaggggcccttactagagtggtgaccaccagagctgaggttgatttgcagcgaattgctgaggaataccaaagaagaaatagcattcctctggaccgcgcaatagccaatgacacttctggagactatcagagcattctccttgcactggttggacatgaggattaa

SEQ ID NO: 1168 - DNA, 2031 bp, Glycine max var. Williams 82
atgcaaacaccaaactgcgaagccgagaggcgaatccagaggctaaccctacacctaaaccccacggcgttggtcgcggcgaagcagttggagatggcaacgtgcgctcgcgggaagctgagcgtggacacgccgtccttgtctagttacatgcgagggaaacacgtggacattcaggagaaggtgttcgattacttcaacgcgaacccgcgccttcaaactcccgttgagatctccaaggacgagcatcgcgacctctgcatgaagcagttaacgggactcgtcagagaagccgggattcgacccctccgttacgtagtcgacgatcccgctaagtacttcgccattttggaagccgttggaagcgttgacatgtcgctcgggatcaagatgggggtccagtatagtctttggggtggttctgttctcaatttggggaccaagaagcataaggataagtactttgatgggattgataacttggactaccctggttgttttgctatgaccgagcttcaccatggttcaaatgtgcagggcctccaaactgttgccacctttgatataatcacagatgaatttatcattaatacaccaaatgatggtgccatcaaatggtggattggtaatgctgcagtgcacggcaagtttgccactgttttcgctaggttgaaattacctacttatgacaaaaaaggactttctgatatgggtgtccatgctttcatagttccaataagggatatgaagacccatcaaccacttcctggaattgagatacatgattgtggtcataaagtcggcctcaatggtgtggataatggagcattgagattccgctcggtaagaattcctcgagacaatcttctaaaccgttttggagatgtctcccgtgatggaaagtacacgagtagccttcctacagtaaataagcggtttgccgctactctaggggaacttgttggtggtagggtaggccttgcgtattcctcagtaagcgtcctgaaggttgctgccacaattgccatcagatattctctacttcgtcagcaatttggacctccaaaccaacctgaagtcagtattcttgactaccagtctcaacagcataagcttatgccaatgctggcttcaacttatgcttttcattttgccacgacaaatctagtggagaaatactctcaaatgaaaaaaactcatgatgatgaattagttgcagatgtccatgccctttcggcaggtctaaaggcttatgtaacatcatacactgcaaagtcactcagcatctgtagggaagcctgtggaggccatggttatgctgctgttaatcggtttggtattttgagaaacgatcatgacatttttcaaacatttgaaggagacaacacagttctgcttcaacaggttgcaggtgatcttttgaaacaatacaagggaaagttcaaaggtggaactttcgcagtgacatggaactacttgagagaatccatgaatacttatctgtcacagccaaatccggttactgctcggtgggaaggcgaagaccatttacgagatcctaaatttcaattggatgcgttcagataccgaacatctagattacttcaaagtgttgctgtacgacttcgaaagcattctaaatctcttggggattttggtgcatggaatagatgtttgaatcaccttttgacacttgcagagtcacatattgagtcagtcatccttgctaaatttattgaagccgtgcagagctgtcccgatccaagctcccaagctgctctgaagctcgtctgtgatctttatgctctggatagaatatggaatgacattggaacctaccgaaatgttgactatgtggctcccaacaaagccaaggcaatccacaagctcgcggagtatcttagtttccaagtgaggaatattgcaagggaacttgttgatgcatttgatcttccggatcacgttacacgggcccccattgccaagcggtcaggggcctactcgcagtacacacaatatgtgggattttaa

SEQ ID NO: 1169 - DNA, 1533 bp, Glycine max var. Williams 82
atgttcatcgagagtttcaaggttgagagtcctaacgtgaagtacacagagactgagattcagtccgtgtacaactatgaaaccactgaacttgttcacgagaacaagaatggcacttatcagtgggttgtcaagcccaaaactgtcaaatatgaatttaaaaccaacacccatgtccctaaactaggggtaatgcttgtggggtggggtggaaacaatggctcaaccctcaccggtggtgttattgctaaccgagagggtatttcatgggcaacaaaggacaagattcaacaagccaattactttgggtcgctgacccaggcatcagctattagagttgggtctttccaaggggaggttatatatgccccattcaagagcctgcttccaatggtaaaccctgatgatgttgtgtttgggggatgggatatcagtaacttgaacctggcagatgccatggccagggccaaggtgtttgatatcgacctgcagaaacagttgaggccttacatggaatctatggttccactccccggaatctatgaccccgatttcattgctgccaaccaaggagaccgtgccaacaacgtgatcaagggcacaaagaaagaacaagttcaacaaatcatcaaagacattaaggagtttaaggaaagcactaaggttgacaaggtggttgtcctgtggacagccaacacagagaggtacagcaacctagttgtgggactaaacgacaccatggaaaacctctttgcttccttggacaggaacgaggctgagatttccccttccaccttgtatgccattgcttgtgttatggaaaatgttcctttcatcaatggaagccctcagaacacctttgtcccagggctgattgatctggccatcaagaggaacagtttgattggaggagatgactttaagagtggtcagaccaaaatgaaatctgtgttggtggatttccttgtgggggccggcatcaagccaacatctatagtgagttacaaccatctgggcaacaatgatggcatgaatctctcagcccctcaaaccttccgctctaaggaaatctccaagagcaatgttgttgacgatatggtcaacagcaacgccatcctctatgagcccggtgaacatccagaccatgtggttgtcattaagtacgtgccttatgtaggggacagcaagagggccatggatgagtacacttctgagatattcatgggtggaaagaacacaattgtgttgcacaacacatgtgaggattcactgttagctgctcctattatcttggacttggtccttcttgctgagctcagcactcgaatcgagtttaaagctgaaaatgagggaaaattccactcattccacccagttgcgaccatccttagttacctgaccaaggcccctctggttccaccgggtacaccagtggtgaatgcgttgtcaaagcagcgagctatgctggaaaacatcctgagggcttgtgttggattagctcctgagaacaacatgatcctagagtacaagtga

SEQ ID NO: 1170 - DNA, 462 bp, Glycine max var. Williams 82
atgggagttggaggtacattggagtacttgtctgatctaatgggcagtggccaccaccaccacaagaagaagaagaagcagttccaaaccgtggagctaaaggtgagaatggattgtgatggttgtgagcttaaggtaaaaaacgctctctcttcactaagtggggtgaaatctgtggagataaaccgaaaacagcagaaagttacagtaactgggtatgttgaaccaaacaaggtgctgaagaaggccaaatcaacagggaagaaggctgagatttggccctatgtgccttacaacttggtggttcatccatatgcagttccttcttatgacaagaaggctcctcctggttatgtgaggagagtggaggcccctgctcacactggaaccatcacaagatatgaagacccttacatcaccatgttcagtgatgacaacccaaatgcatgctctatcatgtag

SEQ ID NO: 1171 - DNA, 678 bp, Glycine max var. Williams 82
atgacagggaagagaaaccaaattacaacaagtcctgtgggaagtccaacatctggtaacatctcagacagctcctcctcaaaagaacaagacaggttcctccctatagccaatgttagccgaatcatgaaaagggcactcccagccaatgccaaaatctcaaaggaagccaaggaaacagttcaagagtgtgtgtctgagttcataagcttcatcactggtgaggcctcagacaagtgccagagggaaaagaggaagacaatcaatggtgatgatcttctttgggccatgacaacactaggatttgagaactatgttggacccttgaagttctacctgaacaactacagggaaactgagggagaaaagagttctatggcaaaacaagaagaacactctccaactcatcaaaccaatattgatggggtggtggttgaaatcaacaagttgcatcattctgtggcagcaaccaacaaagctgcagacttcaacactttcagtggtggtggcttctattctgtggggcctcaagtggctgctccaaagagcttcactgagattggagggatcaatggctatagagaaagttccattgctcaaagtgcggtcagtggtgatcatgatgcaagtggcaatagaatgatgccacccaacctacgttatagggttgaatggtag

SEQ ID NO: 1172 - DNA, 831 bp, Glycine max var. Williams 82
atggtcactaagctagttcagccaccaatgacagattcccatgtgagtcctcttatttgtagaaccatgaatgccatgaaactccaaaattttgttccatctagaaatcattcaagaataaacacttcaagatttggtgagagaccattatggtttagacccattacaatcattaaagttgcagaacacaatcctggctcaggcttagctgagcttgaaacacttgctcagaagaaaagagagctttgccaggcggtggaagagtggcaaaaaaacatgtttcaaggaatcaacaggggaatttttggaatcccagctaccaagaaatctgaaattgaaagattggtgaagcagatagaatctctgaatccaactccatgcccaactctagaactggagaaggtggctgggtgctggaggcttgtttacagtacgatctcaattttgggatcaaagaggaccaaattaggcctcagagacttcatctcattggatgatttttttcagacgattgacatatccaagagcaaagcagttaatgtgataaagttcagtgcaatgggattgagtttgttgtctggacagcttaatattgaagcctctttcaggattgcttcctcaacaagggttgacattaatttcgaaaactcaacgatcactcctgaccggttgatgaatgtatttcggaaaaattatgatcttttgttgggcatcttcaatccagagggatggctggaaatcacatatgttgatgataccttgagaataggaagggacgacaaaagcaatatctttgtgctggaaagatttgatgatagtaataacacgtag

SEQ ID NO: 1173 - DNA, 315 bp, Glycine max var. Williams 82
atggaggcacccattatgttaccccttgaaaggacttcgtcaattgaaagagagcccaggactcttaatatcaaccaaatccaatccgctagggagttagcaatatatatattgaacacaaagaccatagaagaagcgtccagaattttcacggaggggttgcagccagtggttagtgctgcttgctgcatgagatccggcacaacaatggacatggatttgggtgaagaacttgaagtgttgaactccaaagacgcaacaacacaagtagccccagcagcagcattcagagacatagcatctgcacctttctag

SEQ ID NO: 1174 - DNA, 1125 bp, Glycine max var. Williams 82
atgaacgaatctcaaaacgccattccccatttatttagatgccccatcagtttagacttgttggaagatcctgtgactttatgcactggccaaacctatgacagatcaaacatagaaaaatggcttgctctgggtaacctcacgtgtcctgtcacaatgcaaaagcttcatgatccatccattgttcccaaccacactcttcgccacttgatcgatcaatggcttcaactgtgtcaccaattcgaccctgctaaccctgaagcttcaactattgactccttagcttctctgaaaagcaacattgaatcccatgaaagcagcttagaaaacaagttccaagcacttgggaaaatcagtctcttatctgatgagtattgttcctttaacaaatcatgcttcttccaattggatttcctaccacagcttttggaactagtttttggaactcaagtgtcaccagaaattgacatgaacttcatagagctagcactttgttgcattaaaaaattgctgccacttggtagtttggagcctctaaatatgatcaaagatgggtctaaattaaccacgtttgtgctactatttgaaaagggtactaactcggttaagactagcttgtgccgtgttatagagtcatcatcatcatcctctgagacagaagatttatgttctactcttggaaactctcacaaactggtgcacgagattgttcaagttgttaaccaaaattacgaggtttctggggatgcaattaaagccattttggtgagaggaggagcaatagaagaaattatgagatacattacatcagaaagaagaaacatggcaccagtggcaatgagaataatagagaaagttatgtggctgaaaagtgctaaagaggcattggtaaaacaccctaatggtgttcaaactatggtgaatatggttttcagggtatctgatcaagaatgcagtgagagtgctgttgaagtgcttttaactgtttgtggtgaatttgagcgtgcaagagaagaagccattgagagtggagttttgactcggttgctcttgcttctgcagagtcagtgtagtaacccaacaaaatcaaaggcaagaatgctgcttaaattgctaagatcctag

SEQ ID NO: 1175 - DNA, 1950 bp, Glycine max var. Williams 82
atgatgcaaggctgtgaggttgatgccattggcataaactacacgatccacacacacaaatcggagcacccttttaaaatcttcagcaacaaatctgcacatcttgacactgaacaagatggtaaagagccagaagaggaagcagaagttgaacaaagttgcagtggagtaaggcatgtgctgaagaatgtgagtttccaagccaagccatgggagatcctagcaattgttgggccaagtggagctggcaaatcatcactgcttgagattcttgctggtaaacacagccctcaaagtggaactgtgtttctgaaccacaagcctgtagacaaagctcagttcaggaagctttcagggtatgttacacaaaaggacactttgtttcctttacttacagttgaagaaaccctcatgtttagtgcaaagctgaggctgaagctttctcaagagcaactttgctccagggtcaagtcactgattcaggagcttggacttgacaatgttgctggcactagaattggtgatgatagggtccgaggcatatctggtggtgagaggcgcagagtctccattggtgttgaagtcattcatgatccaaaagtgctgattcttgatgaaccaacttcagggcttgacagtacttcagctttgcaaataattgacatgcttaaggtcatggctgacacaagagggagaaccataatccttagtattcaccaacccgggttcagaatagtgaagctgttcaattcattgttgctgttggccaatggaagtgttttgcaccacggaacagctgatttgcttagtgtgaatctaaggctgatgggtctggagcttcctcttcatgtcaatgtagttgaatttgccattgagtccattgataccattcagcagcaacagaaatgtgtgccagttcaggtagaaactccaaggcaactgccagggacaatacaacagaagaaaggtggtgatggtgaagcaggtgagggtaggaatggtaagctcactttgcaacagctctttcagcaatccaaggtaattgatgaacaaaccatgtatgctggaatggatttcactagtgagtttgctaattctagattgagagaaactatgattctcagtcataggttctccatgaacatattccgtacaaaagagctatttgcatgcaggacagttcagatgctggtttctgggctggttgtggggtccatcttttgtaaccttaaggatgatctagagggagcttttgaaagggtgggtctatttgctttcatattaacgtttttattgtcaagcagcatagaagctctaccaatttttctgcaagaaagggagattctaatgaaggagacatcttgtggaagctatcgtgtgtcatcctatgctattgcaaatggcctagtttacttgccatttcttctcatcctagccattttgttctcaatgcccttgtactggcttgtagggctcaaccggaacttcttggcttttttgcactttctgttgctgatatggctgattctttacacggccaattcagttgtggtgtgtttcagtgctctggtgcctaattttattgttgggaactcagtgattgctggtgttatagggtcattcttcttattctctggatacttcatatcaaaacaggaaattccaaattactggattttcatgcattatatatccttgtttaagtatccctttgaagggttcctgatcaatgagttctccaactcggggaagtgcttggaatacatgtttggggcatgtataaagagcggagaggatgtgcttaaagaagaagggtacgggggagagagtaatagatggaagaatgttggggtcactgtgtgcttcatcttggtttacaggttcatttcttatgttattcttagatacagatgttcccagaggggatttggcagggttgtcaccaactaa

SEQ ID NO: 1176 - DNA, 1572 bp, Glycine max var. Williams 82
atggcttccaacgaaacttcaccgtttgagtcccgcgagatgctcgcaaccttcgtctcgtccacgccgctgctgtcggagtcatggcgcctctgcagccaggccaacgccactcccttccggaccttcgtaacggagcgcgtcggcgccgccgtctacgtcgccttctccggcgtccacatggccggcgagtccgacccgaattggagaagtttgattccgttggacagcatcggcggtgttcctctgttttcgtcgcggcggagcaaggaaggggaggagccggtcatggttcacgccggcatgctcaatctcttcttctcacttttcaattctttccagaaccagatgttggaaatagtgggaagcaaagacactaaatcagttgtcatcactggacattccattggaggagccactgcctctttgtgcacactctggcttctgtcctacctccaatccatctcttcatcagtgtcagtattgtgcatcacttatggggcaccattgcttgggaacgagtccttttcccaaatcattttcaaagaaagatggggtggcaacttctgccacgtggtgtcaaagcatgacataatgccaaggttgctctttgcccctataacctctctctctactcagttaaattccctgctacagttttggcacttgtcgatgacttcaccagatatggggaagcttgcaaatcagatatctgaaaaagagaaagataagttgttcactgctgtagtagattacttggaaacggcaacacaagatggagaaacatcagtgccaattttgtttcacccttttgggagctacttttttgtctcagaagaaggagccgtgtgtgtggatagttcagctgctattataaagatgatgcacttgacgcttgcaactagttctccagctagtagtattgaggaccatctgaaatatggggattatgtcaataaaatgtctgcacaaacattgtatcagagcaactccatgcaaaagagcattcctgattcgagctatgaagcagggcttgaattggccattcagtcttctggcatagcaaaccaggaatcagctattacatccgccaaggaatgtctgaagacaacaaggagaatgggtccttcaccaaccctgaatgctgcaagcctagcactgagcttatccaaggtggtaccttatagagcgcaaatagaatggtacaagacttggtgcgaaaaacaagatgaccaaatgggttattatgactcattcaaaagcaggaactcttccagttccaaaaggggcatgaaagtcaacatcaaccgttgcaagcttgccaggttttggaacaacgttattgacatgttggaaaggggtgagctacctcatgattttgacaagagagccaagtgggtctatacttcacacttctataagctattggaagtgtctagtgatgttctctttaagaattcaagttacagtatatgggtggaggatttaagagaactgaaacaactgaaagcaaaggtgcaaaggtttcctcatcagtttactggttttctagatggggaagtagttccttag

SEQ ID NO: 1177 - DNA, 1314 bp, Glycine max var. Williams 82
atggaagatgaagtgatgagtgaagtggctgctccacctcgtcgtgttcttcttgtatcggctggtgccagccacagtgtggcacttctgagtggaaatgttgtttgttcgtggggacgaggagaggatggacagttaggccatggtgacactgatgatcgactatttcctacaaaactgagtgcattggatggccaagacataatatgtgttacttgtggagctgatcatactatggcacgttctgagtctggcagggatgtatatagttggggatggggtgactttggaaggttgggtcatggtgatcatagtgacttgctcattcctcatcccataaaagcattacagggtctaatgatacaacaaattgcctgtggggacagtcattgtttggcagttaccatggacagccaggtgctgagttggggacgcaatcaaaatggtgaacttggacttggaaccgcagaggactctcttctgccacaaaaaattcaaatttttgaggaaatacctatcaaaatggttgctgctggtgctgaacatagtgtagcaatcactaaagatgggaatttgtatggatggggctggggccgatatggaaacttgggattgggtgacagaaacgatcgattgctgcctgagaaagtgactgttgatggtgacaagatggccatggttgcttgtggctggcggcacacaatatgtgtttcatcttctggtggattatacacaaatggatggggcaaatacggccagctaggacatggggattttgaggatcatcttgtgcctcgcaaggttcaagccttgagtgataagttcatttcgcaggtatcaggtgggtggaggcatagtatggcactcacgtctagtggacaacttttgggctggggatggaataagttcggacagattggagttggtaacaattttgattgttgctctcccatgcaagtgaactttccccatgatcagaaagtacaaatgatctcatgcgggtggagacacacgattgctgttactgaacgtgagaatgtatattcttggggaagaggagcaaatggacaacttgggaatggagaaaccatagaccgcaatgttccaacaattattgaggccttcagtgttgatggatcttccggacagcacatagaatcctcaaaaccttatccatcatcagggaaatcctcgtcctccatatcagagagatatgcaattgttccagatgaaactgcctcgggatcacaacctacaacttcagaagagggaaataggcatgataccagtgtccctgaaagtgatgtcaattga

SEQ ID NO: 1178 - DNA, 1827 bp, Glycine max var. Williams 82
atgggtttgttcagaagtaagggtgtgatttataggccagtgaaggatgttaacttaggtcctgatagcactgaattctatctccaagccaatgtcaaagctccccgcatgactggaatcctggtcaagattttcacttggttcttggagtctccaatacttggacccttgctattgtatatattgaagggaaacaatcttattcataaacttattacaaatgcagacttagaagagtcacccctctatgttccctcacatcattttgaagaccacaaagaacaagaagtcaaatgcttggattctgctttaactccagaagaacaagttcaacttgcaatagagtgcttacctacatcttcagaaaaagcacataatggaacaaactcttcgttctctcgttggaccataatggattattccagagcctacagctcgggagaaataacaccactcatggttgctgaacgatttattgccgctgttaatgaatcttcaaaacctccactccgaatgggattttttattcactacagtgctgatgatatactaagacaagcaaatgaatcaactcttcggtataaaaaaggggaacctatctctgtgctagatggagttcctgttgctatcaaggatgaaatggattgtttgccatatccaactacaggaggtacaaagtggttgcacagagaaaggccttgtacagatgatgcttgctgtgttaagcgtctgagattatgtggcgccatacttgttgggaagactaatatgcatgaacttggggttggaattagtggtatcaatccacattatggggctgctagaaacccatatgataccaataagatttcaggaggttcttctagtggatctgctactgtggtgtctgcaggattgtgccctgttgcccttggtgttgacgggggaggttctgtgagggtgcctgcatctctttgtggtgtagttggtctaaaaccaacttttggccgtgtacctcattccggagtccttcctctaaactggacagttgggatggttggaatactagccggcactgttgaggatgcattgatcacttatgcagccattagtggagaaatttcatcccatcagccctctaatatgcttaccaagataaatcttccactgctgcccttgacgaagtccatatgtgacatcaagttggcaaaatatgggaagtggtttgatgattgcagtgatgatgtcatattatgctgctcccgtgccttgaggaagcttcaggatcattatggttggaagacaattgatgtcactatcccagacatagaagcaatgcgcctagcacattacttaacaattggatcagagtgttccacttggtttgattcttttggagaaaaatattttgcagaatttggatgggacgcaagggttgcacttaacatctatggtgctttcagtggcaaggagtacattaaagctcagaaactgaggaatcgacagttgcagtttcacatgaaaatatttgctgaggcagatgtcattgtgtcaccaacaacaggtgtgactgcatactcgattcaagatgatgcactaaagactggtgaacttgactacgtaaatggagctgcacttgttcggtattccatatcaggaaacttcctaggacttcctgctgtgactgtaccggttggatacgataaattgggtttgcctattgggcttcagtttataggaaggccttgggctgaagcaacactgatccacttggcatttgcaacgcaggccatatgcttagaatacagaaagccaaagatattttatgatctgttaagaaaaaattaa

SEQ ID NO: 1179 - DNA, 306 bp, Glycine max var. Williams 82
atgaaggtgaagaagggttggctcgcggttcaagtggaagaagaaggtggcggtggagggtctcaaagatttgtgatcccaatttcgtatctttatcaccctctcttcaagcaccttttggataaggcttatgaggtttatggctaccacaccgagggtcctctcaaactgccatgttcagtcgatgactttcttcatctccgatggagaatcgagaaagaatccactacccatcaccaccaccaacatcatcatcatcaccatcatcgccaacttcctcacgccttgtatttccatgcttgttaa

SEQ ID NO: 1180 - DNA, 2139 bp, Glycine max var. Williams 82
atgcaagagaccctcctcactctccctctctcccaccacgaagacatccacattcgcgccaagaagaagaaaccgcaacagcatcatcacaaaccgggaagcgacaacagccaccccactcgcgtatcgcggcgcgtgagcccggcggtgtctccgtcctccggcggcgagaagtccctcccgaacggcgacatctacagcggcgccctgtcggggaacgcgccgcacggcaccggcaagtacctctggtccgatgggtgcatgtacgagggcgagtggcggaagggcaaggcttgcggcaaagggagattctcctggccctctggtgccacctacgagggcgaattcaagtcgggtcgaatagacgggttcggatccttcattggcgtcgacggcgacatgtacagaggctcctgggtcgccgaccgaaagcacggcttcggcgagaaaagatacggtaacggtgacgtgtacgaaggttggtggaggtgcaacctgcaagagggtgaagggaggtacacgtggcggaacgggaacgagtacgtcggggagtggaggggtggtgttatttcggggaagggggttctggtttgggcgaatgggaaccgttacgaagggtattgggagaatggcgtccctgtgggtaagggtgttttcacatggtgtgacgggagcacgtgcgccgggaactgggggaaggagtttgtggaagaggcacgtgaggagaagatgaagaggtcttcggtggatggctgtaagagtgtgagttttcccaggatttgcatttgggagctcgacggtgaagctggggacataacttgtgacattgttcacaatgcggaggcttctatgttttacagggatggtacttctactactactactggtgaatctgagaatggtggagataataagagtctttgttggtctcttgatggtactgccggtggggatgttaagaagcctggtcaaactgtgtccagagggcacaagaattatgatctcatccttaatcttcaactgggtattaggtacactgttgtcaagcatgcttctattgtgagagagcttaggccaggggattttgatcctaaggagaagttctggacgaggttcccaccggaagggtctaagtttacaccccagcatcattcagtggacttcaggtggaaagactattgtcccatggtgttcagacatctaagggaattatttgccatagatcctgcggattacatgcttgctatttgtggaagtgacacacttagggagatgtcttctccgggcaaaagtggaagcatcttttatctcactcaagacgaccgcttcataattaagaccgtcaagaagtctgaagtcaaggtgctcataaggatgcttccaagttactaccaacatgtttgtcagtacaagaactctttggtgacggcattcctgggcgtgcattgtgtcaaacctgttggaggtcaaaagacccggtttattgtaatgggcaatgtgttttgctcggagtaccggatccacaagaggtttgacctcaaaggttcttctcatggtcgaacaacggataagccaagggaggagattgatgagaataccactctcaaagaccttgatcttaattttgtctttcgcctcgaacagtcttggtttcaagagcttatatggcaacttgatagagactgcgagttcctggaggcagagggtatcatggattacagtcttctaattggcctgcattttcgtgatgattgctcagttgatgaaatgaaaagttcaccacgcagttcacattcaggcaagagagacatgcttgatgatgagatgctcacatgccggggacctctaattcggttgggaatgaacatgcctgccagagctgagagtgtgtgcaagactggattggatcaccaaacaattagtggaagtatcaattcagagagtaatagccaaatctctgatgtaatcctctactttggaatcattgacattctccaagactatgatattagtaaaaagattgaacatgcatacaagtcactacaagtggactccgcctctatctcagctgttgatcccaagctatactctaaaaggtttagggatttcattcacagaatctttgtagaggataaatga

SEQ ID NO: 1181 - DNA, 1281 bp, Glycine max var. Williams 82
atgacatctgcaatggttcgtaggaacatcgccacccactactccaagtttgcttcttcttggtctttgttgtctcgccattcctcaatcctcaaccctctctctgtgtctttttcttcatttcatagccaaggtgttggtggtgatgcattgccatcttacatgcgtggagctgtgtattgggaacccaacaagcctctcaccatcgaggaatttaacatgcctcgccccaaggccggtgaagttctcatcaaaaccaaagcctgtggagtatgccactctgatctacatgttatgaaaggtgaaattccgttttccagtccttgtgttgtggggcatgagattaccggtgaggttgttgaacatggagcactcactgacagcaaaaccatagaaaggcttccagttggatctcgagttgttggggccttcatcatgccttgtggcaactgctcctactgttcaaagggccatgatgatctatgtgaagctttctttgcctataaccgggcaaaaggaaccctctatgatggtgaaactcgacttttttttcgaaacagtggaaaaccagcattcatgtatagtatgggagggcttgctgaatactgcgttgtgccagcaaatggagtgtctgtattaccagactcattgccatatacagagtctgcaattctaggatgtgctgtttttactgcttacggcgctatggctcatgcagctcaagtgcgtcctggtgattctgttgctgttattggaactggaggtgttggttctagttgtttacagatagctagagcctttggtgcctcagatataattgctgtggatgtacgggatgaaaagctacagaaagcaaagacatttggtgctactcacactgtaaattcagcaaaggaagatcccattgaaaagatacttgaaattactggtggaaagggtgttgatgttgctgtggaagccttggggaaaccacagacatttgctcagtgcacacaaagtgtgaaggatggggggaaagctgtgatgattggactggcacaagctggttctttaggagaggtggatataaatcggcttgttcgccgaaagatacaagttattggctcatatggaggcagagcgaggcaagatcttcctaagttaattagactggcagaaacaggaatcttcaatcttggccatgctgtttctagaacatacacctttgacgaggcaggaaaagcattccaagatctcaatgaaggaaaaattgtcggtcgagctgtgatcgagataatatag

SEQ ID NO: 1182 - DNA, 1620 bp, Glycine max var. Williams 82
atggccgaggaagctccaaaccagacaaccacaccaccacctcctcaagagtcagtggcgcaagtggaggaagtggtagtaaccgatgttccacagccaccagaaaaaacaacaaccactgttccagttgaagaaaccgtcactctcgagactcacctctccaaacccaataatgctgacgacaacgacaacatcatccctgaattcaaggaagaaagcaccaaactctctgaactcccagaaaacgaaaacaaggcactccaagacctcaagaagctcgttcaagacgctctcaacaaccaccacttctcttccaaagaagataataagaacccaccaccacaaactgctgctcacaaggaagaagttgtaactgaaactaaaactgatgctgccccagcaaaaaccgaagaggagcaagctgaaacaaaggaggaagaggaaaagaaggaggaagtgaaagaaacgaatgaagaagctgcggtggatgatgatggagcaaaaactgtggaggccattgaagagaccgttgttgctgtctcttctaccgttcagcctcaagctgaagagaaagcttcatcgccacttccacctgaagaggtttccatttgggggataccgctgcttgcagatgagaggagcgatgtgattctgctgaagtttctgcgcgcgagggagttcagggtgaaggaggcattcaccatgctgaagaacacgatccagtggaggaaggagtttgggatggaggagttgatggaggagaagctcggggatgagttggagaaggtggtgttcatgcatggctttgacaaggagggtcaccctgtgtgttacaacatctatggggagttccagaacaaggagttgtacaagaagactttttctgatgaggagaagagggagaagttcctgaggtggagaattcagttcctggagaagagtataaggaagctggatttcaaccctggtggcatatgcaccattgttcatgttaatgacctcaagaattcccctggacttgccaagtgggaacttagacaagccaccaaacatgccctacaattgcttcaagacaattaccctgaatttgttgccaaacaggtgtttattaatgtgccatggtggtacctggcagtgaataggatgataagcccttttcttactcagaggaccaaaagcaagtttgtctttgctgggccttccaaatcaacggaaacccttttgagatacatagctccggagcagcttcccgtgaagtacggtggactaagcaaagatggggagttcggaaatatcgatgctgtcacagaaatcacagtgaggccggcagcaaaacattcggtggaattttcagttactgagaactgcttactctcttgggagcttagagtaataggttgggaagtaacttatggggcagaatttgtgccaagctcagaaggaagctacacagtaattgtccagaaggctagaaaggttgcttcatcagaagaaccagtgctttgcaacagttttaaggttggtgaacctgggaaagttgttctcaccattgacaacacaagctctaagaagaagaagctcttgtatcgcttgaagaccaagccttccccttctgactaa

SEQ ID NO: 1183 - DNA, 1122 bp, Glycine max var. Williams 82
atggcacaagattcagagaaaatttgtgaaggtgcttcggagtctccaacgaccccagttggaacacaagcaccagcaccagcaccagcaccagcaccaccagagagtgaacccaaaagcacttcaactcaaagaatcaaagccacaaggcaccctagatggacaaggcaagaaacacttgttctgatagagtccaagaaaatggtggaaaatggagaacaagtttgccgattcagatcagcatcagggtgcgttcaaaccgatccgaaatgggacatggtgtcatcactgtgtcagcagagaggggtgaagagaggggctgttcagtgcaggaaaaggtggggcaatcttctcactgatttcaggaagatcaagaagtgggaatctggtgtaaaagaggtggagagtgagtcgttttggataatgagaaatgatgtgaggaaggagaagaagttgcccgggttctttgattctgtggtgtacaatgttttggatggaggggtgtgcaccactgttgcatttcccttgacactggttaagatggtgccaaagggtgagaatggtgttgttgttgagggagtgtctcatcatcaggaacagtgtaaggagaacgaggaggaagaggaggaggaggaggaggaggaggaggaagatgaggcgattgttgatgctgagaaaatgggttggagcactgaggaggaaaacatggagactaacatcaatggttttcttaaaacaccaacaggtcttcttattaaggaaaaaggtattgcagggaggctcaagaggacacccatactcacattgcctactccagagaaactacagcagcagccatcttaccaagggaactacgatcctggttttcagaaggaacctatgttccaagagggatacaagagaaagaggttaccgttggatagtagtgaggactgcacagatttcaacagcaacattaccaatctactaaggaggaacagtgacatgctaaaagcccatcttggggctcagaacataaattaccaattggccagggaccagcagaaacaacaaactgatattatagttgcagcccttggcaagctcacagatgccctcacaaaaattgctgacaagctgtaa

SEQ ID NO: 1184 - DNA, 561 bp, Glycine max var. Williams 82
atggcctctgtttcagccacttctctcaggttccaaccctttctcaagttgtctacaaggactactacccagagaaatcaattcaaatttccaaatattaatacaagtgagaaaaaatttagaaggtgtagtgaaatgtatcatgatttggagggtcggtccaatggttggaaaagggtgacgaaagaagggagggatcaggggtgttacaaaacttcaagtttgggggcagtttctgtgggatggaataggagaacctttccctctttgagatcctcccgtttacgcatttgtgcagtcaaggcacaaccggagacagtgcagaaggtctgcgatattgtgaggaaacaacttgctctgcctgctgaatctgagcttaccccagacaccaaattttcagcacttggtgctgattcccttgacacggtggaaatagtgatgggtttagaggaagagtttggcataactgttgaggaggatggctctcaaaacatctcaaccgttcaagaagcagctgatttaatagagaaactgattcaagacaaaagtggagctagttag

SEQ ID NO: 1185 - DNA, 1668 bp, Glycine max var. Williams 82
atgggttgcgcgctcggaaagccggcggacgccggtgaccgtcgccggcatagcactgcgactaccagcggcggccataatcccgctaaggttcgggagaagcagaagcctctacacgccggcgaactttccggcgttataccggcaccagagcgccggagacctcgacttgactcattcactgcgagccaccaagggtggcctccgtggctaatggccgtcgccggcgacgccatccgagattggactcctcgtcgtgccaacacgttcgagaaacttgctaagattgggcaagggacttatagcaatgtgtacaaagcaaaagaccttgtgagtgggaagatagtggctttgaagaaggttagatttgataatgtggaggcagagagtgtgaagttcatggctagagagattcttgttttgaggaggcttgatcaccctaatgttgtgaagcttgaggggttggttacttccagaatatcatcgagtctttacttggtatttgagtacatggagcatgatcttgctggtctttcagctgctgttggtgtcaaattctctgagccacaggtcaaatgctatatgaagcaattgctatctggccttgagcattgccacagcagaggtgttttgcaccgtgatattaagggttccaatctgcttattgacaatgaaggaatacttaaaattgcagattttggactggcaactttctttgatcctaagaaaaagcatcccatgactagtagagtcgtgaccctttggtaccgtccccctgagcttcttctggggtctacctcctatggtgttggcgttgacctttggagtgctggctgcattttggcagaactacttgctggaaagccaaccatgcctggccgaacagaggttgagcagctgcacaaaatatttaagttatgtggctctccatctgatgaatactggaagaaatatagattgccaaatgctacactctataagcctcagcaaccatataaaagaaacattttagaaacattcaaggattttccatcttcttcattacctctgattgaaactcttcttgcaatagatcctgatgatcgtggcactacctcggctgctctaaatagtgaattctttaccactgagccctatgcttgtgaaccatctaatttaccaaagtatcctcccaccaaagaattggatataaaactgagagatgaagaagcaagaaggcagaaagctctaagtggaaaaactaatgccgttgatggtgccagaagggttagagtacgcgagcgaggtttggccattccaggccctgaagccaatgtagagatccaaaataacgtagataggtggagagttgtgacccatgcaaatgcaaaaagtaagagtgagaaatttccacctcctcatcaggatggagctgttggatatccgctggatgattcaaacaaaagagctgtttcatttggagccactgaaacttcctctgcctctaccatatttgattcaaaatcttggggatcggttacaagtcatgatgctgcaagagacaaagggaggaaaactagtaaagcagattcccagatggcatcatcttggaaatttatgcgttcattcaagctatcagcaattggccattcatttgatttattatttagaagcaattcaagcaaataa

SEQ ID NO: 1186 - DNA, 972 bp, Glycine max var. Williams 82
atgattgaaattaacaagctactgaactttgcattgcccccattatcactaattgtcatcttcatcttcacgccacctttgctcttagtgaagctgcttatgtgtgttaaaaagtttctatacaccgaaaacgtggcagggaaagtagtattaatcactggagcagcctcagggattggcgagcaagtagcatatgaatatgctaggcgcggagcaaagctgtctctggttgacattagaaaggacaaacttgtagcagtggctgataaggcacgatctttgggtagccctgatgttaccatcattggtgcagatgtatccaaggtccaagactgtaaccgctttgttgatgaaacggtgaaccactttggaagactggaccatctggtaaataacgctggaattagtcgtaagtctgtaggggtggaggattggcttgatgtttccgaattcactccgattatggacattaacttttggggagcagtttatggcactttatatgcaatcccacatctcaaaataaacaagggtaggatcatagtgattgcttcaggttgcggatggttcccactaccaaggataagtatctataatgcgagcaaggcagcggtaataaacttctttgagactctgagaatggaacttggttgggatattggcataactatcgccacacccggttttgtcaaaacggaccttacattgagggcaatggaatttgagcctacggtgggaagaattccaatggggtcagcatgtgaatgtgctatagccattgtggacagtgcatgcaggggagatatgtacgtcacaaatccatcgtgggtcaaagtgttgcttccttggaagttgctttgtcctgaacttgtggactgggcctgttgcttggtctttggggtttctcaaaactcgtctagcatgaaaggcaatctgcatgtgtccaggatcccagagcttaagttagaataa

SEQ ID NO: 1187 - DNA, 927 bp, Glycine max var. Williams 82
atgggcgaggaagagaaaaaattagaagaaagcaaagaggagaacaaaaaagcagaggaaccaaagaaggaagaagagaagaaagaggagagaaaaactgaggaatcaaaagatgacaaagaatctaaggagaaagttgcgccgtcagaaatcgtgcttaaagtgttcatgcattgtgaagggtgtgctcgcaaggttcgtcgctccctcaaaggattcccaggggtcgaagatatactcacagattgcaagtctcacaaggtggttgtgaaaggagaaaaagcggatccgctgaaggttctagagagactacagaagaaaagccatagaaaggttgaacttctctctccgatcccaaaaccacccacggaagaggagaaaaaaccccaagaggaacaagagaagcccaaaccagaggagaagaaagaagagcctcgggttatcacagttgttctgaaagttcacatgcattgcgaagcttgcgcccaggaaatcaagagacgcatcgagaaaatgaaaggggttgaatcagcggaagcggatctgaagaagtcggaggtaagcgtgaagggggtgttcgagacagcgaagctggtggagcacgtgtacaagaggacagggaagcatgcagtgatagtgaagcaagaggcagagaagaaagaagaagagaagaaagcagaggaagaagttgagaagaaaatggagaaagggagtggcgagggagaagaaaacaaggagaaaaaagaaggaggagagggtgaagccaaagcagaagaggcatccacagtgttggaggtgaaaaagagtgagtattattacaacccaccaccaaggtatggtggcatggagttctatgcatactctggaccagcgtaccctcctcagatcttcagtgatgagaaccccaatgcctgctctgtcatgtaa

SEQ ID NO: 1188 - DNA, 1956 bp, Glycine max var. Williams 82
ttcactttatggaaacacatattctcacatttagctaattgattcattacatggagttaataattaatgcagcactcactaggcaactgctaaatgctttcaaatgattcatttgaaattttacccaaatttgtgatggcttcgtgctttgatatgggagagagaactgtgaaatcattgcggctttcaaaggcattgacagttcctgaaacaacaaccgtctatgaagcttgccgtaggatggctgctcgcaaagttgatgctctattactaactgattctaatgctttgctctgtggaatcctcacagacaaggatatagcaacaagagttattgctcgtgaagttaatctcgaagaaacacctgtttccaaggttatgacaaggaatccagtatttgtcctttctgatactcgtgctgtggaagccctccaaaagatggtgcaagggaggttcagacatttacctgtggtggagaatggagaagtagttgccatacttgacatagcaaagtgtttgtatgatgccattgcccgtatggaaagggcagctgagaaaggaaaggcaattgcggcagcagttgaaggtatcgaaaaacactggggaacatctactcctgcctccaattcgacattcatggagactcttcgcgagcagatatttaagccatctttgtctacaattattcctgagaattcaaaggttgtaacagtttcaccaacagactcggttttgactacaacaaagaagatgcttgaacttcgtgcaagttcagctgttgtgacgattgatgacaaaccttgtggtattcttacttcaaaggatatcttgatgcgggtaatagcacagagtcttcctccatcgtcaactcttgttgagaaggtcatgactccaaatccagaatgtggaacaattgatacaccaatagtcgatgcacttcacactatgcatgacggaaaatttttgcatcttcctgtggttaatagaggtggcattgttgttgctacggttgatgtgattcatatcacgcatgcggctgtggcgacagctagtcaggtcggaaatacgcccaattttaacaacgaagctgccaactccatgatacaaaaattttgggattcggccatggccttagctccaaatgaggaggatgaggattcacaaagcgaggcttccttgaaaatgatttccgagggaggagaaacagggagatccatttcttatcttacgtcaagcatgcagaacgtattttcgttcaaattacaagacaggaagggcagattgcataggttcacatgcgatactcggagcttggcagaggttataacttccatcgttcagagagtcggtgatgatattgaccccatgaacctgccccaaattttgtatgaagatgaagacaatgataaagttgtactggcttcggacagtgatcttgctgcagctgtggaccacgcgaagacggctggtttgaagggattgagattgcatttagactactctggaacacatggttatggaactgattcaagttcagtaagttggaaatatgctaattcagaagcatgggcatcggcatacagtgccattgctgctggaactgcagttgttgctgccttaggtctattggcgtttgtgaggcgaagtcgatgataggaagaagctgagttgtttttggggggtagaggccaaaactgaagcctgttggaacttaggaggaggggcatacttttagcacttgccaatctgtaagttctgacattttgtatatcgacttgtattcgaatattatacgagaaaggaaggaacaacatttttattccgctgtctataaatactacttgcagcttgtaaatttgtaattcacgggtttagaagcctcatcaacacgagaattaaaaacagccatatgtatctctgctaactctatgatatgttattaataattaaatcaga

SEQ ID NO: 1189 - DNA, 669 bp, Glycine max var. Williams 82
atgactctcacaaaggccttgttctttgtgaccgctctatgctgcacctctgccgcatatgctgcaaggtttgacatcacaaaccgatgctcataccctgtttgggccgcggctgtgcctggcggtggcaggaggctgaactcgggccagtcatgggctttagacgtgcctgcaggaacgaaaggggcccgcgtttgggcccgaaccggctgcaacttcgacggctcgggccgcggtggatgccagaccggtgactgcgggggtgtcctcgactgcaaagcttacggcacgcctcccaacaccctagcggaatacgcgctgaaccagttcagcaatttggacttcttcgacatctccctcgtggacggttttaacgtgcccatggactttagtccaacctcgaatgggtgcacacgtggcataaggtgcactgcggacattaacggacagtgccctagtcagctaaagactcaaggaggctgcaacaacccttgcactgtcttcaaaaccgaccagtactgttgcaattccggtagctgtgtgcccactgattattccagattcttcaagcaaaggtgccccgatgcttatagttaccccaaggatgatccaactagcaccttcacttgtaagggtgggactaactatagggttgtcttttgcccttga

SEQ ID NO: 1190 - DNA, 264 bp, Glycine max var. Williams 82
atggcagttcgatattcaaggctctcatttctgatcttaatgattatattgatgattagccagctctcaagttgctgtgaagctggcagatggatgagtaaagaaatcaagcaaaaagaaaaaaacaccccttctcagcagttctcaatctcatggcatttctatacaaagacacaacaggtacccagcacagaggaggtccacccaatttatggagtttctctacgagatgttccagggggtccaaacccgcttcataactga

SEQ ID NO: 1191 - DNA, 2542 bp, Glycine max var. Williams 82
tgaaaacaaacaaacaaaggctaacgagtaaagaaaaagagtaatgctgatgagaaaacaatttgggggcaaccgtaaaatcttgagcttcttaaaccctttctccccaaacatgaatttcaaagattctcgccaccatccaccgctctcatcaatagtacctcattcacttagttcccttgatgttcccaattgtgattcgggttccattcacttcatttctatattctcacacaaatgagaaaaaaaaattaacaggctcttctatccagacattttcgggctatcggcggcttcttgaaggagacacagaagatttgagaatatgtctggatgcaataaatcacccaaaaatggtcaacaatcattcaaatattggcggattcaacacggaggggcatcctctgaggccgttctttcttgtgtagattattcgccatctctttccaccaatgagaacaagcaatgctatggaagttctcaaccaaagtcccctcagatactgagcacatctcagctcatctcggctataggcctgatatgggattctgccagtcgcccgctttcggttttactttcgaaggaaactgtgaatcaggatgataaaggattccagaaagagaaaattctggatagcgttgatgagagaaaaaatgatttggtatatgcttcaaccgacattaagtactatcctgttactgagggaggtgcacagattgtgcagggaaaattggatttccctaaggtaatgcagaagatatcagtacttgactcttctaatgaaagtcaagattatattgattctttattcaagaggtgtttgctggctagtgataaaactacaaataaagattggaaagaaatggaacttaggagggaggaaatgtcttgtaaatcaggaaatgtatattggtgggtaggtaggaatattactaaggcgctaaattgtcaagtggatgttgcccaacctgagatcccggaatctaatgctccagttgctgggggtaacatttcagtagatacaagcacccctgcattggctattgagagtgacgtgtctagtcctaattcaatcacacatgaaactcaatcattatataatgctgcaactctgaacacaagaatagttagccctctttgttcagactattttcttcaagctgtgcctgatacttgtcagatcctttcttctagtatctgtgcggactatcatattaactctctagcttcatataatagtgcttctaatcagtgccaacatgagattgatgataacaaatctctggaaatccaaagaaggcatttcttggatatagctgatgatgaacctaaggttcagacctctgcaacccatctaaagccttgtaattaccaagccaagcaagaacatgttttttctggggcgttagctggtatatgtgtcagcctttgtctgcatcctgttgacacaattaaaacagtcattcaagcatgccgtgctgaacacaggtccatcttttacattgggaagtcaattgtttctgatagaggtttgcttggactgtatcgtggaattaccacaaacattgcatgttcagctccaatttctgcagtttatactttctcctatgaatcagttaaagcagctttgcttcctcatcttccaaaggagtattattcttttgcccattgcatgggaggtggttgtgcaagcattgccacctctttcatttttactcccagtgagcgaataaagcagcagatgcaagttggttctcattatcgcaactgctgggatgtattggttggaattatcagaaatggtggtttttcctccctatatgcaggttggagagctgtactatgccggaacgttccacattcaattatcaagttttacacatatgaaagcttgaagcaagtgatgccatctagtattcaacccaacacatttcagactttagtgtgtggaggattagctggatctacggctgctttattcacaaccccttttgatgtgatcaagactagattacagacacagattcctgggtctgcaaatcaatatgatagtgtgctccatgcactttacaaaattagtaagagtgaaggatttaagggcctgtacagggggttgattccgaggttgattatgtacatgtctcaaggatcactgttctttgcttcatatgaatttttcaagaggacattttctctggaagcatcacatcccactgatttatgcattcaggacaatgacgggaatgctgaagagtgaagaacgcaaaaattttgaattaacaggtccatcatagggtgttccagcagcagcttccctaagtcttgatagtttgcattcttgataacttgatagtgtgtggaagaaacatttaattgtgccacaagctgtaagcagtgtcatactatagatttaaagaataatgttaaatccttttgtaacattatcttacaagtcttcctatttattaagtgaataatgaattgaaagcatagtgttttcaagattttttttaatgtatttattattttataaaatattagg

SEQ ID NO: 1192 - DNA, 1896 bp, Glycine max var. Williams 82
atggtgccagagaacttgaagaaacaacttgctttggctgtgagaagcatccattggagctatgcaatcttctggactgattcaactacccaacccggggtgttgagctggggggaagggtattacaatggagacattaagactaggaaaacaagtcaaggagtagagctcaattctgaccaaatagggttgcagaggagtgaacagctgcgagaactattcaaatccctcaaaactgtagaagtcagccctcaaactaaaaggccttcagcagcactgtccccagaagatctcacagatgctgagtggtattacttggtttgcatgtccttcatattcaacattggccaagggttaccaggaagaactctagcgaagggtcaatccatttggctgaacaatgcccattctgctgattgtaaaatttttagccgttctcttctggcaaagagtgcgtccattgagacggttgtgtgctttccgtttagggaaggggttattgagctaggtactactgaacaggtctcagaagatttgagtgtcattgaacggatcaaaacttctttcttgaacagtctgcatgtcgatgttcccaataagtcagtagctacattgaaatcaaggaaacaggaagatctttcttatgtagcatttgatcataatgactataatgttgaatcgattccagaagttgggtatgaaatagccaacacaacctctcctaatggtagttcaaatgcaatccaagccaatcaaccactagatgacacacttatggttgaaagtataaccaatggcacttctcaagtccaaaactggcaagttattgatgatgaattgagtaactgtgtccataactccatgaattccagcgactgtatatcaccaacttttgccagccttgagaatattgcttctgcccccaagtgtaacaacccttctgatccttgtgcccgagattttcaaaagtgcaacaacccaaaaatgaccttagtggatcctcgaagtgatgagtggcattatcagagagttatttccacccttataaaaaacactgaccagttacttatgggaatgcatttgcaaaaatttcctcaggcatcaagctttgttagttggaggaaaggagagccaatggattcccaatggccaagagcaggaacctcacaaaagttattgaagaaagtattgtttgaagttcctcaaatgcacttggatgggcttcatgagtctcaagaagagaatgactataaagagggaatgagagtagaagctgatgaaaacggcatgaaccatgttatgtcagaaaggaggagaagagcaaaactaaatcaaaggtttttaacccttaggtcaatggtcccttcaatcagtaaggatgacaaagtttcgatactagatgatgcaattgaataccttaaaaagcttgagagaaggataaacgagttggaagctcacaggggtgtaacagatatagagactgggactagaagatcaccacaagatacggtggagaggactcctgatcattattttagcaaaaataataataataatggtaaaaaaccagggatgaaaaagaggaaggcttgtggtgtagatgagaaaggaagagagattaatttagatgctttaaaaggcagttatgctaatgatgttattgtgagtaccagtgacaatggaattgtgatcgaaatgaagtgcccctcgagagcaggaaggatgctagaaattatggaagcaattaacagtttcaatatagattttagttcagttcagtcaacagaagctgatggaaatctttatctgaccattaaatctgtgctcacaggaccaagggttgcaacagccaaaagaatcaaactagcactacaaaaagtggcttccaagtgctga

SEQ ID NO: 1193 - DNA, 1587 bp, Glycine max var. Williams 82
atggacgcagcaacggctttaatgatcctatcagcaatagcggcctatttaatatggttcaccttggtcactcgctccctcaaaggtccacgtgtctggcccctattgggcagcctccctggcctcatccaacacgccaaccgcatgcacgactggatcgctgacaacctccgcgcgtgcggcggcacgtaccagacctgcatctgcgccctccccttcctcgcccgaaaacagtgcctggtgactgtcacgtgcgaccccaaaaacctcgagcacatcctcaagcttcgcttcgacaactacccaaaaggccccacgtggcagtccgccttccacgatttgctcggcgaaggcatcttcaactccgacggcgacacgtggctcttccagcgtaagactgccgcactggaattcaccactcgcaccctgcgccaagccatggcgcgctgggtgaaccgagccataaagcacaggttctgccccatcctagccacggctcagaaagaaaaccaatcagtggatcttcaagacctcttgcttcggctcacttttgacaacatatgcggcttggctttcggccaagacccgcaaaccctagccgcggggcttccagataacgctttcgctctctccttcgaccgagccactgaagccactctacaacgctttattctgccggagatcttgtggaagctgaagcgatggctcaggctcggaatggaagtgagcctgagccggagcctcaaacacatcgaccagtacctctcccacatcatcaagaaccgcaagctggagctgctgaatggtaatgggtcccaccaccacgacgacctcttgtcccgcttcatgaggaagaaagaatcctactcggaggagttcctccaacacgtggcactcaacttcatcctcgctgggcgcgacacgtcatcggtcgcgctcagctggttcttctggctctgcgtcaagaacccgcgcgtggaggaaaacatcctaaacgaactctgtactgttcttctgtccacgcgtggagataacatctccacgtggctgaacgagcctcttgtgttcgatgaggtagaccgtttggtctacctcaaggcagcattgtctgagacactgcggctttatccctccgtgccggaggactccaaacatgttgtgaaggatgatgttttgcctaatggaaccttcgttccggcaggttccgcggtgacctattcaatttactctgttgggaggatgaagttcatttggggagaggactgcctcgagttcaagcctgagcggtggctctctcctgaaggggacaaaattcaggtgcaagactcttacaagtttgtttcgttcaatgcgggacctaggctttgtttggggaaggacttggcttacttgcagatgaagtcaatcgccgccgcggtgctcctgcgccaccgcctcgctgtcgcgccgggccaccgcgtcgaacagaagatgtcactcacactgttcatgaagtacggtctcaaggtgaatgtgtacccaagggatctcaaacccgtgctggaaaaattaaccaccatcaagagtgttactgttggtcaaaagtga

SEQ ID NO: 1194 - DNA, 1377 bp, Glycine max var. Williams 82
atgccaccttttgccggatccgaaccagttggattccctaagccagattccgacatagtttccattgacgttggtggccaactgttccaaaccacgaaacagacactaacctcggcgggtccgaaaaccttcttctccagaattgcggcggaatcttctggactccacacgcccttcctagacagagacccagatctgttctcgctccttctctctcttctcagaaccggtaaccttccctcaaaggccaaaactttcgatctccaagacctaactattgagtctaaattctacggcatcgaatccctcctcgtcaattccctctccaacccttctcaattggaaccctttaatctccaaaagtcgcttcttttacccttgaacggacgcgattccccatccgccctcgccaccaccgcctccggctccctccacgtcgcgcacggcagcaagatcacctccttcgactggtccctccgccgcaaatccaccgtcctgacgcaattcaccgccgtggactccctcctcgcgctctcgccgtcgctcgccgccgccggcgccaacgacttctccggcctccagatcctcgacctcgataaggggcgcgtcagggaaaccctaaattgggaaaacgtcaccaaatccggctccaccgtccaagccatcggatcctcgccggaaaacatgtttgtcagcttcgaatcctctcggagaaactcgaattcaataatggtctacgatttgcacaccctgacacccgttacggagatcggtcacaacgagatcttcggcgcggacatcgattcggcgattccgacgacgaaattgcaatggattgagggttacaatttgttaatggcttctgggtcccacagtgggccctccggcgtgagcgggaacatacggttgtgggatgttcggtccggcaacgttgtttgggaggtttccgagaaagtggattgttttgctgacgtggcggtttgtgatgcgctgtcggttatatttaaggttggggtgaattcgggggaggcatcctacgtggacttgaggaatttgagtagcggtgagagcgcgtgggtatgtctcggagataaaagaaaaattttgaatgggaagaaggaagggtttggttgcaagattgaaacgcaggggaatcaagtgttttgcaccaagggtggtgatatggagttgtggtcggaggttgttatggggtctgggaacagtgggaggatcttcaagaagaacttgatggggagagtgagggatatgggtggggccaagattaccaatttggcctttggagggagcaccatgttcttgactaggaaggatcaacaatgtgttgaggtgtggcagagttcttctagggagttttga

SEQ ID NO: 1195 - DNA, 264 bp, Glycine max var. Williams 82
atgggtactagaggtgaaagcagtgggggtgggcaaagctccttaaattacctttttggatcagaagaacggccaaagcctcctcccccaaagacagtttcatattcgttgccaccttatggaattgacatcgatatcaaccacaatccccccactgctcaaggccaacacctgggaaacgttctcaccaatcgtccatccacaaaagtcaaatcggttccaggtggacactcatcgcttggatacttgttcggagacaagtga

SEQ ID NO: 1196 - DNA, 1479 bp, Glycine max var. Williams 82
atgtctccctacgaaaagataccaatagctcaacgccgcacctgttctccctccaaaagaattaaggtaatggatatgttgttgttattatgtgttctcttggttgcattgccaaacctggctgtagtagagagtcgcagggctcctgttctggactactttgagtattgtgctatgagctgcagagcttacagtgcctcattggaagaatttggaggggttggtgatggaacaactttgaacacaaaagcttttcaggcagccatagatcatctgagtcagtatgcatcaagtggtggttctcaactttatgttcccccaggaaaatggttaactggcagtttcaatctcaccagccatttcactttattcctacacaaggatgctgtgattcttgcctctcaggatgagaatgactggccggtgattgatcccttgccatcttatggtagagggagggacacacaaggtggaaggtttagcagcctaatttttggaaccaacctcactgatgtaatcataactggggacaatggcacaatagatggacaaggtgatctgtggtggcaaaaattccgcaagggggagctcaagtatacccggccttacctgattgaaatcatgtactcagataatgttcaaatatccaatctcactttggttaattctccatcgtggaatgtacatcctatatacagcagcaaccttgttgttcaaggaatcacaattcttgctcctgtgacatccccaaatacagatggaatcaaccctgactcttgcacaaacacgcgaattgaggactgttacattgtctctggggatgactgtgtggctgtgaagagcggttgggatgagtatggtatagcttatggaatgccaacaaagcagcttgtaattagaagactcacttgtatttctccattcagtgctgtgattgctttagggagtgagatgtctggtgggattcaggacgtcagagctgaggacattgtagccatcaattcagaatcaggggtcagaatcaaaactgctgtaggaagagggggttatgtcaaggacatatttgttagaagaatgaccatgaaaaccatgaaatgggcattttggatgacaggaaattatgggtctcatgctgatgacaactatgatcctaatgcacttcctgtgattcagaacattaattatcgtgatatggttgctgagaatgtcactatggcagcaaggttggagggtatatctggtgaccctttcactggaatctgcatatccaatgtaaccattcaactggcaaagaaggctaagaaagttccatggacttgcactgatattgctggaatttcaagtgatgtgactcctgctccttgtggtctgttgccagaccagggagaagagaagattggggcatgtaccttcccagaagaaagtttgcccatcgaagatatcaaggttcaaacgtgcacttacagaaggaatttatga

SEQ ID NO: 1197 - DNA, 1674 bp, Glycine max var. Williams 82
gaaaaatactttaaatacaagggagagaaaaagaacccatgcatcaatttaaattaaacgggtggttaagtaataaaaggataaatgctattcatttttatttattccttaattgatcatcatgcaaagtaaggaacaatactaggtattaaattctaacctttactcttagtttattgattattttgcagtaaaagtccaagaaaaaaaaacaagatggatctgtatgtgacggggaatttagtaatgatggtccccacacaacacaaagtccaacgtgtcgcagatctgtgtgctgcaatgaggcgatattttgtttgttgaagcgcgtgtgagactttgaagcaccggtgaaggagcagctgccacgcgtccaaattcatgtcatttaaattaagtttctcaacggcttggcgcttacccattgaaactcgagtcactaatcgaacggcccatatgcatcgatcatcatcactcacgctatttagagaaggaaaatgtgagaccgagggtttttgttttctttctgttattacacaacacactctgtgaaaaagggggagtttcttattccttctagacgcttccattgatcggcgatttctgatacatggcggagcatcacgaacacgaggaagtgaagggtgagtccttgttggagaagatttctgggaagatccacgaccacgattcctcgtcttcgtcggattccgacaacgacaaaaccagcgccactgattccttcaagtctaatgttttcaggcttttcggcagagaaaagcccattcatcatgttcttggcggtggaaaaccggctgatgtttttctatggagaaacaagaagatatccgcatcgacactcggagttgcgaccgctatatgggttctgtttgaattgcttgagtaccacctcctgactttggtttgccacttcctgatccttgctctggcggggttgttcttgtggtccaatgcatccactttcatcaacaagagtccaccaaagatcccacaagtgcacattccagaggaacctgttttaaaatttgcctctgctcttagaattgagatcaatcgggcttttgcggtgttaagggatattgcttctggaagggatctcaagaagttcttatcagtgattgctggattatgggttttctctattctgggttgttgggccaacttcttgaccttgttctacatagcttttgttttgcttcacactgtgcctgtgctttatgagaaatatgaagatcatgtcgactcttttggtgagaaagcaattgccgagattaagaagcaatatgcagtgtttgatgcgaaggtattgagcaagatacccagaggacctctgaaagataaaaagaaagattgaagtgggcactagattctgacaaatatgttgtagtggggtttcaggaaccctatgatgtcatattttatttttttagggtccttttactagagacactgtggaagaaaagtatcttatatatttttcttctggctttatatgtacctctcaagaaatcctatatgctgcttatggatgacttgttattgtgttgtatttacatgatgaatacatactctgcatttgaatgctttcgtagatgtcgtggtaattatgtttcccaaattttgcaatctcgaagctgtttgacaggtttcccc

SEQ ID NO: 1198 - DNA, 288 bp, Glycine max var. Williams 82
atgggaagcacaaaagtcgagtcctactttgtcttcatgagctatgatcctgaatacgggagacttcaagctgatcgaaccaagagaggggtacatgagcttgatttgtaccttgatagaaaacacgatgaactcttagcaagtaccctagagccaggaagctacaagaagacatcttctttggtcattgttgatgcttttgcagtcgaaattaccgaggatcaagccaatgtgctcagatctgcaaaaggagtgagggttgtggagaaaaatgaagtaccactctag

SEQ ID NO: 1199 - DNA, 753 bp, Glycine max var. Williams 82
atggccgaagaggagaggcattgtaagtcgaagagaaaagaaggcttaacaaagcacagaatgtcctctaatccagtaatactgcagagtgtgaacttgaccaagtatatactggagaccagcgtttatccacgagaagaagagactctcaaagagctaaggaaagccactgcaggccacccttggggctttatgggcgctgctcccgatgcgggtcagctaatgaccttgctcttgaagttgttgaatgctaagaagacaattgaagtgggagtttttactgggtactctcttctcctcactgcacttaccattccagatgatggaaagattatagccctggatccagacagagaagcttatgagataggattaccgttcattaaaaaggctggtgtagagcacaagatcgacttcatagagtctccagctctaccggttcttgataaactcttagaagatccttcaaataaggaaagttttgactttgccttcgttgatgccgataaagataactattggaattaccacgagaggcttcttaaactggtaaagattggtgggttaatcatctatgataacactctctggggtggaactgttgcctggcctgaagaggatgttcctgtaccaaaaaggaaattcaggcaggctacactggctttcaacaaagcaattgctgatgattctcgtgttgaaatttctgttgtttcaataggtgatggcttcactatctgcaggcgtgctcattga

SEQ ID NO: 1200 - DNA, 939 bp, Glycine max var. Williams 82
atgaccatcctcattgagcaacctgcccttgagttacaagttgaaggcaacaatgtgcatgctgaagaaaccaatgagcttgtattggaaggtggatttccattgccaaaggatggatatatggccccagaaatcaattcatttggccactccttcagagaatatgatgctgaaagtgagaggcaaaaaggtgtggaggaattttataggttgcaacacatcaaccagacatatgactttgtgaagagaatgcgggaggaatatgggaaattggacaaagctgaaatgggcatttgggaatgttgtgagctgctgaatgaattggtagatgagagcgatcctgatttggacgaacctcaaattcaacatttgttacagtctgctgagaccatcagaaaagactatcctaatgaagattggctgcatttgaccgcactcatccatgatcttggaaagattcttgcgcttcctagctttggtgagcttcctcagtgggctgttgttggagatacatttcctctgggctgtgcctttgatgagtcaaatgttcatcataagtatttcaaggacaacccggattacaaatgccctgcttatagcactaaaaatgggatctacacagaagggtgtggattagacaacatagtgatgtcatggggacatgatgattacatgtatatggttgccaaggcaaatggcaccactttgccatctgcaggattgttcattatcagatatcattctttctatccattacacaaggaaggtgcatatactcacttcatgaatgaagaagacgttgagaatttgaagtggctcaaaatttttaacaaatatgatctctacagcaagagcaaagttctagttgatgtggagaaagttaagccatactatgtgtcactcattgagaagtatttccctgccaaggttagatggtga

SEQ ID NO: 1201 - DNA, 1272 bp, Glycine max var. Williams 82
atggacccttgccccttccttcgcctcttggtggaatccctcgctctcaagctcccttcctctccggccaaacccccacccctctccggtgtccacccttccaccaccccctgcttctgcaaaatccgtatcaacactttcccttcccacaccgccctcctccctctctcttcctccgcctctgcccccgacaccaccacctccgcccccgccttccacctcgaccccgccgccctccgccgcctctccgccaagcccctcaccctcgctctctccgtctacaacggcccaatgggccgctcctgcggggtccgcggcgccaagcttttgggcagcctccacctcaccattaacctccccgctgccctctctcactccaacaccttccataacggctggctcaacctccgtggtgggccccacaataataataataataaaccatccgcccagcttcacctcgtggtccgctccgaaccggaccctcgcttcgtctttcagttcggaggcgaaccggaatgcagccccgtggttttccaaattcagggaaatataagacaacccattttcagttgcaagttcagtgcggatcgcaactacagatcccggtctcttccatcagattttacaaagaatcgaagtgggtggagaagatccaccacaggtgagaaagagcatcaaggaagggacagaaagggttggatgataatgattcatgatctctctggctcaccagttgctgcagcctccatggtgacaccgtttgtcccatcccctggctcagatcgcgtgtcccgatcaaaccccggtgcctggctcattctccgccccaacggggcctcagagagtagctggaagccatggggtcgtctcgaggcgtggcgagaaagaggtcccgttgatggcttgggctacaaggttgagcttttctctgacaatggaccagccaatagaatacccattgccgaaggcacaatgagcgtcaaaaagggtggccagttctgcattgattacaaggtcatgaaggatgctggattgggttcaaggttgccaggggaagaaggctttgtgatgggttcaactgtggatggtgaaggcaaagttagcaaacctgttgtgcaagttggggcacagcatgtcacgtgcatggctgatgctgctctcttcattgcgctctctgcttctgttgatcttagcatggatgcttgcaggcttttctcacataaacttagaaaggagctttgctatcatgaacaagattccttttcatag

SEQ ID NO: 1202 - DNA, 672 bp, Glycine max var. Williams 82
atggctgagctacctagctcagaagcatcatcatcagcttccactcgcaagcactcgcattccgtctacagaggggtccgaatgcgggcctgggggaagtgggtatccgaaatccgcgagcccagaaagaagaaccggatctggctcggcacctttgccaccgccgagatggccgcgcgtgcacacgacgtcgcggcgctcgccatcaaaggcaactccgccattctcaacttccccgaactcgcctcctccctgccccgacccgactccaactcgccaagagacgttcaggccgccgccgccaaagccgccgccatggaggttaacgatgctccgacgacgccaacttcgtcgtcgtcggcgtcactgtcgcagtcgtcatcttggtcgtcattggcggttagttcttcctccggcgaagacccgtcgacgccggaggagcttggggagatagtggagctgccgagtctggggacgagttttgaaatacccgacccgagtggggagttggtatttttcgacccgtggccgtattctcaggcgtggagtcacggcatttatgatgagagtgagagttatttttttggggatcagatttcaatgcaggactcagagacagagagcatggttctttgtggctttgcctttgaggcttcattgtggcagcattaa

SEQ ID NO: 1203 - DNA, 4155 bp, Glycine max var. Williams 82
atggcaagagcaaaacaagggtcacattggtcatttcagaaactgccgtccgagtcttctaattccggcaagttgaatccaatcaccgtaacttcatattcatataccccccgaacggaccaaagtttcactcactctcccgccaccatgaccaccgtaacggtcacgactcgagctcagatcctccgccacaccgccgcattcacctcctccgtcctctcgcaatccgaactccggcgccgcctcatcgccactctcctccgcgacaccccactctccgaccaaaaacacctaaacctcgccgcagacactctagagagcgcgatctcgttctcgagcccccccacccgctcctcgtccctctctctcgccgagaagctcctcctccctctcccggacttccccctctcctcgctcctcctttctctcatccacgcccttcgtagtcgccctaccgaatccgccgttagcctcctccgaatattccactccaacaataacgcttccctcgctcgttccgaaatcgctcctgcgctctacgagtgccttttctctctccacctcttccccgtcttccgctggttcgatgaccagaggacgcggattctctcctcgagccgtaacgatgacgattacatttattcggtaacttcggaggagtactccgtgttgctgccttgcgcgaaggtgttgtcgaagatgagcgaggagcaggccgcgaagctcagggaggtggagagagagtacgaagatgttctcaaccagaactgcatggttctcgccgagtatttcaaagaggttttggtcaacgaaaacggtgacgctgctgtggtcagtccaccgtcgttggtacttaagagcgccgctgaagatggccacggcggcggggagatcagaaaggaggagatgatgcaaatgaacgtgttggagaacggacggtataataatccaatatggtccgaaagggaagcatctattgaatttttgagccccagtaccagcagcagatcttcccaagcgccattttatcctcaaagagtcttgtccagaatcctcaagccccaaaaagcttcaaaaacttggacaacgccagtctatttaaactcaaccgctgatactgatttttctttagatgagagtttgcttagttcttcttcagattctgaggcagaaaatgacgaggaaaaggacaaaactgttgcattgttggagcctcgacaaagccaaattaaggaacaaatgccaactatcttcaaacaatcaagaggttccccagattatccaatggcagacttggataccccgctgcatggaattgggaagcatgcacatcccaaggactttgtctgtccaataacaagttacatatttgatgatccagtgactcttgagactggtcagacatatgaacgtaaagctatcgaggaatggttcaatagaggaaacttaacctgtcccatcacacgccagaagctgcaaaacacccagctacccaaaacaaattacgtgctcaaacgactaattgcgagctggaaagatcgcaacccccatttggtcccaccatcgtatgagattccgtacgaagaaaccgaggaagctgtgaagctaacaatcccttcaacttctcctaatagcgttataacgcaagccacggtagatgggatgatgagtgagttacgctgtgcaatcaataacctttatatgtcagaggttctccaggaatctgaaatggccgtgcttcaaattgaaaagttctggagaggagtgaatgtgggagtggatatacatagcatgctatcgaaacctgcgataatcaatggatttatggagatccttttcaattctgttgagccccaggtgcttcaagcatcagttttccttttggcggagatggggtccagagacaatgctgttattaagactctcacacgtgtggactctgacgtggaatgtatcatggctcttttcaagaacgggttgacagaggctgttgtgttgttgtatctgctaaacccttccactgtgaatcttgcagagatggcaatagtggagtctctaataacagttttcaataagaaagaggaagacttggttaagatgtgtttgaagcccaaaacagctgcagtgcttttacttgcacggattattggaggcagtgaagagataatttcatcttcggttgtcaatacccttttctctgaaaaagcaataggaactattgtcggcagtttgggagctaacttggcaaaggagaggattgctgcagtggagatcttgttgagatgcatggaagaagatggcactagcaggaacaacattgctgataaagcagagctgacacctcttttggaaaccttaatcggtgcaactgatggagatcgatttaagattattcagtttttctctgagttagtcaaattaaataggcggacattcaatgaacaaatcctccacattataaaggaagaaggaccttttagtacaatgcatactcttcttatttatttgcagacagcccttcaagatcaatgtccagttatggctggcctcttactccaactcgatcttctggttgagccaagaaaaatgagcatataccgggaagaggctatggatactcttatttcatgcctgagaaacgcagatttccccgttacccaattagcagctgctgatacagttatttcactgcaagggagttttgacttctctggaaaccctctaaccagagaagtccttcttaaacgtgcaggtatcgagaaaagttccagaagtcttgtacaggtgaatcagatcagcaacttcagcccagaaatagatataactccagaagaagagaaggcagctgatgattgggaaagaagaattgcatctgttctagttagccatgagtttggcactcttttcgaggctttagcagatggcatgaagagccgaaatccagaactacgatcagcatgctttatatcagctacatggctcatatacatgttgaccattctaccagatacagggatacaagtagcagctcgagcctgcttgctgaagcagttcatagctaaattaaattctactaaggatgtagaagacagaatcctttctatgcttgctctcaatagctttcttcatttctctgacggcttaggtgatctaacttcctacactaaggatatcataaaagggttgagagagctaaagagatcctgtcctttagcaactaaaatgctaaaggttctggttgaagaaaatgaatctaaagcggacatttggatacatacacagctcataaaagaagactgcagcgagaatggagaggttctgtctgtcatttgctttaaggataaatttttttcaggacatacagatggcactattaaggtctggacattaaaggataacttattctatctgttgcaagagatccaagaacatactaaggctgtgacaaacttggtgattttagaatctgatgacagactatacagtggttcacttgaccgaactgcaaaggtctggtctattggaaaggcagcaatacattgtgtgcaggtgcatgatatgaaggaccagattcataatttagttgtaaccaatagcttagcttgtttcattccgcaggggactggtgtcaaggttcagtcattgaatggagaatcaaagttattaaattctagtaaatatgtgaagtgcttggctcatgttcatgggaaattatactgtggatgccatgacagtagtgttcaggagatacatttggccactggaacagttaacactattcaaagtggttataaaagattacttgggaaagcaaatcctattcatgcactgcaaattcatggtgaacttgtatatgcagctggctctaacttggatggatccgctataaagatatggaacaattccaattacagtatggttggatctctacaaactggatctgatgtgcgggccatggcagtgagctcagaattgatttatttggggtgcaaaggaggtacattggaaatttgggataagaaaaaacacaatagagttgacacgttgcaaatgggtacgaattgtagggttaattgcatggctctagacggcaatggagaagttttggtaattggaacttcagatggacagattcaggcttggggaatgaattaa

SEQ ID NO: 1204 - DNA, 4559 bp, Glycine max var. Williams 82
ataagaggttccatttgattcaaaactcagtaattttttgcagtgaaatacaagggtcacattggtaaagtaaagcatttttatactaaaacatggcaagagcaaaacaagggtcacattggtcatttcagaaactgccgtccgagtcttctaattccggcaagttgaatccaatcaccgtaacttcatattcatataccccccgaacggaccaaagtttcactcactctcccgccaccatgaccaccgtaacggtcacgactcgagctcagatcctccgccacaccgccgcattcacctcctccgtcctctcgcaatccgaactccggcgccgcctcatcgccactctcctccgcgacaccccactctccgaccaaaaacacctaaacctcgccgcagacactctagagagcgcgatctcgttctcgagcccccccacccgctcctcgtccctctctctcgccgagaagctcctcctccctctcccggacttccccctctcctcgctcctcctttctctcatccacgcccttcgtagtcgccctaccgaatccgccgttagcctcctccgaatattccactccaacaataacgcttccctcgctcgttccgaaatcgctcctgcgctctacgagtgccttttctctctccacctcttccccgtcttccgctggttcgatgaccagaggacgcggattctctcctcgagccgtaacgatgacgattacatttattcggtaacttcggaggagtactccgtgttgctgccttgcgcgaaggtgttgtcgaagatgagcgaggagcaggccgcgaagctcagggaggtggagagagagtacgaagatgttctcaaccagaactgcatggttctcgccgagtatttcaaagaggttttggtcaacgaaaacggtgacgctgctgtggtcagtccaccgtcgttggtacttaagagcgccgctgaagatggccacggcggcggggagatcagaaaggaggagatgatgcaaatgaacgtgttggagaacggacggtataataatccaatatggtccgaaagggaagcatctattgaatttttgagccccagtaccagcagcagatcttcccaagcgccattttatcctcaaagagtcttgtccagaatcctcaagccccaaaaagcttcaaaaacttggacaacgccagtctatttaaactcaaccgctgatactgatttttctttagatgagagtttgcttagttcttcttcagattctgaggcagaaaatgacgaggaaaaggacaaaactgttgcattgttggagcctcgacaaagccaaattaaggaacaaatgccaactatcttcaaacaatcaagaggttccccagattatccaatggcagacttggataccccgctgcatggaattgggaagcatgcacatcccaaggactttgtctgtccaataacaagttacatatttgatgatccagtgactcttgagactggtcagacatatgaacgtaaagctatcgaggaatggttcaatagaggaaacttaacctgtcccatcacacgccagaagctgcaaaacacccagctacccaaaacaaattacgtgctcaaacgactaattgcgagctggaaagatcgcaacccccatttggtcccaccatcgtatgagattccgtacgaagaaaccgaggaagctgtgaagctaacaatcccttcaacttctcctaatagcgttataacgcaagccacggtagatgggatgatgagtgagttacgctgtgcaatcaataacctttatatgtcagaggttctccaggaatctgaaatggccgtgcttcaaattgaaaagttctggagaggagtgaatgtgggagtggatatacatagcatgctatcgaaacctgcgataatcaatggatttatggagatccttttcaattctgttgagccccaggtgcttcaagcatcagttttccttttggcggagatggggtccagagacaatgctgttattaagactctcacacgtgtggactctgacgtggaatgtatcatggctcttttcaagaacgggttgacagaggctgttgtgttgttgtatctgctaaacccttccactgtgaatcttgcagagatggcaatagtggagtctctaataacagttttcaataagaaagaggaagacttggttaagatgtgtttgaagcccaaaacagctgcagtgcttttacttgcacggattattggaggcagtgaagagataatttcatcttcggttgtcaatacccttttctctgaaaaagcaataggaactattgtcggcagtttgggagctaacttggcaaaggagaggattgctgcagtggagatcttgttgagatgcatggaagaagatggcactagcaggaacaacattgctgataaagcagagctgacacctcttttggaaaccttaatcggtgcaactgatggagatcgatttaagattattcagtttttctctgagttagtcaaattaaataggcggacattcaatgaacaaatcctccacattataaaggaagaaggaccttttagtacaatgcatactcttcttatttatttgcagacagcccttcaagatcaatgtccagttatggctggcctcttactccaactcgatcttctggttgagccaagaaaaatgagcatataccgggaagaggctatggatactcttatttcatgcctgagaaacgcagatttccccgttacccaattagcagctgctgatacagttatttcactgcaagggagttttgacttctctggaaaccctctaaccagagaagtccttcttaaacgtgcaggtatcgagaaaagttccagaagtcttgtacaggtgaatcagatcagcaacttcagcccagaaatagatataactccagaagaagagaaggcagctgatgattgggaaagaagaattgcatctgttctagttagccatgagtttggcactcttttcgaggctttagcagatggcatgaagagccgaaatccagaactacgatcagcatgctttatatcagctacatggctcatatacatgttgaccattctaccagatacagggatacaagtagcagctcgagcctgcttgctgaagcagttcatagctaaattaaattctactaaggatgtagaagacagaatcctttctatgcttgctctcaatagctttcttcatttctctgacggcttaggtgatctaacttcctacactaaggatatcataaaagggttgagagagctaaagagatcctgtcctttagcaactaaaatgctaaaggttctggttgaagaaaatgaatctaaagcggacatttggatacatacacagctcataaaagaagactgcagcgagaatggagaggttctgtctgtcatttgctttaaggataaatttttttcaggacatacagatggcactattaaggtctggacattaaaggataacttattctatctgttgcaagagatccaagaacatactaaggctgtgacaaacttggtgattttagaatctgatgacagactatacagtggttcacttgaccgaactgcaaaggtctggtctattggaaaggcagcaatacattgtgtgcaggtgcatgatatgaaggaccagattcataatttagttgtaaccaatagcttagcttgtttcattccgcaggggactggtgtcaaggttcagtcattgaatggagaatcaaagttattaaattctagtaaatatgtgaagtgcttggctcatgttcatgggaaattatactgtggatgccatgacagtagtgttcaggagatacatttggccactggaacagttaacactattcaaagtggttataaaagattacttgggaaagcaaatcctattcatgcactgcaaattcatggtgaacttgtatatgcagctggctctaacttggatggatccgctataaagatatggaacaattccaattacagtatggttggatctctacaaactggatctgatgtgcgggccatggcagtgagctcagaattgatttatttggggtgcaaaggaggtacattggaaatttgggataagaaaaaacacaatagagttgacacgttgcaaatgggtacgaattgtagggttaattgcatggctctagacggcaatggagaagttttggtaattggaacttcagatggacagattcaggcttggggaatgaattaaaagaagatgctgaaagtgcaacggtacaggaagacatagatgaaacttaccttgacatttgacaagattacattcattaaaccttaaaaatactttcattttttaggttccttgtgagctgtatatagctcaaactttatacatccaagtgccttgtacatagattaactcgtacatatattgctatatcatatgcatgagattgtctttttaatttttatgcattcttcgtttttatttctttatttttttccttttcttttttttgtttaaggacgtttggatggggactttagtagggaaggaagatga

SEQ ID NO: 1205 - DNA, 1722 bp, Glycine max var. Williams 82
atggagatgtcgtcgatggaacaaaagaaagctaccgaactggttgaaaggaaaaagggtggttacagaaccattccctttatcatagcaaacgagacctttgaaaaggttgcaaatgtgggactccatgtgaacatgattttgtacctgctacaagagtatcattttgaccctgcaacaggagctattataatattcctgtggaacgccttgtccaattttttccccatctttggtgcttttctttctgattcttggcttggacgatttcgtgttattgctctcggaatagtcatcgaccttgttggcttagttgtgttgtggctcactgctatttttaggcatgcaagacctcaatgtgatgtagaaccttgtgcgaatcctacaacactgcaactcctgtttcttttctcttcccttgctctcatggctcttggagctggtggcattaggccatgtaccttagcctttactgctgatcaaatcaacaaccctgaaaacccacataatgagaggaccatgaagagcttattcaattggtactatgcttcggttggcatttcagtaactgtttcaatgacatttatagtgtacattcaagttaaagcagggtgggttgtgggttttggtatccctgtggcgcttatgacattttctgctatcatgtttttcttgggttcttgcttatataagaaagtgaagccaaacaagagcttgctcactagcttagctcaagtgattgtagcagcctggaaaaacagacacttacccatgtctcccaagaactctgacatttggtatttccataatggctctaaccttgttcaacctacagggaaagcaaggttcttgaacaaggcttgcatgatgaagaatagagagaaagatttggacagtggtgagatgccaattgacccatggagtctgtgtacagtaagacaagtggaggagttaaaagccataattaaagtccttcccatttggtccaccggcatcatacttgctactagcataagccaacaatcattttctattgtccaagctcaaaccatgaacagagtggtgttccatatgaccatcccacccaccaatttcgctgcattcataatcctcactttgaccatatgggtggttgtgtatgatcgcattctagttcccttatttcctaaggagcgagtactcaccgttaagcaacgaatgggaattgggctattgatctcatgcctggccactctagtagcagcattggtagaaaggaagagaagaaatgaagcaataaaggaagggtttatagataaccccaaaggagtggtgaacatgtcagctatgtggttagtgccccagtactgcttgtatggtttagctgagggtttgaatatcatcggacaaatagagttctattactctcaatttcctaagacaatgtcaagcattgctgtttctctatgtgcccttggtattgggatgggaaacgtcttgggaagccttattgtcaaggttgtgaaagatgggaccaagagaggaggagaagctagttggttagcatcaaatatcaatagagggcactatgattactactatgccctccttttcattctgaatttggttaatttgttatgcttcttcatatggagtcggatttatgggagtacttgtgatataaaaaattgggaggaagaggttgacacgagagtattagagaaagagttggacacaaaatga

SEQ ID NO: 1206 - DNA, 282 bp, Glycine max var. Williams 82
atgttggaaggaaaagctatggtgaaagaaacagacatgtcacccaagatgcagatccatgccatggcctctgcttctcaggctcttgatctctacgatgtttatgattgcatctctattgctgcccatatcaagaaggaatttgatagtgtgtatgggaatgggtggcaatgtgtggtgggatccaattttgggtgctatttcacccattcatcagggactttcatctattttgctctggagacccttaattttcttatctttaagggaacatcttcttga

SEQ ID NO: 1207 - DNA, 1761 bp, Glycine max var. Williams 82
ctagttctgtttgcatattattacaagtctcagtccccaacgactggttctgctttctctctgttgcttcgattcattcacacaactcaaccatgactttcaataatggcgatgcagctgctgcctccctcaacaaggtccccacggtcaacttcaccaagctcttcattgacggacacttcgttcactctgtgtcaggaaagacatttgagacaatagatccaagaacaggagatgttatagcgaggatcagcgagggagataaagaagacattgacattgctgttaaagcagcacgtcatgcatttgacaatggtccatggcctcgccttcccggttctgagagaggaagaattttgctgaaatgggcagagctaatagaggaaaatgcagaagaacttgcggcactagatgccattgatgcggggaagttgtaccatatgtgtaggaatttggaagttccagcagcagcaaacactcttcgttactatgcaggtgctgccgataagattcatggcgaggtgttgaaaatgtcccgagacttccatgcctatacattgcttgaaccacttggtgttgtgggacacattactccctggaatttccccaataccatgttctacatcaaggttgctccttctttagctgctggctgcaccatggtcctcaagcccgccgagcaaacacccctctctgctttgtttaatgctcatcttgctaaattggctggaatcccagatggagtgatcaatgtagtgcctggatttggcccaactgctggtgctgcattaagctcacacatggatgttgataaggttagctttactggttcaacacaaacaggccgtgagataatgcaggctgcagctaagagtaacttgaaacaagtttcacttgaattaggaggcaagtcacccctcataatttttgatgatgctgatatagacaaagctgctgagctagctctactaggcatcctatataacaagggagaagtttgtgttgcaagttcccgtgtgcttgttcaagaagggatctatgatgaatttgagaaaaaactggtggagaaggcaaaagcttgggtcgttggggatccctttgatcctaaagttcaacaaggccctcaggttgacaaggaacaatttgaaaaggtcctttcatatattgagcatggaaagaaagaaggagctacccttttgaccgggggtaaaacagtgggaaacaagggctactttattgagccaacaattttctccaatataagggaggatatgcttatagcacaggatgaaatatttggcccagtaatggcactgaagaagtttaagaccattgaggaagcaattaagagtgctaacaataccaagtatggcctagcagcaggcatagtgaccaagaatttggatacggcaaacacagtgtcaaggtccattcgtgcaggcactatttggatcaactgctattttgcctttggcgatgatgttccctttggagggtataagatgagtggatttggaaaagatcatggattggaagcccttcacaagtacctacaagttaaatctgttgttactcccctttacaattcaccctggctttgaatgtctactgcatatatcatatatggatcttggaaaatagtccattctggccttctggccactacctatcaatttgcatctgccatgagccatggaaattcagttcttgaatagtggtgtctgttatattatcaaaaagttggccttttcctactattct

SEQ ID NO: 1208 - DNA, 1098 bp, Glycine max var. Williams 82
atgagagacatgaaagacgcaggtgccttgggaggcaagacagcaagagcctgcgacagctgcgtaagcagaagagcaaggtggttctgtgcagctgatgatgctttcctctgccatggctgcgacactttggttcattccgcgaaccagttagcaagcaggcacgaaagggttcggcttcaaactgcttcctcaaaagtaaccaccacgcacgcatggcacagtggattcacacgcaaggcaagaaccccgcgtcacaacagcaagcactttgcgctgcaacagcgtctcaaagacgaagttctcttcaacaacaccagtgttcttcccctcgtgccggagctcggaggggaagaacaagaaccggtggttgtggataacgatgagacggaggagcagatgctgtgtcgggtgcccgtgttcgacccttttgatgtgagaaccgatgacttggatagtttttctgacatggatttcgctgagtttgctgctgatgttgaaagcctacttgataaagaagacgatgaaataagtgcgtgtgtgggagggggagagggagttcaaggtgcaatggtgaaggttaaggatgaagaagaaattgatggtgatgtagcgtgttatctggaatcggtttttgatgatgcctttcattggaataacattgagtctgtgctgtcagatgcacgggaagagaaggagggtgtggtggcgtgtgatggaggtgtcggtgatgaagaaggaggaacaaagagagacatatttttgagactaaactatgatgaggttattactgcttggtctagccaaggttcttctccatggacaacttcaaacccacctaagttcaactctgattatgacttctccttgggtttgagtggtgtaggtggggaagtaagaagcttaagggggcacctagatggtggaagagaagcaagagtgtcaaggtatagagagaagagaaggactcgtttgtttgcaaagaagataagatatgaagtaaggaagttgaacgcagagaaaaggcctagaatgaaaggtcgttttgtgaagaggacatgctttgttggagccaatgcttttcctgcttaccactga

SEQ ID NO: 1209 - DNA, 954 bp, Glycine max var. Williams 82
atgtctacttcaaagagcgtcagcagttctagtgaagatgacaatgaacttagaagagggccttggactcttgaagaggataatttgctctcccaatatatttctagtcatggagaagggcgatggaatttgctagctaaacgttcaggattaaagcgaactgggaaaagttgcagattaaggtggctaaattatctaaagccagatgtaaaacggggaaatttaaccccacaagagcaacttataatcctcgaactccactcaaagtggggaaacaggtggtcaaaaattgcacaaaatttgccaggcagaacagacaatgaaatcaagaactattggagaactaggattcagaaacaagcaagacatttgaaaattgacactgacagcagagagtttcaggaacttgttaggcgtttctggatgcctagattgcttcaaaaagccaaagaatcatcttcttcagccatgtcaattcaaaaccaggcaactcctatgccttttgatggtgtttctcagcattcaactgttgggaccataccatcacattcacacaccccttggcagggaccttgtatgaatgaagctggtcccacttacatggaccaacatgagcagaactcagactctgaacacaacaatggttcatgcatctccttgtctgagtcagcaaattttccaaaagtgcctcagcattttggacgcaccaccatcacccaatatcatgccttgaataacaatgactttggcaccttcacatatgacggctacaatgtaagcaacaatgtctatgagatggacaacttcaaaacgcctactacaagggtggctgaggatgcgcaatacccaactggtgattgtcaaatggtaggaagcaattgggtaaacagcgattttgcatgtaacatgtggaacatggatgaattgtggcaatttagcaagttacaaaaataa

SEQ ID NO: 1210 - DNA, 645 bp, Glycine max var. Williams 82
atgagaacccaacggcttaaccatctccttctctccctcttcctcttcgcagccgcattctccagcctccacccgacggccaccgccggagacgaaggcgcaccgtctgcaggcgacggcgaccgcgacgccgatttcatccgcactagctgcaacaccacgctctacccggaagtgtgtttcacctccctctctcgctacgccaatgcggtgcagcagaaccccggccatctggcgcgtgtggccattgccgtaagtctctcgaaggttcaccgtgcggcgtcctacgtctccaacctcacgcgcgacgccgactacggcggaagcacgcgcgccgctcttgctctgcacgactgcttctcgaatctgggcgacgccgtggacgaaatccgcggctcgctgaagcagatgcggcagattggatccgccggcgccggcgcgagttcgttcctgttccagatgagcaacgtgcagacgtggttgagtgccgcactcaccgacgaagagacctgtacggatggattccaggacgtagcggactgtcccatgaaaacgggtgtatgcgatcgcgtcagcaacgtcaagaagttcaccagcaatgccttggcgctcgtcaactcctacgccaacaagggaatgccttga

SEQ ID NO: 1211 - DNA, 528 bp, Glycine max var. Williams 82
atggcttgcttggtatctcgctcaggaagggaattgcagaggtacaacaacatgggtggccggcaagttgttggttgcataccttatagatataaagaagacatagatggtaaaatgagcaacgaattggaagtgctagtggttagttcacagaaaggtcgaggattgatgttcccaaagggaggatgggaacttgatgaatctgtagaagaagcagcttgtagggaatcccttgaagaagcaggagtattgggaatcattgagagtgaactaggacaatggaatttcattagcaaaagatatggcatatactatgaaggacacatgttccccatgtttgtcaaggaacaacttgatacatggcccgagaaaaatctacggagaagaatatggatgactgttgctgaagctagagaagtttgtcagcattggtggatgaaggaagcattagatatattggttcaaagaatcgtgtcttcacaacaacgaaaagaagatatagcattggatgattctttaagtttttaa

SEQ ID NO: 1212 - DNA, 1332 bp, Glycine max var. Williams 82
atgcagaggaggttccggcgagtttgcacttgtctaaaagagcgcagctgcatgagctatgcaaagattgcttcagcgagtggcttctctgacatcaaccttatcatcataaaagcaacagccccagatgacttgcctctgcatgaaaaatacatacaacacctcttgaaactcttctccatctctccatctacgtgccactcctttgccatcagcttcactcgccgatttgggaccacgcgttgctggcgtgttgcactcaagtgtctcattcttctgcaccgcttgcttcgttctgtccctggaaacagctctctctggactgaactcttatggacacgttccaatgccttgatttctctctacccttgccatttcaaggatgactcctcctcgtgtccggtttcctacaccaactttgtcatatcctacgcacgccttctggatgaagcccttaactgtgttgctctggattgcaccaatttggaagaccaagatttggagcaaaatgaagaagccatggatgaaacttttcgagagaaaatgaaggaaatgggtcaagtgcttgaaatgttaccgcaactgcagagccttatagatagggtgatggagtgttaccctgtgggagtggcagcgcgaagtttcattgtgcaggttgccatgaaactcataattcgtgacagcttcgtttgctacacaaagttcagaagagaaatagtgacggttttggacaatctacttgagatgccgtacaggaactgcatagctgctttcaatatatacaagaaagcagcagcgcaaacaaatgagctttatgagttctatgagtggtgcaaggcaaagggtctgtgtggtatgtacgagtaccctttggtggagccaattccatacatacaaatcaaggctttggaaagttttctgagtggcatgtggcagttaacggagtcttcaacgtcgccaactaccagtaccagcccttcatcttctggggattctccttcaaatttctctcaaggacaaatagtgatgagaagagacgttgttaacatcaagggtgaagaggagaagcctttgattgaactagaattggaagaagataatggggatgttagttgggaaacactgttggaaacctccattagttttagtcatgcttatcagagggacttgggcagcttgttcaatcatcggggatgggaaggtggatttcatatcgaacaacatggctttgatgcgaacgaagggcacgatcacgagcgtgcagatgccacatggaacatggcagtcaacaaaaatactactgctaataacccattctccgagccttattaa

SEQ ID NO: 1213 - DNA, 1338 bp, Glycine max var. Williams 82
atgcgtgagattcttcacattcagggagggcaatgcgggaaccaaataggaacaaagttctgggaagtggtgtgtgatgagcatgggattgatcccacaggacaatacgtaggcaactccgaacttcagcttgaaagagtgaacgtttattacaatgagggcagcaatggacgttacgtgccacgggctgtgctgatggaccttgagcctggcaccatggacgctgcccgcactggcccttatggccagattttccggccggacaactttgttttcggtcagtcaggggctggaaacaactttgcaaagggccattacactgagggtgctgagcttattgactccgtccttgatgttgttaggaaggaggttgagaattgtgactgcttgcaaggatttcaagtttgccactccttgggagggggtacaggttctggaatgggaactttgctgatttcgaagatcagagaggaataccctgatcgaatgatgctcacattctctgtgtttccatctccaaaggtgtcagacacggttgttgagccttataatgctacactttctgttcaccagttggtggagaatgctgatgagtgtatggtccttgataatgaagcactctatgatatctgcttcaggaccctcaagctcgctacgccaagctttggagacttgaatcatttgatatcagcaacaatgagtggggttacttgttgcttaagattccccggtcagctcaactcagacctaaggaagctagcggtgaacttgatcccatttccaagactccacttcttcatggtgggttttgctcccctaacttctcgaggatcacagaactaccgtgcactttctgtcccagaactgactcaacagatgtgggatgccaagaacatgatgtgtgcggctgatccacgccacggtcgttacttgacagcctcagcagtgttcagaggcaagatgagcacaaaagaggtagatgaacagatgttaagtgtgcagaacaagaactcttcctactttgttgagtggattcctaacaatgtcaagtctagtgtctgtgacattcctcccagaggcctttccatggcttcaacttttgttggtaactcaacttctatacaggagatgttcaggagagtgagtgagcagttcacagccatgttcagaaggaaagccttcctgcactggtacacaggagaaggaatggatgagatggagtttactgaagcagagagtaacatgaatgatcttgtagctgagtatcaacaataccaggattccgcgactgatgaggatggtgattctgaagaagaaggtgagggtgcagagagctga

SEQ ID NO: 1214 - DNA, 1397 bp, Glycine max var. Williams 82
ttattcattccaagcaaaccagtgcaaagagttcatttccccctcatccaaggcagagaatgcgtgagattcttcacattcagggagggcaatgcgggaaccaaataggaacaaagttctgggaagtggtgtgtgatgagcatgggattgatcccacaggacaatacgtaggcaactccgaacttcagcttgaaagagtgaacgtttattacaatgagggcagcaatggacgttacgtgccacgggctgtgctgatggaccttgagcctggcaccatggacgctgcccgcactggcccttatggccagattttccggccggacaactttgttttcggtcagtcaggggctggaaacaactttgcaaagggccattacactgagggtgctgagcttattgactccgtccttgatgttgttaggaaggaggttgagaattgtgactgcttgcaaggatttcaagtttgccactccttgggagggggtacaggttctggaatgggaactttgctgatttcgaagatcagagaggaataccctgatcgaatgatgctcacattctctgtgtttccatctccaaaggtgtcagacacggttgttgagccttataatgctacactttctgttcaccagttggtggagaatgctgatgagtgtatggtccttgataatgaagcactctatgatatctgcttcaggaccctcaagctcgctacgccaagctttggagacttgaatcatttgatatcagcaacaatgagtggggttacttgttgcttaagattccccggtcagctcaactcagacctaaggaagctagcggtgaacttgatcccatttccaagactccacttcttcatggtgggttttgctcccctaacttctcgaggatcacagaactaccgtgcactttctgtcccagaactgactcaacagatgtgggatgccaagaacatgatgtgtgcggctgatccacgccacggtcgttacttgacagcctcagcagtgttcagaggcaagatgagcacaaaagaggtagatgaacagatgttaagtgtgcagaacaagaactcttcctactttgttgagtggattcctaacaatgtcaagtctagtgtctgtgacattcctcccagaggcctttccatggcttcaacttttgttggtaactcaacttctatacaggagatgttcaggagagtgagtgagcagttcacagccatgttcagaaggaaagccttcctgcactggtacacaggagaaggaatggatgagatggagtttactgaagcagagagtaacatgaatgatcttgtagctgagtatcaacaataccaggattccgcgactgatgaggatggtgattctgaagaagaaggtgagggtgcagagagctga

SEQ ID NO: 1215 - DNA, 2400 bp, Glycine max var. Williams 82
atggcgaggccagaaaggacaggtagaaataaaagtttagagactctaatagactcggacaaaccaggaatgggaagaaatgtgaaccaactgaagactcagaagtccattccaggctatggccttgaattcagtaacctctcgtatagtatcataaagaagcagaaaaacgatggagtttggatcaacaaagaaacatatcttcttcatgatatctctggccaggcaataaaaggtgaaattatggcaatcatgggacctagtggtgctggcaagtccacctttcttgatgcattggccgggcgaattgcaaaagggagtctagaaggatcagttagaattgatggaaaaccagttactacaagctacatgaaaatggtgtcatcatatgtgatgcaagatgaccagctcttccctatgttgacagtctttgaaacatttatgtttgcggctgaagttaggcttcctccttccatttccaggagtgaaaagaagaagagggtttatgagctccttgaccaattgggcttacagagtgctacacatacctatattggtgacgaaggaaggagaggagtgtcaggaggggaacgacgaagggtatctattggcatagacatcattcataaaccatcacttctgttccttgacgaacctacctcaggccttgattctacaagtgcttacagtgttgtagaaaaggttaaagacatagctcgaggaggaagcattgtccttatgaccatacaccagccttcatttagaattcaaatgctcctggaccagatcactgtccttgcaaggggaagactgatatacatgggaaggccagatgcagttcaggctcacatgtcaagatttggtaggcctgtacctgatggagaaaacagtattgagtatcttctagatgttataagtgaatatgatcaagcaacggttgggcttgatccccttgtccaattccaacgtgatggcctcaaacctgacccagcagccatgacacctgttcctagaactccaagaacaccttacaaaaggaacactcctgcatctaaacacatgattagcctacgcagccaaggatttactgctggaacacaacagcctgattctgtgccgtttagttatcatggtgaggatgatgatgatgaggattttgataactcccttgaaaggaaaagtgctccaacaccaaggaatatgattagtggtgttcacccacgtttggcttctcagttctacaaagatttctcagccaaggatttctctgtctggctttaccatggtgtagtaggaaccccgcatcgccaaccatcatggactcccgcaagaactccaggatggacaactgggaaaacacccatgtcaggaccaagaagtgcagtttcaaaccaatattctgcggctcctgcagtggttggccagtctatggactactcagcaacttcatatgaaggatttgagattgaggaagtgcttgatgagctaaacttcggatccaagtatgcaaacccatggttgcgtgaggttgcagtgctctcatggcgaacagcactcaatgtaattcgcaccccagaactcttcctctcccgtgagattgtcttaactgttatggcacttatcctgtccaacatttttcgaaatctgagtcatcctttattcaaagacatcaataggctcctcaatttctacatctttgcagtgtgccttgttttcttttcttccaatgatgcagtcccttcttttatcatggagaggttcatcttcataagggagacttcacataatgcttaccgtgcttcttcatatgtcatttcttccctcattgtttacctcccattttttgctgttcaaggtttcacatttgctgtcataaccaaaaagatgctccacttgagaagcagtctcttgtatttctggctaatactttatgcctcgcttattactaccaatgcatatgtgatgcttgttagtgcacttgtgcctagttacatcacagggtatgcagtggtcatagccacaacagcactcttctttttgacctgtggtttcttcctcaagcgaactcatatacccatttactggaggtggcttcactatatttctgcaatcaaatatccatttgaggcattgctcacaaatgaattcaataacctcaactgctacacaggaaatttaacagacttatctccgggaccattaggagacctgaagctcagcaaacaccataactccagtctgcccgctaactgcttattaggggaagatatcttgtcctcgatggatattacaatggacaacatatggtatgacatcttaatcctgctagcttggggtgttctttgtagattcttcttctatttagttttgagattttactctaagaatgagaggaaatga

SEQ ID NO: 1216 - DNA, 2612 bp, Glycine max var. Williams 82
taaaaccatgctttcattttcaccgtcaccttttgtccttatttcatagctgccaactcttttatttataccattaacaccagcaatcaaagaaggccaaaagtgattgctgaagttcactgtaatggcgaggccagaaaggacaggtagaaataaaagtttagagactctaatagactcggacaaaccaggaatgggaagaaatgtgaaccaactgaagactcagaagtccattccaggctatggccttgaattcagtaacctctcgtatagtatcataaagaagcagaaaaacgatggagtttggatcaacaaagaaacatatcttcttcatgatatctctggccaggcaataaaaggtgaaattatggcaatcatgggacctagtggtgctggcaagtccacctttcttgatgcattggccgggcgaattgcaaaagggagtctagaaggatcagttagaattgatggaaaaccagttactacaagctacatgaaaatggtgtcatcatatgtgatgcaagatgaccagctcttccctatgttgacagtctttgaaacatttatgtttgcggctgaagttaggcttcctccttccatttccaggagtgaaaagaagaagagggtttatgagctccttgaccaattgggcttacagagtgctacacatacctatattggtgacgaaggaaggagaggagtgtcaggaggggaacgacgaagggtatctattggcatagacatcattcataaaccatcacttctgttccttgacgaacctacctcaggccttgattctacaagtgcttacagtgttgtagaaaaggttaaagacatagctcgaggaggaagcattgtccttatgaccatacaccagccttcatttagaattcaaatgctcctggaccagatcactgtccttgcaaggggaagactgatatacatgggaaggccagatgcagttcaggctcacatgtcaagatttggtaggcctgtacctgatggagaaaacagtattgagtatcttctagatgttataagtgaatatgatcaagcaacggttgggcttgatccccttgtccaattccaacgtgatggcctcaaacctgacccagcagccatgacacctgttcctagaactccaagaacaccttacaaaaggaacactcctgcatctaaacacatgattagcctacgcagccaaggatttactgctggaacacaacagcctgattctgtgccgtttagttatcatggtgaggatgatgatgatgaggattttgataactcccttgaaaggaaaagtgctccaacaccaaggaatatgattagtggtgttcacccacgtttggcttctcagttctacaaagatttctcagccaaggatttctctgtctggctttaccatggtgtagtaggaaccccgcatcgccaaccatcatggactcccgcaagaactccaggatggacaactgggaaaacacccatgtcaggaccaagaagtgcagtttcaaaccaatattctgcggctcctgcagtggttggccagtctatggactactcagcaacttcatatgaaggatttgagattgaggaagtgcttgatgagctaaacttcggatccaagtatgcaaacccatggttgcgtgaggttgcagtgctctcatggcgaacagcactcaatgtaattcgcaccccagaactcttcctctcccgtgagattgtcttaactgttatggcacttatcctgtccaacatttttcgaaatctgagtcatcctttattcaaagacatcaataggctcctcaatttctacatctttgcagtgtgccttgttttcttttcttccaatgatgcagtcccttcttttatcatggagaggttcatcttcataagggagacttcacataatgcttaccgtgcttcttcatatgtcatttcttccctcattgtttacctcccattttttgctgttcaaggtttcacatttgctgtcataaccaaaaagatgctccacttgagaagcagtctcttgtatttctggctaatactttatgcctcgcttattactaccaatgcatatgtgatgcttgttagtgcacttgtgcctagttacatcacagggtatgcagtggtcatagccacaacagcactcttctttttgacctgtggtttcttcctcaagcgaactcatatacccatttactggaggtggcttcactatatttctgcaatcaaatatccatttgaggcattgctcacaaatgaattcaataacctcaactgctacacaggaaatttaacagacttatctccgggaccattaggagacctgaagctcagcaaacaccataactccagtctgcccgctaactgcttattaggggaagatatcttgtcctcgatggatattacaatggacaacatatggtatgacatcttaatcctgctagcttggggtgttctttgtagattcttcttctatttagttttgagattttactctaagaatgagaggaaatgaatcatttaccacccctttttctatggataacctattagtttatagatttcccggtctgctaaaaaaagctgaaggtcataacaatcac

SEQ ID NO: 1217 - DNA, 855 bp, Glycine max var. Williams 82
atgaagagaagttgggataaggacaagaaaggcaacggagatggaaccactttcactgactaccttctctttccaacctctcctggtcacaccctttttacccactcttggattcctcgctctcctgtcacttccatcagatatactcattttgcaaatcacctcaatgctaatggcttcagggtttacgggatggattggcttggccacggtggaagtgatgggttacatggttatgtccattctcttgatgatgctgtttctgatatgaaaatatttttggagaaggttctgaatgaaaatcctgggcttccatgtttctgctttggacactcaacaggagcggccattactcttaaggctctgcttgacccaaaggttgaatctcgcatagctggtgctgtattgacatcaccagcagttggtgtttccccttctcatccaattttgctggtacttgctcctatagcttcatttttgctgccaacgtatcaatgtagttctgcatataagaagggatcgccagtgtctagagacccagaggcgctaattgctaaatattctgatccattagtatatactggacctcttagagtacgtactggttatgagattctcaaaattacaagctacttgcagcaaaatctgagaaaattgagagttccattttttgttctccatggcactgctgattccgtaactgatcccgttgcttctcaaaaattatatgtagaagcctcctcaactgataaaactatgaaactatacgatgggttcttacatgacctgctctttgaacccgaacgagatgctatcacacaggatataattcaatggctgaacagtagagtatga

SEQ ID NO: 1218 - DNA, 1457 bp, Glycine max var. Williams 82
tagaggcacagctgtcttctggaatgttttatatatgaatgaatgaatgttttggtctgtcattgatctgatctgtatttggctattatggttttgaggggaaaggaggcttccacgttgattctgctccttctcttccccttccgcaaagggactaccatgcgcttcgccttcaagaccaggagatggaaccactttcactgactaccttctctttccaacctctcctggtcacaccctttttacccactcttggattcctcgctctcctgtcacttccatcaggtgacttgttcttcttattcatggacttaacgagcacagtggcagatatactcattttgcaaatcacctcaatgctaatggcttcagggtttacgggatggattggcttggccacggtggaagtgatgggttacatggttatgtccattctcttgatgatgctgtttctgatatgaaaatatttttggagaaggttctgaatgaaaatcctgggcttccatgtttctgctttggacactcaacaggagcggccattactcttaaggctctgcttgacccaaaggttgaatctcgcatagctggtgctgtattgacatcaccagcagttggtgtttccccttctcatccaattttgctggtacttgctcctatagcttcatttttgctgccaacgtatcaatgtagttctgcatataagaagggatcgccagtgtctagagacccagaggcgctaattgctaaatattctgatccattagtatatactggacctcttagagtacgtactggttatgagattctcaaaattacaagctacttgcagcaaaatctgagaaaattgagagttccattttttgttctccatggcactgctgattccgtaactgatcccgttgcttctcaaaaattatatgtagaagcctcctcaactgataaaactatgaaactatacgatgggttcttacatgacctgctctttgaacccgaacgagatgctatcacacaggatataattcaatggctgaacagtagagtatgaatataagtcgtggcgtcagtgaaaatatcatgaaatttttcaaccatttgaaaattgaagaagcaccttgtctgggtggataatatctgcctctttgtagaggaaagaaatttcaagctgaagctacataaatcgaggcattcttttatcttcaaattctaagaccatatatcagcttcttttatagttaggatcagatttattactcttttctccgatccagtagttatccaaggagcgcagtaagtatttaccttcaattaggttttttttcctttgtcaactttgtccatagaaagtatgtaccattttctttgtgatgattactaagccatcacttattttaagtttagcatttgtgccaaccaacaagtgggccagtgcttgctctgtttaaattataacaacaaag

SEQ ID NO: 1219 - DNA, 948 bp, Glycine max var. Williams 82
atggacttggcggagaagcttttctttgcagcatttctcattctttccgtggccattgatggaatgcaggcagacactatggtcactggcactgtcttctgtgaccaatgcaaagacggacagagatccctttttgattatcctgttaatggtgcaaaagtaattctgtcctgtgctgacagtaatgggcaaattacaatgtcaagagaagaaacaacaaactggtttggaagctatacaatgaggttcaatggcgcacccgacttgagtggttgttctgcccatgtctcaggcagtggtgaagggtcaacaacgggttgtggtgaaggggctggtccttcacaaaatcctaaactcatgtttagaatgtttgacatggaaatgtatacagtggattctctccttgctcagcccgcacaacccatgcagtactgctcaacatcttccaacccagtcccagcaccagacacaccacccaactctccaccacatttcaagctacctccagtgcctccactaccatcactgccaccacttccatcactaccacccctgccaccagtgatttttgcagaagcttcagcatgtccatcagagaagtggacactgccagaatacaaatgctactggagaggtgtgaaccgggacacaaaagttgcagtggcttttggaatggttgcggcgagaagatacggaacagacattacactgtggcatgggttgcaagggagaggagacccttacaggactcttctcagagaagggatcacagcacttcttaactcctataacagctttcaattctcttatcatccacttggcgtcgtccaacacatgaatttggctttgatgggcacaactaggagtgttctacatactgctctgcgcttcaagagggccaattctggtgctggaaatgtcacctgcaaattcaccacttgcaaataa

SEQ ID NO: 1220 - DNA, 1338 bp, Glycine max var. Williams 82
atggttctgaatgttcatcgcgtatattctcctacgctgaattcgataatactcttacttgctctctgcactttatcagattgctatgacccgttggatcctaatggaaacatttccgtaacttttgacatcctcgaacgtactacagataatggatatctggcaagggtgacccttgaaaactactatcaatatcggcatgtagagaaacccgggtggaaactaggatggacgtgggctaacaatgaagtgatatggtcaatgagtggtgccatagcaactgatagagggaattgttcatcttacagtggttctcagatgccacattcatgcaagaaagatcccaccatagttgatctctctctagatgtctcgcaaaacaggtcagagcattgttgccgtggtggtctcctctctgcctggtctattgatcctttcaatgccttctcttcatttgaacttgaagttcgcaacgtgggagataacaacccacttggacaagctcctaataatcttacattgatggccccaggtcctggttacacttgtagcccccttcttgacactgatctctctgtctcctcagattttgggggactaagacaagttcctgttctcagaacttggaagtcaacatgtgcatactccagtttcatagcaaacacaataccggtatgctgtgtttccctctcatcattttacaaccctgccatcacatcttgccgtaattgcagttgtggatgcagagaagcagataaaagtacagcatcttgcataaggcctagttccttgccacggtctaatggagacaacacaattgatgaaataatagaatgcaccgaccacatgtgcccagttcgagtccattggcatttcaagaacaactatatgaaccaatggagggtgaagcttacagtttctaactacaattacaacagaaactactcaaactggaacgtgctggttcaacatcctggtttcacccaaaaagcaagaacttacagcttcaacagcactagacttcctacccttgggctccaagatggagtttcccttttttgggggatagactattacaacaatgagctagtgcattctgataagggtgttgtgggtcttgtgacaacagaaatactattggataaagatccaaattctttcacagtaagtaatggatgggcatttccgagaagaatatatttcaatggggagaactgcgaaatgcctttacctgacacgtttccaatgttacccaatggtagctccagtttaagagctacttactgtggtttcagtcttttatttatcctcttgtttcttgccctactactcctttaa

SEQ ID NO: 1221 - DNA, 2076 bp, Glycine max var. Williams 82
atgcctgccctggcttgttgcgtggatgctgcagcacctcccggctatgcatttgccggtgacatctcttttccggcgccggtcgcccttactggcgtacctccggccacgacagacgacagcaacaacaaccgttggtcgccgtccctctccgctgcgctctacaacgtcgacggctggggcggcccctactttgccgtcaacaccgccgggaacatctccgtgcgcccacacggttccgacacgctgtcgcaccaggagatcgatttgctgaagattgtgaagaaggcctccgatcccaaatctcttgggggtctcagcctccagcttcctctcattgcccgcttccctgacgttctgaagaaccggttggagtccctccagtcggcgttcgattatgcaatccaatctggagggtacgagtctcattaccaaggagtttaccccgtcaaatgcaaccaggaccggttcgtggtggaggatatcgtgaaattcggttcacccttccggttcggtctggaggccgggtctaagccggaactccttctggccatgagctgtctttgcaaaggcaaccccgacgcgcttttgatttgcaacggcttcaaggacgcggagtacatttctcttgccctggttgccaacaaacttgccctcaacaccgtgattgttgtggagcaggaggaggaggttgatttgatcgttgaattgagcaagaagctctgtattaagcccgtgattgggcttcgtgcgaagcttcggaccaagcattccggccatttcggtgggacttcaggagagaaggggaagtttgggctgaccaccgctcagattcttagggttgtgaagaacctggacctcgcgggcatgctggattgcctgcaactgctgcattttcatattggttctcagattccctcaacagcgttgcttgctgatggtgtgggagaggctgcgcagatctactgcgagttggttcggctcggggcgaacatgcgagtcatcgatattggaggtggactgggcatagattacgacggttccaaatcgtgtgactctgatatttccgttgagtacagtctcgaggattatgcagtcgcggttgttcacgcggttcagtgtgtgtgcgaccgaaggtccgtgaaacacccagttatctgcagcgagagtgggagagccatcgtgtctcatcattcggtcttgattttcgaggcggttggcaccagcagcaccaccgggggaggagcttcccctgcattgtccgctcaatatctggcggaggagctgtcggaggattaccgcaatctgtcggagctggcttttagaggggaatatgaaacgtgtctggtgtacacggaggagatgaaggagcgatgcgtggaacagttcaagcaggggacggtgtgtatggaacagctggcagcggtggaaggattgtgcgagttggcgaggaaggcggttggggcgggggaatcggttcggagatatcacgtgaacctgtctgttttcacgtccgttccagacgcgtggggaattgaacaggtgtttcccattatcccaattcaccgtttggacgaaaagccttcggtgaggggtattctctcggacttgacttgtgacagcgacgggaagattgacaagttcatcaacggagagtccagcctgccgcttcatgagatggaaggaggaagaacttactatctgggaatgtttttgggtggggcttacgaggaggcgctcggtggagtccacaacttgttcggcggccccagcgtggtcagggtgtcgcagagcgatggccctcacagctttgcggtcacgcgtgccgtgccggggccatcctgtggagatgttcttcgagtgatgcagcaccagcccgagctcatgttcgagacactcaagcaccgcgcgcaggagtatgtcagccacgacaacgcagcagcgcttctggctgctggccttgctcgcacctttgacagaatgccttatctgctgtctctgtcttcctttgtggctgacgatgttgccgctgctgttcctgctgctcaagatctgggggagcagtggtcttattaa

SEQ ID NO: 1222 - DNA, 1560 bp, Glycine max var. Williams 82
atggcttctgcttgtgtgaccctgaaagccaatacccatttagcaaactctgagaaaggctttcttggagaaagaataaaaggtggcttcaacaacagtgccttggtgatgaatcagttggctatacgttctagaagccacaagagggtgaaacatggtgttggtgttgtatcttctgttctcacatcaaacaatgccaaagaatcactgaccttgcaagtgccttcctttctgagaagaagagctgatccaaaaaatgttgtttccatcatattgggaggcggacctgggacacaactctttcctctcaccaaacgtgctgccacacctgccgttcctgtgggtggatgctacaggcttatagacatccctatgagcaactgtctcaacagtggcatcaacaaaatatttgtgctgacccagttcaactctgcatccctcaaccgccacatcgcccgcacctattttggaaatggcattaactttggggatgggattgtggaggttctggcggctactcaaacaccaggagaggctggaaagaattggttccaaggaactgcagatgctgtgaggcaattcacttgggtatttgaggatgccaagaatacaaatgttgagaatgtgttgatcttggctggagatcatctatatcgaatggattacatggaccttgtgcagagtcacgtggatagaaatgctgatattacagtttcatgtgctgccgtgggtgacagccgtgcatcagattatggattggttaaagtagatgacagaggccgcatcattcaattttcagaaaaacctaagggtgatgatctgaaagcaatgcaagcagatacctctcttcttgggttgtcatcccaagatgcattagagtcaccatatattgcatctatgggggtttatgtattcaagacagatgttttactcaatcttctgaaatggagatatcctacctcaaatgacttcggatctgaaatcatccctgcagctgtgagggatcacaatgtccaatcatatttttttggagactattgggaagacattggaacaataaaatccttttacaatgctaacttggctcttactgaagagagtcacaagttcgaattttatgaccccaagattcccatttacacatctccaggattcttaccaccaacaaagattgacaaatgccggattgtggatgctattatctcccatggatgtttcctgcgggaatgcacagttcaacactccattgtgggtgaacgttcacgcttggattatggcgttgaggtcctggacactgtaatgatgggagcagactattaccaaactgaatccgaaattgcttctctgctggcagaggggaaggtcccaattggtattggaaggaataccaaaattaggaactgtattattgacaagaatgcaaagatcgggaaagatgtcatcatcgcaaacaaagatggcgttcaagaagcagatagaccagaagatggattctacatccgatcaggaatcaccatcataatggagaaggcaaccatagaagatggcactgtcatataa

SEQ ID NO: 1223 - DNA, 276 bp, Glycine max var. Williams 82
atgaagtccaattttgctgttttcgtagtcttctctcttctcttggttgccaatttgagctgtgcaaggaaagacttgggagggtattggaagaatatgatgaaggagcaacctatgccacaagcaattaaagaccttgttgaggactcacaagcatcagatacagggaagaaggatctttttactagggactttgatgtaaagcctaatgtcatattatatcacacccatgttgtgtccatgaagcagaagcagaagccttttctccagaattga

SEQ ID NO: 1224 - DNA, 1125 bp, Glycine max var. Williams 82
atgttggcaatggaagaactactgtatgaacttagtgatcatgaaaggagaaacgagcaaggtctgccaccgggtttcaggtttcaccccactgatgaagaacttgtaaccttttacttggcttcaaaggtctttaatggcaccttctctaacgtcaagtttgctgaggttgacctcaatagatgtgagccttgggaacttccagatgtggcaaagatgggggagagagagtggtatctgttcagcttgagggacagaaaatacccaactgggctaagaacaaacagagcaaccggagctgggtactggaaagccactgggaaggacaaggaagtgtacagtgcatccagtggaaccctacttggaatgaagaagacccttgttttctacaaaggcagggcccctcgtggtgaaaagaccaaatgggtcatgcacgagtaccgtttggttttggatgctcacttttcccttccccacactcacccctctaaggaggagtgggttatatgcaggatatttcataaatctggggaaaagagaagtccagtgctccaagtccatggacattcagatgcttcttcgtccccaagagaaagtgctttacctccattacttgcaagcccaagttgctttacatttgatccagaatctcaatcccaaagttcatctcattctcagcgagacttccaaagcccggttctgattcaccaccaagaccaaaatggccactctcataaccctcgtcttttcccattagaaatcaccaacgccagaaaccacccatcatcattttcggacctattcttcaagccccttcagcagaattgcaccctgaagaccaacgaacaaactattcttccaaaagtaaccaaaacggaggacgctacattctatgatcaatatcatcaattactagatgaccataataacatgcgctgggtgaacaagttgaatcaaaatccaagcaatttactcaacactttcccttttgaggtggatgctggcttgatggcattctcaggagctgcaaatgctcaagttaaggacatatccacttcaacaccctttaatagggtaggcttgcagcagacgctagattcttggcctctggcccagcatgtttga

SEQ ID NO: 1225 - DNA, 1626 bp, Glycine max var. Williams 82
atggctggtggtggtgctactgcagaaagaagcttagaggaaacacccacatgggcagtagctgctgtttgctcagtgttcgtcatcatctctgtattaattgaacacggaatccattcacttggaaagtggtttcaaaaacgacataagaaggccatgaatgaagccttggagaaaatcaaatcggaattaatgttattaggattcatatccctattaataacttttggtacacaatatattgcgaagatatgcatccctgtgtcagccggtgacataatgcttccatgcaagaaggtggaagtgtcagattcagatgatgactcaaatgacagaaggaagctactttcttttgacgacaacatggaatggcgtcgagttttagcagctgcgtctgggggtgactattgctcacaaaaaggtaaagtgtctttgatctctcagtctggggtgcaccagttgcatatatttatattcgtcctcgctgtttttcacattttctacagcgtcatgactatggtactagcccgagcaaaaatgaagaaatggaaggcttgggaagcggaaacatcttccctggagtatcaatttacaaatgatccttcaaggttcaggtttgcgcatcaaacatcattcgttaggcgtcactctggttggtctaggatgccaggaattcgatggatagtggcattcttcaggcaattcttcggttctgtcagtaaggtggattacatgaccatgcggcacggatttattaacgcacattttgctccggatagcaaatttgactttcaaaaatacattaagagatccatgaaggatgactttaaagtggtcgtgggtataagcattccgttatgggtttttgcaatcgtctttatgcttgtgaacgtttacaaatggtacacgctcacttggctatcattagcaccactagtgatacttctattagtgggcaccaagcttgaacttataatcatggaaatggcccaacaaatccaagatcgagccacaattgttagaggagtccctattgtagagccaaacaacaagtatttttggtttaaccggccacagtggattatcttcttaatccactttaccttattcgagaatgcattccaaatagcctttttcttgtggacatggtatgagtttaagatcacatcttgcttccatgaaagcttgccgctaatactgacaagggttgtccttggaatagccttacaagtcgtgtgcagctacatcacatttcctctctattccctagtaatacagatgggatctcacatgaagaaagcaatctttgaggagcaaactgcaaaggcacttaagaagtggcaaaaggctgcaaaggacaagaggaagttaaggaaagcagggatagatatgagtggggaaacaacaccaagccaaggcacatcacccttgcatttgcttcaaaagtacaagccaagccacacagacaccgatagtgttctctactctccacgatcataccaatctgacactgacttgtctgagacagagggatcttcacaccaattgaatgaaataacacaaacgcatcaagctccaaggaatggagaaactcataatatcgatttttcctttgtgaagccttaa

SEQ ID NO: 1226 - DNA, 1758 bp, Glycine max var. Williams 82
atgcgacggagaccgcgcacctccttcctcgtctccttactctccattctcaccttcgcttcattttccctttacctctctcgcaatgccatttccacttggcgcccctactccgacctcagaaaattaaacgccgtcaccaaccacctcgtccttcacaacagaaacaaaaacaacatcttcaacaatcaattctcacgccaaacacggcgggtgtcctccatcaaggacaccttattatccaccgtctccgttctcatccccgactgggagattctcgtcatcgtcgcgccaaacacgcccttatcctcctccgacacaccccactgcctcttccccaacaatgccagctctccggccaaattctccggcgtcctccccttcaccaaccgcaccaccttcaagtgcgacctccccgagccggttcgccgccgccgcatgttctcccagcccatgctcgtgacatcaccaacctcggagaccgagttcccgtcgccggcaccggagctcctgaagtggaactttctcgtgtacgagtccttctccacggaaaacgacgtcgtcgtgttcgccaaaggggtcaaccatcgcaacggagacaaccgctccccggaggaactccgttgcgtgtttgacctcggtagcggtgtccttaacgtcgccgttacgagctccgtccaagaagtgttccgttgccctcacccagatccatccgaattagatttcgattctcattatggcttacccaatagaatcggaatctcccttgagatcgtttcagaaaacaccgtcgtcccgtcggtcgcatattacattcccaagcccgggctcaagcccaagctcatgacgaatgatctatccgtacaagcccggcccaaatatttcttatgcgcatgcacgatggtttacaacgtggcaaaagtcttacgggaatgggttatgtatcatgccaaagtcggcgtggagaatttcatattgtatgataatgcaagtgatgatgatttgtatgccgtgatcgacgagcttcgaaaacaaggttacaacattagcacgttgttttggatttggcctaagacacaagaagctggattctcccacagtgttgtgtactccaaatcgaaagaactgtgcagttggattatgtacgtggacgttgacgagttcgtgttttctccctcatggggacatgaaactgaaaatagtgttgttgttccttcgttgaaaaagttattggcgagggaaataataaagggggggactagggtgggacaagtttcgatgaggtgcatggaattcgggccttcggggcaacggcggcacccggaggaaggagtgacgcaggggtacacgtgtcgtaggaggggggaacagaggcacaagtcaatggtgttggtggaggcggtggaccccagtttgaggaacgtgatacatcattttcaagtgaatgaaaggaaagggttcatgtcgaagcaggtgagtgtggaggaagggttggtgaatcactacaagtaccaggcgtgggatgagttcaagagtaagttccgaaggagggtgtctgcgtatgttgtggattggaagcaggaaattaaccctaattctaaggataggactcctggcttgggcttccaagcaatagaacccaaggattggacccataggttctgtgaggttagagaccagaggttgaaatccttgacccgtgcttggtttcgctccgtcacgcccaacggctacagaatggcttggcaaacaaattga

SEQ ID NO: 1227 - DNA, 1644 bp, Glycine max var. Williams 82
atgccgctcaagttggcgggagtagccactgtcggttcccttcttctatgtgttgctatttctctctttcacatcgctggggccgaagatccctaccgcttcttcaactggaatattacttatggtgatatttaccctcttggtgttcgccaaacgggaatattgatcaacgggcaattcccaggtccagatattcattctgttaccaacgacaacctcatcatcaatgtcttcaacagtttagatgagccttttctcctctcctggaatgggatccagcagagaaggaactcgttcgaagatggtgtttttggaacaacatgccccattccagcagggaagaatttcacttacatccttcaagtcaaagatcaaattgggaccttttactacttcccatcccttgcattccacaaagccgctggcggttttggaggcattagaatccttagcaggccaagaattccagtcccattccctgatccagctggtgattacactgtcctcattggagattggtacaagtccaaccacacgactttgaaagcccgtcttgataggggcaagaagctgccttttcccgatggaatccttatcaatggtcgcggacctaatggagtgtctttcaacgttgaacaaggaaagacttataggcttagaatatcaaacgtggggctgcaacactcccttaactttagaatccagaaccacaaaatgaagctggtagaagtggaaggaacgcacacccttcagaccatgtactcctctcttgacgttcatgtagggcaatcttattcggtgctggtaactgcagaccaacctgctcaagactattacattgtggtttccacacgattctcctacaaggtcctcaccaccactggagtgcttcgctatagcaactccgcaggcccagtatcaggcccaccccctggtggacctacaatccaaattgattggtctttgaaccaggcccgctcaattcggacaaaccttacagcaagtggaccgaggccaaacccgcaaggatcgtaccattacggtatgataaacacgacgaagacgatcatactggcgagttccgctggtcaagtaaatgggaaacaaagatacgcaattaacagcgtgtcttatgttgtcccagacacccctcttaagctcgccgattacttcaaaatctccggtgttttccgccccggaagcatatctgacagacccactggcggcggcatttaccttgacacatctgtgttacaagctgactacagaaattttgtcgagattgtcttccaaaacaacgagaacatcgttcagagctaccatcttgatggctactctttctttgtcgttggtatggatgggggacaatggacaactgctagcaggaaccagtacaatctccgagatgcagttgcacgttgcaccacacaggtataccccttttcatggactgctatttatattgcccttgacaatgtgggaatgtggaacttgaggtctgagttttgggcacgacaataccttgggcaacagttatatttgcgcgtttatacaacatcaacctcaatcagagacgagttccctgttccaaagaatgcaattctttgtggtagggcaagtgggagacacacgcgacccctttga

SEQ ID NO: 1228 - DNA, 504 bp, Glycine max var. Williams 82
atggccaccgtcacttctgcagcagtttctattccctcattcactggcctcaaggcaagcgcaggcaaagtgagtgccgccgcagttaaagtctcagctccccaagccacaaggttctgcggcatcaaggcttccctcaaagacgttggagtcgctgttgtggccactgctgcgagcgcagttctagctagcaacgccatggccattgaagtgttactgggcactgatgacgggtctctggttttctctcccaactctttctccgtggcccctggggaaaagatcgtgttcaagaacaacgcaggtttcccccacaacgttgtgttcgacgaggacgagattcctagcggcgtggatgcagggaaaatctccatgagcgaagaagaccttctcaatgcggctggtgagacttacagcgttactttggatgccaagggaacctacagtttctactgttcgcctcaccaaggagctggtatggtgggaaaagtcaccgttaattaa

SEQ ID NO: 1229 - DNA, 393 bp, Glycine max var. Williams 82
atgctcgattcggttcttctggcgcttttcttgccgtgccttggcatgagcggggtttttatcgtctacatgtgccttctatggtacgccactacccgccgcaaccaaccccccattgacggtcaaccggtgaagcccgtaactgataagggtctatccgctttggagttggagaagcttccaaaaatcaccggcaaagaactcgtcttgggcaccgaatgcgccgtctgcctcgacgagatcgagagcgagcaaccggctagagtggtccccggttgcaaccatggatttcatgtccaatgcgctgacacctggctctctaagcaccctatttgccccgtttgtaggaccaagctggacccgcaaatcttcacttcccaaagcccctgctga

SEQ ID NO: 1230 - DNA, 987 bp, Glycine max var. Williams 82
atggatcacttaacactagcatttccatttttactaacacttcatctattagcatcgggtgtattagcaacaacaacgttcacactggttaacaaatgcgactacacagtgtggccaggcattctctcaaacgcaggaatcgcgacgcttccaacaaccggtttcgttcttcaaaccgctgagtccaaaaccgtaaccgctccaacctcttggggcggccgtttctggggccgcactctctgcacccaagactccgccggaaaattctcctgcattaccggcgattgcggctccggcaagctcgaatgcgccggcagcggcgccacgccgccggcgaccttggccgagttcaccctcgacggcgccggaggcctggatttcttcgacgtgagcctcgtggacggttacaacgtggcgatgctggtggctccccagggtggctccggcgataactgcacgagcacggggtgtgctggggacctgaacggcgcgtgtccttcggagcttagggttacgagcgaggatgggaaacagagcgtggcgtgtaagagcgcgtgtgaggcgttcgggtcaccgcagtattgctgcagcggcgcgtatgggtcacccaacacttgcaagccttcgccttactcgcagattttcaagaacgcttgcccacgcgcctacagctacgcgtacgatgacaagaccagcacgtttacgtgcgcttctgctgcggcttacaccatcactttttgtccttctcctaacagtaatcccagtcagaaatcatggcaggggcaaaaccctaaatcagatagtagtggctcggcttcatcttcttctgggtcgccacaaattaacaacggcacaattgtgtatataggtagcatggatccaagtgaattatggtccgcaggtagtacccacgtgcgggaatctcaaaccattgcgggctttgtcagtatcaccatcgctgtttggctcttgtgccacctctgttaa

SEQ ID NO: 1231 - DNA, 1966 bp, Glycine max var. Williams 82
tcaaattcatctcatgtttccccaaagcatctgctgggaaatttgcctcccctgaatatatggtgccaagaaatgctatcctttgttttcccttgagccttggcactggcttctttccatcttgggtcccctgaaccgaaaagctgggtaaaatcattcgtattttggcggggatgatatcacattttcgtaaattttttgtcttttaataataattcctcctttttttttgcaaaattatttccctataaatagtaaatacccatcatccctcctcagttcacaaatcctttgtccttaaacacaatagaaggatttcgataatccttttatcttttccattctttattttttgcaatataccaacttatcctcgattcgattctcttaacatggatcacttaacactagcatttccatttttactaacacttcatctattagcatcgggtgtattagcaacaacaacgttcacactggttaacaaatgcgactacacagtgtggccaggcattctctcaaacgcaggaatcgcgacgcttccaacaaccggtttcgttcttcaaaccgctgagtccaaaaccgtaaccgctccaacctcttggggcggccgtttctggggccgcactctctgcacccaagactccgccggaaaattctcctgcattaccggcgattgcggctccggcaagctcgaatgcgccggcagcggcgccacgccgccggcgaccttggccgagttcaccctcgacggcgccggaggcctggatttcttcgacgtgagcctcgtggacggttacaacgtggcgatgctggtggctccccagggtggctccggcgataactgcacgagcacggggtgtgctggggacctgaacggcgcgtgtccttcggagcttagggttacgagcgaggatgggaaacagagcgtggcgtgtaagagcgcgtgtgaggcgttcgggtcaccgcagtattgctgcagcggcgcgtatgggtcacccaacacttgcaagccttcgccttactcgcagattttcaagaacgcttgcccacgcgcctacagctacgcgtacgatgacaagaccagcacgtttacgtgcgcttctgctgcggcttacaccatcactttttgtccttctcctaacagtaatcccagtcagaaatcatggcaggggcaaaaccctaaatcagatagtagtggctcggcttcatcttcttctgggtcgccacaaattaacaacggcacaattgtgtatataggtagcatggatccaagtgaattatggtccgcaggtagtacccacgtgcgggaatctcaaaccattgcgggctttgtcagtatcaccatcgctgtttggctcttgtgccacctctgttaatttgttcttaaaacaaactatgcccatgaactatgtttttgtgcctacaaacatggtgggaccctatccgccacttgtctaatctactttactacgtaggcatgcgtgtcattttaaatacatcatccatcgatggaactccaccaccttacaatgcaacacaagtgttctgtttttgtcctggaacccccaaaagcacaatcccatgttaaaagctatggctattgtggctcaatggtgaagagtgaacatcccccaaaattaataaacaacatactatatggaggaaaggtggtggggaaattaaatgatttctttccagcaggagagtaactttcttgcttagttgaataggtatagtatagaattctttgtgttatgggcgatgggattcatttatttgttcggaataatagacaacataatgaccacaaggacaaatggattcttattgaggagtacttattttactgccttctatcttcaataaatcactttgcatttttttctcttacactgataatcactttttcgctctctttccctatggaaaaatatggcattttatataaactgtaaaggagtac

SEQ ID NO: 1232 - DNA, 1590 bp, Glycine max var. Williams 82
atgggagaaaaatcgaggtccaaaggagggtgctgcggttggttcatcgcgttcgtcattctggctctcgtcgtcggtgccattgtttttaccgttaagaagaaatttagtcactccggttccgataagcctgctcctgttcccggtccccctggcgccgttgaccaaaaatactccactgcactcaaaaccgcaatgcaattcttcgatgttcagaaatctgggaggttagttgacaataaaatatcttggagagggaattcggctcttaaggatgggagccaagcgaagttggatctatcaaaagggatgtatgatgctggggataacatgaagtttggttttccgatggcttttacggccacggtgctgtcttggtccattctggaatatggagatcaaatggatcacgttggccagttagacgccgctcaggattcgctcaagtggatcactgattttctcatcaatgctcacccttctgagaatgttctttatattcaggtgggtgatcctgttgcagatcacaagtgttgggaaaaaccagaagccatgactgaggaacgtccactcttacaagtgaatgcatcttgtccaggatcagacattgcagctgaaactgcagcagccatggcctcagcttctttggtctttaaaaagactgatcctacatattcaagcactctcctcaagcatgcaaaacagttgtttacttttgctgacaagaatagaggatcttatagtgagaatatacccgaagttgcgacatattataactcaactggatatggtgatgagcttttatgggctgctagctggctctatcatgctacgggtgatgattcttaccttcagtttgtgactggccaagatggggaagactatgctcaatggggaagcccaacctggttcagttgggataacaagcttgctggaactcaggttttgttatctagattaagcttttttaaggcaaaggacatttcaaattcgtatagctctgggctccatagttacaggaaaactgctgaggctgtaatgtgtggtcttcttccggattctccaacagccacaaaaagcagaacagatgatggtcttatatgggtgagtcaatggaactctttgcaacatcctgttgcatctgcattcttagctgctgtttacagtgactatatgctaacatcgcagacaccaaaactaaaatgtgattcagattcctttaccccatcagatcttcgagactttgccaaatctcaggctgattacgtattgggcaagaatcctatgcatatgagttttctggtgggctatggagataaatacccacaatttgtgcatcataggggtgcttcaattcctgctgatgcaaaaactggctgcaaggatggcttccagtggcttgaatcatctgatcctaatcccaatgtagctactggagcacttgttggtggacccttcttaaatgagactttcattgattccaggaacaattccatgcaaacagaaccaagcacgtacaacagtgctgtcatagtcggtctcttatcaagtttagtcaccacgtcttctgccgttcaatcctttacctaa

SEQ ID NO: 1233 - DNA, 1677 bp, Glycine max var. Williams 82
atgcccacactaagttattcccaaaccacaccaatgtcgacctcttcaccactcttcctcctcctaattattattattattattcctatcctccactttcacgcggcggaagccgccgccaagggacagtggcagctcctccacaaaaacatcggcattgtcgccatgcacatgcagctcctccacaacgaccgcgtcatcatcttcgaccgcaccgactttggactctccaacctaaccctccccgacggaaggtgccgcaacaacccaaacgaaatggtcgtcaaaaccgactgcaccgcacactctgtcgaatacgacgtggtagccaacacattccgcgccctcttcgtccaaactaacgtctggtgctcctccgcttcagcctctcccgacggaacactagttcagaccggcggattcaacgacggcgaccgcgccgtcagaaccttcaccccgtgccgcacctgcgactggaaagaaattgacgatggactcgcggcacggagatggtacgccaccaatcacatcttgccagatgggcgacaaataattatcggcggaagaagacaattcaactacgagttttaccccaagacacaagctaagaacacttacagcttaccttttctggttcaaaccaacgacgctaacgctgaaaacaacctctacccgtttgtttttctaaacgtggatggcaacctttttatcttctcaaacaaccgcgctatcttattcgattacaataagaacagtgtggtgagaacgtaccctcaaataccaggtggagatccacggtgttatcctagcaccggttccgcggttttgcttcctttgaagaatcttcgagcacctaaagtggaggctgaggttttaatctgtggtggagccccgagaggagcttaccagaatgctttatcgggtaagtttgttccagcgttggaaacgtgcgctcggattaaaataaccgacccgaacccgaaatgggatatggaaacaatgcccggtgctagagtcatgagtgacatggttttactcccgaacggcgacgttttgattgttaatggagcagccgtagggactgcgggctgggaattgggccgtaacccgctactgagtccgtttctttataaaccaaataatcgggtcgggtcgagatttgaggttcaaacatcgtctgatattccgagaatgtaccactccagtgccgttttgcttcgtgacggtcgcgttctggttgctgggagcaaccctcacatttattacaaatttacgaatgttttgttcccaacggagttacggttggaagcgttttctccttggtatcttgagcctggattctctagcgtgcgtcccacaatagtgtttcctgcgtcccaaacaaaactcaagtacggtcagacgttgaggcttcggtttgaggtgatgagcgcgactttggttggggattcggtgtcggttacgatgctgtcgccgccatttaacacgcactcgttctccatgaatcagaggatgctggtgctggagccacacgatttgagtaaggttggggaatcgacgtacgaggttgaagttaccgcgccggtttccgctgttcttgcgccaccgggtttctatctgctgtttctggttcatcaagaaattccaagccagggtatttgggtccagatggtgtga

SEQ ID NO: 1234 - DNA, 750 bp, Glycine max var. Williams 82
atgctgaaatcgggcatgggaattgaggagagaaagcaagtgaagaagccagcacaagccagctcgagaaaagggtgtatgagagggaaaggaggtcccgagaatgctagttgcacctacaaaggtgtgaggcagagaacatggggaaaatgggttgctgaaatccgtgaacccaatcgaggtgctaggctctggctcgggacttttgagacctctcatgaagctgctttggcttatgatgctgctgcacgtaagctctatggctctgatgccaaactcaacttaccagagctctctatcaaatcacaatctcagtgtccaccaccaccttcttctgtttccaacaacactcagattcctcaaatggagaacctgcagcagcagattcaaaacaattacatggacatggctacatgttctaataatttcaacaacaacaccaataatccttcagaagtttccatggcctctcagcaggttggagttggagtaccaatttacaccagtgactccatcgtgtctcttcccttggacaccaatcccaagcctgtggagaatgatggtgactttcgtccttcgtggggtacaatgaatgagggtttgccagtttttgatgattctatttgggctgaagctgccatgtctctagattttcctcaaattgcagcagagactgcgatttattcatcgggtaacaacttggccgatgtgggtgtgtgggactctctgcaaaccccatggtgcatgtaa

SEQ ID NO: 1235 - DNA, 1328 bp, Glycine max var. Williams 82
ataacaaaagaagctattgaacttatctctcttctcacttctgttgttataagtaacttccctcatcattacaaaacaatcctccacaggtttcaaaatgctgaaatcgggcatgggaattgaggagagaaagcaagtgaagaagccagcacaagccagctcgagaaaagggtgtatgagagggaaaggaggtcccgagaatgctagttgcacctacaaaggtgtgaggcagagaacatggggaaaatgggttgctgaaatccgtgaacccaatcgaggtgctaggctctggctcgggacttttgagacctctcatgaagctgctttggcttatgatgctgctgcacgtaagctctatggctctgatgccaaactcaacttaccagagctctctatcaaatcacaatctcagtgtccaccaccaccttcttctgtttccaacaacactcagattcctcaaatggagaacctgcagcagcagattcaaaacaattacatggacatggctacatgttctaataatttcaacaacaacaccaataatccttcagaagtttccatggcctctcagcaggttggagttggagtaccaatttacaccagtgactccatcgtgtctcttcccttggacaccaatcccaagcctgtggagaatgatggtgactttcgtccttcgtggggtacaatgaatgagggtttgccagtttttgatgattctatttgggctgaagctgccatgtctctagattttcctcaaattgcagcagagactgcgatttattcatcgggtaacaacttggccgatgtgggtgtgtgggactctctgcaaaccccatggtgcatgtaatttcatcactttcaaaagggcaagggaaagccacaagctatagcttttcttctcatgccagctggactgatatctgcttgttaaaatatatagtgtatatataagaggggtaagtaagtactttgtaaagacatatatgatacccaaattaagactagtttagttaaataggatactatatcatatcatatatatggtgtctaccttggagtgtatggaaaaccatgacgtgcttattttcgcacgacgtcgttttctgccttatagtctatagtaatattatgttatatgtaaatattacttaatacgataagggatggtggtgatgctctatcgccccgatattaataagttgtgttagcttttgtgcagtttattgtgagttttatgtaagcatcttgtgagttatatatgtcaataagaatgtacaactagtagttgtgtagtaataatggtgtacatataaaatgtattattgtag

SEQ ID NO: 1236 - DNA, 1896 bp, Glycine max var. Williams 82
atgccatacaagtacgagaattatgacccctcattccccgaccaacccgtggttgacttatacctcccagtttgggccaggttacctgccttcaagtccaagccagctttcatttgggcacaagacttgcacaccttcactgctctcacctaccaacaacttaacgccacagttgatgtcatctcctctcgactactcgctccgttacaacgaggtgacactgttcttcttctttgctctcctggacttgacctagttgagctcatctttgcgtgtcaaagagctggtcttttgagcgttcccatcatccctcctcacccttcttttgctaaagaaaactatcaccatctcataagagccatttcgcagaccaaacccaaagctgccctagctcaccctcactacatatcaagcattagacaatacgtgtcttccccccacaacaacaagaaacttgctcacatgttacatagcatccactggatttccgtagacgaactcaaacatcatcatggtgttgttactttaaataatcttgattcactgacatacagtggttgcaaagcgaatgaagtttacttggttcagtacacgtctggtgccactggggttccaaaacccgtgcttgtcacagcgggctcagctgctcacaacgttagaacagcgagaaaagcttacgatcttcatcccaacagcacaatcgtttcgtggctgcctcagtatcatgattgtggtctcatgttcttgttgctgacccttgtatcaggagccacgtgtgttctcacttccccaacggcgttcatcaaacgccccagactctggcttgaactcttgtcgaaattcaaggccacgtgcactcccgttccctcgttcacattgccactcgtggtcaaacgaggaggaattcaccaaggagcttctacttcatccatcaacctttcaactttgaagaatctcataatcatcaacgagcccgtctatagagactcagtggaagaatttgttcacactttttctccatttgggttaagcccttcttctatctctccttcctacgggttagcagagaattgcacctttgtgtccactgcgtggaggagcgttaatagtgatcataatgatagtgttggtgcctattattcttcaagcttcccagattttcccactcacaacaagctcttaccagttgcaaggctcgaaaacgtggaagaggaagacgtggagattatggttgttgatgaagaaacgttggagccagctgaggatggtgttgaaggagaaatttgggttgcttcaccaagcaacgcttctgggtaccttggccaccctagtttaacaagagaagtgtttcatggaagactaagaaacatgattagcaagtgctttcttcgaactggggacagaggcatagtgaaaggagaaaaaagatatctttttgtcactggtcgctgtcaagacgttatggaactccgaaatggtcgaaaggttcatccacattacatagaaactgcggcttataacagttgccccaagttactgagaggaggttgtcttgcagcgtttaaagtttcatcaacggtggtggttgtggcagagatgcagaggatcgaaaagggtatagaaaaaggtgtgttgaagaggatttgcgagggagttaaagaagctgtttggaagaaagagaaggtggaggttggatgggtggttttggttgagagtgagtgtgttccgaaaaccacttctgggaaattgataagagggaaggctaaggagaagcttcttgcaggggaaatggtgattctgatgaagatgcggtttggaaaagatgttactgtttttaagagagcaaagaaggtaactggttcaattttatttgcagaagctcgtagctcattataa

SEQ ID NO: 1237 - DNA, 672 bp, Glycine max var. Williams 82
atgcttgaggcaatggaaagttcggtcaatggtgggtttacccatttgcagagctgtggagatagcagcgaagaagagttatcggtgcttcctcgtcacaccaaagtggtcgtaacaggaaataaccgcaccaaatcggtgctcgttggtcttcaaggtgttgttaagaaagccgttggactaggtggatggcattggctggttcttacaaatggtattgaagtgaagctacaaaggaatgctcttagcgtgattgaagcacccaccggtaacgaggaagatgatgaccttgagtttgaaaatatgccgtggaatggatcagatttggcatcggacgatacacagaagttccacaagccgaggcatagaatgcatagaacattgggatcatctcacaagaccatgagtaggtcattctctggcgattcacagtcaaagggctccgtttctatgcctcatgggtccacgaaggtagacttgagcaaacttgaaatggctgcattgtggagatattggcgacattttaatctagtggatgcggtcccaaacccatcaaaagagcagctagtagatgttgttcagaggcatttcatgtcgcagcaaatggacgaattgcaggtgattgtgggattcgtccaagctgcaaagaggcttaagactgtgtgcaaatga

SEQ ID NO: 1238 - DNA, 369 bp, Glycine max var. Williams 82
atggctatggccacagctgtcgtgtgtcctcagaacatcaccggagccatcgtgggctcacccaagaagagagtggtgcacgtgagagggttaaattcatttgggggactgaaggctagcaatggtgttgtctctttgggacttcctatgagcactgagaagtgctttgctaaggttgtgagttcagtgaaagcagcaacatcaaatggaaaaggaaagggtggaggggcactctcctccacgtgcaacgccgcaggtgagatattcacgattgctgctatcatcaatggacttgttcttgtcggggtcgcagttgggtttgtgctcctgcgagttgaagcatgggtcgaggagtccgaggcagaatga

SEQ ID NO: 1239 - DNA, 904 bp, Glycine max var. Williams 82
tgaattgagaataaaataataggtgagacgcggagttgtgacccaccattccatttttgttaagcatcaaaatctgatcttcagttgtcattcgtgggctacgagccaatcagtttgagagtcccttatccaaataaatacccacttttcgtgccattagattttccgtcgttgaaaatcccttcctatccacaggtaagtttggttgatcaatattttttttttttttgctgggtagcagtgaggatcaaattcaaatggctatggccacagctgtcgtgtgtcctcagaacatcaccggagccatcgtgggctcacccaagaagagagtggtgcacgtgagagggttaaattcatttgggggactgaaggctagcaatggtgttgtctctttgggacttcctatgagcactgagaagtgctttgctaaggttgtgagttcagtgaaagcagcaacatcaaatggaaaaggaaagggtggaggggcactctcctccacgtgcaacgccgcaggtgagatattcacgattgctgctatcatcaatggacttgttcttgtcggggtcgcagttgggtttgtgctcctgcgagttgaagcatgggtcgaggagtccgaggcagaatgaaactttgttgaatcagataagcaagtgattaattaatatccagaaagttgtatgtttctatattgatgctctgcttgttcttgttttcataatgacttgtatatttacctgtgaagtttcatcattttcttgttttgttcataattggcatgagctgctgcattgaacctagaagtgagtctctggctctctccaacgagaaatcatatgtaatgtaattcttgcacacccattaaatatgagaaagaagtatacatcaaataaattaatttttgaaa

SEQ ID NO: 1240 - DNA, 888 bp, Glycine max var. Williams 82
atggaaacacatcatcaaccccaaaagaacaaagaaaacgatgtgcaaaagaaaactgaagaaggagtagtagcaaagccaccttcaccatcctcttccccttctcacgaattctccttcacaatctctctccactctacttctaacaccacaatccaagacaaatccaaaaccccaccttctcttgcagttgatctatctccagcagatgacattttcttccatggtcacttgcttcctctacacctcttatctcacttctcttcttcacctcgcttttccaccaactccgtggacagtttcacactccccatcagagagttcttagaagatgaaaaacgcaacagcagcaacaggagcaacatcaccatagatagcattaccagctgcaacaacaaagatgactactacaacaatagagtcacaaaggaagaaagtaagtccaagcctagtttctcattgtttggtttatcaaaggggcgtaaagggtgtcaagttagagataacaaagaagataaagaggataacattaagcacaagaagaaactagggtatgatgtgatgcatgcactaaagaagtacttgagaatggtgcagccactagtgcttttcagagggagaagagaaaagggtcggttccatggacaagcttattctcattcggggaatttgattaggaaaaacaagcctgaagtgagaggaagaagaggtgagtattcagcaccagcttctatgagaacttctccaacaaacagtggtcttcttcttgcaactactgctcttcctcctgcgaatgacagcaccatggaagagttgcaagcggccattcaagctgcaattgctcactgcaaaaattctattgccaaagaagagaagctcagttgctga

SEQ ID NO: 1241 - DNA, 237 bp, Glycine max var. Williams 82
atgatgttgtcttgccaatacaacagcttccatgaaacctcccaaattcactccctctcttatctcaaatgcggaacttcaacacatcttcccctccatacccttcgctgtggacaacgcaccggagccaccgctcctgcacacggcggcgactttgttccggcgcgcgagcgggtgacgaatgatgttgtgcgtgtggatccgaggacctcgacccaattggcgaagccggcctag

SEQ ID NO: 1242 - DNA, 198 bp, Glycine max var. Williams 82
atgcgagataggcggagaacagggtggctctatctcaaagtgaggttgtcacttgtcacagtcatgggaaagttggagtttaggatcagttgcgtactttcgtttgatacacattgtaagagtagggcctcagccagctcttcatttttttttcctttagttttccacttagtattcttgtacaacacatttccttaa

SEQ ID NO: 1243 - DNA, 210 bp, Glycine max var. Williams 82
atgcaacaagacaccgccacgtggcaaaccaagttgcacccgagcagcgcaatctggcagttgagcacgagtggcaggcactcgccttgcgccgccacgtactgcggtccagaacctgtaaccaaacataacggagaacgggagcgtggtgaagaggatcgcgagaactccagccacaggaaagacatgaacgcggaaatggcgtggtag

SEQ ID NO: 1244 - DNA, 972 bp, Glycine max var. Williams 82
atggaaagtggattacctttgcttaattatctcttgcagcagactctcagaaccatttgcacttctcccaattcttccactccttctaagtgggtatatgctgtcttctggaggatattacctcgcaactttcctccaccaaggtgggaatttggaggaactgctcttgatctctccaaaggaaataaaaggaactggatccttgtctgggaagatgggttctgcgattttaacgaatgcgagcaaaggaagagtggtagtggttacttgaacggtagatttggagctgacgtattcttcaaaatgtcgcatgaggtttacaattatggagagggactcgtgggaaaagttgccgcagataatagtcacaaatgggtttacaatgagagtcacaatgagtgtgaatctagctatattgcttcatggaatgcttcagtcgaacctcaaccaaaggcgtgggagtttcagttcaattcaggcattcagagtatagtcataatcgccgtcagagaaggcgtagtgcaattgggttcttttaacaagatatcagaggacctgaatctggtgatcagcatacagaggcaattcagctaccttcagagcatacctggtgtgtttggtattcaaagaccatacctacctcttcaacatccatacattgtgaagccaagtttcatagaaaacaatgcaatgactctatatgatatggggtggaacaccaaccctcagaatggagcaccaggcccatctctttgttcaggttctccttctctaccactaccaaccatgccctgtagttttggagctttgctatcaaagttaccatctggaatcccaccctataattccactcaagtccttgatgcagggacacaaagcaccattgagagagtgaagatagaggattgtgaatttcatcctacccttgatgacgatcacaaaggaagaaaggtcggttccctgaacaagtag

SEQ ID NO: 1245 - DNA, 1399 bp, Glycine max var. Williams 82
ttcacccccacattggtggctgcaagaggccagtgggtaccatcctcacttttgtttgcattttgccttttaaatttaatcttgttgcccccatttggccattcatttccccactctgtttactccgtgtccgcagaagatggaaagtggattacctttgcttaattatctcttgcagcagactctcagaaccatttgcacttctcccaattcttccactccttctaagtgggtatatgctgtcttctggaggatattacctcgcaactttcctccaccaaggtgggaatttggaggaactgctcttgatctctccaaaggaaataaaaggaactggatccttgtctgggaagatgggttctgcgattttaacgaatgcgagcaaaggaagagtggtagtggttacttgaacggtagatttggagctgacgtattcttcaaaatgtcgcatgaggtttacaattatggagagggactcgtgggaaaagttgccgcagataatagtcacaaatgggtttacaatgagagtcacaatgagtgtgaatctagctatattgcttcatggaatgcttcagtcgaacctcaaccaaaggcgtgggagtttcagttcaattcaggcattcagagtatagtcataatcgccgtcagagaaggcgtagtgcaattgggttcttttaacaagatatcagaggacctgaatctggtgatcagcatacagaggcaattcagctaccttcagagcatacctggtgtgtttggtattcaaagaccatacctacctcttcaacatccatacattgtgaagccaagtttcatagaaaacaatgcaatgactctatatgatatggggtggaacaccaaccctcagaatggagcaccaggcccatctctttgttcaggttctccttctctaccactaccaaccatgccctgtagttttggagctttgctatcaaagttaccatctggaatcccaccctataattccactcaagtccttgatgcagggacacaaagcaccattgagagagtgaagatagaggattgtgaatttcatcctacccttgatgacgatcacaaaggaagaaaggtcggttccctgaacaagtagcatggatttggaattggaagattaattaattaagagacaggaaccactttgaccataatgactcctaaatcatagtcagtatgttaagaaatggttagttatttattttctttcacttggccacaatgtgtattgtggtatgtttattggtggccgacaacctatcaatcatagcgatcactgttactgtttctttctgcgcgcatttatgtaatgatcaatgcaatgcagacattattatctagattagaacaaaactacattcagctttgcttcttttttcttctg

SEQ ID NO: 1246 - DNA, 1089 bp, Glycine max var. Williams 82
atggcttaccaccatcatgaccacaccaaccggaaatcccttttggacaccctatactgctccgaagcagaggaggactacggtcatttcctaaacaactcctcccctgcgtcccctcctttcttgctccaaagcgacatgttttcggacgaacaagagttgacatcgctgctggggaaagaacaccacaaccctctaagcacctgtctccaaaccaaccctgccttggactttgctcgccgggaagccgtggagtggatgctcaaagtcaactcccattactctttctctgctctcaccgctgttctttcggtcaactactttgaccgttttctcttcagcttccgctttcagaatgacaagccatggatggttcagctcgctgccgtcgcttgcctctccatcgctgccaaagttgaggagacgcacgttccctttcttattgaccttcaacaagtggatgagagtagatacttgtttgaagccaaaactattaaaaagatggagattttggtcctttccactcttggatggaagatgaaccccccaacccctctctcgtttcttgattacttcacaagaaggcttggatcgaaggatcatctctgctgggagttcctcagcaagtctcaaggcgttcttctctccctccttggagattcgaggtttatgagttatctaccttctgtattggcaactgctacgatgatgcacgttgtgaaaagcgtggagcctggtctagaagctgaatacaagagccagctctttggtattctcagaatcgacaaggagaagcctgagaaggtgaattcttgttgcaagctgttgttggaggtgtggtcagggtacgaggaggaggagcaggagcaggggaagcaatgcatgaaacgcaagtttggaatagggtcgattcctggaagcccaaacggcgtgatggatgtgtcgtttagctgtgatagtagctccaatgactcttcggtctcttcctcaccggaacctttgtcaaagaagagtagaagtgaagaacaagagcagcttcttctaccaaacccaaaccattccaactcagattttctccatcgcctttaa

SEQ ID NO: 1247 - DNA, 984 bp, Glycine max var. Williams 82
atggggggttgggctatagcggtgcatggtggcgcgggtgtggaccctaatcttccaccagagcgtcaagagcaagccaaacaactcctcactcgcgttctcaatcttggcatctctgcccttcgttccgatgcttctgccctcgacgtcgtcgaacttgtcgtacgggaactggaaacagatcccctgttcaactctggtcgcggagcagctctgacagaaaagggaacagcggaattggaagcaagcatcatggatggttacaagagacgatgcggcgccgtttcgggcgtcaccaccgtcaaaaatcctatctcactcgctcgtcttgtcatggaaaagtcaccccactcctacctcgcctttaacggcgctgaagatttcgccagacaacagggagtggagattgtggagaacgaatacttcatcactcctgaaaatgttggtatgctgaaactggcaaaggaagcaaacacaatcctgtttgattatagggtgccattgcaaaatggatacgataactgcggtgtggaggttgagaatccattgcaaatgaatggactgccaataagcgtgtacgcgccggagacggtggggtgcgtggtggtggacagcgagggacggtgcgcggctgccacgtcgacaggagggttgatgaacaagaagtgcggtaggatcggtgactcaccactaataggtgcagggacttacgcgtgtaaggtgtgtggggtttcgtgcactggtgaaggagaagctataatacgtggcacgctggcgcgtgaggtggcagcggtgatggaatataaaggactgggacttgaggaggcagtggagtatgtgatggagcaccgtttggatggagggaaggcagggttgatcgccgtgtcaagttctggtgaggtggcctatggattcaactctaatgcaatgttcagggcatgcgccacccaggatggattcatggaggttggaatctgggaataa

SEQ ID NO: 1248 - DNA, 1269 bp, Glycine max var. Williams 82
ccaaccaagttcctttcaactaggcaagaaatatcacagagcagagacaagttataattataatggggggttgggctatagcggtgcatggtggcgcgggtgtggaccctaatcttccaccagagcgtcaagagcaagccaaacaactcctcactcgcgttctcaatcttggcatctctgcccttcgttccgatgcttctgccctcgacgtcgtcgaacttgtcgtacgggaactggaaacagatcccctgttcaactctggtcgcggagcagctctgacagaaaagggaacagcggaattggaagcaagcatcatggatggttacaagagacgatgcggcgccgtttcgggcgtcaccaccgtcaaaaatcctatctcactcgctcgtcttgtcatggaaaagtcaccccactcctacctcgcctttaacggcgctgaagatttcgccagacaacagggagtggagattgtggagaacgaatacttcatcactcctgaaaatgttggtatgctgaaactggcaaaggaagcaaacacaatcctgtttgattatagggtgccattgcaaaatggatacgataactgcggtgtggaggttgagaatccattgcaaatgaatggactgccaataagcgtgtacgcgccggagacggtggggtgcgtggtggtggacagcgagggacggtgcgcggctgccacgtcgacaggagggttgatgaacaagaagtgcggtaggatcggtgactcaccactaataggtgcagggacttacgcgtgtaaggtgtgtggggtttcgtgcactggtgaaggagaagctataatacgtggcacgctggcgcgtgaggtggcagcggtgatggaatataaaggactgggacttgaggaggcagtggagtatgtgatggagcaccgtttggatggagggaaggcagggttgatcgccgtgtcaagttctggtgaggtggcctatggattcaactctaatgcaatgttcagggcatgcgccacccaggatggattcatggaggttggaatctgggaataaataattccttgcttcataaaaatgtgaaataattctagtagtcctttctctctttctctgcaaaggaattcccctcagtgtgctcttatccaacaaccaccaataaaaacaaaatacaccaaataaactttttagaatttctatatttgtcacaagttattagtgtattttagccaaaaatatctcacaaagatttttcatttgccatatatcagtctattct

SEQ ID NO: 1249 - DNA, 414 bp, Glycine max var. Williams 82
atggcagaacgaagggttttcactctctcacaggttgcccaacataaatccaacaaagactgttggcttgtgatcaatggcagggtgttggacgtgacaaagttcttggaggaacacccgggaggggaagaggtgattctagaggtagctgggaaggatgcgacaaaggagtttgatgttattggacacagcaaagcagcgcaaaacatggtcctaaagtaccaagtgggtgtcctccaaggtgccacagttcaagaggtgaaggatgttgtcgacaaggaatccgacaccaaagagatgagtgccttcgtgatcaaagagagtgcaaggtctaagtccctcgttttttacgagttctttgttccacttcttgtagctgcactctattttggttaccgatgtctcacttactag

SEQ ID NO: 1250 - DNA, 1389 bp, Glycine max var. Williams 82
atgcaatgttccaaaaaggagcaaaacactcgaggttgtataaatggctattcagattgtagagctggcgttgcccgttactcctcctatctatcgtgcgtatctctttctctctccatttttatttatatatttctctccattatttggtgtgcatgctctagacacacacacaccccaccaccaccaacactgagttttagcagaaggatagagagcagaatgattcaaagaactgtgtcctttcccagtttaaggaaattgcttcttcgggctggttgttctaaatctgcttcgtccaagatcggaacttacaattgctttgcttctcagtcctcccctctaccgagccacaaccctagttaccgtgatgacgagtatgctgatgtggactgggacagtcttggatttggactgatgcccactgattatatgtatattactaaatgttgtgagggccaaaattttggacaaggacaactcagtcgttatgggaacattgaactcagtccatcagctggtgtcctaaattatggtcagggtttattcgaaggcacgaaagcatacagaaaagaaaatgggggcttgctactcttccgtccagaagaaaatgccattcgcatgaagactggtgcccaaagaatgtgcatggcatcgccttccattgatcattttgttgatgctttgaagcaaactgtcttggctaataagcgttgggttcctccaccgggcaaaggatccttgtaccttaggcctctgctcctaggaactggtccggttttgggtttggctcctgcacctgaatacacattcctcatatttgcttcccctgttcgcaactatttcaaggagggctctgctccactcaacttgtacgtggaggaaaactttgaccgtgcttctagccgcggcactggaaacgttaaaaccatttccaattatgcaccggtcttgatggcacaaattcaagccaagaaaagaggattttcggatgtgctataccttgattcagacaccaagaaaaatctcgaggaggtctcttcttgtaacatttttattgccaagggcaaatgcatctcaacacctgctactaatggaactattctttccggaattacccgaaaaagtgtcattgaaattgctcgcgatcatggctatcaggtagaagagcgtgctgttgccgtggatgaattgattgaggctgatgaagttttctgcacaggaactgcggtcggtgttgctccagtagggagtatcacataccaggataaaaggatggaatatataacaggttctggaaccatttgtcaagagctgaacaataccatttcaggaattcaaacgggtactattgaagataagaagggatggattgtcgaagttgattaa

SEQ ID NO: 1251 - DNA, 1649 bp, Glycine max var. Williams 82
ttaatataaaattgaaaataatgttttctatatgcaatgttccaaaaaggagcaaaacactcgaggttgtataaatggctattcagattgtagagctggcgttgcccgttactcctcctatctatcgtgcgtatctctttctctctccatttttatttatatatttctctccattatttggtgtgcatgctctagacacacacacaccccaccaccaccaacactgagttttagcagaaggatagagagcagaatgattcaaagaactgtgtcctttcccagtttaaggaaattgcttcttcgggctggttgttctaaatctgcttcgtccaagatcggaacttacaattgctttgcttctcagtcctcccctctaccgagccacaaccctagttaccgtgatgacgagtatgctgatgtggactgggacagtcttggatttggactgatgcccactgattatatgtatattactaaatgttgtgagggccaaaattttggacaaggacaactcagtcgttatgggaacattgaactcagtccatcagctggtgtcctaaattatggtcagggtttattcgaaggcacgaaagcatacagaaaagaaaatgggggcttgctactcttccgtccagaagaaaatgccattcgcatgaagactggtgcccaaagaatgtgcatggcatcgccttccattgatcattttgttgatgctttgaagcaaactgtcttggctaataagcgttgggttcctccaccgggcaaaggatccttgtaccttaggcctctgctcctaggaactggtccggttttgggtttggctcctgcacctgaatacacattcctcatatttgcttcccctgttcgcaactatttcaaggagggctctgctccactcaacttgtacgtggaggaaaactttgaccgtgcttctagccgcggcactggaaacgttaaaaccatttccaattatgcaccggtcttgatggcacaaattcaagccaagaaaagaggattttcggatgtgctataccttgattcagacaccaagaaaaatctcgaggaggtctcttcttgtaacatttttattgccaagggcaaatgcatctcaacacctgctactaatggaactattctttccggaattacccgaaaaagtgtcattgaaattgctcgcgatcatggctatcaggtagaagagcgtgctgttgccgtggatgaattgattgaggctgatgaagttttctgcacaggaactgcggtcggtgttgctccagtagggagtatcacataccaggataaaaggatggaatatataacaggttctggaaccatttgtcaagagctgaacaataccatttcaggaattcaaacgggtactattgaagataagaagggatggattgtcgaagttgattaacaacgagtgtttataatttataattgtttattccaatgttattaaaccaattttaaactgtaataatgattgcccatacgaaaaatggcgcatatactgttgttcgttatctaaaagcatgttatatgtgtaaaatgttttttttggatacatatatatgtaaaatgatgtgcacattataaattataatgattatataaagtaaaggacttgcaaatcatattccgag

SEQ ID NO: 1252 - DNA, 1493 bp, Glycine max var. Williams 82
ttaatataaaattgaaaataatgttttctatatgcaatgttccaaaaaggagcaaaacactcgaggttgtataaatggctattcagattgtagagctggcgttgcccgttactcctcctatctatctttaaggaaattgcttcttcgggctggttgttctaaatctgcttcgtccaagatcggaacttacaattgctttgcttctcagtcctcccctctaccgagccacaaccctagttaccgtgatgacgagtatgctgatgtggactgggacagtcttggatttggactgatgcccactgattatatgtatattactaaatgttgtgagggccaaaattttggacaaggacaactcagtcgttatgggaacattgaactcagtccatcagctggtgtcctaaattatggtcagggtttattcgaaggcacgaaagcatacagaaaagaaaatgggggcttgctactcttccgtccagaagaaaatgccattcgcatgaagactggtgcccaaagaatgtgcatggcatcgccttccattgatcattttgttgatgctttgaagcaaactgtcttggctaataagcgttgggttcctccaccgggcaaaggatccttgtaccttaggcctctgctcctaggaactggtccggttttgggtttggctcctgcacctgaatacacattcctcatatttgcttcccctgttcgcaactatttcaaggagggctctgctccactcaacttgtacgtggaggaaaactttgaccgtgcttctagccgcggcactggaaacgttaaaaccatttccaattatgcaccggtcttgatggcacaaattcaagccaagaaaagaggattttcggatgtgctataccttgattcagacaccaagaaaaatctcgaggaggtctcttcttgtaacatttttattgccaagggcaaatgcatctcaacacctgctactaatggaactattctttccggaattacccgaaaaagtgtcattgaaattgctcgcgatcatggctatcaggtagaagagcgtgctgttgccgtggatgaattgattgaggctgatgaagttttctgcacaggaactgcggtcggtgttgctccagtagggagtatcacataccaggataaaaggatggaatatataacaggttctggaaccatttgtcaagagctgaacaataccatttcaggaattcaaacgggtactattgaagataagaagggatggattgtcgaagttgattaacaacgagtgtttataatttataattgtttattccaatgttattaaaccaattttaaactgtaataatgattgcccatacgaaaaatggcgcatatactgttgttcgttatctaaaagcatgttatatgtgtaaaatgttttttttggatacatatatatgtaaaatgatgtgcacattataaattataatgattatataaagtaaaggacttgcaaatcatattccgag

SEQ ID NO: 1253 - DNA, 1104 bp, Glycine max var. Williams 82
gtattgttgttgaaatctgaaaacagggtttattcgaaggcacgaaagcatacagaaaagaaaatgggggcttgctactcttccgtccagaagaaaatgccattcgcatgaagactggtgcccaaagaatgtgcatggcatcgccttccattgatcattttgttgatgctttgaagcaaactgtcttggctaataagcgttgggttcctccaccgggcaaaggatccttgtaccttaggcctctgctcctaggaactggtccggttttgggtttggctcctgcacctgaatacacattcctcatatttgcttcccctgttcgcaactatttcaaggagggctctgctccactcaacttgtacgtggaggaaaactttgaccgtgcttctagccgcggcactggaaacgttaaaaccatttccaattatgcaccggtcttgatggcacaaattcaagccaagaaaagaggattttcggatgtgctataccttgattcagacaccaagaaaaatctcgaggaggtctcttcttgtaacatttttattgccaagggcaaatgcatctcaacacctgctactaatggaactattctttccggaattacccgaaaaagtgtcattgaaattgctcgcgatcatggctatcaggtagaagagcgtgctgttgccgtggatgaattgattgaggctgatgaagttttctgcacaggaactgcggtcggtgttgctccagtagggagtatcacataccaggataaaaggatggaatatataacaggttctggaaccatttgtcaagagctgaacaataccatttcaggaattcaaacgggtactattgaagataagaagggatggattgtcgaagttgattaacaacgagtgtttataatttataattgtttattccaatgttattaaaccaattttaaactgtaataatgattgcccatacgaaaaatggcgcatatactgttgttcgttatctaaaagcatgttatatgtgtaaaatgttttttttggatacatatatatgtaaaatgatgtgcacattataaattataatgattatataaagtaaaggacttgcaaatcatattccgag

SEQ ID NO: 1254 - DNA, 1353 bp, Glycine max var. Williams 82
atgatgggtgcctcaggaaaatgggtaaaggcattaatcggacttaagaaaccagacaaagaggagcatgtgaaagagggtggtggtaagagcaagaagtggaggctatggaggagttcttctggggacacgggggtttcttggaagggtttcaaaggaggaaaccacagcgcggtagcttcttctgaagtggggtctgattcttctccacatgttgtagcagcagcagcagcaacaggcgcggctttcacagcagcagtagccactgtggttcgagctccacctaaagatttcagactcgtcaagcaagaatgggccgctataagaatccaaactgctttccgcgccctcttggcaagaagggctttgagggcattgaagggagtggtgaggattcaagctcttgttcgggggagacaggtgaggaagcaggctgcggtgacattgaggtgcatgcaggccttggttcgtgttcaggcccgagttagagcccgtcgtgtcaggatgtccatagagggccaaactgtgcagaacttgctcaatgaaagacgcagtaagcttgatcttttgaagcaagctgaggaaggatggtgtgacagcagaggaacgttggaagatgttaagacaaagatacaaatgaggcaagaaggagctttcaaaagggaaagagcaatggcttactctcttgctcacaaacaatgcagatcaacaccaagccctaatccacgaacacgtgcctcatttacctctcttaagagtcatgagatgaacaaagctaactgtgggtggagttggttggagcgttggatggcagcaaagccttgggagagtagattgatggaacaatcacaatctcaggctgaagccttagataaaaccccacctccaaagaagtttgtggaatcctttgtgagctctaattccaaacaaagcatggtcaaagtcaagaagaacaacgtcacaacaaggatttcagctaggccaccccttgttgggcaagctactcgctcatcctcaagtccaagttctgagtttcgatacgatgagagttctgcatcatcttccatttgtacatccacaacaccaatgtctgggaacacttgtgacaggactgaggatagtaatggtaatgctgttgttgctaggcctaattacatgaacctgactcagtccacaaaggcaaagcaaaagacaagtggcaatcatgtatataatagagctcagaggcagcaatccatggatgggtttcaattcctcaagagggcagcggttttctccactgcggattctgacccttcaatcaacttttctaggccacttcacttggacaagagttcagtgatggcacggtga

SEQ ID NO: 1255 - DNA, 1341 bp, Glycine max var. Williams 82
atgaatctgcgtgagagccctcgtactcaacagaaactttctcggcaatcatcgaagtcaaacagaggggtgaagcaagaggcagctgctagccctctctcgagtggatgctgtcgaggcttgagcagcgtaaggactgtgtcatccaccgcaccaacctcgcagcaacacgatcagctccaacagcgttatgaaaaattggaagcgaaggtagcaggtttggaaaaagaagtgcaaaggcagacagaacttcgagtcatgtataggaaaagaatggaaagaacacaagattacttaaaatactgtctccaaatagcacaggaaaatggaatcttggacctcattgtccactccaaagttgaactctcacagtctcccctctctctatataccgccaactccactcctcccatccccactccttcccaccaccccaatctaacggccatcattgatcaagccaaaatcaatggatggtatatcaacccaagtgagattgagttggtagaaaaaatagggcaaggaaccaccgcagacattcacaaagggacatggcgtggatttgatgtggcggtgaagtgtatgtccactgcattcttccgcacaaacgaaaacggtgtcgtattcttcgctcaggagctcgaaaccctctcaaggcagcgccaccggttcgtgctccacctcatgggtgcatgtcttgagcctcctcatcatgcatggatagttactgagtatctcaacaccacgctcaaggagtggctacatgggcctgccaaaaggcccaaaaacagatccgtcccacttcctcccttcaaagacagactcatacgggccttggaaacagcccaagccatgcagtatctccacgaccaaaagcccaaagtggttcaccgtgacttgaagcccagcaacatcttcctggacgatgcattgcatgttagggttgcggattttggacatgcacggttcttgggtgacgacgaaatggccctcaccggagaaacaggaacatacgtgtatatggctccagaggtaatcagatgtgagccctataatgaaaaatgtgatgtatacagttttggaatcatactgaacgagctacttactggaaaatacccttatattgagacacaatttggtcccgccaagattgccatggaagttgtggagggcaagctaaggcctttgcttccatcaagggacgatggtgaccaactgggagagctaattgacttaatatgtctttgctgggatggaaatccatccactcgaccatccttcgcaacaattagtcgtagcctcaaaagctatgccaagagggtcctccaaatttctagttag

SEQ ID NO: 1256 - DNA, 1448 bp, Glycine max var. Williams 82
aatttggaagaacagacatacaaaactacgtacattaaaccgacatgaatctgcgtgagagccctcgtactcaacagaaactttctcggcaatcatcgaagtcaaacagaggggtgaagcaagaggcagctgctagccctctctcgagtggatgctgtcgaggcttgagcagcgtaaggactgtgtcatccaccgcaccaacctcgcagcaacacgatcagctccaacagcgttatgaaaaattggaagcgaaggtagcaggtttggaaaaagaagtgcaaaggcagacagaacttcgagtcatgtataggaaaagaatggaaagaacacaagattacttaaaatactgtctccaaatagcacaggaaaatggaatcttggacctcattgtccactccaaagttgaactctcacagtctcccctctctctatataccgccaactccactcctcccatccccactccttcccaccaccccaatctaacggccatcattgatcaagccaaaatcaatggatggtatatcaacccaagtgagattgagttggtagaaaaaatagggcaaggaaccaccgcagacattcacaaagggacatggcgtggatttgatgtggcggtgaagtgtatgtccactgcattcttccgcacaaacgaaaacggtgtcgtattcttcgctcaggagctcgaaaccctctcaaggcagcgccaccggttcgtgctccacctcatgggtgcatgtcttgagcctcctcatcatgcatggatagttactgagtatctcaacaccacgctcaaggagtggctacatgggcctgccaaaaggcccaaaaacagatccgtcccacttcctcccttcaaagacagactcatacgggccttggaaacagcccaagccatgcagtatctccacgaccaaaagcccaaagtggttcaccgtgacttgaagcccagcaacatcttcctggacgatgcattgcatgttagggttgcggattttggacatgcacggttcttgggtgacgacgaaatggccctcaccggagaaacaggaacatacgtgtatatggctccagaggtaatcagatgtgagccctataatgaaaaatgtgatgtatacagttttggaatcatactgaacgagctacttactggaaaatacccttatattgagacacaatttggtcccgccaagattgccatggaagttgtggagggcaagctaaggcctttgcttccatcaagggacgatggtgaccaactgggagagctaattgacttaatatgtctttgctgggatggaaatccatccactcgaccatccttcgcaacaattagtcgtagcctcaaaagctatgccaagagggtcctccaaatttctagttagtgtatcgaacatcaaatcaattgtttactaattcgaaaagcagtactagtataattaagcaac

SEQ ID NO: 1257 - DNA, 864 bp, Glycine max var. Williams 82
atgcagcagcctcactacgatatggtggccaacaccttttatgaggaactctcacttgacgcttttaactcatcatccagtttatgcccaaaccacagtgctcaccaatactatccacaatttctccacaacccacgacacaaacagcgacacgagtatcaacattcttatcaattgttccaacaacacccaaatcaatttcatccatcaccacaacaccaacaacaaccccaatatctgggagcacttaattgtcaccagccccaagaagaatccacaaccaccgtgtcgttttggaaagcattcaacacggtgctctctgacgcaaatggaaaaaaccaagagggaaacgaaaactttggggaacttgaagctgtatacataaacgctcgtaataaaaaaaagactgattcagcccttgccgttgaaaacacatgtaatgtggcaaatgagtgtcaattgttagcgacgaaaacaactggggttgatggagtacggacgaagaaaggtaggaaaaggaggagaaagaagcaagtggaagaagaaatgggtttgatgggttcatttttcaagaggttggcgaagcgtgtgattaagcaccaggaggttcttcagaacaaattgctggaagctattgagagaatggagaaagagagagcggaatgggaagaaggttggagggttcgagaaagggaaattcacgacagagaagcgattgtgaaagcgcgtgagcgagatcttgcttctaagagagactcttccattgtttccaacttagagaagataacaggtcaaaaaagcttcgttcttgtttcttctgggaagagtagtcacgagcaattatctacaatacatgaatattga

SEQ ID NO: 1258 - DNA, 684 bp, Glycine max var. Williams 82
atggcaaaaaccatgactatgtggtttctgttggtcactctttccttcgtttatgctgctgccactgctaatactcaaatcaaagttactaacaaccctgcggacaagttggtagttgcgattaacgaaaacagaactgctcacaaggtgtcagccttaacggacaacccggggcttgcgtgtattgctctacaatacattaaggcataccagggtgaatgtgatgctgtgggtggatctgatggcaagaaacctcctgaatctcgatttgctgaagtttttgctccaaactgtggtgttgaggcatcaactcttgctcctataacgggtcgtttcctggcgtgccagactaagtatgtccatgcccctgaggcattttctgatatcctcataaggaaccaacagagcttagacatactctacaataataatcacactcaggttggtgctgctgtcacaggtactgatgggggctctccttacttctggtgtgtgttgtttagcagtggcaaacccaacaaaacatttacttttgagagtggtgtggctaaaataacaaaacccggttgctttagtggagctaatgatgagtgcagtggtgctagttattggtcaccactcaatgagatgtgggtatttgccacttcgcttttgattgcaatggggtttgctttaacattatga

SEQ ID NO: 1259 - DNA, 2955 bp, Glycine max var. Williams 82
atggcgtttcggtttggactactccttctggtttctcttctttgtttggattcaattagttccgtgaattcacacgtcggagaaacgttgttggagataaagaagtggttcagggatgtggataacgtcctgtatgactggacagactcaacttcttctgattattgtgtttggagaggtgttacgtgtgataatgtcactttcaacgtggttgcactcaatctttcggggttgaatcttgagggcgaaatttcacctgcaatagggagacttaacagcttgatctctattgatttcaaggaaaaccgtttatctggccagatacctgacgaacttggtgattgttcctctttgaaaagcatagacttgtcatttaatgagattcggggagatataccgttttcggtttcaaagatgaaacagctggaaaatctaattttgaaaaataatcagctaattggaccaatcccttcaacactctctcaggttcctaacttgaagattctagacctggcacagaataatcttagcggggagataccaagacttatatattggaatgaagttttgcaatatcttggcttgcgaggtaacaatttggtgggttcactttctccagacatgtgccagttaactggattgtggtattttgacgtgagaaacaatagcttgacgggcagtattcctgaaaacataggcaattgtactactttaggggtcttggatttatcctacaacaagctaaccggagagataccattcaatattgggtatctgcaagtagcaactctgtcattgcaaggcaataaactctcagggcatattccatcagtgattggtctgatgcaagcgcttactgtcttagatttgagttgtaacatgttaagtggaccaatccctcctatcttgggaaatttgacctacacagaaaaattgtatttacatggaaacaagctgactggcctcatccccccagaacttggaaatatgacaaaccttcactatttggaattgaatgacaaccatttaagtggacatatcccacctgagcttggaaagcttactgatttgtttgacttaaatgtcgccaacaacaaccttgagggtccagttcctgataatcttagcttgtgtaaaaacctcaacagcctcaatgtgcatgggaataagctgagtggaacagtcccctcagcttttcatagcttggagagtatgacctatctgaatctttcttcaaacaagcttcaaggctccattccagttgaactttcacggattggtaatttggatacactggatatatcaaataataatataattggttctattccttcttccattggtgacttggaacatcttctgaagttgaatctgagcagaaatcatttaacagggtttattccagcagaatttggaaatctaagaagtgtcatggatattgatctttcaaataatcaactctctggcttgattcctgaagaacttagtcagcttcagaacattatatccttgagactagaaaagaacaaattatctggggatgtgtcttcgcttgcaaattgctttagtctttctctacttaatgtctcttataacaacctagttggtgttattcccacaagcaagaatttttccaggttttcccctgacagttttattggaaatcctggtctttgtggtgattggctggatttgtcttgtcatgggtcaaactctacagagcgagttaccttgtccaaggcagctatcctgggaattgcaataggcgcccttgtgattctttttatgatattgctagctgcttgccgaccacacaatccaacttctttcgctgatggatcttttgacaaaccagtcaattactcacctccgaagctagtgattcttcacattaatatgacacttcatgtgtatgatgatatcatgaggatgactgaaaacctaagtgagaagtatataatcgggtatggtgcatcgagtacagtttataaatgtgtccttaaaaattgcaagccggtggctatcaagaagctctattcccactacccacaatacttgaaagagtttgagactgagcttgagacagttggtagcgttaagcacagaaatctggtcagtctccaaggctactctttgtcaacgtacggaaatcttctcttttatgactacatggaaaatggcagtctatgggatcttctgcatggacctaccaagaagaaaaagcttgattgggatcttcgtctaaaaatagcactaggatcagcccaagggcttgcttatctacaccatgattgcagtccactcatcattcacagggacgtgaaatcatctaatattttactagacaaagactttgagccccatctcgctgatttcggcattgcaaaaagtctatgcccatctaagacccacacttcaacttacataatgggcacaattggctacatagaccctgagtatgctagaacttcccgcctcactgagaagtccgatgtgtatagctatggtatcgtattgcttgagcttctaactgggaggaaagctgttgacaacgaatcaaacctccatcatctgattttgtccaagacagctaatgatggcgtaatggaaaccgttgatccagatattactaccacatgcagggacatgggagcagtaaaaaaggtttttcagcttgctcttttatgcacaaagaagcaaccagtcgataggcctacaatgcatgaagtgactcgcgtgctgggaagccttgtgccatccataaccctaccaaaacaaactgactcaacacaagtgctgctacctgattctcagtcatctgctaaaatgcaatgctacaaagatgaatatgcaaatctcaaaactcctcacttggttaactgtccttccatgagcacctctgatgcacaactcttcctcaaatttggggaagtaatatcacaaaatagtcactga

SEQ ID NO: 1260 - DNA, 1368 bp, Glycine max var. Williams 82
atgttactgtacaagtacttgagtactacattgtatagaacttggaatactatatactacatcttcctccatggagaagaacacaaactgaacttgttgctttctagtttcgcttcacacttcacacttaacgtatccgccaaatctaggggcatattccattccaccaccatttctctgcaaaagagacccttttgcttcttttcagataacatgggcttagtctgcagcagaggtcgtcgttttcgtgaagctgatgctgaagaaaatgctcaggatgcagaaattgaaagaagaatcaagttagaaacaaaggctgaaaagcatattcagaaacttttattactaggtgctggagagtctgggaagtctacaatctttaagcagataaaacttttgtttcaaactggctttgacgaggctgagctaaaaagctacataccagtcattcatgctaatgtgtatcaggcaataaaagtactgcatgatgggtcaaaagagttggcgcagaatgatgttgattcttcaaagtatgtaatatctcatgaaaaccagaacattggtgaaaagctctcagaaattggagccaggctggattatccttgttttaccaaagagcttgcacaggaaatagagagactgtgggaggatgctgcaattcaggaaacatgtgcccgtggtaatgaactccaagttccagattgtgcccattatttcatggaaaatttggagaggctgtctgatgcaaactatgttccaacaaaggaggatgttttgtatgcaagagttcgtacaactggtgttgttgagatccagttcagccctgttggagaaaataagagaagtggtgaagtctatagactctttgatgttggtggtcagagaaatgagaggagaaaatggatccatctttttgaaggagttacagctgtaatattctgtgctgcaattagcgggtatgatcagacactttatgaggatgaaaacaagaacagaatgatggagactaaggaacttttcgagtgggtcctgaagcaaccatgttttgagaaaacatccttcatgttatttttaaacaagtttgacatatttgaaaagaagatcctgaatgttccgctcaatgtatgtgagtggttcaaagattaccagccagtttcaacagggaaacaagagatcgaacatgcgtacgagtttgtgaagaaaaagtttgaggaattgtatttccagagcactgctcctgaccgtgtagatcgcgtgttcaagatctatcggacgactgcccttgatcagaagcttgtgaagaagactttcaagcttgttgatgagactttgagacggaggaatctctttgaagctggcttattatga

SEQ ID NO: 1261 - DNA, 981 bp, Glycine max var. Williams 82
atggagacaagaacaggaactctttccataacagtttgttctcttgttatgttttcttttgtttcccttgtaaagggtagcctctctttcaacttctatgcagcttcatgtccatcagcagagtctatcataagaaacatagtcagctcatcctcttctactgatcctactattcctggaaagcttcttcgcttggttttccatgattgctttgtggagggatgtgatgcttctttgatgctacaagggaacaatacagaacaaagtgatccaggaaataggtctgttggaggatttacagttatagattcagcaaaaaggatccttgagaaattctgccctggaactgtttcttgtgcagacataatagctctagccgctagagatgctgttgaaatagctggtggaccaaggactatgattcctacaggtaggagagacgggatggtttcagttgcttcaaatgtcagacctaacattgtggacaccagtttttcaatggatgagatggttaaactctttgcttctaaaggactgtccttacttgatcttgtcatcctttcaggagctcataccatagggacagcacattgcagctcattcagggatcgttttcaagaagattcaaagggaaagcttaggctcattgacaaaacccttaacagtgactatgctaatgagctaataaaacagtgtccagcaggtgtccaaccatctgtaacagtgaacaatgatcctgaaacatctatggcctttgacaacatgtactaccaaaatcttctggcccacaaagggctattccaatcagattctgttttgataagcaatgatagcacaaggaagttagtggtggattttgcaaatgatcaagagcttttttttgaaaattgggatcagtctttcttgaagctcactagtgttggagtaaaaactggtgataagggtgaaattcgaatttcttgtgcatcgactaatgcataa

SEQ ID NO: 1262 - DNA, 528 bp, Glycine max var. Williams 82
atggctgcttgctcaagaacttctcttttgctccttttctttctctttggattctccgcagctaaggaactattggttggaggcaaaatagatgcttggaagattccatcttctgaatcagattccctcaatcaatgggctgaaaggtctcgtttcagagtcggcgatcatcttgtgtggaaatatgagaatgggaaggactcagtgttggaagtaacaagggaagattatgccaattgcagcacatccaagcccatcaaagagtacaatgatggaaacacaaaggtgaagctagagcatgctggtccattctacttcataagtggagcaaaggggcactgtgagaagggacaaaagttgattgtggtggttatgtctccaaggcacattatttctccagcaccttctccaacagagttccactttgagggtcccgctgtagctcctactagcagtgccacaacgtttcaagttggcctactcactgctcttggagttttggccatgtatgtggtttttctcaagtaa

SEQ ID NO: 1263 - DNA, 288 bp, Glycine max var. Williams 82
atgatggatcaagaggtagaaacgcttgaagcgaagctgcaacgtgtgaaggaggataatcgtacccttagagagatgctggaaactctgagcagcaaatgcgagaagcttcagtctcatcttcaagagatcaataatgaagaacaagaagtgagcacaaaatcagaccaaagtggatcagtattattagctagagccgagtttcccatagcacaaaagccatcacaaatctttgttaaaacccaccccaaggacaatagtttggtatgccgtatgcctattaattaa

SEQ ID NO: 1264 - DNA, 389 bp, Glycine max var. Williams 82
ttctacttctggtaacatattgaagcttgttcaacttcaaagtagctagctagctcccatgatggatcaagaggtagaaacgcttgaagcgaagctgcaacgtgtgaaggaggataatcgtacccttagagagatgctggaaactctgagcagcaaatgcgagaagcttcagtctcatcttcaagagatcaataatgaagaacaagaagtgagcacaaaatcagaccaaagtggatcagtattattagctagagccgagtttcccatagcacaaaagccatcacaaatctttgttaaaacccaccccaaggacaatagtttggtatgccgtatgcctattaattaattacttgtgattaatgctcaaatactgtcaggaacttcataca

SEQ ID NO: 1265 - DNA, 417 bp, Glycine max var. Williams 82
atggcggggactccatcaaggcttgaagaaattatagcttcacttaactgtttccgtgtgctctacgccccacaaggcccacatcgatatgaatcgcgtggggaagagcaagaaacgttggagattcgtcgaaaatggttgcggaagaaactagagagggcgatgaaggtgttgtcagaaattttggtgtggccaaagaagagtttttctttgcggaggttgaggacgtgtattagtgaagccaaggaaatgaaaaggaaaatgcaattccagtatgatcccaagagttatgcgcttaattttgatgatggatcaatagaggaggatgatggtgtttttcttgatttctcggctcggtatgcatgtccattagggataaacaagctatatttggaatgggagcacagtgaagcttaa

SEQ ID NO: 1266 - DNA, 2454 bp, Glycine max var. Williams 82
atgggaaaacattggtctttcttccatattacgggtacccttttccttttgtgcaaagtctgtctagctgggagtcaatattctggacgtgtcttacccggggtattaaatggttctcaaatgaattggattgacagagatggcaagttccttgtctcaaaaaaggttcagtttgcctttggctttgtcaccacaacgaatgacaccaccaagtttctacttgcaatcatccatgtggccactaccagggtaatttggaccgccaatagagcagttcctgttgctaactcggacaattttgtgtttgatgaaaagggcaacgctttcttacagaaagatggaaccttggtttggtcaacaagcacaagtaacaaaggggtttcttcaatggaattgcttgacacagggaatttggttttgcttggaattgataatagcacagtgatttggcaaagttttagccatccaacagatactttgttgccaactcaagagttcactgagggaatgaaactcatcagtgatcctagctcaaacaacttgacccatgttcttgagatcaagtctggtaatgttgttctcactgcaggttttcgaaccccgcagccttattggactatgcagaaggacaaccgcagagtcatcaacaagggcggtgatgcggtggcttcagcaaacattagtggaaattcatggaggttctatgacaaaagcaaatctttgttgtggcaattcattttctctgcagatcaaggcacaaatgcgacttggattgctgttttggggagtgatggcttcatcactttctcgaacctcaacgatggagggtcaaatgctgcttctccaacaacaataccccaagattcttgtgctacaccggaaccttgtgatgcatacaccatatgcacaggtgaccaaagaaggtgtagttgcccttctgttattcctagttgcaaacctggttttgattctccctgtggtggtgactcagaaaagtccattcagttggttaaagctgatgatgggcttgattactttgcgcttcaattccttcaacctttttcgaaaaccgatttggctggttgccaatcttcttgccgcggaaactgctcgtgccttgctttgttcttccacagaagttcaggggactgtttccttttggacagtgtaggtagctttcagaaacctgattctgattctggttatgtttcttacattaaggtctcgacagatggaggcgctggcacgggttctgggggcggcggaggtgtccataagcacaccatagttgttgtggtcattgtcataatagccttggttgtcatttgtggtctggtctttgggggagttagataccacagaagaaagcaaaggttgcctgagtctcctagagaaggttcagaagaggacaatttcttggagaatttgactggcatgccaatccgttacagctacaaggaccttgaggcggccactaataacttctctgtgaagcttgggcaagggggttttgggtcagtgtacaaaggagttctacccgatgggactcagttagcagtgaagaagttggaaggtattggacaagggaagaaagagttcagggctgaagttagcatcattggtagcattcatcatcttcatttggttaggcttaagggattctgtgctgatggaactcataggctccttgcttatgaatacctgtctaatggctccttggataaatggatattcaagaaaaacaaaggtgagtttcagttggattgggatactaggttcaatatagctctgggaacagcaaaaggacttgcttatctgcatgaagattgtgactcaaagattgttcattgtgacatcaagccggaaaacgtgcttctggatgaccacttcatggccaaggtttcggattttgggctggctaagctcatgaaccgagaacaaagccatgttttcacaacactgaggggcaccaggggatatcttgcaccggagtggataacaaactatgccatatcagagaaaagtgatgtctatagctatggtatggtgctactagagatcattgggggaaggaaaaactatgatcccagtaagtcttcagagaagtcccatttcccaacttatgcttataagatgatggaagaagggaagctgagagatatttttgactcggagttgaaaattgatgagaatgatgataggtttcaatgtgctataaaagttgcattgtggtgcatacaggaagacatgtcaatgaggccatctatgaccagagttgtccaaatgttggagggtatttgtattgttcctaacccaccaaccagttcttcgttgggttctcgcctttatgccactgtgttcaaatcctccagtgaaggggccacctcttctggtccctcagactgtaacagtgatgcttatctctccgcggttcgcctttcagggcctagataa

SEQ ID NO: 1267 - DNA, 441 bp, Glycine max var. Williams 82
atgaggaccagttgcttcctaagccttcccccttttacttcaaaccaaccttccattcccccaaaacatcctcaactttcatcggtgaagaacgaagcatgttggaagaggcaatgcgttgtgatgggagtggcatccattattggactagaaatgtgcaattcagtggcaatggcccacgaagcaattgaaatcaagaccatgccatttagtaaccaagtagtatcaaatagcaattcttacggtggcgccaaatggagcgagaaaagaatgtgcccaccttggcaaggcaattcgctcgaaacgatcgtgccggagaatcttccccggccgtcggcacggcggagatacgaggctgttcgttcctcctccaagactgcgccgccgctctccgccccgatcatagtccaaagcaacaagggcagttgcttctccatgtga

SEQ ID NO: 1268 - DNA, 927 bp, Glycine max var. Williams 82
atggaaagtgagagagagattatgatgattccatgttttgattttggcaaggcattagaagaagggagtgaggagtggaaagaaatgagcaagaaagtgagagaagcatgtgagagtcacggttgcttcctcttggtttgtgatgagatgattcctaagggtgtacgtgaagagttttttagtaatatggaagcattgtttgatttgcctgaagaaagaaagatgaagcacataagtccaaagccttatagcagctacagtggcaagagccctgtcattcccctcagtgaaacctttgggatcgatgatgttcctctctctgcttcggctgaggccttcaccaacctcatgtggcctcaaggaaacccacctttctgcgagacactaaagatcatgagctcaaagatgttaaaattaagttctctcatcctgaaaatgattgtggaagattatggcattcaacaacattacatctcagatgttgaaaagatgaaaagctctagcaattcacgattgatcaaatacaaaattcctgaaaataataatgactccaatactggcctggtgtctcacacggacaaaaatgcgttaaccattatatgccaaaacgaagtccaaggactccaagtactgtccaaaacagacaattggattgaattggagatggctttgtggtcattgttggcgtggagcaatgggaggcttcatgcagctacacacagagtgatgatgagtggagacaaagaaagatattcatttgggctttttacaatgccaaaggaagagatggacattgaggtacccattgagttggtggatgagaaaattcatccccttcgttatcatccattcaaatatggagagtacatctcttactttgtttcaaatctcaaagaaaatgctcttgaagtgtttgcaggtctttga

SEQ ID NO: 1269 - DNA, 1371 bp, Glycine max var. Williams 82
atgcgcccaccggttattctcaaaactaccacctctcttttggattcttcttcttcttcaccaccctgtgatcgcagactcaacactctcgctagacacttccttccgcaaatggcttctcacgacagcatctccgcttctccaacctccgcttctgattccgtcttcaatcacctcgttcgtgctcccgaagatcctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaacaaggaatatattccgatcgttgggcttgctgattttaataaattgagtgctaagcttatttttggggctgacagccctgctattcaagacaacagggttaccactgttcaatgcttgtctggaactggttctttaagagttgggggtgaatttttggctaaacactatcaccaacggactatatacttgccaacaccaacttggggcaatcacccgaaggttttcaacttagcaggcttgtctgtcaaaacataccgctactatgctccagcaacacgaggacttgactttcaaggacttctggaagaccttggttctgctccatctggatctattgttttgctacatgcatgcgcacataaccccactggtgtggatccaacccttgagcaatgggagcagattaggcagctaataagatcaaaagctttgttacctttctttgacagtgcttatcagggttttgctagtggaagtctagatgcagatgcccaacctgttcgtttgtttgttgctgatggaggcgaattgctggtagcacaaagctatgcaaagaatctgggtctttatggggaacgtgttggcgccttaagcattgtctgcaagtcagctgatgttgcaagcagggttgagagccagctgaagctagtgattaggcccatgtactcaagtcctcccattcatggtgcatccattgtggctgccattctcaaggaccggaatttgttcaatgactggactattgagttgaaggcaatggctgatcgcatcatcagtatgcgccaagaacttttcgatgctttatgttccagaggcacacctggcgattggagtcacattatcaaacagattggaatgtttactttcactggattgaatgcggaacaagtttccttcatgactaaagagttccatatatacatgacatctgatgggaggattagcatggctggtctgagttccaaaactgtcccacttctggcggatgcgatacatgcagctgtaacccgagttgtctaa

SEQ ID NO: 1270 - DNA, 1164 bp, Glycine max var. Williams 82
atgcatagttatgcttctggtctttctttctataaaaaccaaccctcgggtctttcatttcacatgttccatagttcttgctctgggtgggtaaagatggaaggtgctagtagagtcttatgcttgtttctggcggcatttttgtggtttaatgctcaacatgcttttgtaagttgtgctttgacatttgagttgcaaagcaaaattgctaaagccaaccaagagggaccttacctaggtttaatcataccaaattcttttgaactagaccctcttcttcagaatcctggctacacagctagtgacaccatcatagacttcgctggaaggagatttcgctttggagccattggtgacaagcctgttatactggtcatgacaggattgagcgtgataaatgcagctataacgactcagcttctgttgagtttattcacggtagaaggagtggtgcattacggcattgctggaaatgcaaacccgtccttgcatattggagatgtagctattccccaatactgggctcatctagcactatggagctggcagaggtatgggctagggcctgatgacacattacccttggaagacaatggagactacaccagggaattagggcacttaaattttgcaaatttcacctcaaacgtaactgctgatagtccatttgataaccaactcaacaatatatggtaccaaccagaggagatttttcccattgatggcgttccggaagtaaggcagcatgtcttctgggttccggttgattccaagtactaccacattgccaaaaagttgaaggacttggagctagagtcgtgcataaactcgaccacatgcttaacaacgacaccgaaggtggagcttgtgaatagaggtattagccaaagcatctacctagacaatgcagcatacaggtctttcatctacaacaaatttgaagtgagcccagtggacatggaaagtgcatcggtggctcttatatgccatcaacaaagggtacccttcattgctattagggctctctccgacttggccggtggcggctccgccgagtccaatgaggccgataccttcttatcaatcgctgccaccaattctgtcactgtggtcattgagttcgtgaagctcttgtcactccactctaagtggtggtccatgtaa

SEQ ID NO: 1271 - DNA, 792 bp, Glycine max var. Williams 82
ctcccacaagctcagttatttggtgcagaaaaaatagcccaaccagagaagaatttgtttgactgggtcaaaaatgacaacagaaggtttctccatgttgtgtaccgtgttggagacttggagaagactataaagtatgctctattgagaaaacgtgatataccagaagacagatattctaatgcttttcttggatatgggcctgaagagtccaattttacagttgaacttacttacaattatggagtggataactatgatattggaagtggctttggtcattttggtgttgcaggaaggttaattacaagggaaccagggcctgttaaagatggcagtgcagtaattgcactcattgaagatcctgatggctataagtttgaacttttggagagaagacctacatctgaacccctatgccaagtgatgcttcgagtaggtgatattgatcgtgctgctggaatgaaacttctccgcaagagggacaaccctgagcagaagtacacagtagcttttatgggctatggtcctgaatacatgaatagtgttctagaactgacatataactatggcgtcactaattatgacaaaggaaatggttatgcacagattgccataggcacaaatgatgtctataagactgcagaagcaatcaaattatgtggaaggaagattatccgtgaacctgggcccttgccaggtatcaacaccaagattgtagcttgcctggaccctgatggttggaaattggcatttgttgataatgttgattttctgaaggaattagagtga

SEQ ID NO: 1272 - DNA, 1764 bp, Glycine max var. Williams 82
atggccactttatataaaacattcatagtgaattgctccattcagaaaagaccctcccatgtctcggacaattctcgccactacaaccttccactcttccctgcctttaagccactcaagaaagttctgcctgaagtccccttgcaaattgatgatgttaagaaaaccatgtcaaaaactgcagctatattacttgatgcctttgtagattcgttctttgaatttattgaccaaccactgcttccatctcagagtaactttgctccggtggtggagttaggtgaagccatagttgtgacaagcatccaaggacaaattccagatgattttcccgagggtgtctacattagaaacggtccaaatccactttttggaggactgcaatcaacaaattctatctttgggaggtcaagttacatatgggtggaaggagagggaatgcttcacgcaatttattttaaaaggtggagtccagggatttggactgtcctctacaacaacaagtacgttgaaaccgatacatacaaggttgaaaagcaacgaagtaaaccattgtttctaccggccatagaaggcgattcaccagccattttgtctgcttatctgctaaattggttgcgatttggcaaagtaaacaagtacatcagcaacaccaatgtctttgagcactcagggaagttttactccgttgctgaaaatcacattccacaagagattgatatctttacactgaaaactttaaggaattggaatgtcaatggtgcctgggatcgtccttttactagtcatccaaagaaagttccaggtacaggggaactagttacatttggggttgcagcaaccaaaccttttgccgtagttggaattatttctgctgatggcaagaaattggttcacaaagttgacctcaaactaaacaggtgcactctttgccatgacataggtgttacacagaggtacaatgtgatcatggatttcccactaaccattgatctaaacagacttcttagaggaggcccattaatgaagtataataaggaggaatatgcaaggattggagtaatgccacactatggtgatgccaactcaatcaaatggtttgaggtggaacctaattgcacttttcacattatcaattcttttgaggatggtcacgaggttgtagtgaggggttgcagatctcttgattcattaattcctggacctgacccgagtttgaaggaatttgagtggttatctcgttgtcacgagtggcgattgaatatgcaaacgggagaagttaaggagagaggtctctgtggagccaacatagtttatatggattttcctatgatcaatggaaacttcataggtattaggaatagatatgcatacactcaagtagttgatcccattgcaagctctactcaagacgtgccaaaatacggaggtttagcgaagctctactttgaagaatcatgtgcaaagttttccatgcagagaaacagagagcaacctgaagagcctataagagtggaatgccacatgtttgagaagaacacattttgcagtggggctgcctttgtccccagagatggtggtcttgaagaagatgacggttggatcatagcttttgttcacaatgaagatacaaacatatctgaagttcatataattgacacaaagaagttttctggtgaaacggttgctaaaattacaatgcctcgtagagtaccatatggatttcacggagctttcatgccaatttcatttgagacacagtag

SEQ ID NO: 1273 - DNA, 3066 bp, Glycine max var. Williams 82
atgtccaaactacccctcttcatgctgaaatttccttttcatttcctcttattgctcagtgtcatagtaccctttcaagtattttcacaatcagaaaataccgaacaaacagtcctactctccctcaaacgtgaattgggggacccaccgtcgctccgatcatgggaaccgtcaccgtcggcgccgtgcgactgggcggagattcgctgcgataacggctccgtcacgaggctcctcctctcccgcaaaaacatcaccaccaacaccaagaacctctcttccacaatctgcaacctcaaacacctcttcaagctcgacctctccagcaacttcatctccggcgagttcccgacaacgctgtacaactgctccgacctccggcacctcgacctgtcggacaactacctcgccggacaaattcccgccgacgtcgaccgcctcaaaacgctcactcaccttaacctcggcagcaactacttctccggcgagatcatgccgtcgatcggaaacctgccggagctgcaaactctcctcctctacaaaaacaacttcaacggaaccatccgcggggaaatcggaaacttgtccaatctcgaaatcttgggtttggcttataacccaaagctcaaaggcgcgaaaatcccgttggagtttgccaagttaagaaaactgaggatcatgtggatgacgcagtgtaacttgatcggagagattccagaatatttcgggaatattctcacgaatctggaacggttggatttgtcgaggaacaatctaacagggagcattcctcggagtttgttctcgctgaagaagttgaagttcttatacttgtactataacagtttgtcgggtgtaatacctagtcctacgatgcagggtttgaatttaaccgaacttgatttctctaagaacaatttgacgggttccatacccggagagcttggaaacttgaagagtttggttaccttgcacttgtattcgaattacttgtctggtgagattccaacaagtttaagcctacttcctagtcttgagtatttcagggttttcaacaatggtttgagtggaacactgcctccagatctaggcttgcattcgaggattgttgcggttgaggtttcagagaatcatctcagtggtgagttgccgcagcatttgtgtgcaagtggtgctctcattggttttgttgctttttctaacaattttagcggggttttgcctcaatggattgggaattgtccttctctcgacacgattcaggtttttaataataatttctctggggaggtacctttgggtttgtggacttcgaggaacatttcctccttggttctgagcaacaactccttttctgggcctcttccgagtaaagtattttggaatacaaaaaggattgagatagcgaacaacaagttctccggaaggatatctattgggattacttcggcggcaaatttggtgtattttgatgcgagaaacaacatgctttccggtgaaattccgagggaattgacgcatctttctcaacttagtactctcatgcttgatggtaaccaactttctggtgcccttccatctgagattatttcatggaaatcactgagtactatgacactctcaagaaacaaactctctggcaaaatccctattgctatgaccgctcttcctagcttggcttacttggacttgtcccaaaatgacatatcaggtgaaatcccacctcagtttgatagattgaggtttgtttttctcaacttgtcttccaaccaaatatatgggaaaatctctgatgagtttaataaccacgcatttgaaaacagtttcttgaacaatcctcatctgtgtgcttacaatccaaacgtcaaccttcctaactgcttgaccaaaaccatgccacactctagcaattcatcttcaaaatcacttgccctgattttggttgtcatcatcgttgtgttgttgaccatagcctccttggtcttctatatgttgaaaacgcaatggggcaaacggcactgcaagcataataagattgaaacgtggagggtcacctcattccagaggcttgatctcacggaaataaatttcctctcaagtttgacagacaataacctcataggaagtggagggtttgggaaagtttaccggattgcttcaaatcgtccaggtgagtattttgcggtgaagaagatttggaatcgcaaggatatggatggcaagttggagaaagagtttatggctgaggttgagatcctgggtaatattcggcactcgaatatagtgaagcttttgtgttgttatgctagtgaagactccaaacttcttgtttatgaatacatggaaaatcagagcctggacaaatggcttcatggaaagaagaaaacgtcaccttctaggttgagttggccaacgaggttgaatattgccattgggactgcacaaggtctgtgttacatgcaccatgattgctcacccccggtcatccaccgagatgtcaagtctagcaatatactgttggactcagagttcagagctaaaatagcagattttggtctcgccaagatgttggcaaagcttggtgaaccacacaccatgtctgctctagcaggctcttttggctacattccaccagaatacgcctactcaacaaagattaacgagaaggttgatgtatatagctttggggttgtgctcttagaacttgtgacaggaagaaatcctaataaagcaggcgaccatgcatgcagcctagttgaatgggcgtgggagcattttagtgaagggaagagcattactgatgcattcgacgaggatatcaaagatccatgttatgcagaacagatgacgagtgtcttcaaattagctctcctttgcacaagctcgttgccctcaactaggccttccacgaaggagattttgcaagttcttcatcggtgttgccattcaggttctacacgtagaagagtgggaaacgaatttaatatcacccctcttcttggtgatacaaggtacatctatagttacaaggagagtaatgctgcaagcaataactcatcttggtga

SEQ ID NO: 1274 - DNA, 1359 bp, Glycine max var. Williams 82
atgagagagtgcatttcaatccacattggtcaggccggtatccaggtcggaaacgcctgctgggaactctattgccttgaacacggcattcagcccgatgggcagatgccgagtgacaagaccgttggaggaggagacgacgccttcaacacattcttcagcgagaccggcgccggaaagcacgtgcctcgcgccgtcttcgtggatcttgagcccaccgtgatcgacgaagtccgaaccggcgcgtaccggcagctcttccacccggagcagctgatcagcggcaaggaagacgccgccaacaacttcgcgcgtggccactacaccatcggaaaggagatcgtcgatctctgcctcgacaggatccgaaaactcgccgacaactgcactggtctccagggcttccttgtcttcaacgccgtcggtggcggcaccggttccggcttgggctcgcttctcttggagcgtctctccgttgactacgggaaaaagtcaaagctcggtttcaccgtttatccttcgcctcaggtttcgacctcggtggtggaaccctataacagcgtcctttcaacgcactctctccttgaacacaccgatgttgccgtgcttcttgacaacgaagcaatctacgacatttgcaggagatcacttgacattgaacgccctacctacaccaaccttaaccgtctcgtttcccaggtgatttcatccctcaccgcctcgttgaggtttgatggagcactgaacgttgatgtgactgagttccaaaccaacttggttccttaccctaggatccatttcatgctttcctcatacgcccctgttatctctgctgagaaagcataccatgaacagctttccgttgctgagatcaccaacagtgcctttgagccatcctccatgatggccaagtgtgaccctcgccacggcaagtacatggcgtgttgtttgatgtatcgcggcgatgtcgtgccgaaggatgtgaatgctgcagtggccaccatcaagaccaagagaaccatccagtttgtggattggtgcccgactgggttcaagtgtggtataaactatcagcctccaaccgttgttcctggaggtgaccttgccagggtgcagagggctgtgtgcatgatttctaactccaccagtgtggctgaagtgttctcaaggattgatcataagtttgatctcatgtatgctaagagggcattcgtgcactggtatgtgggtgaaggtatggaagagggtgagttctcggaggctcgtgaggaccttgctgctcttgagaaggattatgaggaggttggtgccgagtctggtgatggagatgatgatggtgaaggagatgatgattattag

SEQ ID NO: 1275 - DNA, 504 bp, Glycine max var. Williams 82
tggcgcgcaatggtcctctctcactaccagcaatttatggaagagaaatccaacgtggcaaacgacgacgtttaccttctcttttctccaccctggctttccgcgtacgaaagggctctcctctggattggggactacaagccctctctaattcaccgtttagtagacggcgccgtgaaggggttaacggcggagcagagggggagggtggagagaacgagggacaagacgaagagggcggagagggagctgacggaggcagtagcttcagttcaagagagcatggcgaataatggagcaggagcggcgcttgaggggctcgggaaggcgcttgagaaggttctggagagagccgatgagcttcgcgcgttggccatgaggaaggtggtgggtatcttgagtccgccgcggacggtggcgttgctggcggcgacgatgcactttcagatgagggtcaggatgtggggtttgcaaagagccgaggttggacggtctcgtcgttga

SEQ ID NO: 1276 - DNA, 384 bp, Glycine max var. Williams 82
atggagattgaggacacatcaagtagagtatctattgcatttcctcttggcttagctcttcttgttgccttgttattgttcttttgttgcttcttttgttgctgcttgcactgggaaaaactccaacctttgtttccattttgtatggttatcgtcgatactcagcctcagacacaagcagacttcactccccctcctcacaagccaggctttcctgtcttgatgatgcagcataaccgaggtgagagcttgccagtgctgatgccaggagatgaggttccaaaattcatagcactagcatgcccatgtcagcctccaacaaatgaaatgatcacaatccatgtgcagaagacagcaccaaatgatttttgcggcggagcttaa

SEQ ID NO: 1277 - DNA, 1005 bp, Glycine max var. Williams 82
atgaccactctcacacactccaatttccaccatgaccttcttcttcttttctatttttttctcctcaccgaatttccgtcgccgctcaccgcgcagcttccggacacgctaactccgccgtctccgcagcagcaggaggaccgttttgcgaggctgaagttcgacaaatccatggccatcgttctggtgatcctcgtggcggtgttcttcgtcctagggttcctctccgtgtacactcgccagtgcgcggagcgcaggatgcgagggaggttcgacatctccatctccatctcgcgccggcaacgcggcctggaccgcgaaatcatcgaaacgttcccaacgttcgtgtactccaccgtaaagagcctcaagttagggcgcgccacgctagaatgcgccgtgtgcctcaacgagttcgaggaggtcgaaacgctgcgtttcatcccaaattgcagccacgtgttccactccgagtgcatcgacgcgtggctcgccaatcactccacttgtcccgtgtgtcgcgccaatctttttcccaaacctgatgacccgtcttttgatcctatccaaattccggatccggaacaacccgttatatcatcaccgacccgagccgaaactgggggctctaatcctcgttctccgaatttgattgatcagaaccctacgtcgcggtcaaggtcaacgggttttcgtatcgcggggtggtttccgcggtctcactcgacgggtcactcgctggttcaacccggggagaattgtgaacggtttacgctgcatttgcctgaggaagtgcggaaccagcttatgctgagtcgcaccaagagttgcggcgtgggcgtgacgttcacgcgcgagaacagtgaaaggaggggttatagggcgaggagcgttggtagtagcctcagccctcacgtgagggggtggttttctgtgaaggatgatgtcggggaaaggtcttcggatcggttattctccacgtcgacaagggatagtgaggtttag

SEQ ID NO: 1278 - DNA, 507 bp, Glycine max var. Williams 82
atggcattctctagtgctttgattctgtggtcgttgctagcaatcaacatggccctgccaaccctcgcaaccgtctacaccgtgggagatacttcaggttgggcaattggtactgattatagcacttggactggcgacaagatcttttcagtgggtgatagtctcgcgttcaactatggagctgggcacacagtggatgaagttaaagagagcgattacaagtcgtgcaccgcagggaattctattagcacagacagtagtggtgcgaccacaattgcccttaaaagtgcaggcactcattacttcatatgttctgttcctggacattgttctggcggtatgaaacttgccgtcactgtcaaatcaggaaaagcctctgatgccacacccactacttccactactaccgccactaaatcaaactcgtcttcagcgagtagtgtctcaccaattgttgctatgttcattgtttcctcgatctcttactatgttttgcgtatgctataa

SEQ ID NO: 1279 - DNA, 1980 bp, Glycine max var. Williams 82
tctgatttttttcctagcaacttttttcattctataaaaggccttattcagcagagtaataagccacgtaccacaatcaaccttcatcttttctcttctctgtttttccactccttctccacacccctcccttttatttccaatattattctgcctaagcagtttcttccaaatttccttttacattttccaatttctttattctatcaaaagggttaatttgaattttgaaggaaaggaagatagatatgatgacgaaccaaaatgtggtgactcatgaggttattaacacgctgattgccatggcagcttccatttcaaactcaaccgtgttgccaagtgcaacagtaccagaatccatggctgtgcttggtgggttttgggggctgccccataataaaaatcttgtgaaaagattggaaggagccaaagttagtgcatggattgattcaatgagagcttcttccccaactcgtgccaaatcagaaagccaagaaaaaagatcttggattctttatcacccttcagctctgaacacctttgaacagatagtatatagtgccaaaggaaagcaaattgtagtttttcttgactacgatggaactctctctccaattgttgcagatccgaataaggctttcatgactagaaagatgagagcaacactaaagggtatagcaagacattttcccacagcaatcgtgactggaaggtgcagagacaaggtatataactttgtaaaattggcagaactttactatgcgggaagccatggcatggacatcactggtccaacaaaaagtccaaagcaaggtaataataataataaagcagtgctgttccaacccgcgagtcaattcctgccaatgatcgatgaggtgtacaagatcttgttagaaaaaacgaagactgtcccaggggctaaggttgagaacaataagttttgcttgtccgtgcactttcgttgtgttgacgaaaagagttgggcagcgttggcggagaaagttagattggtgctcattgagtatccacaacttaggctaacccaagggagaaaagtgctagagatccgtccaaccatcaaatgggacaagggcaaggctcttgaatttttgttagaatcattagggtacgagaattcgaatgatgtatttccaatctatattggtgatgatcgaactgatgaggatgcttttagggtaacaaatgctgccacgcctagcttgctagttttgcgcagtaggggtcaaggaattgggattcttgtttctagagttgcaaaagaaacagatgcttcctattccttgcaagatccatcagaggttgagcaattcttgcggcgtttggtggagtggaaaagatcgagtactgtgactcccgcaagtgtatagagtttgtaggatggatgtagatgatcagttcaaagaattgacaccaccaccttagaatggtgaaggggtgatcgaattttatcacttttttttcttgttgataatggaaatagcattattccattattattattaaatttttaaggacaaagtccgaacaaatagattcctacacacgtttgcatgcgcatgcggatagtgaaaggcagatgttttatgccgcagttgcaaatggcccccgtcaactttgttgccatgaattgtacttatcgtacatgtggccaatatatatactgaaaaagataactacaattgatctccaacttcaaaagccgatttagacattcagaaatactagtaaattaaatgagttagtttagacattttaatgcggtaataatccttacaaacatttcatattagtgatcattcagttcatttgatccccctcatcgatggttttccttgactgctcgacgtatggcatatatatatacccatctcagtgaatatttatactgcaaaaacaacgcctttttcattatcttttttatttaatagagtatctttttttgctttttacattaaa

SEQ ID NO: 1280 - DNA, 1248 bp, Glycine max var. Williams 82
atggagcacttcaaccatgacgatctcgaatacatcgtccacttccaagacgattttccgacgactgataccacttgttcggaagccagaaacgggaaagatattcagggaatcccctgggagaggcttaactatagcagagacaaataccgtgagaccagactcaagcaatacaaaaattaccagaacttctctctctctcctcaccacctccacaaggagtgtttccaagtgcagaaggggcaaactttctatgacttcttcttcaataccaggcttgtcaaatccacaattgtccactttcagctgaggaatttgttgtgggcaacttcaaagcatgatgtataccttatgcaaaattattcagtgatgcactggtccgcattactacaaagaagtaaagaagtgcttaacgtagccaaaccaattattccaacccttacgcatcctggattcttagctcagcctgtctccagagtgcaaataagcaccatgactgttaaggaaaatctgatggtggcaggtggtttccagggtgagcttatatgcaagaatttgaagcaacctggagttctattctgtggtaaaataactacagatggtaatgccataaccaatgccgtggatgtttaccgcaatccagctgggtcgttgagggtaatcacagcaaataatgattcccaacttcgggtttttgatgcagagaattttgcttctcttggttgtttcaagtatgattggtctgttaataacacttctattagtccggatggaaggttgttagctgttcttggggacagtactgagtgcttgatggctgatgctaactctggaaagattactgggagcctaaaggggcacttggactactctttttcatcagcttggcacccaaatggacaaatattggccactgggaatcaggacaaaacatgcaggttgtgggacataagaaatctttcacaatctatggctgtgttaaagggaagaatgggtgcaataagagcactaagattcacttcggacggacgatttttggccatggctgaacctgcagacttcgtccatatttttgactcacattcaggttatgaacaaggtcaagagattgacctatttggtgagattgctggcatatcctttagcccagacacagaagctctatttgtgggtattgctgaccgaacctatggtagcttgttagagttcaacagaaaacgtcactataattacctagactcgttttga

SEQ ID NO: 1281 - DNA, 591 bp, Glycine max var. Williams 82
atgggtaatgaaaaccattaccgccatcagttttactatcagaaaagcacattccttccaatgctttgttcaaggccttccatcaaagaggtgactctacctcgattcagagatccttctgcttcttcaggcaacgaccctttgtccccaagaatcagttgcatgggtcaggtgaagagaaacaacaaaattgctggcattccaccctcacatagactcactttcacaaccaaaaccaacacaaacacaaacactacctcatcccctattgtcaaatactataaactcaaaaaactcttctctggcaagaactttattattagcacgccaaaacccacgacagccaccagcactatctcaagctgtagatcaaggcagcaacaaatttcagatgtgcccaaaaaccaaaaagtcattgaggaaatggatcctcctttgcctgtggtcaaaagagtgtccccattggaagaatcaaaagaattggatagtctctggaaaagaagatcgggtatgggtaggcctgcactcaaaagtttgcagcttcaacagattcaagatccaaggatttgttttcagccttcaactgtttga

SEQ ID NO: 1282 - DNA, 2673 bp, Glycine max var. Williams 82
atggcggcttccgtcgaccagcgtccgtaccccggcctccacaatggcgtcgttcggcccctcaaaccaggcccggatatcccgcgtcccaagaagctaccccagccgccgccgccactctcggattcctcaagcgacgaagaagaagacaccaccttgaacttgaaggacctgattcgcaagggaacaacggaagttgaatcctccattttcgacccgcgcgacgatggaacctctgaccactggatccaacggaactcttcccttgtccgtttaacgggaaagcacccgtttaactcggagccacccctccctcgcctcatgcaccacggcttcatcaccccggtccccctccactacgtccgcaaccacgggccagtcccccgggcccgctgggaggactggaccgtggaagtcacgggcctggtcaccaggcccacatgcttcaccatggagcaactcctccacgatttccccagtcgcgagttcccagccacactcgtctgcgctgggaaccggcggaaggaacagaacatggtgaaacagagcatcggcttcaactggggggcagccgccatctccacttcggtgtggcgcggcgtgcccttgcgcaccctgctcaagagctgcgggatctacacccgcaccaagggcgcgctccacgtgtgcttcgaaggggccgaggatctgccaggtggaggtgggtccaagtacggaaccagtatcctgagggaggttgcactggatccctcccgcgacatcattctcgcctacatgcaaaacggggagcctttgtccccggatcacggcttccccgttagaatgataatacccggtttcattggtggccgcatggtcaaatggttgaagcgcatcattgttactaccgaccaatctcaaaactattaccattataaggataacagggtactcccttctcacgttgatgccgaacttgccaatgctcaagcttggtggtacaagccggactatattatcaacgagcttaacataaactccgtgataaccacgccttgccacgaggagatcttgcccatcaactcatggactactcagatgccttatttcatcagaggctatgcgtattccggtggtgggagaaaggtgacacgtgttgaggtaaccctggacggaggtgaaacgtggcaagtgtgcacactggactgtccggagaaacccaacaaatatggaaagtactggtgttggtgtttttggtctgtggaggttgaggttttggacctgctcggagccagggagattgcggtgcgtgcttgggacgaggccctcaacacccaacctgaaaagctcatttggaatgttatgggcatgatgaacaactgctggttcagagtgaaaaccaatgtgtgcaggccccacaagggtgagataggtatagtgtttgaacaccccacccaaccaggcaaccaatccggcggatggatggcaaaagaaaaacacctagagaaatcatctgagtccaacccaaccctcaagaagagtgtctcctccccattcatgaacaccacctcaaaaacctataccatgtctgaagtcagaaggcacaacaacgccgattcggcttggatcatagtccacggtcatgtctatgattgcacccgcttcctcaaagaccatcccggtggcacagacagcatcctcatcaacgccggcaccgactgcaccgaggagttcgaagccatccactccgacaaagccaagcaaatgcttgaagactaccgaatcggcgagctcaccaccacctgctacaactctgattcttcatcgtcaaacccctccgtgcatggcagctccgacaccatccctttgacccccatcaaggaagtgattacaccaatgcgaagcgtggctcttaacccacgcgagaaaatcccatgcaagctcatctccaaaacctccatctctcacgacgttaggcttttccgctttgccctcccctccgacgacctactcatgggtttgccagttgggaagcacatattcctatgtgccaccgttgacgagaaactatgcatgcgagcctacactccaacaagcagcgttcacgaagtgggatacttcgacctcgtcgttaaggtttacttcaaaggggtgcaccctaagttccccaacggtgggatcatgtctcaacacttggactctctccccattggttctgtcttggacgtgaaaggcccacttggccacattgaatacactggcagaggaaacttcctcgttcatgggaaaccaaggtttgccacgaggctagccatgttggctggtggcacaggaatcacacccatttaccaagtggttcaagccattctaaaggatccagaggactgcaccgagatgcatgtggtttacgcgaaccgaaccgaggatgatatattgctgaaggaagagcttgatgagtgggctaagaagtatgataggttgaaggtgtggtacgtgatacaagaaagcataagagaagggtgggaatacagtgtgggattcatcactgaaagtatcctgacggagcatattccaaatgcatctcctgataccttggcattgacttgtggaccaccacctatgattcaatttgcagtccagccgaatttggagaagttgggctacgacacccagaataacttgctcgtgttttag

SEQ ID NO: 1283 - DNA, 3133 bp, Glycine max var. Williams 82
tcgttcaaaaacaaaaccattctaccttctccaaaaccatccaactctcatgttcgaagaaaacatacacaatctcttcaaactctaattttcttttcctttcatttaatttcctcaatggcggcttccgtcgaccagcgtccgtaccccggcctccacaatggcgtcgttcggcccctcaaaccaggcccggatatcccgcgtcccaagaagctaccccagccgccgccgccactctcggattcctcaagcgacgaagaagaagacaccaccttgaacttgaaggacctgattcgcaagggaacaacggaagttgaatcctccattttcgacccgcgcgacgatggaacctctgaccactggatccaacggaactcttcccttgtccgtttaacgggaaagcacccgtttaactcggagccacccctccctcgcctcatgcaccacggcttcatcaccccggtccccctccactacgtccgcaaccacgggccagtcccccgggcccgctgggaggactggaccgtggaagtcacgggcctggtcaccaggcccacatgcttcaccatggagcaactcctccacgatttccccagtcgcgagttcccagccacactcgtctgcgctgggaaccggcggaaggaacagaacatggtgaaacagagcatcggcttcaactggggggcagccgccatctccacttcggtgtggcgcggcgtgcccttgcgcaccctgctcaagagctgcgggatctacacccgcaccaagggcgcgctccacgtgtgcttcgaaggggccgaggatctgccaggtggaggtgggtccaagtacggaaccagtatcctgagggaggttgcactggatccctcccgcgacatcattctcgcctacatgcaaaacggggagcctttgtccccggatcacggcttccccgttagaatgataatacccggtttcattggtggccgcatggtcaaatggttgaagcgcatcattgttactaccgaccaatctcaaaactattaccattataaggataacagggtactcccttctcacgttgatgccgaacttgccaatgctcaagcttggtggtacaagccggactatattatcaacgagcttaacataaactccgtgataaccacgccttgccacgaggagatcttgcccatcaactcatggactactcagatgccttatttcatcagaggctatgcgtattccggtggtgggagaaaggtgacacgtgttgaggtaaccctggacggaggtgaaacgtggcaagtgtgcacactggactgtccggagaaacccaacaaatatggaaagtactggtgttggtgtttttggtctgtggaggttgaggttttggacctgctcggagccagggagattgcggtgcgtgcttgggacgaggccctcaacacccaacctgaaaagctcatttggaatgttatgggcatgatgaacaactgctggttcagagtgaaaaccaatgtgtgcaggccccacaagggtgagataggtatagtgtttgaacaccccacccaaccaggcaaccaatccggcggatggatggcaaaagaaaaacacctagagaaatcatctgagtccaacccaaccctcaagaagagtgtctcctccccattcatgaacaccacctcaaaaacctataccatgtctgaagtcagaaggcacaacaacgccgattcggcttggatcatagtccacggtcatgtctatgattgcacccgcttcctcaaagaccatcccggtggcacagacagcatcctcatcaacgccggcaccgactgcaccgaggagttcgaagccatccactccgacaaagccaagcaaatgcttgaagactaccgaatcggcgagctcaccaccacctgctacaactctgattcttcatcgtcaaacccctccgtgcatggcagctccgacaccatccctttgacccccatcaaggaagtgattacaccaatgcgaagcgtggctcttaacccacgcgagaaaatcccatgcaagctcatctccaaaacctccatctctcacgacgttaggcttttccgctttgccctcccctccgacgacctactcatgggtttgccagttgggaagcacatattcctatgtgccaccgttgacgagaaactatgcatgcgagcctacactccaacaagcagcgttcacgaagtgggatacttcgacctcgtcgttaaggtttacttcaaaggggtgcaccctaagttccccaacggtgggatcatgtctcaacacttggactctctccccattggttctgtcttggacgtgaaaggcccacttggccacattgaatacactggcagaggaaacttcctcgttcatgggaaaccaaggtttgccacgaggctagccatgttggctggtggcacaggaatcacacccatttaccaagtggttcaagccattctaaaggatccagaggactgcaccgagatgcatgtggtttacgcgaaccgaaccgaggatgatatattgctgaaggaagagcttgatgagtgggctaagaagtatgataggttgaaggtgtggtacgtgatacaagaaagcataagagaagggtgggaatacagtgtgggattcatcactgaaagtatcctgacggagcatattccaaatgcatctcctgataccttggcattgacttgtggaccaccacctatgattcaatttgcagtccagccgaatttggagaagttgggctacgacacccagaataacttgctcgtgttttaggggactaaactagaatacattgtatgtgtatatagtagtttattgttatatataaataatggattctattagctgcttcgtttcaagatttttttatgtttcaatttttaaataaaagtgtacatgggacagctagctagctacgcaggtttacttttcctcgtcaacttttgatgtagacaagtatgtcaattattttgactacttttgcatgtataaataaataaataaaacagtgtgcaactatcactttttcaatttatttactctgaatcaaaggcattacaacattatgtcattaatttaatgacattttatatgaataaaatacatattacaaggc

SEQ ID NO: 1284 - DNA, 531 bp, Glycine max var. Williams 82
atggccgagactcggagatccacgggcaccgttaagtggttcaacgcgcacaaaggtttcggattcataactccccaagatggaaccgatgatctcttcgtgcacttcacttccatccgatccgacggctaccgttctttgtccgacggtcagtccgttgagtttctcctcgattacggcgacgacggccgcaccatggccgtcgacgtcacctcagccgttagatctcgtcttcccggaggatttcgcggcggcggcggtgggaggggcagaggaggaggacgctacgggggcggggaaggccgtggcagagggttcggtcggagaggaggaggccctgagtgttataactgtggaagaataggtcacttggcaagggattgttaccatggacagggtggtggtggtggtgatgatggtaggaatcggagacgcggcggtggtggtggaggaggaggagggtgttttaactgtggggaggaagggcattttgcgagggaatgtccgaatgttggaaaaggaaatgagtga

SEQ ID NO: 1285 - DNA, 986 bp, Glycine max var. Williams 82
cctcaattcagcgtaagctttcccaaacccaaataagaatcttccagaaacttcttttctttcaggagccaccatggccgagactcggagatccacgggcaccgttaagtggttcaacgcgcacaaaggtttcggattcataactccccaagatggaaccgatgatctcttcgtgcacttcacttccatccgatccgacggctaccgttctttgtccgacggtcagtccgttgagtttctcctcgattacggcgacgacggccgcaccatggccgtcgacgtcacctcagccgttagatctcgtcttcccggaggatttcgcggcggcggcggtgggaggggcagaggaggaggacgctacgggggcggggaaggccgtggcagagggttcggtcggagaggaggaggccctgagtgttataactgtggaagaataggtcacttggcaagggattgttaccatggacagggtggtggtggtggtgatgatggtaggaatcggagacgcggcggtggtggtggaggaggaggagggtgttttaactgtggggaggaagggcattttgcgagggaatgtccgaatgttggaaaaggaaatgagtgagaatgtgttatggtttcttctattgaattgagtctgttactgttagttggggttggttaaatggattctgttatttttgtttctagccattggcatttccttccttccttccaaatatgtttttccagggctttgctaattgttttatctaatgcgcttcttttcaacaaagtgtgattcattatgcttgttcctcctcttgaatatgaagattgaagcgcaacggacggcttaattaatgcttgatttaatcaatttactaattcgcctaaacgctgtattaatccttcaaaatatctgtatctgcctggccatcctgctattgggattctgcttctcacatctgtggttttatatgttttgtctatatctttaaaccctt

SEQ ID NO: 1286 - DNA, 1476 bp, Glycine max var. Williams 82
atgtcggttgaggagatgcagtcacagaagaggaatgtgtttgacgcagaaacggcgtcgtccttggtgaaggagctgagggacaacttcggttcgggaaggactcggagttatgaatggagagtgtcacaagtgaaggctctgttgaaggcggtggttgataacgaggaacagatcgtcgacgctcttcgttccgacctagccaagcctccactcgaaaccatcgtctacgaggttggtatgtttaaaaactcatgtgaagtcatactgaaggaattgaaacaatggatgaagccagaaaaggtcaaaacatcaatcagaacttttccttcgtcagctgaaatagtacctgaaccactgggtgttgtgttggtcatctctgcatggaactatccaattttgttgtctcttgatccagtcgttggagctatagctgctgggaatgctgtggttctaaaaccatcagaaattgctcctgcctcatcatcattattattaaaattgatagagaagtattgtgataactcatttataagagttgtggagggggcagttgatgaaacaaccgcactattgcagcaaaagtgggacaagattttctacacaggcaatggaaaagtgggaagaatagtgatgactgctgctgcaaaacaccttacaccagttgtgctggagcttggaggaaaatctcctgttgttgttgattccaatgtcgatttgcagatagcagctaggcgaataatttctggcaagtggggattgaataatggacaagcctgcatttctccagattatgttataacaacaaaagattgtgctcccaagttggtggatgccctaaagactgaattggagaaatgttatggaaagaacccgttggaatcagaagatttgtctcggattgtgacttccaaccactttgctcgattgtcaaagctattggatgatgataaggttgctggcaagattgtttatggaggtgaaaaggatgaaaagaaattaaggattgctcccactcttttattggatgttccgcgagattctctgataatgggtgaggagatatttggtccattacttcctattatcacggtgaataaagtggaagaaagtattgatttgatcaactcaggaacaaagcccctggctgcatatatatttacaaccaacaagaagttaaaggagcagttcgtaatgaatgttcctgcagggggtttgcttgtcaatgacactgtcttacatcttgtcgttgatactttgccatttgggggagttggggagagtggaatgggtgcataccatgggaagttctcttttgatgcttttacacacaaaaaggcagttctttatcgcagttttgctggtgattcatcattaaggtacccaccatacacggatacaaagctgagattgatgaaggctctcatcggtggtcgtttcctcggaataattcgtgctcttttcggatggtcctaa

SEQ ID NO: 1287 - DNA, 699 bp, Glycine max var. Williams 82
atggagtttctggataccagaaaactacagttacaacaacaacaactgcaacaacagccacaacattttcatgtgttggcagtggacgacagtgtcatagataggaagcttttggagaggctccttagaggttcttcatgcaaagttacctgcgtggactctggagacaaggctttgaaatatcttgggctaattgatgagcttgatgatacttcttcaaccactttagaatcagaatcttctcatcctccacctcaaccattacagcaagagggaatcaaagtgaatttgatcatgacagactattgcatgcctgggatgagtggctatgatttactcaaacgagtcaagggatcttcttggaaagatgttccagtcgtgattatgtcatcagaaaatgtaccttccagaatcagcatgtgcttagaagaaggggcacaagagtttctattgaagcctcttcagttatcggatttggataagcttcagccgtactttctgaaatcgcttgacaattcttgtgaaaaagaatctgctaacagttccatagattcaaacaatgacaatgtcatcaacaacaacagcaataacagtaacaataacaacaataataatattagcaaaaggaaggccatgtctcctgagcctcatcaggaggagagatcaagacccaaaatgaaagagttagcggtggtgtaa

SEQ ID NO: 1288 - DNA, 171 bp, Glycine max var. Williams 82
atggaaaagaaagtgcacgtgggaatgggatcagttcatcgaactaggccagcatgcaaaagaaaaaactcattccctcctagtagaggaagcatcaagaggaaaatattcatcttcatatgtggaaagataaggcaacgcatccttgcttatatggtcagctcaacttag

SEQ ID NO: 1289 - DNA, 1464 bp, Glycine max var. Williams 82
atggcatcctggttattgggaaggtcgagtaggatcttgattcatcaacatcaccaccttcacaaaaagtacttgcctttcttgttaggaccatttcttaaccataataatagctcttgttcctcttttccatcaactgaaccatttaggtgccgtgatgcatttccgggtaagaactcatcacccaccctcttccgattctcgcgtcatgaatcaaccaaagctgaggcacaattggaattggagcaagatgttgccaccgaggatgagcctaatcaggtcattgattttcctggagggaaagtgggatttacttctgaaatgagattcatttctgagtctcctgagaaaagggtgccctgttatcgtgttcttgatgacaatggtgagatcgttaaatacagcaactatgtacaggttagcaaggaaatgggtgtgaagatgtattctgacatggtcactcttcaaactatggacaacatattctatgaagtgcagaggcaaggtagaatttccttctacctcacccaaatgggggaagaagcagttaacattgcatctgctgctgcacttgctcctgatgatataatattgcctcagtaccgggagcctggagttctattgtggcgtggttttacactgcaacaatttgttcatcaatgctttggaaacacacatgattttggaaaaggcaggcagatgccaatacattatgggtctaaccagcacaattacttcacagtgtcatcccccattgcaacacaacttcctcaagctgttggagctgcttattcccttaaaatggatgggaaaagtgcatgtgcagtcactttttgtggggatggtgccaccagtgagggagattttcatgctgctatgaattttgcagcagtaatggaggcccctgttgtttttatctgtcgtaataatggatgggcaatcagtacacctgtggaagaccaatttcgaagtgatggtattgtagttaagggtaaagcttatggcatctggagcatcagagtagatggaaatgatgctcttgctgtttatagtgcagttcacactgctagagaaatcgctataaaagaaaaaaggccagttttaattgaggctctcacttatagagttggacatcactctacatctgatgattcaactaagtaccggggaactgatgagattgaatattggaagatggcaaggaatccagtgaataggttcaaaagatgggtagaaaggaatggttggtggagtgacaaggatgaattggagcttagaagcagtgtcaggaagcagttaatgcatgcgattcaggtggcagagaaagcacaaaaacctccacttcaggacttatttaatgatgtctatgaccaaataccatcaaaccttcaggagcaagagagactaattagaaaaaccatcgagaagcatcccaaagactacccttctgatgttcctttgtag

SEQ ID NO: 1290 - DNA, 1839 bp, Glycine max var. Williams 82
atgaataaggatcatagccctccagcttctgcatcttacgtggtggttgcatgtgatgccactagggaccgcactgaacacgagatcaaactcgttgttgatcatgttcgggccaggcgtgtctttctctcttctggtgacaagttgcttgtgctatgtgtcttgcataaggtgtctcaccctatggggtaccagacattagcatgtcccgagtcttttgctggaaccaactttcgtgcaatggaggatgaagtcaagaagaaagttgatgcatatgcaactgagcttttgtcaagttatgaagattttgaaagtgaaggggtcagtatcgaagttaaagtcaccgcgggatttccaattaaacatgttgttttacaagaggttacaaactataatgcatcttgggtaatacttgacagacatcttcggcgcgacctgaggtaccaccttaacaagatgccatgcaaggttgcattggttaaagatgacttgtctctggatatctggagatctcattatgtacatgagacaaagatcactgaaacaaaatgtgtatattctttgtcaaagtttgtgtcgctagcagattgtcatagtgttgaagacattgagcattctattatctcttgcaaaagctatccccattctatattttcttctgatggctctagtacgattaggagctatacaaagcagtcatcatatggtaacaggtcacgggagaacagttccttatcagattttggatcttcttctaagcaagaaagaacaggactaaacatcaaaggagaatgtaggctcattacttctcagattgaccaaaagcaaaaccaaagtggctttctgccaaaacattcagatgcaccgcttctttgtactggctgtgggacaagaactgagttgtctatcaaggagtcaatgaagttcagctactctgacatacaaaatgcaacaaatgatttttcaaaggataacttattaggtgaaggtggatatggtcacgtatataagggtgtgcttaaagatggacaacaaattgcagcaaaggtaaggaaacaagaaagttcacaaggattttcagaatttcattctgaggtgtacgtcttaagttttgctcgacacaagaacatagtgatgctgttgggctattgttgcaaagaaaataaaaacatcctgatttatgaatttatttgcaacaagtctctccattggcatttatttgaaaataatgaagctgttcttgagtggcaccaaaggtatgccattgccgttgggactgcaaagggattgcgttttctacatgaggaatgccgtggtggtcctattattcatcgggacatgcgaccaagcaatatccttctcacccatgattttgttcccatgctaggtgactttggtcttgccaaatggaagactggtgatgatactctacaaacaaggataatgggaacattaggataccttgctcctgagtatgctgaagacggaattgtttctgtgggaacagatgtgtattcttatggcattattctgctacaattgatatcagggcgccaggttggcaattccaacaatccagaacaacaacaacaacaatctctccgacaatgggctgagccaatgataaagaatttggctttacatgaactgattgatactcatctaggggaatcatatgacacgcatgaactctacctcatggctaaagcagcatacttctgtgtacaaaggaaacctgagatgcgtccatcaatgggagaggttgtgcgacttcttgagggagaaagtagccatttccactccttggaagatcaatttgtaactaattataatttataa

SEQ ID NO: 1291 - DNA, 2205 bp, Glycine max var. Williams 82
tttggactagacaaggggaagtgcatgcttctgtccttgattcattggacgatcgtttctcactctccattgcaacttttcacgttattatgtataaccccatttcatgtcaacgttcaaggtttaacattggatcgagcatagaataattgatatttgagtatgaataaggatcatagccctccagcttctgcatcttacgtggtggttgcatgtgatgccactagggaccgcactgaacacgagatcaaactcgttgttgatcatgttcgggccaggcgtgtctttctctcttctggtgacaagttgcttgtgctatgtgtcttgcataaggtgtctcaccctatggggtaccagacattagcatgtcccgagtcttttgctggaaccaactttcgtgcaatggaggatgaagtcaagaagaaagttgatgcatatgcaactgagcttttgtcaagttatgaagattttgaaagtgaaggggtcagtatcgaagttaaagtcaccgcgggatttccaattaaacatgttgttttacaagaggttacaaactataatgcatcttgggtaatacttgacagacatcttcggcgcgacctgaggtaccaccttaacaagatgccatgcaaggttgcattggttaaagatgacttgtctctggatatctggagatctcattatgtacatgagacaaagatcactgaaacaaaatgtgtatattctttgtcaaagtttgtgtcgctagcagattgtcatagtgttgaagacattgagcattctattatctcttgcaaaagctatccccattctatattttcttctgatggctctagtacgattaggagctatacaaagcagtcatcatatggtaacaggtcacgggagaacagttccttatcagattttggatcttcttctaagcaagaaagaacaggactaaacatcaaaggagaatgtaggctcattacttctcagattgaccaaaagcaaaaccaaagtggctttctgccaaaacattcagatgcaccgcttctttgtactggctgtgggacaagaactgagttgtctatcaaggagtcaatgaagttcagctactctgacatacaaaatgcaacaaatgatttttcaaaggataacttattaggtgaaggtggatatggtcacgtatataagggtgtgcttaaagatggacaacaaattgcagcaaaggtaaggaaacaagaaagttcacaaggattttcagaatttcattctgaggtgtacgtcttaagttttgctcgacacaagaacatagtgatgctgttgggctattgttgcaaagaaaataaaaacatcctgatttatgaatttatttgcaacaagtctctccattggcatttatttgaaaataatgaagctgttcttgagtggcaccaaaggtatgccattgccgttgggactgcaaagggattgcgttttctacatgaggaatgccgtggtggtcctattattcatcgggacatgcgaccaagcaatatccttctcacccatgattttgttcccatgctaggtgactttggtcttgccaaatggaagactggtgatgatactctacaaacaaggataatgggaacattaggataccttgctcctgagtatgctgaagacggaattgtttctgtgggaacagatgtgtattcttatggcattattctgctacaattgatatcagggcgccaggttggcaattccaacaatccagaacaacaacaacaacaatctctccgacaatgggctgagccaatgataaagaatttggctttacatgaactgattgatactcatctaggggaatcatatgacacgcatgaactctacctcatggctaaagcagcatacttctgtgtacaaaggaaacctgagatgcgtccatcaatgggagaggttgtgcgacttcttgagggagaaagtagccatttccactccttggaagatcaatttgtaactaattataatttataacggttaaggtttcattggctcagtatgtgtgttgtagtcattttcttctttgtgtgtgtgtcctttctgctttggtttctccctttttttttttcgtgcttgggagattatttagtttgtataaatggatggcttacatatgcacgtcggtttgctcttataaatgccttttatgttatcctgatggaatggatgcgaattgcg

SEQ ID NO: 1292 - DNA, 546 bp, Glycine max var. Williams 82
atggccctggagaactgtttgcgagtgaccacagtaggcacagccacaccccaatgcttttctccattttttccatcttcaagggataaacttgtcttcccaactcacagaggtttcaagaaatccttgcaaaactcaacactgtcatacccttatctttactccaccggtgctgcctatagaaaatcccgttttgtttgcaatgctcgtgaagcagtaaatgaagttaaagtggtgactgactcaagctggaacaaccttgtcattgcaagtgagacccctgtgctggtagagttttgggcaccatggtgtggtccatgcaggatgatagcacctgctatcgatgagctagcgaaggaatatgctggaaaaattgcatgctttaagcttaacacagatgattctccaaacatagcaacacagtacggcatcagaagcataccaacagttctgttcttcaagaatggagagaaaaaagaaagcataattggtgcagttcccaaatccactctgtccgcaacagtggaaaaatacgttgattcataa

SEQ ID NO: 1293 - DNA, 1083 bp, Glycine max var. Williams 82
atggaggctaggactaagatgtctgaagtgctaccattcatagtgatggtgattatggaaggttggaccataggactcacgatttttgcaaaaactgcaataactaatggaatgagtccatttgtgttcattgtttataccaatgctctggccactataatactgttcccttgtttctttttaccacaccaagaggacagaaaggagaggccatcttttactttctctttgttcatgcggttcttgttcctcggttttatagggatgacgatgactcaggcctttttattcctgggtctaagctatagttcgccaatacttgtgtgtgccatgagccacttgatcccaacgtttaattttctgctctctctcattctcaggaagacagagttgaatctgagaagccctggtatccaagtccaagtgattggaatcttggtatcaataatgggagcagtgttagctgaattctttaagggaccacttgtaagaccctcttctcaccaccttagacacactgataagcaatatctggtattctcctcaacaccagagttttgggttcttggtggcgctttgcttgctgcagcttccttctcagtttcaatttccaactttattcagaaagaaactctcaagcaatatccagaaccaatgaagctgctctcttattctagcttacttgggactatccttagtgcaatagtctcggggatagttgagagggacataaatgcttggaagataaagcgtaacaaggatgtcattctcattgttctaactgcactagttgggggagtgattcgtcctaatattcaagtatggttcactcgcatgaagggtccactttatgtgccacttttcaagccatttggtattgcatttgccactacttttgcagtttgcttcttttcaaacagccttcattatggaagtgtgataggaacaactgtacttggaatggggcattatacagtaatgtatggacaactcagagaaaatgaagaagagacaagctgtgacgaaagctctgattctttggacaagatggtaccccttttgcaagaaaagatggaagtgtga

SEQ ID NO: 1294 - DNA, 1652 bp, Glycine max var. Williams 82
tctcatcttcatccacctttgcttcttatattataagagcatatacacacaagtgttatcaattcaagctcaataaagagagggtaagtgggtttcttggtgcttgtgcaagctccaactaggggcgcacacacacaaagatcatataccacatactcatagtccctctctaattatagatatattaaggaagaaagtgctatttatatcatcattaacatatatattagaactctctaagtgagagcaaaagaaggaaattaaattcaatggaggctaggactaagatgtctgaagtgctaccattcatagtgatggtgattatggaaggttggaccataggactcacgatttttgcaaaaactgcaataactaatggaatgagtccatttgtgttcattgtttataccaatgctctggccactataatactgttcccttgtttctttttaccacaccaagaggacagaaaggagaggccatcttttactttctctttgttcatgcggttcttgttcctcggttttatagggatgacgatgactcaggcctttttattcctgggtctaagctatagttcgccaatacttgtgtgtgccatgagccacttgatcccaacgtttaattttctgctctctctcattctcaggaagacagagttgaatctgagaagccctggtatccaagtccaagtgattggaatcttggtatcaataatgggagcagtgttagctgaattctttaagggaccacttgtaagaccctcttctcaccaccttagacacactgataagcaatatctggtattctcctcaacaccagagttttgggttcttggtggcgctttgcttgctgcagcttccttctcagtttcaatttccaactttattcagaaagaaactctcaagcaatatccagaaccaatgaagctgctctcttattctagcttacttgggactatccttagtgcaatagtctcggggatagttgagagggacataaatgcttggaagataaagcgtaacaaggatgtcattctcattgttctaactgcactagttgggggagtgattcgtcctaatattcaagtatggttcactcgcatgaagggtccactttatgtgccacttttcaagccatttggtattgcatttgccactacttttgcagtttgcttcttttcaaacagccttcattatggaagtgtgataggaacaactgtacttggaatggggcattatacagtaatgtatggacaactcagagaaaatgaagaagagacaagctgtgacgaaagctctgattctttggacaagatggtaccccttttgcaagaaaagatggaagtgtgaatagaacttcgaaagattctagaggcagaggaattcacctatttttcagaatcttcctccctttcgtttgattcgtttcaaacgattgtgatacaaatacaagtctctcccatgttgcaaatattttaattgtaattaactccaactgtgtatatataaatcatgaaacatgtaagtagcatgcaaaaaaaggtggtcgaatttttatttgagacctttatattttcgttgtacaaaaaatttctctgtaaatatatgtaatacacgtatctcgagctttactgtactgatatatgtgat

SEQ ID NO: 1295 - DNA, 1095 bp, Glycine max var. Williams 82
atggaggttaataagactaagatgtctgaggtgctgccattcataatcatggtgattatggaaggttggactataggactcacgatttttgccaaaactgcaataactaatggaatgagcccacttgtgttcattgtttataccaatgctttggccactataattctgttcccttgttcctttttaacacaccaagaggacagaaaggagaggccatcttttactttctctttgttcatgcgattcttgttcctcggttttatagggataacgatgactcaggcctttttattcctgggcctaagttatagttcgccaatacttgtgtgtgccatgggacacttgatcccaacgtttaactttcttctctctgtcattttcaggaagacagagatgaatttgagaagccctggtatgcaagtccaattaattggtatcttggtatcgataatgggagcagtggtagcagagttcttcaagggaccacttgtaagaccctcttctcatgaccaccttaaacacgctaataagcaatatctggtattctcctcaacaccagagttttgggttcttggtggcgctttgcttgctgcttctttcttctctctttcaattttcaaccttttccagaaagaaaccgtcgagcgatatccggaaccaatgaaagtgctttcttattctaacttacttggaaccatccttagtgcaatagtctcgtggatagtagagagggaaataaatgtttggaagataaagcgtaacaaggatctcattctcattgttctaactgcactcgttggtggtgtgattcgtcccaatattcatgtatggttcactcgaatcaagggtccactttatgtgccacttttcaagccctttggtattgcctttgccactacttttgcactttgcttcttttctaacagtcttcattatggaagcgtgataggaacaactacacttggaatggggtattatacagtaatgtatggacaaatcaaaggaaatgaagaagagacaagctgtgacgattgctcatcagattctttggacaagaagatacctcttttgcaagaaaagatggaagaagtgtga

SEQ ID NO: 1296 - DNA, 1902 bp, Glycine max var. Williams 82
atggacaagaagctgcccctcttgttcattttttcagctgccttggtgatggaagcagtgttgttggttagtgttggagctgaaccagtggaagataaacaagctttgcttgatttccttgacaacatgagtcactctcctcatgtcaactgggatgagaactcttctgtttgccaaagctggagaggagtgatttgcaactccgacaagtcccgagtcatagaacttcgattgcctggagctgggttgagtggtccaatccctcccaacactctgagtcgcctctcggcactcgaggttgttagtcttagatcaaatggtataagtggccctttccctcatggtttctctgagctgaaaaacttgaccagcctctttctccaatccaacaacatttctggacaattaccattggatttttcggtttggaataaccttagtgttgtcaatttgtcaaacaattccttcaatgagaacatccccttttcaatttcaaaactgactcatctcacctcattagtccttgccaacaactccctttcgggtcagattcctgatctcgatattccaagcctgcgggagctgaatttggccaacaataaccttagtggggctgtgcctaaatcccttcttagatttcctagttcggcctttgccggtaacaatcttacatcagcagatgctctccctccagcttttcctatggagccaccggctgcctatccagcaaagaaatcgaaaagactcggtgaacctgcactgttgggtatcatcattggtgcttgtgtgttgggatttgtggtgattgcaggtttcatgattttgtgctgctatcagaatgctggtgtaaatgcgcaagcagtaaaatcaaagaaaaaacaagccactctgaaaacagaatcttctggaagtcaagacaaaaacaacaaaattgtcttctttgagggttgcaatcttgcatttgatctagaggatttgttgagagcttctgctgaaattcttgcaaagggtacctttggcatgacatataaggctgctctagaggatgcaaccactgtggcggtgaagaggttgaaggaggtcacagttggaaaacgagattttgaacagctgatggaggtggtggggaaaattaagcacgaaaatgtggatgcagtgagggcatattattattcaaaggaggagaaactcatagtatatgattactatcaacaaggcagtgtttgtgcaatgttacatggcaaaggaggggaatgcagaagttctttagactgggatagccgcttgagaattgcaattggtgcagtcagaggcattgctcacatccacgctcaacatggagggaaactcgttcatggaaacataaaagcctcaaacatcttcctcaactcacaaggatatggatgcatatctgatattggcttggcaacattgatgagtccaatacccatgccagcaatgagagcaactggataccgtgcaccggaagtaacagacacgcgcaaagcaactcatgcatcggatgtgtacagctttggggtgctgctacttgagcttctgactgggaaatcccccataaacagcacagaaggtgagcaggttgtccacttggttagatgggtgaattctgtggttagagaggagtggactgcagaagtgtttgatgtagaattgttgaggtatccaaacatagaggaagaaatggtggtgatgctacaaatagggatggcttgtgctgcaagaataccggatcagagaccaaagatgcctgacttggtgagaatgatagaggagattcgtcgagtaaatacgccaaatccaccatccactgagtctagatcagaagtttctacaccaacccctcgtgcagttgacattccttctacctctgttcaacaatga

SEQ ID NO: 1297 - DNA, 765 bp, Glycine max var. Williams 82
atggcagagaccattcgtttggctgttgctgttcttggcaatgcagcctcagttgccctttatgctgcaccaatggttacctttagaagagttataaggaagaaaagcacagaggagttttcatgctttccttacatcattggcctcttgaattgtctccttttcacttggtacggtttgcctgttgtgagttacaagtgggaaaatttccctctcgtcacagttaatggagttggtattgttctcgagttatcctatgttctcatttacttctggtatgcttcagccaaaggaaaggtgaaggtagccatgactgcaataccagttttgctggtgttctctataattgctgcagtgtcagcttttgcattccatgataatcatcaccggaagcttctcgtaggtagcatcggcttaggtgtttcagtaacaatgtatggatcccctttgattgtaatgaagaaagttatacaaaccaagagtgtggaattcatgccactaccgttatccatgtgctcatttttagccactgttctctggctgatttatggacttctcattcgtgatatattcgttgcgggtcctagtgcggttggaactcccttggggatcttgcaacttgtactttactgtaaataccgaaaagggagtgttgtggaggatccaagtaagggggaccttgagaagggtaacttggagaaggtggaaatggaaattgggaaagtggaaatgaatgtcacgaatcacatgaacggacactcgtga

SEQ ID NO: 1298 - DNA, 1089 bp, Glycine max var. Williams 82
atggaggacggcgcaggaagaggtttggaatgcccgaagactatggatgggaaggcgagtaacgggaatgggttagagaaggaaattccttcttgttgtctgaaggctaaggcttcaatccctgagtctgaggcgaagtgccattctactgttgtttctgggtggttctcagcttctcaaacttgctctgggaaatctgggaaagctgtttatttcaacaacccaatgtggccaggagaagcccattcaatcaaagtagaaaagatcttatacaaggaaaagtcggagtaccaagaggtcttggtttttgagtcatcaatgtatgggaatgtgcttgtacttgatggaatagttcaattgactgagagggatgaatgtgcttaccaggagatgatagctcatcttcccctctgttcaattcattcgcccaaaaatgttttagttgttggtggtggagatggcggtgtactaagggaagtagcccgccatagctctgtggaacatattgatatttgtgagatagataagatggttattgatgtttctaggaagttttttccacagttagctgttgggtttgaagattctcgagtgcatctgcatgttggtgatgctgttgattttcttaaatccgctcctgaagggaagtatgatgccataattgttgattcctcagatccagtgggtcctgcccaggaacttgttgagaagcctttctttgatacaatagctagggcattaaggcccggtggagttctttgtaatatggcagaaagtatgtggcttcatacacatcttattcaagatatgatctctatttgtcgagaaacattcaaaggttctgtacgttatgcatgggcaagtgtaccaacgtatccaagtggcatgataggctttattctctgtgcaacggaagggccgcctgttgattttgtaaaccctatcaatcccattgaaaagttggaaggtgctaatgagcacaaaagagaacttcaattctacaattcagagatgcactcagctgcttttgcgttgcctgcgttcctgaagagagaagtgagcctgctgcgtgatctctcccttcagtag

SEQ ID NO: 1299 - DNA, 837 bp, Glycine max var. Williams 82
atgtatgcagagactggtcttttcttcccatatttgcacaacgtctctcacggccttcatcagcttgaggagtactgcaaaacccagaagtccaatgcttcaatggatgaccttgttcagtcttctgccatgtcagagtatgatttggcagctgagggagatctgttcaaagctcctgaacctattattgaagagccaatcatggacatgtcagcggccatctcaatgatgtcttgtggggaagatgtctcgtcacagggactaaagtccactgatattgatattcttcaaaatgatcagtttctgagtgaggtgttctatgaatgtgaaaaggatctcttagaaaaggcagcaatagagtcaccattctctgagattctggaaatcaaggttccttttctgaacattgatgagaacacaattcaagaaaacaagccatttactgacatgcaattagcaaagagtgtcagctcaggaagtttgagctcaatggactggatgcgtggagctgcaatgaagcctgctttcattgatatctctgcaatagatttcaatgcagattatggcatgcggagatcatttagtgaaggagatataaagactcttggtaatggtaacatgaacatcgtccaatcaccccttgagaggccccttcttatcagcaactgcaccagtgaggaacgcttccaaaagctctccagatacaggaataagaagacaaagaggaattttgggaggaaaatcaagtatgcttgcaggaaggcacttgctgacagtcagccaagaatccgtggaagatttgcaaggactgaagaatctgatgtcaagagggaatga

SEQ ID NO: 1300 - DNA, 705 bp, Glycine max var. Williams 82
atggcagcttttacatcaattgctgtacagtactcatccacatcatctttacagtctttggtgccttctttagaggctacacgcgatcataactcatggtgggggagagtgagatcatacaaacccacagcaaaaatttcactccaacagaatatcacaagaggcttaacaatccaaaatgcagccacaaaaccagcaaagtcgccagctgaagaagactggaaggttaagcgagaatatctgctggaaaaaagggtaagaagtgtggatgcaaaggaagctttccgtcttcagaaagaaaataagtttgtgattctcgacgtaaggccagaagcagagttcaaagaggctcatcctccagatgctatcaacgtgcaaatatataggcttataaaagagtggacagcatgggacattgctagacgtgctgcatttgcattttttggtatttttgctgggactgaagagaacccagagttcatccagtctgttgaagcaaaattagataaaaatgcaaagataatagtagcttgctcagcagggggtacaatgaaaccatcacaaaatctgcccgaaggtcaacaatcaaggtctctcatagcagcttacttgctggtccttaatggttataccaatgtcttccatcttgaaggtggtctttactcatggtttaaagaggatctgccaagtgtttcagaggagtga

SEQ ID NO: 1301 - DNA, 1559 bp, Glycine max var. Williams 82
taaaggactctcaaaacgtcaaccacaatctcagattctgaccactaaatatctacaattaactcatctcacacaaattgcccaaagtacactatcccatgatcttcccactaattcaaccattgaatattgaccattaactaaaaaaatttgaaatctcgtatctgatttttttttttttcagttgaaactgagcttcaaagcatggcagcttttacatcaattgctgtacagtactcatccacatcatctttacagtctttggtgccttctttagaggctacacgcgatcataactcatggtgggggagagtgagatcatacaaacccacagcaaaaatttcactccaacagaatatcacaagaggcttaacaatccaaaatgcagccacaaaaccagcaaagtcgccagctgaagaagactggaaggttaagcgagaatatctgctggaaaaaagggtaagaagtgtggatgcaaaggaagctttccgtcttcagaaagaaaataagtttgtgattctcgacgtaaggccagaagcagagttcaaagaggctcatcctccagatgctatcaacgtgcaaatatataggcttataaaagagtggacagcatgggacattgctagacgtgctgcatttgcattttttggtatttttgctgggactgaagagaacccagagttcatccagtctgttgaagcaaaattagataaaaatgcaaagataatagtagcttgctcagcagggggtacaatgaaaccatcacaaaatctgcccgaaggtcaacaatcaaggtctctcatagcagcttacttgctggtccttaatggttataccaatgtcttccatcttgaaggtggtctttactcatggtttaaagaggatctgccaagtgtttcagaggagtgaatctagtgccaagaatgtgtgtagtgaagcctagacctagttttgaccataaagagagtgctgataaatgcgtatgaagaatagaaccaacgaattgaaatgtcattatttaactattgcagaaaaatagtatgcaagaattaccaacaaaaatgtcaggttgcattctgtatagattgcattcctagcttaaactggaaagggtccacttatttatcagcagcatcttatcagcattttgtgatttagcaccatgcataaaccatgtttctgaacaactgatgcatattgattcaatgaaaaaaccaagttttgcattcaattcattgctctccacaccacaaaagaatgtgggggaaaaataaaaccactcatgcgtacaaaagtacaacctgggattccagcaacctcatagagcttgtcattttctaaacccctccaaagatttggtaatggttttctgctctcaaatttagcaggtgaaattgccactgcctgcagtcgctaattctcacttctatcatcctacaaacaataatcatctattacataaattgtcaatcaaatagtaaaacaaataatgaattctaaactttacaagcaacctgaacacgatgataagcaaaataaaccactatacagttgttttt

SEQ ID NO: 1302 - DNA, 1610 bp, Glycine max var. Williams 82
gcaactaaaatgcatgacatctgttagactgttaccattctctgccctccaaaatttccaaagctttgcaacttctatttatacttgttctttttgtaccttgtttagattctctttagctcatatttttctttctttgccccatgtgctaatcaaaacaatacaaacctcgatcagttcatgattcgtgtacacaaaagccttttccaaccacagattgattcttcttcctttctttagatagggacaattcaaagagagagagagcatgaaaattgttaaggaatggttcaagtggtcgcagactgtgcttagcatgcttttagtgcaagtttttgcaaccgggatgcagattctatcgagggttatactggttgagggcactttcatttttgcactcattgcataccgtcatgctgttgctgctatttgtgttgctccttttgctttctactttgaaagagacggcgcgaagaagttgaggtggtcgatttggttttggctcttcctaaacgccttggtggggataacaatggccatgggattgttctattatggtctgcgagacacatcagctacctactcagtgaattttctcagcttggttcctattttcacttacattatctctattgtatgcagaatggagaggttgaggtttcaaacatggacgagtaaagtgaagacaatgggggcagttttgtgtgttgggggagcattaacaactagtctatacaaggggaaggaattctatattggtcaaagtagtcatcagactcacagtacagttgaggcatcaaaaaccaacatgcttcgtggcactctctttttgcttggaagctgcttgtcatacacagcttggttcattgtgcaagttaagttgcttgaaatatttccgttcaaatattggggaacaatgctcacgtgcattatagcatcaattcaagcaaccatagtaggaatatgcttagatggcagaaaggttacttggagtttaaagtggaatctacaactagtgactataatatactcgggagcattggctaccgctgctacattttgcttaatttattgggcaattgccatcaaaggaccaacttatcccacgatgttcaatccattggctcttctttttgtggcaatatcagaagctctcttactgggtgaaccaatcagtcttggaatgattgtgctcatttttgtggggcaaagggaaggagacgcaatgtatgcttcaagcatctggagaagtttcaacaactatggcagctgagtctgctggagtgcactccacagccacagtggtaccaagtttttcacctaggcatgcagttcttagagttgaaaagaatgacagaaactgaaaagtaaaaatgaaatactactcctgaaggcaataattagtttttatctcagaattcttgccttgatatttaagattaaatgcttccatgaaacatatattaccattctcaatggataggtcacagatgcaaaatcttgattaagcaatttttgtaaaaaaaaatagggttattgaaacaaatattgtaaaataggagcgaatatatatgatagagaattgatggcttaataaaaatataggatgc

SEQ ID NO: 1303 - DNA, 3765 bp, Glycine max var. Williams 82
atggctcctcaaaacgttttacaaatggtagacactaatattgctgatgaaaaagatgaacctaagaagaaagtggttaaaactttgtcattcttcaaactcatgagctatgctgacgtgatagactggattctgatgggtttgggaggtctaggttcggttgtgcatggcatggcatttcctgttgggtatctcttgttgggaaaagctcttaatgcttttggaaacaatatcaacgacatagatgccatggttaatgctcttaaaaaggttgttccatatgtgtggtatatggccatcgcaacatttcctgctggggtacttgagattagttgttggatgtatgcaagtgaaagacagttatttcagctaagattagcatatctaagagcagtcctcaaccaagagataggtgcttttgatacagaattaacaagtgcaaaagtcatcagtggaataagcaagcacatgagtgtcatacaagatgccattggtgagaagttgggtcacttcacctctagctgtgcaactttctttgctggaattgtgattgctgccatatgctgttgggaagtaacgcttctttgtttagtggttgttccgcttattcttataataggggcaacttacaccaagaaaatgaacagcatatcaaccaccaaaatgcttttccattctgaagctacatctatgatagagcagacaatatcacaaataaaaacagtttatgcttttgttggagagagctctgcaatcaaatcctttacagagaacatggaaaaacaatacgttataagcaaaggggaggcacttgtgaagggagttgggacagggatgtttcaaacagtgagtttctgttcttgggctctcattgtatgggttggagctgttgtggtcagagccggaagagcaaccggaggagacataataactgcagtgatgagtattctctttggtgccatatctctcacttatgcagcaccagacatgcaaatatttaatcaggcaaaagctgcaggatacgaagtttttcaagtgatccaaagaaagcctctaataagtaatgaatcagaagggatgatgcctagcaaaatcaaaggtgacattgaattacgagaagttcacttttcctacccatcacggccagagaaagcaatccttcaaggactgtccttgtcaattccagcaggaaagacaatagcactagttggtagcagtggctgtggaaagagcactgttatttccctggttagcagattttatgacccctcgagaggagaaatttttattgatcatcacaatataaaggatctcaatctgaagttcctgcgaagaaatataggggctgtttcccaagaaccatcactctttgctggcaccatcaaggataatttgaaagtgggaaaaatggacgcagatgatcaacaaattcagaaggcagcagtaatgtcaaatgcacactctttcatatcacagctgcctaatcagtacctaacagaggtaggagaaaggggtgtccaattatcaggaggccagaaacagagaattgcaatagcaagagccattctgaaaaatcctcccatccttttgcttgatgaggccactagtgccctcgattcagagtctgaaaagctggttcaagaagcacttgagacagctatgcagggaaggactgtcatcttgattgcacacaggctctcaacagttgtaaatgcaaatatgattgccgtagtagagaatggacaagttgccgagacaggaacacaccagagtttgttggacacaagcagattctatagtacattatgcagcatgcagaaccttgaaccagttcctgaatctagagctatagtttccaagaatagaagtgtatgtgaagaagattttcttgatgaaactagaccactagtagaggtgcagggagaggtccaaataaatatcactgagccttctgtgctaaaggaacagaacaaaatgagcagcggagaaagacatatatttttcagaatttggtttggtttaagaaagagggagctggtgaagattgctattggctcatttgcagcagctttctctggaatctcaaagccattttttgggttcttcatcatcactattggagtagcatacttcgatgaagatgcaaaacaaaaagttggattttattcagccatcttcgctgcagtagggttgctttcattattcagccacaccttccagcattacttcattggagttgttggagaaaaggccatggcaaatctaagacgtgctctgtattcaggtgtgctacgtaatgaagtaggctggtttgacaaatcagagaatactgttggttcattgacttcacgcattaccagtgacactgccatggtcaaagttatcattgctgatcggatgtctgtaattctgcaatgtgtttcctccatactcatagcaacagttgtcagcatggctgtcaactggagaatgagtttggtagcttgggctgtgatgccctgccacttcataggtggtctcattcaagccaagtctgccaaaggattttcaggtgactactctgctgcacattctgagcttgttgctcttgcatctgagtccacaaccaacataaggacagttgcatcattctgtcatgaagaacaagtactggggaaagccaaaacatccctggaaattccaaagaaaaattataggaaagaaagtatcaaatatgggatcattcaaggcttctccctttgcttgtggaacattgcacatgctgttgctttgtggtacacaacaattctgattgacagaggtcaagccacctttaaaaatggaataagatcataccaaattttttctctaacagttccttccatcacagaattatacacactgatcccaactgtcatctctgctatcagtatactaactccagcattcaaaacccttgaccgtaaaacagaaattgaaccagacacaccagatgattcccaacctgagaggatccatggaaatgtagaatttgaaaatgtaaaattcaactacccttcaagacccacagtcactgttcttgacaattttagtttacgaattgaagctggattgaaggtggcttttgtaggaccaagtggagctggaaaatcctctgttttggcccttttactaagattttatgatccacaggcaggaaaggtattaattgatgggaaaaacatacagaaatataatataagatggttaaggacacaaataggactggtacaacaagagccactgctttttaattgctcggttagagacaatatttgctatggcaatagtggggcttctgaaagtgaaatagtggaggttgctaaagaagcaaacatacatgaatttgtaagtaatctaccaaatggatataacactgttgttggagagaaaggctgccagttttccggaggacaaaagcaaagaatagctattgccagaacattactaaagaagcctgcaatattactcctagacgaagcaacaagtgctcttgatgctgagtctgaaagaattatagtgaatgctttaaaagcaatacatctgaaggaagacagtggcttgtgttcaagaaccacccagatcacagtagctcataggctttccacagtaataaactcagatactatagttgtcatggataaaggtaaagttgtagagatgggttcccactcaaccctaatagcagcagaagcaggactttattcaaggatattcaggttacagagctttgaagaaacttcatag

SEQ ID NO: 1304 - DNA, 3892 bp, Glycine max var. Williams 82
ctactcatgcactactgttgccaataatggctcctcaaaacgttttacaaatggtagacactaatattgctgatgaaaaagatgaacctaagaagaaagtggttaaaactttgtcattcttcaaactcatgagctatgctgacgtgatagactggattctgatgggtttgggaggtctaggttcggttgtgcatggcatggcatttcctgttgggtatctcttgttgggaaaagctcttaatgcttttggaaacaatatcaacgacatagatgccatggttaatgctcttaaaaaggttgttccatatgtgtggtatatggccatcgcaacatttcctgctggggtacttgagattagttgttggatgtatgcaagtgaaagacagttatttcagctaagattagcatatctaagagcagtcctcaaccaagagataggtgcttttgatacagaattaacaagtgcaaaagtcatcagtggaataagcaagcacatgagtgtcatacaagatgccattggtgagaagttgggtcacttcacctctagctgtgcaactttctttgctggaattgtgattgctgccatatgctgttgggaagtaacgcttctttgtttagtggttgttccgcttattcttataataggggcaacttacaccaagaaaatgaacagcatatcaaccaccaaaatgcttttccattctgaagctacatctatgatagagcagacaatatcacaaataaaaacagtttatgcttttgttggagagagctctgcaatcaaatcctttacagagaacatggaaaaacaatacgttataagcaaaggggaggcacttgtgaagggagttgggacagggatgtttcaaacagtgagtttctgttcttgggctctcattgtatgggttggagctgttgtggtcagagccggaagagcaaccggaggagacataataactgcagtgatgagtattctctttggtgccatatctctcacttatgcagcaccagacatgcaaatatttaatcaggcaaaagctgcaggatacgaagtttttcaagtgatccaaagaaagcctctaataagtaatgaatcagaagggatgatgcctagcaaaatcaaaggtgacattgaattacgagaagttcacttttcctacccatcacggccagagaaagcaatccttcaaggactgtccttgtcaattccagcaggaaagacaatagcactagttggtagcagtggctgtggaaagagcactgttatttccctggttagcagattttatgacccctcgagaggagaaatttttattgatcatcacaatataaaggatctcaatctgaagttcctgcgaagaaatataggggctgtttcccaagaaccatcactctttgctggcaccatcaaggataatttgaaagtgggaaaaatggacgcagatgatcaacaaattcagaaggcagcagtaatgtcaaatgcacactctttcatatcacagctgcctaatcagtacctaacagaggtaggagaaaggggtgtccaattatcaggaggccagaaacagagaattgcaatagcaagagccattctgaaaaatcctcccatccttttgcttgatgaggccactagtgccctcgattcagagtctgaaaagctggttcaagaagcacttgagacagctatgcagggaaggactgtcatcttgattgcacacaggctctcaacagttgtaaatgcaaatatgattgccgtagtagagaatggacaagttgccgagacaggaacacaccagagtttgttggacacaagcagattctatagtacattatgcagcatgcagaaccttgaaccagttcctgaatctagagctatagtttccaagaatagaagtgtatgtgaagaagattttcttgatgaaactagaccactagtagaggtgcagggagaggtccaaataaatatcactgagccttctgtgctaaaggaacagaacaaaatgagcagcggagaaagacatatatttttcagaatttggtttggtttaagaaagagggagctggtgaagattgctattggctcatttgcagcagctttctctggaatctcaaagccattttttgggttcttcatcatcactattggagtagcatacttcgatgaagatgcaaaacaaaaagttggattttattcagccatcttcgctgcagtagggttgctttcattattcagccacaccttccagcattacttcattggagttgttggagaaaaggccatggcaaatctaagacgtgctctgtattcaggtgtgctacgtaatgaagtaggctggtttgacaaatcagagaatactgttggttcattgacttcacgcattaccagtgacactgccatggtcaaagttatcattgctgatcggatgtctgtaattctgcaatgtgtttcctccatactcatagcaacagttgtcagcatggctgtcaactggagaatgagtttggtagcttgggctgtgatgccctgccacttcataggtggtctcattcaagccaagtctgccaaaggattttcaggtgactactctgctgcacattctgagcttgttgctcttgcatctgagtccacaaccaacataaggacagttgcatcattctgtcatgaagaacaagtactggggaaagccaaaacatccctggaaattccaaagaaaaattataggaaagaaagtatcaaatatgggatcattcaaggcttctccctttgcttgtggaacattgcacatgctgttgctttgtggtacacaacaattctgattgacagaggtcaagccacctttaaaaatggaataagatcataccaaattttttctctaacagttccttccatcacagaattatacacactgatcccaactgtcatctctgctatcagtatactaactccagcattcaaaacccttgaccgtaaaacagaaattgaaccagacacaccagatgattcccaacctgagaggatccatggaaatgtagaatttgaaaatgtaaaattcaactacccttcaagacccacagtcactgttcttgacaattttagtttacgaattgaagctggattgaaggtggcttttgtaggaccaagtggagctggaaaatcctctgttttggcccttttactaagattttatgatccacaggcaggaaaggtattaattgatgggaaaaacatacagaaatataatataagatggttaaggacacaaataggactggtacaacaagagccactgctttttaattgctcggttagagacaatatttgctatggcaatagtggggcttctgaaagtgaaatagtggaggttgctaaagaagcaaacatacatgaatttgtaagtaatctaccaaatggatataacactgttgttggagagaaaggctgccagttttccggaggacaaaagcaaagaatagctattgccagaacattactaaagaagcctgcaatattactcctagacgaagcaacaagtgctcttgatgctgagtctgaaagaattatagtgaatgctttaaaagcaatacatctgaaggaagacagtggcttgtgttcaagaaccacccagatcacagtagctcataggctttccacagtaataaactcagatactatagttgtcatggataaaggtaaagttgtagagatgggttcccactcaaccctaatagcagcagaagcaggactttattcaaggatattcaggttacagagctttgaagaaacttcataggtctatactcgacagttttgtacagatctggaatctgtaactgtaaaaagtgtctgttgtatcaagtcataaaactaggtttttcttgaatttcttctcca

SEQ ID NO: 1305 - DNA, 411 bp, Glycine max var. Williams 82
atggaaagtggtgatgttcctcatgttttggccgttgatgacaaccttattgatcgcaaactcgttgagaaactcctcaggaattcttcttgcaaagttacaactgcagaaaatgggccaagggcattggaattattgggcttaacaagtggtggacagaacaccatgaacggtagatccaaagtaaatatggttatcacagactattgcatgccagggatgacaggctacgagctacttaagaaaatcaaggaatcgtcggtaacgaaggaggttccagtagtgatcatgtcatctgagaacataccaacacgaattaacaagtgtctggaagaaggagctcagatgttcattctaaagcccctcaaacaatctgatgtaaaaaaactgacatgtcagttaatgaattga

SEQ ID NO: 1306 - DNA, 753 bp, Glycine max var. Williams 82
atgcccattgtagcaacctctcttctcttctttcttcttaatttatgcctcagaggcacttatgctgactatggaggtggttggcaaggtggtcatgccacattttatggtggaggtgatgcatctggcacaatgggaggggcttgtggatatggaaatttgtacagccaagggtatggcactaacactgcagcactcagcactgctctattcaacaatggcatgagttgcgggtcttgctatgagatgaaatgtgacactgaccccaaatggtgcctccccggtagcataatcgttactgccacaaacttctgcccccctaactttgcattggctaacaacaatggtggctggtgcaaccctcctttgcaacactttgatcttgctgagcctgctttcttgcaaattgctcaatacaaagctggaattgttccagtttccttcagaagagtctcctgtgtgaagaaaggagggatcaggttcaccatcaatggtcactcttacttcaacttggttctcatcacaaatgttggtggagctggagatgttcattctgtgtccatcaaagggtctagaactgggtggcaaaccatgtctagaaactgggggcagaattggcaaagcaactcctacctgaatggccaaagcctctcttttcaggtcactacaagtgatggcaggactctcactagcaacaacattgtgcctgctaactggcaatttggacaaacatttgaaggggcacagttctag

SEQ ID NO: 1307 - DNA, 3098 bp, Glycine max var. Williams 82
catttgttatacaaccgtttctttgaatagttatttatagtatggatgagatgcacttacttctttctttgccttggtgattcttgctctagtgtatctgattaacacaacttgtgcattctttcttcttaatgctatttttttaatctcttactacctttgaatatattatatgaaatgaaatgaaattgtgatttaatgaaaaagtatcaccttaggaatattgctttttggaggaaataaaaaattgtgtccacttttcaagaagatttgacagagatatggatgtcatgtgagtgtttatccaaaagtgagtgaatgtcttccttcttctaatcacctctgattgcgagcacacaagatgggtggctgtaattgctgatctgcagctacaagtgtgcttaagctgatactcttcaactggagaacattcataagtgagcgaggctaatggatcttgaatccagcaagtgttgggacacctcaaagggctcttggaagactattctgctcttggcctaccaaagccttggtgttgtatatggggacttgagcatttctccattgtatgtttacacaagcacatttgctgaagatattgagcattcagagaccaatgaagagatttttggtgccctttcttttgtcttctggactctgacactggtgccactcttcaagtacgtttttgtggttcttcgagctgatgataatggagagggaggtacttttgctctatattccttgatttgtaggcatgctaaagttagtctcctaccaaatcgacaacacgcggatgaagcgctttctacatataagatggaggaggctccagagaaagatacttctaaagtgaagatgatgcttgagaaatataagggcttgcacacagctctcctaattgtggttcttcttggcacttgtatggtaataggggatggtctacttaccccagctatttctgttttctcggcagtatctggtcttgaggtatctatgtccaagaaacaccaccagtatgctgtgattcccatcacttgcttcatactggtgtgtttgtttgcactacaacactatggtacacatagggtgggattcctttttgctccaattgtgttggcatggctgttgtgcatcagcacacttggtttatataatatattcaaatggaatccgcatgtatataaagctctttcgccatattatatgttcaagttcttgaagaagacaaggataagtggatggatgtctttgggtggaatattgctgtgcataacaggctcagaagctatgtttgctgatcttggacatttctcatatatggctattcagattgcattcacctttctggtatatcctgcgcttatattggcctatatgggtcaagctgcttatttgtcgcatcatcatgattccgaactccaaatcagtttctatgtctcagttccagaaagtgtgaggtggccagtgcttatattagctattctagcttctgttgtgggaagccaagcaatcatcagcggaacattttctatcataaaccaaagccaatctctaggttgcttcccaagagttaaggttgttcatacatctgacaagatacatggtcaggtctacattcctgaaattaattggatactcatgatcctctgcattgctgtgaccattggatttagggacacaaaacacatgggaaatgcttcagggttagcagtgatgaccgtgatgctggtgacaacatgccttacttctttagtaattgtagtttgttggcagaaaccccctataatagctctttgcttcctgttgttctttggctttattgaactgctgtatttctcagcttcactgacaaagttttgtgagggtgcctggttacctattctgctggccctattcctcatgattataatgtttctttggcactatgcgaccatcagaaaatatgaatacgatcttcacaacaaggtgtcactagattggcttctagccttaggtccaagcttgggaattgctagagtcccaggaataggcctagtgttcactgacctcaccactggcatcccagcaaacttctcccgctttgttaccaacctccctgcatatcaccgcatccttgttttcgtgtgtgtaaaatcagtgcctgtccctcatgtccctgctgctgagaggtatctggtaggccgtgtaggacctgctgctcatcggtcctaccggtgtatagtcagatatggatatcgtgatgttcatcaagatgttgattcctttgagtctgaactagtagcaaggcttgctgatttcatccaatatgattggtaccgatctaggaggagtagcatgagcattgaggatgatggttcaaactccaatgaatcatcaagttacagattaactgtaattggaacaactggtttcaccatccaaccaggatacgagagtggcggggagagtgtgcagcaagcaagtgtatctgttggtttcccaactgtacaaagtgtgactgatgttattgagatggaaccggtcatgactgagaggagagtgaggtttgctattgaagatgagcctgagagtgatgcaaggtctgagacaggagtgcaaatgcaggaagagttggaagatctttatgctgctcaagaagctgggattgccttcattctagggcattctcatgtaagagcaaagcaaggctcatctgtactaaaaaagttggcacttaactatggctacaatttcttgagaaggaattgtagaggccctgatgttgcacttaaggttcccccagtttctcttttggaagttggcatggtttatattgtgtagaatatctaacttgtaattagcttcttttttttttggtgtttttcatatagaggacataggcttcaatgccatagcagtgtgcagtttccaaaaggattttgtgaatgagactgtgggaatgactctacccttaaaatttaacgtgatttatatagaatgcttgagtgcatgaacagaaaggcttatatagatgtatgctaccgttccctgttcttgatgctactcttaagatctaagaagttttccaaattgtaagattaggaggtacactaaca

SEQ ID NO: 1308 - DNA, 282 bp, Glycine max var. Williams 82
atgaacatggagaaaggcaaacccttctctgcctatcatcattccagttcctatcacgacttcagggctgggttggaggatcgaaccacatcttacagcttcaacggtccaagaagcagcaaaagagatgttctggccactaatggtaacccagagctcaaaagaagaaaaagggtagcatcctacaacatgtacaccattgaagctaagctcaaatcctcttttcgcagcagtttcaaatggatcaaaaacaagctttgtagaccactattatcactatga

SEQ ID NO: 1309 - DNA, 969 bp, Glycine max var. Williams 82
atgaacaaccctacattgtcaaggctatttccgggtttgaatagggagagggagatgtctgctatggtctcagctttgacccacgtggtctccggagaggtgccaataaccggtgattcttcttcttcttcttctttggttcttcatcatcaacctcatgatgatactgttattgttacaccaaccatgccttcttcttcttcttcatctacttatgttgttggcacctcttctctcaagagaagtagggaaaatgatacatatacatcatccttattctcacatccaccttcatcatcccctgctatgccaacaagggcagaatatgcaacaagggaaatgggaaattctgtgtacgaatacagaacaacaacagagaatgcaacaagggatgaaggaaggagaaaatacagaggggtgaggcagaggccgtgggggaaatgggcagcagagataagagacccagtcgaagcggcaagagtatggttaggaacatttgacacagcagaggcagcagctagagcatacgatgaagctgctcttcgtttcagaggcaacaaagccaaactcaattttcctgagaatgtcactctccgacaacctcaattcactgtttccaattctccatcttctcttgtatctattacaacatcaacagacccagttgttcacagtactcgacctcttcttcttccttctcaggcttcaactgcgaccaatgtttacgagtattttcaactctcgggcttccccaccaacaccaacctttatgatggtaataggatgtttgtgacgtctaatgccatggcttctcatcatcttcaatcttcgtcttcgttgttgtcgtcttcttcttctgcgtttgtttcttctgtaacttctcaggacacttcactttcttcgttgtattctggccagttgccaccatggtcaaaggtttctggtcacagctcgtcttcctccggatga

SEQ ID NO: 1310 - DNA, 822 bp, Glycine max var. Williams 82
atgggtgaactaaagccatatttagcagtgtttataatacagttaatatattccgggctgactttgttgtccaaggcagcgtttaacggaggaatgaatacctgtgtgtttatctcctatagacagttgactggtaccgttattatggtccctttggccttgatacttgaaagaaaaagggcagtgccagtgtcactttcattttttaccttctgcaagatttttgtgtttttcatttcttgggtacaactcactctggctttaaatatgcaagctattgcccttgtttacacgtctgccacgttagccgccgcaattgttaattccctccccgcatctacgtttttctttgctgtgcaggtaaatataaggacaaaatctggaattacaaagattggaagtgtattattgtgcttggttggtaccatttttcatcttggcaaaagatggatattgggttctttagtcttgttcttaagcgtcatcctgtggagtttttggcttacaattcagcctcaaattcttgaaagctaccctgcaaaactgaagttctcgagccttcagtgcctgtcaagttcaattcagtcttttggtattgatatagcttttgaaagggatattcagcagtggaagttgggttggaacatgagactgcttgaagttgtttattgtggggcactggtgactggggtatcctactacttgcaagcttgggtgatcgaaaagagaggaccattttcccaagtaatgtggaacccactgagttttatacttgctacaacaggttcgatattgttcttgggcgagccactattttgggaa

SEQ ID NO: 1311 - DNA, 1494 bp, Glycine max var. Williams 82
atgctggaaatctcaactttaccggaaaccgcgacggagaacgcggacggcggttccgcggcggtatccgacgggtcgaaagcggagcacagcgaagacggtgaccggaattccgccgcgaaccggtggccgagagaggagacaatggctttgctcaagataaggtctgaaatggacgttgctttcaaagacgcaaaccccaaagcccctctctgggaacaagtctcaaggaagttagcagagctaggatataatagaagtgctaagaagtgcaaggagaaattcgagaacgtttacaagtaccataggagaaccaaagaaggtcgttttggaaaatcaaacggtgcaaaaacttatcgatttttcgagcagttggaagccttagacggaaaccactcacttcctcctccgacaacaacaaccgacaacaacaacaacgttgatgatgatgatgttatcctcaacgcggttccgtgttccgttatagctgcggcggcgcacgagcattcgagttcgacgacgtcgtcttcggggaagatgaagagaaagctgacgcggtttctggaggggctgatgagggaagtgatagagaagcaagagacgctgcagagaaagttcatggaagtgttggataagtgtgaaaaagatcgaatggcgagggaggaagcgtggaagaaggaggagctcgagaggatcaagaaagaacgcgagcttctcgctcatgaaagatcaattgctgccgccaaagatgaagctgttcttgcttttcttaaaaagttcgcagaagcagaaggcacggtgcagttgctcgagaaaattcaggttcagaacgacaaacagaaaaacaagcatcaaaatggtgctaatgctaatagaggtggtgatgtcacggttgtcactgatatggataaacaagaatgtggaaataatggtgttagtgttgggaattttgtgcacatgagtagttcgcggtggccgaaggatgaagtggaggctttgataaggttaaggactgagtttgatgtgcaggcacaagggaataataataatagtaataatgggtctaaagggcctctttgggaggagatatctttggctatgaagagcattggttatgatcgaagtgcaaagaggtgtaaagagaaatgggagaacataaacaagtacttcaagaggataaaggagaagaacaagaggaaacctcaggattccaagacgtgtccttattatcaccaccttgaggctttgtacagtaagaagcctaagaaggtggtggatcatgggaacgagttgaagcctgaggagctgttaatgcatatcatggaaagtcaaagtcaggaacagcagcaagagatgcagactcagactcagtcatcatctgaagatgctgagagagatcaggatcagaatcaggatcaaagtgggtatcagaatcagatggttgataataataataataataatagtccttcttccattgcaattatgagttaa

SEQ ID NO: 1312 - DNA, 1254 bp, Glycine max var. Williams 82
atggtgagagcaagagacgatctatgcataagcgttcccagcttcttcaagtgccccatctctctcgacgtcatgaaatcccctgtcagcctctgcaccggagtcacctacgaccgctccagcatccaacgctggctcgacgccggcaacaacacctgccccgccaccatgcaactcctccataccaaagacttcatccccaaccgtactctccaaagcctcatccagatctggtccgattcgcttcttcgccacccaaccccttccgaaccgctcccttcccctgaccaagtcctccgaaccgtcttcgacttcaaatccgactcggactccctccggttcggttcgctctcgaaactcctcctcttcgccaaagattctctccaaaacaaacttttcctcgcaaaattagaaggcttcgtgaatcaactcgttcgcttcctccataatgtcgacgtcggagtaaccgcgggaacgagtgttgaatttctcgaacaagtcgttatcgtgttgggtttgattctcgatagcatcgaggatcgcgagggattgaaaaactctatgctgaaaggaaagaaacaaagcttagattctctgcttttagttctccaacgaggaagcttggaatcaaaaattgcctccgctagggttcttcaattcgtcgccgtggacgcggaggcgaagatttcaatcgccgagaaggaaagtgtggtggcggagttgctgaaatcggcggcgccggagaaagatgcggcgctgatcgaggccgctctggcgagcctggtggcgatttcggcgccgaagcggaacaagttgaagctggtgaacctcggagcggtgaaggcgatgacgaggctgttgacggaggcgaatttgggcgccgcggcggtggagaaggtgttgaagattgtggagacggcgtcatcgacgagggaggggcggagcgagatatgcgaggaggcgacggcggcgtgtgtggcggcggtgctgagcaaggttctgaaggtgtcgagcgcggcgacggagcacgcggtgacgacgctgtggagcttgtgttacctgttccgcgatcgcaaggcacaggaggcggtgacgcagaacaatggcttgaccaagattctgttgctgatgcagagcaattgtgcgccgcacgtgcgacaaatgtgcaccgatttgctcaagatttttctggcgaactccaagtcttgcctttcgtgctacgacaccaaaaccacgcatatcatgccgttttga

SEQ ID NO: 1313 - DNA, 540 bp, Glycine max var. Williams 82
atggtttcttctaagatcttcttcctttttctcctctttctagcacaccttcatcaacatgcatctgtggaaggagattccagtttgataaagagaacttgcaagaacaccaagtactacaatctatgcttctcttccctcaaatctgatccaagcagtccaaacgcagatcctaagggcctagctgtgatcatgattggaataggaatgaccaatgccacttccacatcctcctacttgtcttcaaagttgcctaccccctccaacaacacaacctggaaaagggtcctcaaggagtgtgctgataagtactcctatgctggtgatgccctccaagattcggtgcaggatttggctaatgaggcttatgactatgcttacatgcacatcactgccgccaaagattacccaaatgcttgccacaacgctttcaaacggtaccctggtttggtttatcctcgtgatcttgctcgtagagaagatggtttgaagcatatatgcgatgtggcaatggggattatagataatcttgattggtag

SEQ ID NO: 1314 - DNA, 465 bp, Glycine max var. Williams 82
atggcgttctctgctactctatcctacacctccttcccttgccttcctcgtttcccgcaaactttgagaacaaaaagtgttcatttccctctgattcgtgcagtgcaaggtggtcaagcagagacacccgagagcaagaagagtgaagggtcatctaatgctcagtcttcaagtgctgctgctcctaaacccaagaaacccgtctattccttgaagaaaggtcagattgtgagggtggacaaggagaaatatctcaatagcgtcaattatctttctgttgggcacccaccttattacaaaggattagattacatttatgaggaccgtggtgaggtcctggatatgcgtatatttgaaacgggagaatatgcacttattgcgtgggtaggggtccccactgctccagcatggcttcctacggacatgcttatcaagtcagagaaactcaattatgagaggttatga

SEQ ID NO: 1315 - DNA, 2469 bp, Glycine max var. Williams 82
atggcagatgttccaagcaataaaacggatgactatatagtgtgctatgcacctaccatgataacaacaaatggggtgtggcaaggagacaaccctttggaatattctctccctctcttcatcttgcaattgactttggttgtggttgccacccgcatattcgtcttcattctcaagccttttcgccagccacgagtaattgctgaaatcttggttagtggagtgatgttgggtccttcggtgcttgggcaaaaccaagcatttgccaatgcagtgtttcctctaagaagtgtgatggtgattgaaacaatggcaaacattggtctcctttattttctgttcttggtaggggtggagatggacatgacagtgatgcgcagtgttggtagaaaagctgtggcttcagcaatagctggcatggttctaccattcgtggttggaattgtcttctcctaccttttggccgaaagaactgattctgacataaaccaaggcacttttatactattcctcggtgttgctctctctgtgactgcatttcctgttcttgccaggatccttgcagagcttaaacttattaacacagagttggggaggcttgctctttcagctgcactcatcaatgatgtgtgtgcttggattatgttagctttggccattgcattagctgagtctgaagccactaccttggcttctctctgggttctaatttcaagtgcagcatttgtggccgtttgtgtttatgctgttaggccagcagctgcatggctagttaagaaaacccctgaaggtgaacccttcagtgagttttatatatctcttattctagccggggtcatggtctcaggcttcatcactgatgctattgggactcatgctgtttttggagcttttatgtttggtttgtcaatcccaaatggacaactcagttttactcttgtggaaaagcttgaggacttcgtttcaggacttctactccctctcttctttgccatcagtgggctaaaaactaacctagggctcatccatgggtcacacacctggttaattcttcttctagtcatttttctggcctgcattggtaaagttgctggaacgattttggttgcattgttttatcaaatgccaatacatgaaggagctgcccttggtttgctcatgaacacaaaaggccttgttgaaatggttgtgcttaatgttggcaaggaccagaaggtttttgacgaagaatcatttgcaattatggtggttataacagtgataatgactggaattattgtacctgccatatcaataatttataggccatcaagaaatagcatatattacaaaagaagaagcattgagatgtcaaaattagataccgagttcagaatactagtcttctctaatccaacaaagaactccccaatatgtgtgtatgtgctccatttggtggagctgagtgggcgtacatcagccattctcattgttcacaacactgcaaaacaagatgcccctgtccttaatagaaccgaagcacaatctgaccacataatcaaagcctttgaaaactatgagcagcatgcttcatacatctcagtccaacccttaacagcaatctcccgttactcgaccatgcatgaagacatatgcaatttggcagcggacaaccgcgtgtccctcgtaattgttccattccacaaacaacaaacggttgatggcggcatggaagctacaaacatggcatacagatccatcaaccagaatgtgctagcaaatgctccttgctcggtaggaattctagtggatagaggcttaagtggctctaacaacttggcaggaaatcaagtatctcaccatgtagcagtcttgttctttggaggaccagatgatagagaggcattgtgctatcgatggagaatggtcgaacatcccgggattagcctcaccgtaatgcgttttgtccaaactgatcaagtacaacttgagcctttcagccaacaacaacaacatggtagtattgatttccatcaaccaagggtcctcacagtgcaaacagatagggatatacagaagcagcttgatgaaaagctaatacatgagtttaggatcaggtgtgaggatgataattcggttggttatgttgagaagctcgtctccaatggggaggacacggtggcagcaataagaacaatggatgacattcatgatcttttcattgttgggagaggtcaaggggtcatttcacctctcactgcaggactcactgattggagtgagtgtcctgagataggggcaattggggatatgcttgcttcttcagattttgcagccactgcttctgtcttggtgctgcaacaatatgttggggatggttcaccatgtgaaggattggaaacaccaaatgctgaagaacatattactggcattagccatagttccacaccacctccatcaggacataaaatgttcaattcagatcgctag

SEQ ID NO: 1316 - DNA, 804 bp, Glycine max var. Williams 82
atgtcaggtgtgtctctagcagtgtctggtccaccagcagcaacagtggctgaagcagcaggtacaaagcctaaacgaagaacagaacaggcaccaatgggtggcatgatgggttcactgcgcgtgatagaacttcagctggtggccttcatcttggtgttctcagcaagtggcctcgtcccactccttgatctagtgttccctgcattcgcctctgcatacatcttggcactttcacaattcgcatttccatcggcgtcttcgtcggggactgagatcttcaaagggagcagattgttccgaatgtatgttgtttttggcaccaccgtggggctgttcttgccgctggcttacgtgcttggtgggtttgcaagaggggatgagcatgcagtgcgttctgccaccccgcacttgttcttgctatcgtttcagatactcactgagaacattattggtggtttgtctctgttttcgccacccgtgagggcgttggtgccaatcatctacacaattcggaggatctttgtggatattgattggattcatgatgtctggctcaacaagactttgcctgtcaatgccaaatttcaggacttggcatggtattggttcggaaagggtctggcagtggccaatctggcttatttctccattaatctatttgggttcttgatacccaggttccttccaagagcttttgagaggtatttccaagagaagggagagatctataccaagtcagcagaggataaaagatctgtggttgtcaacagaacccaattatcagaaaagaagacagattaa

SEQ ID NO: 1317 - DNA, 1333 bp, Glycine max var. Williams 82
caagtgtcgtgcatgccacattccacgttacaacgttgctattgattcgcgtgtcttggggaagtgcatggttcttttatgtcttgtgcaccaatttaggatcatacacacagcaaccttgacataatcgatatctttcatcgcctacggcaacgcttcatttgaatcaacactccttcctcttcctctctctcgtccattttagttcaactttgaataattctccttcgtatcaagtcttcctcatcttcaccacctttttgtaagtggatatttatgtgtctaagaacataaactaaaaaaccaaggcgagtgaaagaaaaaaaatgtcaggtgtgtctctagcagtgtctggtccaccagcagcaacagtggctgaagcagcaggtacaaagcctaaacgaagaacagaacaggcaccaatgggtggcatgatgggttcactgcgcgtgatagaacttcagctggtggccttcatcttggtgttctcagcaagtggcctcgtcccactccttgatctagtgttccctgcattcgcctctgcatacatcttggcactttcacaattcgcatttccatcggcgtcttcgtcggggactgagatcttcaaagggagcagattgttccgaatgtatgttgtttttggcaccaccgtggggctgttcttgccgctggcttacgtgcttggtgggtttgcaagaggggatgagcatgcagtgcgttctgccaccccgcacttgttcttgctatcgtttcagatactcactgagaacattattggtggtttgtctctgttttcgccacccgtgagggcgttggtgccaatcatctacacaattcggaggatctttgtggatattgattggattcatgatgtctggctcaacaagactttgcctgtcaatgccaaatttcaggacttggcatggtattggttcggaaagggtctggcagtggccaatctggcttatttctccattaatctatttgggttcttgatacccaggttccttccaagagcttttgagaggtatttccaagagaagggagagatctataccaagtcagcagaggataaaagatctgtggttgtcaacagaacccaattatcagaaaagaagacagattaagagctatagccaattttgacttcacttgcaattttaaacactttcagcattttttttccttagaaaatagtaatgaatgtgtatgatgatatgtgagcctggacttaaaaatctggctctccgttacattatgaaactatatatggcttttggataaattttatgtatcatacaggttaattcaatatttgctgatttcttct

SEQ ID NO: 1318 - DNA, 183 bp, Glycine max var. Williams 82
atgctcagtgcacttgtaccctgccaacctggagagacatttgtgaattatcccacgtgtccagtggatacaacaacagattttgaaggggcagccaacatgcaaccttcacagacgacctcattattttattgcagtcaaaggtttattgcattgagcacaggaaactggatgctattataa

SEQ ID NO: 1319 - DNA, 222 bp, Glycine max var. Williams 82
atggacaaggcacgatttgggtttttcttcatgttgctcattctcctttcttctcagatggtggtacaaacagagggaaggcactgtgagtcaaagagccatcggtttaaagggatgtgcctcagtaagcacaactgcgcttcggtttgccatcttgaaggcttcacgggtggcaagtgtcgtggatttcgtagacgctgtttctgcaccaggcactgttag

SEQ ID NO: 1320 - DNA, 1170 bp, Glycine max var. Williams 82
atgaaaatggcacgcttgccagtgatttttttcccatttttgaccctgctcctgatatctgtctcgacgaatattaatgtacttggggagctaccgttttcagcaatgtttgtgttcggagattcattagtggacagtggaaataacaactatctcaactccttggcaagagccaatttcgtgccttatggcattgatttctcagagggtccaactgggaggttttccaacggcaaaacagtcacagacatcctcgtttttacaggggaaattataggtcttcctttactaccagcttttgcagataccctgataaaaagcagaaacatttcctggggagtgaactatgcttcagctgctgctgggatccttgatgagacagggcaaaatttgggagaacgcattagctttcggcagcaggtgcaagattttaatacaaccgtaaggcagatgaagatccaaatggagcacaaccaattgagtcagcacttagcaaattcattgacagtagtgatccatggcagtaatgattacataaacaactatttcttgcctgaacaatatacttcaagcttcaactatgacccaaaaaactatgcagatcttctcattgaggtttacaaaaggcacattttgagtcttcatgatttgggactcagaagattcttactggcaggacttgggccacttggttgcatacctagacaattagccttaggctctgtccctcgaggagagtgtagacctcacatcaatgacattgtcgacatgttcaatgttttgttgaaatctttggtggatcaactgaatgcggagcaccatggttcagtttttgcgtatggcaacacttacggagttttcaatgatctgattaacaacgcaaaaacctacggtttcacagtaactgatagtgggtgctgtggtattggaagaaatcaagcacagataacatgcttatttgcgttgtttccttgcctggatagagacaaatatgtgttctgggatgccttccataccactcaagcagtgaacaatattgttgctcataaggcttttgctggacctccttctgattgctacccaattaacgtcaaacagatggcacaaatgtgggtgttaccatccggtcaaaacaaaacttcagtgccgtccattgtatcaaaaaattag

SEQ ID NO: 1321 - DNA, 2853 bp, Glycine max var. Williams 82
atgcaagtttcatcctcatggttcggaacaatagtactttccaaccgctactcacgcaaccgctccctccctctggaaccgtgttccaccacaaccacatcatcggtttctgctacctcgtaccctcctctattcacgcgcccctatagttctctttcgtttctcgtctctcaaagaaaaggcttcaccctcacctcgctgtcaccgatcagaacaaataagaagagaagaagagcgtcgttgagggtttccgcggtgttcgagaggttcaccgagagagctataaaggccatagttttgtcgcagagggaagccaaagcgctcggaagcgaattagtttacacgcagcatcttcttctggggctcatagccgaggaggatcgttcctccgatgggtttctcgcgtctggtgtcaccgtcgagaaggcgcgtgaggttgtgcgcagcgtctggcttcggaatggctccgcacgtgccggctctggtgccgcacgtgctggggttgatgatgacggtagcaaagcgagtgccacgcaggttccgttttctgttaacgcgaagcgcgtgtttgaggctgcgtttgagtattccaagtctctgggacacaagttcgttggccccgaacatattaccgttggtttggtcaaagtagatgatggaagtgttagtagggtcctttacagattggggacaaatggaagccagttggcatctgtggcattctccagactacaaaaagagattgctaaagatggtagagaaccgaatgtgatttccaagggggtgcctaacaaatcgatttctagaaaaggttctgatgcaggagcctctgccacaacaggagaggagagtgctctatcacaattttgtgtggatctcactgcccgtgcgagtgaaggaagaattgatccagttgttggccgagaagttgaggttcagagaattattcaaattctatgccgaaaaacaaaaagcaatcccattcttcttggtgaagctggagttggaaaaacagctattgcagaggggatggcgcttcgcattgctaaggcagatgttgctccttttttattgacaaagcgtgtgatgtccttggatatagccctattaatggctggagcaaaagaaagaggagaactagaggaacgggttacaaaattagtaaaagacataataaagtcaggtgatgtcattctcttcattgatgaagttcacatacttgttcaggcagggacaattgggagaggaaataagggatctggccttgacatagctaatttacttaaacctgcacttggaaggggtcaatttcagtgtattgcatcaaccaccctagatgaatacagactttattttgagaaagacacggcattggctcgacggtttcaacctgtttgggttgatgagccgagtgaggatgacgcaatcaagatacttatgggtctacgtgagaaatatgaggcacatcacaaatgcagatacactgcagaggctataaaggctgcagttgatttgtcagcgagatacatagttgataggtatctacctgataaagctattgacctcatagatgaagcaggaagtagagcttgtattgaagcctttaagaagaaaaaggagcacgaaactggaatcctttctaagtgcccagctgattactggcaagaaattaaagatgttaagtccatgcatgaaatggagaacaagcttaaatactatggcgcttctagcattgacgataccaatgaactcatactggactcatatttatcttctacaaccaccgataatgaacctatagaagttgggccagaagatatagcagcagttgcttccctctggtcaggaattcctgtacagaagctcacagctgatcaaagaattcttctgttagatcttgagaatcaacttcggaagcgtgtgattggacaagaggaggctgttgctgccatttctagagctgtgaagagatcccgggttggcctaaaggatcctgatagacccatagctgctatgttattctgtggcccaaccggtgttgggaaaacagaactcgcaaaatctttggcggcgtgttactttggatcggaggcagccatggtacgattagacatgagcgaatatatggaacggcatacagtgagcaaattgataggatctcccccaggttatgttggttatggagagggtggcgttttaacagaagcaattagaagaaaaccattcacactgttattgttggatgaaatagaaaaagctcatccagatatattcaacattcttcttcaaattttagaagatggtcaacttactgattctcagggtcggagagtttcatttaaaaatgcattggtggtgatgacttcaaatgtggggtctagtgccattgctaagggtcgacacaactccataggtttcttgattccagatgataaaacaacatcatacaatggcttgaaatcgatggtaattgaagaactgaggtcatattttcgtccagaattgctcaacaggatagatgaagtggtagtgtttcaaccccttgaaaagtcacagttgctccaaatattggatttgctactgcaagacatgaagaaacgggtattgtccctaggagtccatgtaaaggtgtctgaagcagtcaagaaccttgtgtgccagcaaggctataacccaacatatggtgctcgccctctgagaagggcaattacatcactaatagaagatccattgagtgaggcattcctttatggagagtgcaagcaaggagacactgtcctcattgatttggatgctaatggaaacccctttgttacgaatcagcttgatcagattgttaacttatctgactga

SEQ ID NO: 1322 - DNA, 1020 bp, Glycine max var. Williams 82
aaagcagagcagagcagaggaggttttaatcaatcatttgggattttgggtactataatcaatagaaatagaaccaaatcaaaattggaacctctggctctggatgatgaacgattcacaggccagagaccaataagacagacagaggtaacgtaattcaactttcggcttcttcttcttcttctagttgtggttgttgttccactcacactcagattgcgccgcaactaattccaattccataaaagaaaagcgtagaagaaagatgggtacggattcggattcggatgcgaatggatggaaccgtgctcgagggttggcccttaagactctgctactctttggtggcgcacttctcgtcaagcgcctccgcaagtccaccacgcgctgggaccacgctcatttcgtctccaagtccctcgccggcgaaaagtattccaaggagcaagcttccagagaccctgataactatttcaacattagaatgcttacatgccccgcagcggagctagtggatggttccaaggttttgtattttgaacaggctttttggaggactccacaaaaaccatttcggcagaggctttttatggtgaaaccttgtcctaaagagttgaaatgtgatgttgagttaagtacatatgccattagagacatggaggagtacaaaaatttctgtgatcgaccaagggatcagcgtccacagccggaagaagtcattggggatattgcagaacatttgacaacagtacatcttaagcgttgtccacgtggaaaacgttgcttatataaaggttcaaccccacctggtggatttcctaattcatggaatggagcaacccactgtacttcagaacttgcaattttgaagaacaatgatatacatacctgggataggggttatgatgatgatggaaatcaagttagttttcttcatctggttttatctagttgggctagtttggtggttgctttaactttatagttgcaaatttatatagtatatgacaacaacaaaaa

SEQ ID NO: 1323 - DNA, 672 bp, Glycine max var. Williams 82
atgagtctgatgagtagtcttctacctcctcttgcttcttcttcttacataaacacagctcctaaactgaaaactactcacactccaaaccttgtacttggacagagggtcctacctaatctcctctctttggcccttgctgtaaccttagcctctcctttaccatctcatgcaatcccatccctcaattctcaaccccctccaatctccctcaccactcccttttctcaatccaagaatttggagcttggacttgaaaatggaaaaattagaccttgcccatcaatcaatccaggttgtatatcaacaaatcccaagtcatcatctttttcgtttccttggcttattccctcaaattcctcggatgatgctattcagaaactacgtgaagcaatcctgaagacccagaaaaatgtgaaatttcagcctgtggaagatactccagatggccaatatctacaagctgaagttgatggaggatttggtagagatattcttgagtttctggtgaaaggtgatgtggttgcatacaggtgtgtggcaatgaaagtaacttatgtgtaccctttcactactgcattcggagattcaaagggtcaagaagcaagactgaagcaaatcaatgaccagttgggatggtatgctccaagttttgattccatggaggaatag

SEQ ID NO: 1324 - DNA, 1872 bp, Glycine max var. Williams 82
atggaagggttttttggaaattgcttcaatatgattttgctgatgttgtgcttcaccaacttgagcatagcttttgctcaaagtcatatgaatggatttggagagcagccactggccaagattgccattcacaagaccgttttggcgctacacagttctgcttccattatagcagtcccttttgtgctaggaactaagggtgaggatacccaatgggtgactgtagagctagagtccccaataccatctgttgatgactgggtcggagttttttctccagcaaacttcaattcagcaacatgtcctgacactgacggcattggctgggtagaggaaccatacatatgcacagccccaataaagtacaagtatgccaactactctaaccgaaactatgcaaagaccgggaaagctattttgaagttccagttgatcaatcaacgtgcagatttctcatttgcactattttcaggtggattatccgatcctagacttgtggcaatttcgaattccatatcatttgcaaatcctaaagcacctgtgtatccgcgccttgctctaggaaaatcttgggatgaaatgacagttacatggacaagtggatatgacataaatgaagctgtgccttttgttgagtggggaccaaagggaggaaagaaaacacgatctcatgctggaacattgacatttaaccgaaacagcatgtgtggtgaacctgcacgaactgttggttggcgtgaccctggttttatacacacaagtttcttaaaagaactgtggccaaattttaggtacacttacaagttggggcatatgctgtctaacggttcttatgtatggagtaagaagtattcattcaaggcatccccatatcctggacagaactctttgcaacgtgttatcatatttggtgacatgggaaaggctgagcgtgatggttcaaatgaatatgctgattatcaaccgggttctctaaacaccacagaccaactcgtcaaggatttagaaaattatgacattgttttccacataggagacatgccttatgcaaatggatacatctcacaatgggaccaattcacagctcaagtgcaagaaatttcgtcaacagtaccatacatgattgcaagtggaaatcatgaacgtgactggccaaacacaggatcattctatgatactccagattcaggtggagaatgtggagtccctgcagaaaccatgtattattttcctgctgagaatagagccaaattctggtataaagcagattatggcctgtttcgtttctgcatagcagatagtgaacatgactggagagaaggatcagaacaatacaaattcattgagcattgtcttgcaacagtagatagaaagcatcaaccatggctaatcttttcagctcatcgtccccttggctactcctctaatctttggtatggcatggagggttcatttgaagagcccatgggaagggaaagtttgcagaagctttggcaaaagtacaaagtagacattggattttatggtcatgtccataactatgaaagagtatgccccatttatcagaatcaatgtgtgaatgaagaaaagcatcactactctggcactgtgaatggaacaattcatgtggttgttggtggagggggaagtcacctgtcagacttcacaccatcaccccctatttggagtctttatagggacgttgactatgggtttggcaaattgactgctttcaatcattcatatctcttgtttgagtacaagaaaagtagtgatggagaggtctacgactcctttaccatttcaagagactacagagatgttttggcctgtgtgcacgatggttgtgagaaaactactctagcaacatga

SEQ ID NO: 1325 - DNA, 888 bp, Glycine max var. Williams 82
atgagtgaacctgcaagaactgttggcaggcgtgaccctagttttatacacacaagtttcctcaaagaactttggcaaaatttgaggtacacttacaggttggagcatgtgcggtctaacgattcttacatatggagcaagaagtattcgtttaaggcatccccatatcctggccaaaactctttgcaacgtgttatcatatttggtgacacgggaaaggagacatgccttacgcaaatggatatctcacagtgggaccacttcacggctcaagtgcaagaaatttcgtcaacagtaccatacatgattgcaagtggaaatcatgaacgtgactggccaaacacaggatcattttttgatactccagattcaggtgcagagtgtggagttcctgcagaaaccatgtattattttcctgctgagaatagagccaaattctggtataaagcagattatggcctgtttcgtttctgcatagcggacagtgagcatgactggagaaaaggatcaaaacaatacaaattcattgagcatgctcatcgtccccttggctactcatctaatgattggtatgccaaggaaggctcatttgaagagccaatggcaagggaaagtttgcagaagctttggcaaaagtacaaagtagatattgcattttattgtcatgtccataactatgaaagaatatgccccatttatcagaatcaatgtgtgaatcaagaaaaccatcattactctggcactgtgaatggaacaattcatgtggttgttggtggtgggggaagtcacttgtcagacttcacaacaccccctatttggagtctttacagggatctcgactatgggcttggcaaattgactgcattcaatcatccatctcttgtttga

SEQ ID NO: 1326 - DNA, 2292 bp, Glycine max var. Williams 82
atggggtttcatgacttggttttgctattctgttcagcttggtgtgtgttttatgtgggtagttgcagtgctcagttgcaatcctctcagactcaagttcttctccaactgaaaaagcacttggagtacccaaaacagttggaaatatggagagatcgttggacagatctttgctctatttcttctcctgggcaagtgaatgtcacatgcaaggacaattttgtcactgagctcacaatcttgggtgatgataagccaacaacaaagggtagagattttgatgggtttgccattccaaatcaaacactatcagagagcttctccatggactctcttgtggccactctggcaaggttaaccagcctgagagtccttaaccttgtctctttgggcatgtggggaccactccctgatagaattcacagactctatgcacttgaacatttggacttgagttccaattatctttatggatcaatccctccaaagatttgcacaatggagaaccttcaaactcttagattggttgataacttcttcaatggtaccatcccaagcttgttcaattcatcaagccacctcacagttcttagtttgaagagtaacaggttgaagggtccatttccaccttcaatccttagtgtcaccactttaactgaaattgacatgtcaagcaatcaaatatcaggtagcttggaagatttgagtgtcttgagtagcttggaggaactagatttaagggaaaacaggttagagtctaaactacctgcaatgccaaaagggttgataagtctttacctcagcagaaactccttctcaggtgaaattcccaagcactatggtcaactaaataggcttgagaagcttgatgtttccttcaattcactcacaggcactgctccttctgaacttttttctttgccaaatattagttacttgaatttggcatccaacatgttgaatggaccactccaaaaccacctaagatgtagcagccaacttagatttgttgacatatcatacaatagatttgtggggggcttgccttcttcactgaacactactaaatcagaaaaaatagttgttaagagtgatggaaactgtttatctgggagtgtgcagcatcagcatgcagtatcctactgcacagaagctcatgtgaagaagaaatcatacagagttggaatttttgttggactcattgtgggaattcttttcatcattgtggttttggctttgaccataattataacttgtaaaaggtatttcccttggggggtgtcagagcagcacctattgcataaaacagttcaagatagcagctatgcagcagggctctcctctgagcttgtcacaaatgcaaggtatgtttctgaagctgaaaagttaggcagagaggacctccccacatgtaggtcatattccttggaagagctaaaggaagccacaaataactttgacaactctacttttatgggtgaaaatatatatgggaagctttacagaggaaaattggagagtggaatacaggttgtaataaggtccctgcctttgtcaaaaaagtattcaatcaggaatttcaaactgaggttggatttgcttgcaaagcttcgtcaccctcatttggtatccctcctggggcactgcattgatggtgttgtaggagagaataatgaggcaaatgtctttctcatttatgaatatgtgtcaaatgggactttccagacttatctctctggagatagtccaggcaaggttttcaattggtcagagcgattgtctgtactaattaatgttgctaaggctgttcacttcctacacactggcatgatacctggtttcttcaaaaatcgacttaagaccaacaatatcttgctgaatgagaattggatggcaaagttgagtgactatggattatccattatatcagaagagactgatgcatgtggggtaaaaggagaaagttctgattcatggcaaatgaaaatgttagaggatgatgtttatagctttggattcatactactcgaggcacttgttggaccttcattatcagctaaaagagaagcaaatgtgctgaatgtaatggcatctttcaatagtcaagatggttggaaacaggttgtggacccagttttgcaagctacatgttctaaagagtctctattagttgtgatttccataacaaacaaatgtatatcttctgagtcatggagccgaccatccattgaagatgtcctttggaaccttcaatatgcatctcaaattcagggaacagctgatgggggataa

SEQ ID NO: 1327 - DNA, 1542 bp, Glycine max var. Williams 82
atggctctactatcatcagtcctaaagcaattgccgcatgagctaagttcaacccattacctaacagttttcttctgcatcttccttatacttcttcagctaataagaagaaacaaatacaatctgccaccatccccaccaaagatacccataatcggcaatcttcaccagctaggcacactgccacaccgctcctttcatgcactctcacacaaatatggccctctcatgatgttgcaattgggtcaaattccaaccctagtggtctcatcagctgacgtggccagagaaataatcaaaacgcatgatgttgttttctccaaccgccgacaacctacagctgctaaaatctttggttatggatgcaaggatgtggctttcgtgtactacggcgaagagtggagacaaaagataaagacatgtaaggttgagcttatgagtctgaagaaggtgcggttgtttcattccattagacaagaagttgttacagagttggttgaagctataggtgaagcgtgtggtagtgaaagaccatgtgtgaatctgactgagatgctgatggcagcatcgaacgacattgtgtctagatgtgttcttggacggaagtgtgatgatgcatgtggtggtagtggcagtagcagctttgcagcgttgggaagaaagattatgagactattatcggctttcagcgtgggtgatttcttcccttcgttgggttgggttgactatctgactggcttaattccagagatgaaaaccacgtttctcgcagtagatgctttccttgatgaggtaattgcagaacacgagagcagtaacaagaagaatgatgacttcttggggatacttcttcaacttcaagaatgtgggaggcttgactttcagctcgaccgagataacctcaaagcaatcctagtggacatgataataggtgggagtgacactacttcaacaactctagaatggacttttgcggagttccttagaaatccaaataccatgaagaaagctcaagaagaggtaagaagagtggtgggaatcaattccaaagcagtactggatgaaaattgtgtgaatcaaatgaactacttgaaatgtgtagtcaaagaaactttgagattacatccaccccttcctcttttgattgctcgagagacatcatcaagtgtaaaactaagagggtacgatattcccgcaaaaacaatggtatttatcaatgcatgggcgatccagagggatcctgaattatgggatgatcctgaagaatttattcccgaaagatttgaaactagccaagttgatcttaatggacaagattttcaattaattccgttcggtattgggagaaggggatgccctgcaatgtcatttggacttgcttcaactgagtatgttcttgctaatcttttgtattggttcaattggaatatgtccgagtctggacgtatattgatgcacaacattgacatgagtgagacaaatggactcactgtcagtaagaaagtaccacttcatcttgaaccagaaccatataaaacatga

SEQ ID NO: 1328 - DNA, 2949 bp, Glycine max var. Williams 82
atgttgaggctttacgtgtgtgtattggaaaccaaggacctacccgtgaaggatacctacgtgacgctaaggctcggaaagttgaagtgcaagacaaggatactgaggaacacgtggaaccccgtttggaacgaggagtttggtttcaaggtgcatggtgctgaagacgtgcttgttgtctctgttgttgttaatcatgataataataataagtgcagatcagtgaccaatggttctgtagtggagtttgtgggtgaggtacggattccggttggttcggttgcttttgaggataagcaaacgttgctgcccacgtggttctctcttgaaagccccaagagtgggaggtttttcaataaatattgtgggaaaattctccttactgtgtctcttcatggtaaaggccgctcttttatgaatcataagcattctccaaattcaactattgcagttgagaactcaagagacttggaaggtctgcactttttatgtcagtcacattgtgataaaatgggtgtaggcaaacaattgttgaaggatattgctaatggtctgcataggattttcaaaaagaaagagggaaactcaaattttggggattcttcagaactatcctcttcattatctgattatgaagatagtgtacacgaaaatacgtttccttgtagctttgaagaatccattgcactgatggaatcaagagatgacaacaaaccagaaatgcctgaaaatttgcccggaacaacaaatgtgcaagaggggccttggacatggaaaaatggagacacatcatgtttaacacgagttgttacctatatgaaagcggctacaaaattgattaaggcagttaatgccattgaggagcaaacctacattagagtgagtagaaaggaatttgctatactggttagtgtaagcacacctgaggtcccatatgggaattcctttaggattgaattactttacaagataatgccaggggaggtatcttctggagaggaatcctcccatctagttgtgtcttggggaattgtcttcctccaaagcacaatgatgaaaggcatgatagaaggtggggcaagacaaggattgaaggagagttttagccagttctcggaccaacttgcacggaattttaaggtgctagataaggcagatttaccagacaaggaacatttgttggcaactttgcaaacagaagaccagtggtattggtggcagacaattacatacttttggaatttcactgtggcttccaccattttcatgtttttatatgtgttggtgcatattttaaggtgtggtccaaatctgcttcagggcttggaatttagtgggcttgaattgccagatagttttggagagctcattacaagtggaattttaatcatccagttgcagcgtgtttataatatggtgtctcactttgtgcaagctagatttcaaatgggaactgaccatggcctcaaagctcatggcgatggatgggttcttactgtggctttaattgagggggttgacctagcctccttggagtcagagggattgtcagatccctatgtagttttcacttgtaatggacaaacaaggtcaagctctgtgaagcttcaaacttctgatcctcaatggaatgagatattagagtttgatgctatggaagaaccaccatcagttctacatgtggaagtttttgattttgatggtccatttgaccaggatgtttcacttggacatgctgagatcaattttctaagacacacatcaactgagttggcagacatgtgggtcatgctagaaggaaagcttgcccaatcttctcagtcaaagttgcacttgagaattttcttggataacaataatggagttgaaacaattaaggaatatttggagaagatggaaaaggaagtcggcaaaaaattgaatcttagatcacctcaaaggaattctacattccagaaattgtttgccttgcctccggaagaatttctcatcaaagatttcacttgttacctcaagagaaaaatgcctttgcagggtcggctgtttctttcagcaaggattctggggtttcatgccaatttgttcggacacaaaaccaagtttttcttcctttgggaagatattgaagagatacaagtgcttcctccatcattggcaacattagggagccctacattggtcatagttctgcgaagaggccgaggtctcgacgcaaggcatggtgcaaagactcaagatgaagaagggagacttagatttcattttcaatcttttgtttcatttagtgctgcctccagagcaataaaggccttgtggagaacaagaatactgaacccctatcagaaagaacaaatttcagaagagcatgaagatcaagaaagatttgtaatcccggaagactctgcatctatcttagaggatgaagaaaaaatgtccagaattttctctgcagaactgccaatcaagatgaaatcagtgatgggaatttttgatggaggaaacctggagcataaaattatgcagagaacaggatgtacgaactatgaaacaacatcatgggaacaagtaaagcatgatgtcttcgagaggcgtgtttcttaccaattcaatcgacacgtgtcagcttttggtggtgaagtcacttgcacacaacaaaagtttccaaatgcaaacactggaggttggactgtgattgaagttatggatcttcacggtgtcccatttgctgatcacttccatattcattttaggtatgaaatagagaaatcctctcttggtgactgtgcttgcaagtgtgatgcttacattggtattatgtggcttaagagctcgaagtttcagcagaggatcaacaggaacataactgccaagtttaaccttcgattgaaggaaatatttgaactggttcagaaagagattttattaatgtctcagaactctcatggataa

SEQ ID NO: 1329 - DNA, 3293 bp, Glycine max var. Williams 82
ttgtaaagagctagttttattattaagctatgttgaggctttacgtgtgtgtattggaaaccaaggacctacccgtgaaggatacctacgtgacgctaaggctcggaaagttgaagtgcaagacaaggatactgaggaacacgtggaaccccgtttggaacgaggagtttggtttcaaggtgcatggtgctgaagacgtgcttgttgtctctgttgttgttaatcatgataataataataagtgcagatcagtgaccaatggttctgtagtggagtttgtgggtgaggtacggattccggttggttcggttgcttttgaggataagcaaacgttgctgcccacgtggttctctcttgaaagccccaagagtgggaggtttttcaataaatattgtgggaaaattctccttactgtgtctcttcatggtaaaggccgctcttttatgaatcataagcattctccaaattcaactattgcagttgagaactcaagagacttggaaggtctgcactttttatgtcagtcacattgtgataaaatgggtgtaggcaaacaattgttgaaggatattgctaatggtctgcataggattttcaaaaagaaagagggaaactcaaattttggggattcttcagaactatcctcttcattatctgattatgaagatagtgtacacgaaaatacgtttccttgtagctttgaagaatccattgcactgatggaatcaagagatgacaacaaaccagaaatgcctgaaaatttgcccggaacaacaaatgtgcaagaggggccttggacatggaaaaatggagacacatcatgtttaacacgagttgttacctatatgaaagcggctacaaaattgattaaggcagttaatgccattgaggagcaaacctacattagagtgagtagaaaggaatttgctatactggttagtgtaagcacacctgaggtcccatatgggaattcctttaggattgaattactttacaagataatgccaggggaggtatcttctggagaggaatcctcccatctagttgtgtcttggggaattgtcttcctccaaagcacaatgatgaaaggcatgatagaaggtggggcaagacaaggattgaaggagagttttagccagttctcggaccaacttgcacggaattttaaggtgctagataaggcagatttaccagacaaggaacatttgttggcaactttgcaaacagaagaccagtggtattggtggcagacaattacatacttttggaatttcactgtggcttccaccattttcatgtttttatatgtgttggtgcatattttaaggtgtggtccaaatctgcttcagggcttggaatttagtgggcttgaattgccagatagttttggagagctcattacaagtggaattttaatcatccagttgcagcgtgtttataatatggtgtctcactttgtgcaagctagatttcaaatgggaactgaccatggcctcaaagctcatggcgatggatgggttcttactgtggctttaattgagggggttgacctagcctccttggagtcagagggattgtcagatccctatgtagttttcacttgtaatggacaaacaaggtcaagctctgtgaagcttcaaacttctgatcctcaatggaatgagatattagagtttgatgctatggaagaaccaccatcagttctacatgtggaagtttttgattttgatggtccatttgaccaggatgtttcacttggacatgctgagatcaattttctaagacacacatcaactgagttggcagacatgtgggtcatgctagaaggaaagcttgcccaatcttctcagtcaaagttgcacttgagaattttcttggataacaataatggagttgaaacaattaaggaatatttggagaagatggaaaaggaagtcggcaaaaaattgaatcttagatcacctcaaaggaattctacattccagaaattgtttgccttgcctccggaagaatttctcatcaaagatttcacttgttacctcaagagaaaaatgcctttgcagggtcggctgtttctttcagcaaggattctggggtttcatgccaatttgttcggacacaaaaccaagtttttcttcctttgggaagatattgaagagatacaagtgcttcctccatcattggcaacattagggagccctacattggtcatagttctgcgaagaggccgaggtctcgacgcaaggcatggtgcaaagactcaagatgaagaagggagacttagatttcattttcaatcttttgtttcatttagtgctgcctccagagcaataaaggccttgtggagaacaagaatactgaacccctatcagaaagaacaaatttcagaagagcatgaagatcaagaaagatttgtaatcccggaagactctgcatctatcttagaggatgaagaaaaaatgtccagaattttctctgcagaactgccaatcaagatgaaatcagtgatgggaatttttgatggaggaaacctggagcataaaattatgcagagaacaggatgtacgaactatgaaacaacatcatgggaacaagtaaagcatgatgtcttcgagaggcgtgtttcttaccaattcaatcgacacgtgtcagcttttggtggtgaagtcacttgcacacaacaaaagtttccaaatgcaaacactggaggttggactgtgattgaagttatggatcttcacggtgtcccatttgctgatcacttccatattcattttaggtatgaaatagagaaatcctctcttggtgactgtgcttgcaagtgtgatgcttacattggtattatgtggcttaagagctcgaagtttcagcagaggatcaacaggaacataactgccaagtttaaccttcgattgaaggaaatatttgaactggttcagaaagagattttattaatgtctcagaactctcatggataaggatatgttaggcagatagaataaactatatcacgccatagaagtgtttggagatctctaagtttatgactcgtttagtctgtggatttaacggcgggcaaacatgtagcaaattaagaaatcattaaggatcatcatgatctccaaaattcccaagaggtagttaatcctctaatatatcattcaccaaaaaaataatcatgatctccaaaaatcttctataactgaattttattaacccttttcttgtaaattgaaacatttaattaagctaagtcaactgaaaaatttagttaagccaagtcaatggatcta

SEQ ID NO: 1330 - DNA, 2470 bp, Glycine max var. Williams 82
aattttttatttgcaagttcttgaatgcaggctttgcttgttttcatgttttttaatattagctaactgtgtttctatttttgttgtaatgttgcataggagtcgttgctgcaatgccaagggcacagtcaagccaccctttggatcctttatctgctgctgaaatctctgtggctgtggcaactgtgcgggctgctggatctactcctgagcttagagatagtatgcgcttcattgaaatagttttactggagccagataaaaatgttgttgcactggcagatgcatatttctttccacctttccaaccatcattacttccaagagctagaggaggacctctgattccagctaaactccctccaagatgtgccaggcttgttgtttacagtaggaaaacaaatgagactagtatatggattgttgagttgtcgcaagtacatgcggtaactcgaggtggtcatcaccgagggaaagtaatttcatcacatgttgttcctgatgttcagcctccaatggatgctgaggaatatgcagaatgcgaggctgttgtcaaaagttttcccccatttatagaggctatgaagaaaaggggtattgaagacatggaccttgtaatggttgatccgtggtgtgttggttatcacagtgaagcagatgctcctgggaaaagacttgctaaaccactcatattttgtcgatccgagagtgactgtcctatggaaaatggctatgcccgacctgttgagggtatctatgttcttgttgatatgcaaaacatggtggtgttagagtttgaagatcgtaaacttgttcccctcccaccggttgatcccttgaggaactatactcctggtgaaacccgaggtggctctgatagaagtgatgtaaaacccttgcaaattattcagcctgaaggtccaagcttccgtgtcaatgggtattttgttgaatggcagaagtggaatttccgtattggattcacacccaaagaaggtttggttatatattctgttgcatatgttgatggtagtcatggacgaaggcctgttgctcataggctgagttttgtggagatggttgttccctatggagatccaaatgatccacattacagaaaaaatgcttttgatgctggggaagatggattgggaaaaaatgcacattccctcaagaagggatgtgattgtttgggatacatcaagtattttgatgctcacttcacaaatttcactggtggggtggaaacaattgaaaattgtgtatgtttgcatgaagaggatcatggaatgctctggaaacatcaagactggagaactggcttagcagaagtccgaagatctagaagacttacagtttctttcatatgtactgttgccaactatgagtatggatttttttggcatttttatcaggatggaaggatcgaagctgaagtaaagctaactggaattctcagcctaggagccttactgcctggagagtttcgaaaatatggaaccatgattgcgcctggtctatatgcaccagttcatcagcacttttttgttgctcgcatggacatgtctgttgattctaaacctggtgaagctttgaatcaggttgtggaggtcaatatgaaagtcgaggaaccaggtgagaagaatgttcacaataatgcattctatgctgaagagactttgctcagatctgaattggaagccatgcgtgattgcaattctttgactgctcggcattgggttgtaaggaacacgagaacatgcaatagaactggacagttgacaggctataagctggtacctggctctaactgcttgccattggcaggctctgaagccaagtttttaagaagagctgctttcttgaagcataacttttgggtaacaacatattcacgtgatgagttgtttcctggaggagaatttcctaatcaaaatccacgtgttggtgaaggactagctacatgggttaagcagaaccgatctttggaagaaactaatgtagttctttggtatatatttggaatcacacacgttcctcgtttggaagactggcctgttatgccagtagagcgcattggttttatgctcacgcctcatggattcttcaactgttcccctgcagtagatgttccgccaaatgcatgtgaaatggattctaaagataatgacattaaggataatggttcttcgaaaccaattcagagtgggttaacggcaaagctttaggaacttgaccctccaaaagttatggctctgtgctgctgatatggagaaacatgagtactattctgatatatgttgttgagctcattataattttgaatctagaatattaataaagctattgaaataaatagtggtttcgttttaaagcttgcctgctggtaatattcatttgatttactttgtacccagaatactggcttcaaatttgactcaaggaatttaaccgggaaattcatattttc

SEQ ID NO: 1331 - DNA, 786 bp, Glycine max var. Williams 82
atggcaaagtcatctgagctggccattgaagagctgaagaagcttctcagagacaaggaggaatttgatgccgtggcggctgcaaaagttgaggagcttatagctgagttgcagggatgtggcccgcgtccatatgagcctgctgtgcaaagaatcgtagacggatttactcacttcaagatcaacaatttcgacaagaactcggatctgtacagccaacttgctaatggccaaagccccaagtatctggtgttttcttgttctgactctcgagtgagtgccactactatcctcaacttccaacctggagaagctttcatggtacgcaacattgctaacatggtccctccatttaatcagctaaggtacagtggagttggtgcagccattgagtatgctatcacggctcttaaggtgccaaacatcctggtcattggacatagtcgctgtggtggaatccaaaggcttatgagtcatccagaggatggttcttctccctttgacttcatagatgattgggtgaaaattggtttgcctgccaaactcaaggtcctgaaagaatacgaaggctatgatttcaaagaacaatgcaaattctgtgaaaaggagtcagtgaataactcactagtgaacctgaagacatatccatatgttgaaaagggaataaggaacaagaacatagccctgttggggggttactatgattttgtgataggagaattcaagctttggaagtatgagtctcacatcactgaacccatttccattcctctctgtacccattag

SEQ ID NO: 1332 - DNA, 1674 bp, Glycine max var. Williams 82
atggggtgggtggcgaatcggtggacgggcgtcgccgccgccatatggatccagtggagctgcggcgcatcgtacaccttcagcatctactcctccgtgctcaagtccacgcagggctacgaccaatccacgctcgacaccgtctctgtcttcaaggacatcggcgccaatttcggcgtcctctccggcctcctctactccgccgtcgtcccctacacaacccaccgcgcctccgccgccgccaagtccaaatgggcatcgctcggcgggccctgggtcgtcatcgcggccggcaccgtccagtgcttcgcgggcttcatcttcatctgggcctccgtcgtgggccttataagcccgccgcccgtgccggtcatgtgcttctttgcgtggctcgcgtccaacggccagaccttcttgaataccaccaatgtcgtcaccggcttgcgcaatttccccgagtacagcggcaccatcattggtatcatgaagggatttcttggactgagtggagctatcttgatccaaatttaccatacgttttttgatggggacccagcaacataccttttgatgcttgcagcgttgccttcattcatctgcgtgttgcttatgttcttgctgaggatatatgaagtgcatggcagtgattacaagaagcatttggatggtttctctgtggttactgtgattattgtagcctatctcatgttcataataattttacagaacttagttagtttaccatactggggacggatgtttgcatttgtgattcttatggttctgctagcaacgccttttggaattgctatcaaggctcattgggaagaatcacggaaatttgcgcaatcctacacaattgggaggagttcttctacaaataagggtactacttcctccagttattctgcatcagtggatcaagtggagtaccatgagttgcctagtgatgaggggcaggaacaagtgacttcagatgacaaattgccccgtgaagaagaaaagaacctctggcaagctatgtgcacggttgatttttggatgttgtttgtgatcatgatatcaggattgggttctgggcttgcaactataaataatatgagccaaataggacaatcccttggctatagtaccatagagattaataatttggtgtcactatggagtatgtggaacttccttggtcgttttggaggtggccatgtatcagattatatcatgcacagaaaaggttggcccaggccactgttgatgacagcaactctagggataatgattcttggccatttaattatagcatctggtttccgtggaaatttgtatttgggtcctgtcctggtaggtatctgctatggtgcacattggtccttgatgcccacaatcacttctgagatatttggtgtaaagcatatgggtaccatcttcaatactattgctgcagcaagtcctcttggatcgtatatactttctgtcagagttgttggatatatttacgacaagcaagccgataaagaagataatttgtgctttggcatcgactgtttcatgccctcattttttatcctggcaggtgtagctcttcttgcatttttggttggtttggcattgttcttccggacccgaaggttctataagcaagttgtgcttagaagattaaaacattatgcaagatga

SEQ ID NO: 1333 - DNA, 1815 bp, Glycine max var. Williams 82
atgggtcatgcagtgttgattttggtggtggtgatttccagcattgtgttatgcccttcttctcttgctctaacgcaagacggattgacattgttggaggtcaaaagcactttgaatgacacaaggaattttctcagcaactggagaaagtctggtgaaactcactgtacatggactggtatcacttgtcatcctggggaacaacgagttcgctcaataaatttaccttacatgcagctgggggggattatatctcccagcattggcaaactcagtagactgcatagactggcacttcatcaaaatggcttacatggaattattccaaacgaaattagcaattgtactgagcttagagcactgtacttgagagctaattatttacaaggaggcatcccatcaaatattggaaatctttcctttttgcatgtattggatttatcaagcaactcattgaagggtgctataccttcttctattggccgtcttacacagttgcgagttctgaacttgtcaacaaatttcttttctggcgaaatccctgacattggagtactgagcacctttgggaacaatgcgtttattgggaatttagatctttgcgggaggcaagttcagaaaccatgccggacatcacttggtttcccagtggtgctaccacatgctgaaagtgatgaagctgaagtccctgacaaaagatcttcacattatgtgaaatgggtgctagttggtgcaataactataatgggccttgcacttgttatgacactttcattactatggatttgtttgctatcaaagaaggaaagagctgccaggagatacatagaagtgaaggatcaaatcaatccagaatcaagtaggaagaatgacggtacaaaactcatcacattccatggtgatctgccgtacacatcattggagatcattgaaaagttggagtctcttgatgaagatgatgtggtagggtctggaggatttggtaccgtttaccgaatggtgatgaatgattgtggtacatttgctgttaagcggattgatagaagccgtgaaggttctgatcagggtttcgaaagggaactagaaatattgggtagtatcaagcacattaatctagttaacctgcgtggttactgcagactcccttctactaagcttctaatctatgattatttggccatgggaagtttagatgatctcttgcatgaaaatactgagcaatcactgaattggagtactcgcctaaagatagccctcggttctgccaggggattgacttacttgcaccatgactgctgcccgaaaatcgtgcatcgcgacataaaatccagcaacatccttcttgatgagaacatggagcctcgtgtctctgattttggtcttgcaaaacttttggtagatgaagatgcccatgttacaacagtggttgctggcacatttggctatctagcaccagagtatctacaaagtgggagagccactgagaagtcagatgtttatagttttggagttctattgctagaacttgtaacaggaaagagacctacagatccttcctttgcaagcagaggtgtaaatgtagttggctggatgaacacattcctcaaagaaaatagattggaagatgtagtagacaaaagatgcattgatgcagatttggaatctgttgaagtaattcttgaactagcagcaagttgcactgatgcaaacgcggatgaacgtccgtcgatgaaccaagtgttacagatactggaacaagaggttatgtctccatgcccaagtgatttttatgagtcacaatcagatcactgttaa

SEQ ID NO: 1334 - DNA, 1848 bp, Glycine max var. Williams 82
atggagtttggttcagaaagatctggtcatgaagtcaaggatgagaagagaagtgaatctagtgttggagatgaagaagatcgtcgtgaacaagagattgttacgcaggagccacccctgtctactaccgaaagatccacagtggaggctgggccaaatgcttcttccctaaccaaaaaggaagaggctgttgatgaacttgaagttgccaaagccgaaatgggtgaagtgatggaagaaaaccaacgactaaagacgtgtttgaaccgaatactgaacgattaccgcgcactccaaatgcaattccacaacatagttgaacaagagacaaaagattcttctgatcagaaagtgaacaacaacaatgaccaatatcaaatagatgaatcaaacctagtttccctcagtcttggaagacttccaacaagaaacaataataaagtccctaataataaaccattgaaagaggaagcagaaaaagaagataaagaaggcttgtcccttggattagactgcaaatttgaaacatcaaaatctggaataagcacaactgaatatttgccaattcatcaaagccctaataatagtgttgaagaagtgccaaaggaagaagcagctggtgagagttggcaacctggcaagggaataaagacagctagagatgctacaggagaggatgaagtttctcaacaaaatccagcaaagaaagcaagggtttgtgtgagggcaagatgtgacactccaactatgaacgatggatgtcaatggaggaaatatggacagaagatttcaaagggaaatccttgccctcgagcttactatcgttgcacggttgcaccatcatgcccagtaagaaagcaggtgcaaagatgtgcacaagacatgtccatattattcaccacctacgaaggcaaccacaaccaccctcttccactctcagccacagccatggcctccaccacttcagcagctgcatccatgctattatccggctcatcaacctcacactccggaacaaggccttccacagccatgaccaccgcagatcttcatggaatgaacttcttcctatcagacggttccaaattatcaaagcaatactacctgtcccatcctgcagcactctcatcttcaccttcacaccccaccatcactcttgacctaacttccaataataatccatcctcatcatcttctgctgctcttgttaaattcacttcaaactcaaactacaataacacacaaaggtaccctctttccacaagcttaaacttcagttcctcagaatccaacaatgcaacaacttcttggagcaataatgggttcctcagctacaacaacactctaccatataatagcaataggaatgtgacaaatgtccttagcaacataaaccttggaagacaacaacaacaaccaatggaaaacatctacaactcctacatgcaaaggaacaacaatgttccaatctctccaccacaacattctctgccagataccatagctgcagcgacaaaagtaatcactgcagaccccaattttcaatcagctttggcagcagcacttacaacaattattggttctggaagcactactcaaggaaaccatggtggtgcaggggaaaatctgagtcagaaaatgaaatggggtgaactgtttccttcatcttcttctgcattaccttcatcttcaacaaaagtcaatggttgtgcatcaagcttcttgaacaaatcagccgctaatacacaaccaggaacagctttgatgtttcttcagccacctttgcctctttctagccccaaaagcgcttctgggtctccaggagatcatatagacaagagaaattga

SEQ ID NO: 1335 - DNA, 2424 bp, Glycine max var. Williams 82
atgttcttcactggcactaaccaatcttttggagaaattatatctaggaatatgatcccaagtaacttgagttctataaacagttctgatattacggctagtttggcatcaaatgtagtgggatcagattcagagccagagaacaccaattttctggaacctgctttcttttcagaccttcctatttattatctacagaatcagtgcacacagaactctacattctccgtttctcttcagatagcaggcattagcaagcagcaagaggtaatatgtgctcagggtttacgtttatggcgtaatagttcttctgaggtgaacaatgagctatataaaggttatcggagaagtaacacagagagacagatcaatgagatagctgcaggttatgattttttaaattcaaatcggagtatatttaatgtcagcatatggtacaactcaacctacaaaaatgacactggctttaatcaaattgcattggcgcgtattcctcgttctgtaaatttggtatcaaatgcctaccttcagtttctattgggacctggtaccaaaatgttttttgagtttgtaaaggaaatgccaaaacctgagaccccgattaaatttgatttggcttctcttttgggtggtctcttctttacatgggtcatcctacaacttttccctattgccttgacatcgttagtatatgagaagcaacaaaacttaagaatcatgatgaaaatgcatggccttggagacgggccatattggatgatttcgtatggttattttcttgccatatccattgtctacatgctgtgttttgtgatttttggctcagtcatagggttgaatttcttcacaatgaatgactacagcatccaatttgtgttttatttcatctatataaatttacaaatttcactggcttttttattggcttccctgttttcaaatgttaaaactgctacagtacttgcatacataggtgtgtttggaactgggctattagctggctttcttttccaattttttgttcaagacacgtcgtttccaagagggtggatcgttgttatggagttgtatcctggttttgctttatatcgtgggctatatgagttttcgcaatatgcctttagtggggatgctttggggagcgatggtatgcgctggagcgatctgagtgatagcacaaatggcatgaaggaggtcttaattatcatgttcgtggagtggctattggtgcttttgtttgcttattatatcgatcaagttttgtcttcaggaagcaggaaaagtcctctttttttcttgaaaagatttcagaaaaagcctcattcatcttttcggacgcctagtatccaaaggcaaaaatctaaggtttttgttcagatagagaaacctgatgtcactcaagagagggagaaggtggagcaactgctacttgaaccgactattaatcaagcaattgtatgcgacaacatgagaaaagtctatccggggagggatggcaacccggagaaacttgcagtgagagggttgtcccttgctttgcctcaaggggaatgctttggtatgcttggtcccaatggtgctgggaagacttcttttatcaatatgatgattggtctcaccaagccaacctctggtaccgcatttgttcaaggtcttgacataagaactcatatggatggaatatatactagcatgggtgtatgcccacagcatgacttgctgtgggaatccctaacaggaagagagcacctactcttttacggcagacttaaaaatcttaaaggttcagccttaacacaagcagtggaagaatcgttgaaaagtgtaaacctttttaatggaggagttgctgataaacaagctggaaaatacagtggaggaatgaagaggaggcttagtgtcgcaatttcattgattggagatcctaaagttgtttatatggatgaaccaagtactggattagaccctgcatcaagaaacaacttatggaatgttgttaagcgtgcaaaacaggatcgtgcaatcattcttaccacacattccatggaagaagcagaagtcctatgtgatcgattaggaatatttgtagacgggggcttgcagtgcataggcaatccaaaggagttgaaagccaggtatggaggaacatatgtcttcacaatgacaacatctatggatcatgaaaaggatgtagagaatttggtgaggcaactctcaccaaatgctaacaagatctaccatatctctggcacccaaaagttcgagctaccaaaggatgaggttaaaatagcaaatgtattccaagctgttgaaactgcaaagagaagcttcaccgtttcagcgtggggtttagctgataccacactggaagatgtcttcattaaagttgcacgtggggctcaggcatttgacaccttgtcataa

SEQ ID NO: 1336 - DNA, 321 bp, Glycine max var. Williams 82
atggccatggctaagcttgtatgtgttctgcttctggcattccttggcatttccatgatcacaactcaagttatggcaacagattctgcctatcacttggatggaaggagttatggacctgggagtctaaagacctcacagtgcccttctgaatgcacaagaagatgtagccagacacagtaccacaagccgtgcatgtttttctgccaagaatgctgcaaagtgtgcctttgtgttcctcctggctactatggcaacaagtctgtgtgcccctgctacaacaactggaagaacaagcgtggaggacccaaatgcccttga

SEQ ID NO: 1337 - DNA, 249 bp, Glycine max var. Williams 82
atgggtgatgggtcattcttaaatggagcacttcattggttagttttcacccatgataatgatgatcccagaattattgcatttaatgtgatggaaaggaatatatcagagatttcacagccaccgcgtgaattgaaatatccaccacatttgtgtcatttttctaagggtaatgggagaatgtttatgtctctgaaagaatacaaagtgcaatcatcttggaccaaattattattatttttatactaa

SEQ ID NO: 1338 - DNA, 759 bp, Glycine max var. Williams 82
atggccaccgtcacaacccaagcctccgccgcgattttccggccatgtgcctcgaaatcgaggtttctgaccggctcttccggtaaactcaaccgggaagtgactatgaggccaatggggtgccctccttctgcctctttcaaggttgaagccaagaagggagagtggttacctggcttggcctccccaacttacctcaatggcactcttcctggtgacaatggatttgaccctctgggactagctgaggacccagagaacttgaggtggtacgttcaagccgagcttgtgaatggacgttgggccatgttgggtgttgcaggaatgctacttcctgaggttttcaccaagattggaatcatcaatgcccctcaatggtatgatgctgggaaatcggagtactttgcttcatcgtcgaccctctttgtgatcgagttcatcttgttccactacgtcgagatccggagatggcaggacatcaagaaccctggctctgtcaaccaagaccccatcttcaagcaatacagcttgccccaacatgagtgtggataccctggtagtgtgtttaaccccttgaactttgcacctactttggaggccaaggagaaggaacttgccaatgggagattggctatgttggcattcttgggattcatagttcaacacaacgtgacaggcaaaggaccatttgagaacctattgcagcacctctctgacccgtggcacaacaccatcatcaatacaattcgtggctactaa

SEQ ID NO: 1339 - DNA, 645 bp, Glycine max var. Williams 82
atgagaggctcttgttcatgtcaaccaagcaataacgataaagaaagaaattttatggttatggaggtctcagcatacatttgcaacaacaacttcatcttctcttcttctcgtgccataacacaaaaatcttctgcttctttctcatcacctatgcttgtcaaatccatggccactcccaagcctcttccctcagtctctagaactgtaggctctagaaagaactcaactgtgttcccacttggggaacaacctaggagcagccccgcgacagccacgcctcccataaagcttttgacaaggatggagcagctgaagctgctgagcaaagcagagaaagcagggttgctatctgcagcagagaagtttggattctccctctcaacaatagagaggcttggactcctctcaaaggcagaagagttgggtgtgctatctgctgcaactgatcctggaactccaaggacactcttgaccctcagcttggggttgctgatccttggacccttatttgtttacttcgttcctgaggacaaccttggattggtggggttgcaggttgtggttgccttggtcagtgtaattgggggttctgctggcttggctgcctcaaattttgtatccaacttgcagaaattgaaataa

SEQ ID NO: 1340 - DNA, 1371 bp, Glycine max var. Williams 82
atggaacataccatgttacctgccattggatctgttttccctcgtggtgtctttgccgcactcttgctcatgttactgttttctttctccacattcacttctatagaagcctatgatccacttgatcctaccggaaatataacaatcaagtgggatgtcattagctggactccagatggctatgttgctgttgtcacaatgtacaactttcaacaatatcgccacattcaggcccccggatggtcattagggtggacatgggctaaaaaggaagtgatttggaacatgatgggagcccaaaccacagagcaaggggactgttcaaagttcaaagcaggcattccacattgttgtaagaaggaccctacagttgtggatttactgccagggactccttacaaccagcagattgcaaattgttgcaaagggggtgtcctaaattcatggggtcaggaccccagcaatgcagtaagttctttccagattagtgttggttctgccggaacaacaaacaaaaccgtcaaaatgcctaaaaattttaccctcaaagcaccgggacctggctatacttgtggtcctgccaaagttgtgaaaccaactgtatttattaccaatgacaagaggagaaccacccaagccatgatgacctggaatattacctgcacttattctcaattcctggctcaaaaggcaccaagttgctgtgtttccctctcatccttctataatgacacagtagtaaactgcccaacctgcacctgtggttgccgaaacaaaacagaacctggcagctgtgtagatccaaattcgccacatttagcttcagttgtatcagcatcaggcaaaacggcaaacacgccactagtccagtgtaccagccatatgtgtcctattcgagtgcattggcatgtgaagctcaattacaaagagtactggagggtcaagatcacaatcacaaatttcaattacagaatgaactactctcaatggaaccttgttgtgcagcatcctaatttagataatattacccagctcttcagttttaattacaagtcactaaatccctatgagggcttgaatgatacaagtatgctgtggggagtcaagttctacaatgattttctttcttcagctggatctcttggtaatgttcagtcagaaatcttacttagaaaagacaaatcaaccttcacatttgataagggatgggccttccctagaagaatttatttcaatggggataactgtgttatgcctcctccagatgcctacccctggcttccaaatgcaagttctaaactagttttctctttactcagtacagtcatagccactttagcttctttgttaatcttattgaatcaatcatag

SEQ ID NO: 1341 - DNA, 960 bp, Glycine max var. Williams 82
aaatactctagagttaggaaatggactgttggaataccaggtggtaaagaacttatagccattatccgagcatcagggagtattagtcgtgtagagagtcaattatctgtctctagctcagggatcattgcagagaagttcattgagaagattcgcactgtcagagagtcaaaagaattcaaggctgctatcatcagaattgacagtcctggaggtgatgctcttgcttctgatttgatgtggagagaaatccggcttttggctgcttcaaaaccggtcattgcttcaatgtctgatgtggcagcaagtggagggtactacatggcaatgggagctgatgttattgttgcagaaagtcttacattaactggttcaattggagtggtcacaggaaaatttaacctggggaaactgtatgagaagattggctttaacaaagaaattttatcaaggggaaaatatgctgagctccttgctgctgaacaacgtcctttcagaccagatgaagcagagctatttgccaaatctgctcagcatgcttataaacaatttcgagacaaggcagcttcatccagatcaatgactgtagaaaagatggaggagtttgcccagggaagggtttggactggtaatgatgcagcttcacgtggtttagttgatgctattggtggtctttctcgagctattgccatagcaaaaatgaaggccgatatacctcaagacagacaggttacacttgtggagatgtctagagccaacccttctctacccgagattttgttaggcgtagggagttcccttgttgtagcagacagaacggtgaaggaactgctacagggcttgacattttcttatggagttcaagcccggatggatggaatcttgtttcagacattggaagaatatccttttggcaaccctattttgtcaataataaaagatatcatcagttccctgtag

SEQ ID NO: 1342 - DNA, 3573 bp, Glycine max var. Williams 82
atggaaggtaatggtagaaggaggaggcgccacttcagcagaatccatgcattctcttgtggaaaagcttcattcaaaggggagcattcactcataggcggtcctggattctcaaggatagtgtactgcaacgaagcggaacgcggtgaggggagtcttgtgagctatggtgacaattatgtgagtactactaagtatacagtggccactttccttcccaagtccttgtttgagcaattcaggagggttgccaatttttacttccttatctgtgcaattctgtcttttttcccggtttctccttactcggctgtcagcaatgttgttcctcttgtggttgtggttgctgctacaatggggaaagaggctgttgaggattggaagaggaaaaagcaggatattgatatgaataatagaaaggttaaagtgcaccgtggagatggtgtttttgactattctaaatggaaggatttgaaagtcggggacatagtaaaggttgaaaaggatgaatttttccctgctgatctcatcttactttcatcaagctatgacgatgcaatttgctatgtagagaccatgaatcttgatggagaaacaaatctaaaagttaaacaatcacttgaagaaacttcaaagttgcaagaagattcaagctttcaaaatttcaaggctattatcaaatgcgaagatccaaatgcaaatttgtactcgtttgtaggcagtttggagcttgaagatcaattgtatcctctttcacctctgcatctactgcttagggactcaaagctaaggaacaccgagttcatctacggtgtggtaatctttacaggccatgatacaaaggttatgcagaattcaacagaacctccatccaagagaagcacagttgagaagcggatggataagatcatctactttctgttcttagtcttatttttaatttcttttattggttcaattttcttcgggattgcaacgaggaaggaccttgaaaatggagttatgaagcgatggtacctcagaccagatgacaccacaatttactttgatccaaagaaagcaccagtcgcagccatgctgcacttcctgactgcacttatgttgtatagttacttgattccaatttctttgtacgtttccattgaagttgtgaaagttcttcaaagcattttcatcaaccaggatttgcacatgtattatgaggaagctgaccggccagcacatgctcgtacctcgaatttgaatgaagaacttggccaagttgatactatactttcagataaaacaggaactttgacttgcaactctatggaattcatcaagtgttctattgctgggattgcgtatggccaaggagttacagaagttgagagagctctagccaggagagaaggagtacctttaagtcaagagttgacagaagatggaaatgttccaaagtcttccattaaaggttttaactttatggatgaaaggatcatgaagggaaattggatcaacgaacctcacgccgatgtaatccagaactttctgcggttgttggcagtatgccatactgcaatacctgaagttgatgaagaaatcggtaaagtttcatatgaagctgagtcacctgatgaggcagcttttgtggttgcagccagagaacttggttttgagttctatgaaaggacacagacaaatatttcactgcatgagttcaatccgagatcaggccaaacaacagaaaggtcgtacaaacttttgaatatattagagtttagtagtacaagaaagcggatgtctgtaattgtaagagatgaggaggggaaactgctactatttagcaaaggagcagacagtgtcatgtttgaacgacttgcaaggaatggaagggagtttgaagagaagactaagcagcacattgatgaatatgctgatgctggtttgaggaccttgatacttgcgtatcgggaacttgatgaagaagagtacaatctattcaatgaagaatttatggaggccaaaaacttagtgagtgcagatcgagagcaaattgtggaggaaatatcagaaaagattgagaaggatttaattcttcttggtgctactgcagttgaagacaaacttcaaaatggggttcctgaatgcattgacaagctagcacaggcaggaattaagctatgggttctgactggtgataaaatggagacagcaatcaatattgggtttgcttgtagtttactcagacaaggaatgaagcaaattataattagttcagacactccagaaaccaaatcactggagaaagtggaggacaagtctgctgctgcagcggcagttaaggtaagtgttattcatcaattaacgaatggaaaggaattacttgctgaatctgatgaaaactctgaggcattagctcttatcattgatgggaagtctctcacttatgcactagaagatgatgtaaaggacttatttcttacacttgctgctggctgtgcatctgtcatatgctgtcgttcatctcccaagcagaaagcacttgttactagattggtaaaggttaaaactggcagtacaactctagcaattggtgatggagcaaatgatgttggaatgcttcaagaagcagacattgggatcggtatcagtggtgttgaaggaatgcaggctgtaatgtcgagtgatatcgcaattgcccaatttcggtttctagagcgtttacttcttgtgcatgggcattggtgttacagaagaatctcatcaatgatttgctacttcttttacaagaacattgccttcggcttcaccctcttcttctacgagatctatgcgtcgttctcggggcaagctgcatacaatgattggtacctctcactatataacgtattcttcacttctcttcctgtaattgccttgggagtgtttgaccaggatgtttctgctagactatgccacaagttcccattattatatcaagaaggtgtacaaaatgtcctattcagctggaaacggatcctcggttgggctttcaacggagtcttgagtgctaccataatattcttcttctgcatcaacggaatggagaatcaagcattccgtaaagccggggaagttgctgatcttgaagttcttggtgccaccatgtacacttgtgttgtgtgggtggtgaattcccaaatggcattgtccattagttacttcacttacatacaacatttattcatatggggtggcattcttttctggtacatattcctcttagtgtatggaaccatggacccttctctatcaaccactgcctataaggtcttgattgaagcttgtgcaccagcaccatcttactggctcatcactttgcttgtgcttgttgcttcactccttccatacttcgcctacgcttcgatccaaatgcggtttttccccacgttccatcaaatgatacagtggatacgaaatgatggccaaacaactgatccagaatatgttaatattgtgagacaaagatcaataagacacacaacggttgggttcacggctcggtttgaagcatcacatagttcaggagcatccaagagtattcaagtctga

SEQ ID NO: 1343 - DNA, 1833 bp, Glycine max var. Williams 82
atgataatcaaagtgagcttcattgttgcagcttcgattgctgcactcaagatttcgcagacaaaaaccagctcttccaccaagagaaatggtacactaaaatgttcaggaagtgatgggtcacacttggaacaagagtttgaagagagggaaaatagcactgttaatgctaatcatgtgatacagaatgaagagaaggagattaaatttgaaatgccacagaatctgccaacaggagaatttaaggacttggagctgttaatagatagtgagaaaatgcacaatgctactaaaaaggaggtattgcagaatttggtacaaaattacaagcagagagaagtaaaccttgaaaggaagcttcttaaattgaatagtctgagggaagagcaatcagccattgctcaaatgcaaaaacaattagaggaaaagacagagactgtggagattcttaaaaagaccattggttccttgcagtcagagagtgaagtttttcgagaaaaaataagagaggatctaatgttaaaaaagcagctagatattgcaaagaaaatgatgaatgagatgcataggaaaaaggatgttaatgcaagccctgtgagggagcagatattgatgctccaacagcaagtagctgaatttcggaagtttaatagttcaggtggaaatgctatgggaaataagaaacttaaagatgtccaagacatgatggttaaagttttggaactaaagaggaggaacaaagagcttgaattggaaaagagggagcttgtaattaagttggctactgcacaagcaagaatcagaacagaggaggaaatagggccccggataaaacaagaaattactggcttaaggcatgtgcatgaagaactttcagagcaagttgaaagattgcagagaaacagatttgacatggtccaggaagttgtgtaccaacggtggctttacacattgttgaaatttgaagtgcatgatcatcaaaaacaaagtagaaaggcctcaagaagagatagcattaggagccagaattcaagcaaagaactgtgtgggaaaaagcatgcatcaatatctgatcttgagcttgaaagcgtctcttccaattccacatcgaacgaaaacgatgaaattgaaactaatacctttgaaagctcttccagtagccaaagtagcagtggcagcacgaaactgaagagatggaggacaaccaaagactactctaacaaaatttggtcaaagggtagaaatttttttatccaacctggtccgatacaaagattttctatgtcaatggttgaatcagatgtttctaagttagaaagcccaataacgccaaaaattaaaagagtttctttcagcgattctgtcaaactctctacttatgaagatatgccagagacaactactgaggatgcaattgatgacaaaggaacaaagtctgagcagatcatggagctgacttcaagtgttgtgaactctatcaacattgattgcattgaaaaaaatgaaggtgccaagaataaaattggtcatttgggtgaagtgtattcaagtgttgtgagctccaccaacattgattccattgaaaagaatgaaggttccaagaataaaattggtcattcgggtgaagtgtattccagtggtgtgagctccaccaacattgattccattgaaaagaatgaaggtgccaagaataaaattggtcattcagatgaagtgtattcaaggaatggaaccatttctagaaaggatgacaggatcaaaactatactagtgcagctggtaacatttttattctttttattaatcctgctagcatgtttcaggatcaaataa

SEQ ID NO: 1344 - DNA, 1947 bp, Glycine max var. Williams 82
attcttaaaggattcactgggttcggttcagtggcacgcacctaagtctcatttggaaaccaaattgttcttacttgtgtgaagaaccacatgataatcaaagtgagcttcattgttgcagcttcgattgctgcactcaagatttcgcagacaaaaaccagctcttccaccaagagaaatggtacactaaaatgttcaggaagtgatgggtcacacttggaacaagagtttgaagagagggaaaatagcactgttaatgctaatcatgtgatacagaatgaagagaaggagattaaatttgaaatgccacagaatctgccaacaggagaatttaaggacttggagctgttaatagatagtgagaaaatgcacaatgctactaaaaaggaggtattgcagaatttggtacaaaattacaagcagagagaagtaaaccttgaaaggaagcttcttaaattgaatagtctgagggaagagcaatcagccattgctcaaatgcaaaaacaattagaggaaaagacagagactgtggagattcttaaaaagaccattggttccttgcagtcagagagtgaagtttttcgagaaaaaataagagaggatctaatgttaaaaaagcagctagatattgcaaagaaaatgatgaatgagatgcataggaaaaaggatgttaatgcaagccctgtgagggagcagatattgatgctccaacagcaagtagctgaatttcggaagtttaatagttcaggtggaaatgctatgggaaataagaaacttaaagatgtccaagacatgatggttaaagttttggaactaaagaggaggaacaaagagcttgaattggaaaagagggagcttgtaattaagttggctactgcacaagcaagaatcagaacagaggaggaaatagggccccggataaaacaagaaattactggcttaaggcatgtgcatgaagaactttcagagcaagttgaaagattgcagagaaacagatttgacatggtccaggaagttgtgtaccaacggtggctttacacattgttgaaatttgaagtgcatgatcatcaaaaacaaagtagaaaggcctcaagaagagatagcattaggagccagaattcaagcaaagaactgtgtgggaaaaagcatgcatcaatatctgatcttgagcttgaaagcgtctcttccaattccacatcgaacgaaaacgatgaaattgaaactaatacctttgaaagctcttccagtagccaaagtagcagtggcagcacgaaactgaagagatggaggacaaccaaagactactctaacaaaatttggtcaaagggtagaaatttttttatccaacctggtccgatacaaagattttctatgtcaatggttgaatcagatgtttctaagttagaaagcccaataacgccaaaaattaaaagagtttctttcagcgattctgtcaaactctctacttatgaagatatgccagagacaactactgaggatgcaattgatgacaaaggaacaaagtctgagcagatcatggagctgacttcaagtgttgtgaactctatcaacattgattgcattgaaaaaaatgaaggtgccaagaataaaattggtcatttgggtgaagtgtattcaagtgttgtgagctccaccaacattgattccattgaaaagaatgaaggttccaagaataaaattggtcattcgggtgaagtgtattccagtggtgtgagctccaccaacattgattccattgaaaagaatgaaggtgccaagaataaaattggtcattcagatgaagtgtattcaaggaatggaaccatttctagaaaggatgacaggatcaaaactatactagtgcagctggtaacatttttattctttttattaatcctgctagcatgtttcaggatcaaataacaataagacaatatctatgaaaat

SEQ ID NO: 1345 - DNA, 1962 bp, Glycine max var. Williams 82
atggcattccatttggaaattatcatgctcattctcatcttcatcgctcttgcgcagccgagtgagcgagtcaacgcggagccgactcaggacaaacaagccctcctcgcattcctctcccagaccccgcacgcgaaccgggtccagtggaacacctccagttcggcctgcgactcctggttcggcgtccaatgcgactcgaaccgctccttcgtgacttccctccacctccccgccgccggcctcgtgggccccatccctcccaacaccatctcccgcctcacgcgcctccgcgtcctcagcctccgctccaacgcgctcgtgggccccatccccttcgacttcgccaacctcacctccctccgcaacctctacctccagaacaaccacctctcgggcgagttccccacaaccctaactcgcctgactcgcttgactcgcctcgaactctcctccaacaatttcacaggaccaatccctttctccctcaacaacctcactcgcttaaccggcctcttcctagaaaacaattccttctcgggtagcctccccagcattacgttaaagttagttaacttcaatgtctccaataaccgcctcaacggctccatccccaaaaccttatcgaatttccccgcgacctcgttttcaggaaacaacgatctctgcgggaagccattacaaccatgcacacccttctttccagccccagccccagccccttctcctgtggaacaacaacagcataactccaaaaggctttctatcgctgccattgttggaattgccgtcgggtctgctttgtttatactgttattgctattaattatgtttctatgctgccggcggaggaggaggaggaggagagcggctaagccgccacaggctgtggcggcggtagcgcgtggggggcccacagagggcggaacgtcgtcgtcgaaggacgatattacggggtcagtggaggctgctgagaggaacaagctggtgtttatggagggtggagtgtacggatttgggttggaggatttgttgagggcttcggcggaggtattgggaaaagggagcatggggacttcttacaaggcgattctggaggacgggaccacggtggttgtgaagaggttgaaggacgtggcggctgcgaagagagagttcgaggcgcgaatggaggttgttgggaacgttaagcacgagaatgtggttcctctcagagcgttttactactccaaggatgagaagttgctcgtctacgattacatggccgccggcagcttgtctgcacttcttcacggaagcagagggtcagggcgaaccccgttggattgggacacccgaatgaaaatagcactgggagctgcaagaggcctcgcctgcctccacgtgtcaggaaaactggtccacggcaacatcaaatcctccaacatcctcctccacccgacccacgaagcctgtgtttcagacttcgggctcaacccgatatttgccaacccggttccctcaaaccgagttgccggttaccgggcaccagaggttcaggaaaccaaaaaaatcactttcaaatccgacgtctatagctttggcgtcttgatgctggaacttttaacaggtaaggcaccaaaccaagcctcgctgagcgaggaagggatcgacctaccacgatgggtgcagtccgtggttcgcgaagaatggaccgctgaagtgttcgatgcggaactgatgaggtaccacaacattgaggaggagatggttcagttgttgcagattgcgatgacgtgcgtttcgctcgtgccggatcagaggcccaacatggatgaggtggtgcacatgatccaggatattagccgaagcgagaccaccgatgacggcttacgccaatcgtccgatgatccttctaaaggatcggacggtcacacacccccgcaggacgctaggactacccctaggtcggacacgtcgtag

SEQ ID NO: 1346 - DNA, 1365 bp, Glycine max var. Williams 82
atggatgaaaggagagtgaatataatcgctgctatatcagtgattacactgattattctcatagttgttgctcgtgtcacgttgaagctctcaaaggcctttttcctgatttttggtgctggtgttgctgtgattcttgcagtcttcgcttatgtacttgtgagcataagttacaaccgcagaaggaggctattggagtcacagtttaaatccgaaagccaagaacttcgaatagagtacagtttcttaaggaaagttgcaggggttcctatgaagttcagatacaaggagcttgaggaagccactgatgggtttcaagcactgataggaaaaggtgcatctgcttcagtcttcaaaggaattctcaacgatggaacttcggtcgctgtgaaacgaatcgatgcagaggaaagaggggagaaggagttcagatcagaagttgcagccatagctagtgtgcatcatgtgaaccttgtgaggctattgggctattgcaatgctcctacagcaccaaggtaccttgtttatgaatatgtctcgaatgggtctttggattggtggattttttccaaaagggtatctcagaggcgccgtggagggtgcttgtcatggaatttgaggtacaatgttgctattgatgttgccaagggacttgcttatcttcaccatgattgcaggtcaaggatcttgcaccttgatgtgaagccagagaatatacttttggatgagaattttagagcacttgtttcggattttggtctagcaaagctaattggtaaggaagagagccacaaggaagtgtctgctattagaggaacaagagggtacttggctcctgagtggctcttagagaagggtatttcggacaagactgatatatatagttatgggatggttctcttggagattgttggaggaaggaaaaacgtgtgctcggtggaaattgatgaaagggccaataagtccaagagaaaatggcagtattttcctaagattgtgaatgagaaagtgagggaagggaaattgatggaaattgttgatcctaggttgttggaatgtgggggtgttgttgatgagacgcaagttaggacattggtttatgttgctttgtggtgtgtgcaagagaagccacgattgaggcctagcatgcctcaagttgttgatatgcttgaagggcgtgtaagggtggagatgccacctgataccagaatggttgttgttgattttctatgtgtggatgaagaaagtgcaactgatagtaatagcatgccaaggttggactttgtgtcgaatcaaagaacacaaagcaatgtggagtcttcttctacctactcgtttgctaccaccattatgtcaggaagatag

SEQ ID NO: 1347 - DNA, 699 bp, Glycine max var. Williams 82
atggtttttccaaaactagttattaccattgtactgatattagtccttttctttttcatctatgaatctgagggtgcatcttattcttctggttcatataatgttggtcatggtgctgacattaatacaccatatgatcatcagaaagttaatctatcagtttactatgacagtctttgccaatcttgtgcaactttcattgttaaggatctgctgaatgtcttctacaacaatctcatcagcattgtcaatcttcagctagtcccttgggccaatgcttatgtcaataataccaacaattccatatcatgtcagaatgggccagatgaatgtgagctaaattcactggaatcatgtgcccttaatctttggcataaagtggacatacgttattatttgattaactgctttgagtatctggtaattggggggaaaagcatggaatgggtgaactgtttaagccagttgggtttgcctaaggagcctattatgaagtgcttcaacatgggaaatggggcacagcttggaaaaacatatattaatcaaaccgcacaactttacccacctccttcatttttgccatgggtggtggtgaacaatcaacctgttggaaaagactatgcaaattttgcacattatgtttgtaaggcttacaaaggtgctgcagttccagaggtctgcaatcctccttcgaaatga

SEQ ID NO: 1348 - DNA, 504 bp, Glycine max var. Williams 82
atggcaaggaaggtgggtttgaattttatagggtgctccatcgttgcaatggttttcataattggtgtggctgaagcaacagattatatcgttggtgaaggcttcggatggagcgttccctccaatgagagcttttatacagactgggctagcaccaagagattcttcgttggtgacaatctcattttcaacatcagcggagagcattcggtgggaattagaacagaggctacttattatgagaattgcaacaccagcttattaactggtttcacgttcataggcgtcaatgggagtaattcgatgtttcgacataatattattcctccaactgggcctcgctatttcctctgcaccgttggaaatcactgtgaaagaggccagaagtttagtatcagcgttgagtctcatcctgattccgctgctcctactacactgtcattcagaatcttatctgcatttctctctagcttggctgtgtatttcttcactgttactagttag

SEQ ID NO: 1349 - DNA, 757 bp, Glycine max var. Williams 82
aatactaaatatccaccaccacaatttcataacgcataacacgaaaaaaataatggcaaggaaggtgggtttgaattttatagggtgctccatcgttgcaatggttttcataattggtgtggctgaagcaacagattatatcgttggtgaaggcttcggatggagcgttccctccaatgagagcttttatacagactgggctagcaccaagagattcttcgttggtgacaatctcattttcaacatcagcggagagcattcggtgggaattagaacagaggctacttattatgagaattgcaacaccagcttattaactggtttcacgttcataggcgtcaatgggagtaattcgatgtttcgacataatattattcctccaactgggcctcgctatttcctctgcaccgttggaaatcactgtgaaagaggccagaagtttagtatcagcgttgagtctcatcctgattccgctgctcctactacactgtcattcagaatcttatctgcatttctctctagcttggctgtgtatttcttcactgttactagttagttactttgtcgtgtaactctacgaggattttgcattcttgttcctagcaattctttgaacatattcactatagatattataggattgctgggttgtttgtttcaataaatgttgtactgctacttacaacatactattgtaactttaaatttaataaagacgttacttcaattaatattgaattgatagagttttagtttt

SEQ ID NO: 1350 - DNA, 1041 bp, Glycine max var. Williams 82
atggaagtgacgaataaatacatagtaataaagcatcacgttgaagatgcacctaaacagtccaattttgagctcaaaactaaggcttttgctctgtcagttgagtcaggatctgatgatatcattgtgaagaatctctacatttctattgatccctatcagattaaccgcatgaagagttatagctcttcccagggcactataaactttgcagtgcccataaccccaggcgaggctattgatggtgctgttattggaaaagttgtggcttctgggaatgctaagtttcaaaaagatgatttggtgatgggagtattcacttgggcagagtacagtttggtcaaagaagggaacataataaaaaaattagagtcctctgaatttccactctcttatcatcttggagttctgggattcaatggactgtcagcttatgcggggttttttgaattgtgtaaacccctaaagggtgaaaaggtctttgtctcaacagcttctggagcagttggaaacttggtagggcaatatgcaaagcttttaggttgttatgttgttggttgtgcagggagccagaaaaaggttgcattgcttaaagaaaagctaggatttgatgatgcattcaactacaaggaagaaacagatctaaactccactcttaaaaggtattttcctgatggaattgatgtatattttgacaatgttgggggtgagatgctggaagcagcggttgctaacatgaaagcatttggaagagtggctatttgtggggtaatatctgagtatactagtgctggaaagagagcttcaccaaacatgttggatgttgtgtacaagagaatcaacatcagaggatttttagctgctgattttctgaatgtttttgaagatttttccacaaaaacttcggattacatacgtacagggaagttgaaggtgattgaagacttgtcattgggggtggagagcatcccttctgcttttgttggactcttcaaaggggataacattggaaagaaaattataagtttaacagaagagtga

SEQ ID NO: 1351 - DNA, 1329 bp, Glycine max var. Williams 82
agaaaagctgaaaaatggaagtgacgaataaatacatagtaataaagcatcacgttgaagatgcacctaaacagtccaattttgagctcaaaactaaggcttttgctctgtcagttgagtcaggatctgatgatatcattgtgaagaatctctacatttctattgatccctatcagattaaccgcatgaagagttatagctcttcccagggcactataaactttgcagtgcccataaccccaggcgaggctattgatggtgctgttattggaaaagttgtggcttctgggaatgctaagtttcaaaaagatgatttggtgatgggagtattcacttgggcagagtacagtttggtcaaagaagggaacataataaaaaaattagagtcctctgaatttccactctcttatcatcttggagttctgggattcaatggactgtcagcttatgcggggttttttgaattgtgtaaacccctaaagggtgaaaaggtctttgtctcaacagcttctggagcagttggaaacttggtagggcaatatgcaaagcttttaggttgttatgttgttggttgtgcagggagccagaaaaaggttgcattgcttaaagaaaagctaggatttgatgatgcattcaactacaaggaagaaacagatctaaactccactcttaaaaggtattttcctgatggaattgatgtatattttgacaatgttgggggtgagatgctggaagcagcggttgctaacatgaaagcatttggaagagtggctatttgtggggtaatatctgagtatactagtgctggaaagagagcttcaccaaacatgttggatgttgtgtacaagagaatcaacatcagaggatttttagctgctgattttctgaatgtttttgaagatttttccacaaaaacttcggattacatacgtacagggaagttgaaggtgattgaagacttgtcattgggggtggagagcatcccttctgcttttgttggactcttcaaaggggataacattggaaagaaaattataagtttaacagaagagtgacgaaggaatgccacaatttacctctatgaaagtagctagtgtgatgaatttgatctttaagaataagattgttgttttgtttaacaggagatgagatgattgaagcttgagaaattcattgaaaaaggctttgaagttacacctcatttcaacttctgcaaaagtaaactttagaatcggcaagaataaaattgattcacaattttaccgtttttttctatctcgtaggcctgaattgtcaggttattcaagggtagtaaaatatataaatccc

SEQ ID NO: 1352 - DNA, 1239 bp, Glycine max var. Williams 82
tggatcagattacataatcctgcaaccttatcctcttcaaaaggttcaatcaaaattgccgtggtctttgaattttgctgtccaaaaaaaaccaggaaaataagaaaacaaaatacaaagaaagatttggaaagagaaaaaatggcaacaaatattctctcaacctcaaaccccttcctactaactaattcattctcatcatcatcatttgtaacaccaacatatgtttactacaatcccataatgaaatgcacagtgaagagggaattaactctttgcaaagcagcaaaccaaccagcccctccacactctccaattgttgtgacaaagagaggcttgtccatcagcttcatcaccagcttcgtgctttcattggctagtaagaagaatgcaaatgcagcaatacttgaggctgatgatgatgaagaactcttggagaaagtaaagcgtgacagaaagaagagacttgagaagcaaggtgtgatcagttcttccaaacaagaaacagggtatcttcaagatctggtgtacaagctaagcacggttggtcaagcacttgaaaagaatgatctatctgctgctggctctgtccttggaggaaacgcggacgcagattgggtccaaagggctaatatagccttcaataaactgagctccagtcctgaagagaagactgaggtagactcattcaactcctcattagcttcactaatttcatcagtttctaagaatgatgttgagtcctccaaaattgccttcgtctcttcggccaccgcatttgagaagtggacttctatgacaggccttgctgctcagcttaaggggctttgagggaaaacaatgtacaaaagatatcatttcatttcatcattttgcgatcaatatagagaattccattaatttttctacccatgtcacctaattgttgtcttgggagcagtctcttcacagcattatcttgtactgcttcataactatcaacaagcccattctttgttaggttaattaagcttgggttacgagcagtgtcactgaaattttgtaaatttgatgtcattatttaatggcatgttctgttatttttgctcatctaccttggcaaacaaaggcctttttaagtttattgtagggtgatcgctatgtatattaaatctgtttagcaggggaactacatggcctattttttattcattgctttatatttattttgttttaaatttgatgcttaatgttatttcc

SEQ ID NO: 1353 - DNA, 1056 bp, Glycine max var. Williams 82
atggcgaagcagcaaacacacgaaatcaatgcaagcactaacaataacattaacacaactaaaactgtcaccaccaaggtgaaacgaacaaggagaagtgtccccagaaattccccacctcaacgcagctcaatatacagaggagtcactagacaccgatggacaggtcgatacgaagctcatttgtgggacaagaattgctggaatgagtcacagaacaagaaaggacggcaaggtgcttatgacgatgaagaggccgcagcacatgcttatgatctagcagcattgaaatactggggtcaagataccattcttaattttccgttatcgacctaccagaatgaactgaaggaaatggagggtcaatctagggaagagtatattggatcactaaggaggaaaagcagcggtttttctcgtggagtttctaaatacagaggtgttgcaagacaccatcataacggaagatgggaagctcggattggcagggttttcggcaacaaatatctttacctcggaacttatgcaacccaagaagaagctgccacagcatatgacatggcagctattgaatatcgaggactcaacgctgtgaccaattttgacctcagccgctatatcaagtggcttaagcccaataacaacaataacaaagtcaattctaataatcttattgtctctatccctaattgtgcgaccaactttaccccaaactctaaccaacaacaaggattcaattttttcaacagtcaagaatcattcaataataatgaagaagcggcaatgactcagcctcggccagctgctgccacgtcagccctaggacttttgcttcaatcatccaagtttaaggaaatgatggagatgacttctgccatagatttgtcaacaccgccatcagaatctgagttgccgccatgcacatttcccgatgacattcaaacatattttgagtgtgaagattcccatagatatggagaaggggatgacatcatgtttagcgagctcaacggctttgtgccccctatgttccattgtgatgactttgaggcttga

SEQ ID NO: 1354 - DNA, 1020 bp, Glycine max var. Williams 82
atgaacgaatggaagatgttagtatccaaaaaagaatcatgtatggtagatgtttggcccttcctaaatagcttgacaggagatgtcatttctcgtacggcttttggaagttgctatgaagagggaaaaatagtatttcaactccagaaagaacaagccgagcttacagccaaggtttttcaatctgtttatattccaggatggaggtttgtaccaactaaattgaacaagaggatgaaggagattgattttgaaattcgaaacgtacttagtggaattatccaaaaacaggaagcggctatgaagacatgcaaagctccaaatgataacctactaggattattattggaatccaatcaaaaagagatcgaagatcgtggacatagaaaggatgttggaatgaacaccgatgatgtaattaacgagtgtaagttattttactttgctggacaagaaacaacgtcggtgctacttaattggacaatggtgttattaagtaggtttccaaattggcaaacactagcaagagaagaggtcatcggaatttttggcacaaaagaaccagactatgatggattaaatcgtctaaaagttgtcacaatgattttgtatgaggttctacgactatacccaccagttactgctattacaagagtcgtaagaaaggaagcaagagttggaaatttgactttaccagctggagcacttgctactattccaatcgtgttggtacaccatgattctgaattatggggcagtgatgcaaaagagttcaaaccagaaaggttctctgaaggaatcttaaaagcaacaaatggccaagtttcatttctcccatttgcatggggtccccgaatatgcattggacaaaactttgctttgcttgaagccaaaatggcattgtgcttgattctgcagaacttctcgtttgagctttccgcatcctatactcatgctccattcactgttataactgctcaacctcaatttggcacgcctattatattccataaattatag

SEQ ID NO: 1355 - DNA, 561 bp, Glycine max var. Williams 82
atggaagttgatgcaacaacgatgatgtttgttggattttgtattgcatttgttaccatactcctaacgaaagcactgagttggctgtggctggagccaaaaagggcagagaggtaccttagaagacaaggcttaaagggaaactcatacacacttttctttggagacatcaaagcaatttctacgttgatacagaaagcaaaatctaagcccatagacatcaacgatgatgttactcctcgcctagttccatttcaacatcaactgataagaaattatggtaagaattcgtttttttggtatggcccgaagcctgtagtgcatattatggatcctgaagcaataagagaggttctcaatttgataaatgactttccaaagccgaccttaactccactttccaagttcctgataaccggacttgtagaccttgatggtgataaatggtcaaagcacagaaagatcatcaaccctgcatttaatctcgcgaagctaaaggtttttttttctcattatatattgtgccaatctctaactttaaattttattatatattattga

SEQ ID NO: 1356 - DNA, 2904 bp, Glycine max var. Williams 82
atggcaaacaggaacttggaaaagatggcatccatcgatgctcagcttcggctgttggttccagccaaagtgagtgaggatgataaactggttgagtatgatgctttgctcttggatcgattccttgatattcttcaggatttacatggggaggatctgaaagaaacggttcaagaggtgtatgagctttctgctgagtatgaagggaaacatgacccaaagaaactggaggaacttggaaatctgataactagtttggatgctggagattccattgtagttgccaagtccttttcccacatgcttaacttggccaacttagccgaagaggtccaaattgcacacagccgaaggaacaagttgaagaaaggtgattttgctgatgaaaacaatgccaccactgaatcagatattgaagaaactctcaagaaacttgttggggatatgaagaagtctcctcaggaagtttttaatgcactgaaaaaccagactgttgatctggttcttactgctcatccaactcaatctgtccgtaggtctttgcttcaaaaacatggaaggataagaaataatttaactcagttgtatgccaaagacattactcctgatgataagcaggaacttgatgaggctctacagagggagatccaagctgcatttcgtactgatgaaatcaggaggacccctccaaccccacaagatgagatgagagcagggatgagttacttccatgaaacaatttggaagggtgtaccaacatttctacgtcgtgttgatacagctttgaagaatatagggatcaatgagcgtgtcccttataatgctcctctcattcaattttcctcttggatgggtggagatcgtgatggcaatccaagagtaactccagaagtgacaagagatgtttgcttattggctagaatgatggctgctaacttgtactactcccagatagagaatcttatgtttgaactgtcaatgtggcgctgcaatgatgagctacgtgttcgtgcagatgaacttaacaggtcttccaagaaaaattcagtggcaaaacactacatagaattctggaaagtcattcctccaaatgaaccatatcgtgtgctactgggtgaagtaaggaataggctttaccatactcgagagcgctcgcgccatttgctagctcatggctactctgacattccagaggaagaaacattcaccaatgttgaggagttcttggaaccccttgagctctgttacagatcactctgtgcttgtggcgatcgagcaattgctgatggaagccttctagatttcttgagacaagtctctacttttggactctccctagtgaggctcgacataaggcaagagtcagaccgccacaccgatgtcttagatgccatcaccaagcatttggaaataggctcataccaggaatggtccgaggaaaaacggcagcaatggcttttatccgagttgagtggcaaaaggcccctatttggccctgaccttccccaaacagaagaaatcagagacgttttggacacattccatgtcatagcagagcttccaccagacaactttggagcatacatcatctcaatggcaactgcaccttctgatgtgcttgcagttgagcttctgcagcgagaatgccatgtcaagcatccactaagagttgtgccattgtttgagaagctagctgatctggaagcagcaccagctgcattggcacggttgttctccgtagactggtacagaaacaggatcaatgggaagcaggaagtgatgattggctattctgattctggcaaagatgctggaaggttttcggccgcgtggcagctgtataaggctcaagaggagcttataaaggtggctaaagagtatggtgtgaagctgacaatgttccatggccgtggagggacggtcggaagaggaggtggtccaactcaccttgctattctgtctcagcctccggataccattcatggatcgctgcgcgtgactgtccaaggtgaagttattgagcaatcatttggagagcagcacttgtgcttcagaacgcttcaaaggttcactgcagctactctagaacatggaatgcatcctccaatttctcctaaaccagaatggcgggctttgatggatgagatggctgtcattgccactgaggagtaccggtccattgtgttcaaagaaccacgatttgttgagtatttccgcctggccacacctgagttggaatatggaaggatgaacattggaagtcgaccggcaaagaggaggccaagtggaggtattgagacactgcgcgccataccttggatctttgcatggacacaaacaaggttccatcttccagtgtggctaggctttggtgcagcattcgaacatgttattgagaaggatgttaggaatattcatgtgctgcaggagatgtataatcaatggcctttctttagggtcactattgatttagtggaaatggtgtttgccaaaggagacccggggatcgctgctctttatgataggctccttgtttcagaggatctgtggtcatttggagagcagttgaggaccaagtatgaagaaaccaaggaattcctccttcaggtggctggccatagggatcttcttgaaggagatccatacttgaagcaaagactgcgcttgcgtgattcttatattactaccctaaacgtgtgccaagcctacacattgaaacgtatacgcgatccaaactataacgtgaagctgcgccctcacatctccaaggagtctatagaggtaagtaaacctgctgatgaactcataacacttaacccaacaagtgaatatgcacctggtttggaagacaccctcattctcaccatgaagggtattgctgctggcttgcaaaacactggctaa

SEQ ID NO: 1357 - DNA, 1518 bp, Glycine max var. Williams 82
tctccttcacccctgcctcctcattcttcaattctggttcttgccacaaattctctactttccttgttatccttctaattcagcgtgtattcttggaaagggttgattttaactgagtatccatttcagtggcaccaacatccgtctagcttcaggaaatggaattagtctggattgccattatgtactagatgctcatgacagctatttggatcagcacttacaaccatatgtacaaggtcatgctttgccttggcatctgtctcttccaatgccatatgtagaagctttcagcgctaatagaagttcatcagagaatgcgagaattggtccacagagatatcatttatcatgacacaaatggcatcagaagtggccatagatttccacggagatatcatgacacaaatggcagcagaagtggccatagatttccatatagatatcatgatacaaatggcagcagaagtggccacagatttccacggagatatcataacacaaatggcagcagaagtggccacagatttccacagagatatcatgatacaactggcagcagaagtggccaaagatttccccatcatcctccacagcaccatagctttcatcatcaagtacagccagcacaagtaatcagaggccactccttcaacattcatcctcctgtaactgcaccttcatatagacttccaacaaatccttcacgtaattcttcaatcctcatacatgatgcttttgagatgggcgccaggcatcctggctttgcaccatttgcaggtgcacgcatacaccagtctcatagaggcaacttgcacgagatgataactcttatacatcaaaatcttcctcctgcggtctttttctcagatgatgatgcttctttactggttgaccatcatactgatatgtacttggacactgaagatatgtcttatgaggaccttcttgaattaggtgagcagattggcaacgcaaaatcaggtttatcagagaaaacaattacaagtcaaatgaagaccaaaacttacatactacctactaatgctactaacttggaggaggcagcttctgaggaacagggaactgatctttgcataatatgccaggatgaatataagaacaaagagaatattggaattcttagatgcgggcacgaatatcacgcagattgtttaaggagatggttacttgagaaaaatgtctgccccatgtgcaaatcaatagcattgactcctggaggaaaacaatgagatttacatgtctctctgttcctacatgcacacttcttagctgctacattttctcgaacgaattcatattttttgttatgtatatgaacttgtacatatacacagtttcattgtccaactcaattatttgttggcaccactgcaccagaagatttatgtgtatatcaagttgtacagacttctgttgatatgttagctttaggcaattacattttgcttgttttttatttcagttttttatgtgaatggttgaatgtgtcatgtc

SEQ ID NO: 1358 - DNA, 1389 bp, Glycine max var. Williams 82
atggctccaacaagaaaccaccttcttcacattgccatgttcccatggtttgcaacaggtcacatgactccattcctccacctttcaaacgagttagccaaaaggggtcacaaaatcacgttcttgctacctaaaaaagccaaactacaactccaacacctcaacaaccatcctcacctcatcacattccataccctcacaattcctcatgtaaaaggccttcctcatggcaccgaaacagcctcagagatccccatttccttgaaccatttactagtcatagccatggacaaaacccgtgaccaagtggagcacacacttagtgcaacaaaccctgattttgtgctctatgataacgcttattgggtgccccagatagcaaaaaagctgggcatcaaaaccatttgttacaatgtggtttgtgcagcaagtttggctatagttcttgtgcctgcaaggaatgttcccaaggacaggccaattactgtggaggaactaagccaaccaccagaagggtacccttcatccaaagtagttcttactggccttgaagcagagtcattgatgtttatttcagtaccctttggtgaagacaacataacattctatgatcgcataactagtgccttgagagaaagtgatgctatagccattagaacaagtagggaaattgagggtaacttttgtgactacattgcatcacagtttggaaaaaaagtgcttttgactgggccagtgttgccagaggaggctgaggggaagttagaagaaaattgggccaattggcttgatgcgtttgcgaatgagtctattgtgtattgtgcatttgggtctcaaatcaatttggagaaagatcaatttcaagagcttttgcttgggtttgagctttcagggttaccctttttggttgctctcaaaactcctagagggtgtgagagtgtggaagaggcactgcctgaggggtttgaagagagggtgaaggggagaggggtggtttcaagggggtgggttcagcaattgttgatcttgaagcacccttctgtggggtgctttgtgaaccattgtgggtttgggtctatgtgggagtctttgatgagtgacaagcagatagtgttggttccacagttgggggaccaagttttgaacaccaagttgcttgttgaggaacttggagtggctgttgaggtggagagagggggaaatgggtgggtctccaaagagagtttgagcaaagccattaagttagtgatggatggagacagtgaggttggtgctagagtgaagaagaatcacatggagtggaagaaaactgggggcagtcctaatttaatgaatggttacatggataggtttgtccaaaatcttcaagattttcctctccatgggtga

SEQ ID NO: 1359 - DNA, 1389 bp, Glycine max var. Williams 82; identical to SEQ ID NO: 1358

SEQ ID NO: 1360 - DNA, 189 bp, Glycine max var. Williams 82
atgcacgtgctctacatagcttgtactatacaattgcatgtaaagacttattattctccattttgccttagttgcttattcaattgtctttggccttctttcaagctttctccaactcctaacaaacaatattatttgatcaaccattttttttttaatttttatcttttaaaatattgtttaatttaa

SEQ ID NO: 1361 - DNA, 558 bp, Glycine max var. Williams 82
atggagagggagagagcattgtttgagagggtgagaaagaatagcacagtggaagaggaagtggaaaatgaagtagaggaggaggatgaaagtggcgttagtattactgaagaagagaagaagaaaggggttggtagtagtggtgggagaagagggtcaagtggaggtagtggaggggtttctccaccttcatgtcaagcagagaggtgtggtgctgatttaactgatgcaaagaggtaccatcgccgccacaaggtgtgtgagtttcattcaaaggcacctgttgtggtggttgcagggctaaggcagaggttttgccagcaatgtagcaggttccatgacctggcagagtttgatgaatccaagagaagctgccgccgccggttggccggacacaacgagcggcgccggaaaagcaacccggaagcttccaatgagggcagcaccaaaggccatcaccctaaggaaacaacacactgcaggcttgcaaatgagagggagagaattcagatgaacctaccagggagttccggctacaagtctttcaacatcagatga

SEQ ID NO: 1362 - DNA, 1443 bp, Glycine max var. Williams 82
atggaactgcaaaaacccactcacgtggctcttctctcgagccctggtctgggtcatcttatcccaacgattgagcttgggaagcgcttcgttcttaaccacaacttcaaagtcactgttctcgcggttacttcgcaaacctcacgcgccgaaactcagattctgaactcagccctcacaccctccctttgcaacgtcatcaacatcccttcaccagacctcaccggcctcatccaccaaaacgaccgcatgctcacgcgcctctgcgtcatgatgcgccaagccctacccaccattaaatccattctttccgaaattacccctcgcccctcagcactcatagttgacatattcggcaccgaggctattccaatagggaggaaactcaacattccaaactacgtctacgtggcatcacaggcttggttcctgtcgttgctcgtgtattctcctattctcgatgagaaaatagaaggggaatacgttgaccaaaaggaagcgttgaaaatcccgggttgcaacccggttcgaccggaggacgtggtggaccagatgctagaccggaacgacagagagtataaagagtatcttggagtagggaaggggatcccgcaaagcgacggcattttggtgaacacgtgggaggagcttcaacgtaaagaccttgaagcgttgagggagggaggtttgttaagtgaggcactgaatatgaacattccagtatatgctgtgggacctttagtgagggaaccggagttagaaacaagttctgtgactaagtcgctgctgacgtggctcgatgaacaaccgagcgaatcggtggtttacgtgtcgtttgggagcggaggaacgatgtcgtatgagcagatgacggaattggcttgggggctggagttgagtgagtggagatttgtttgggtggtgcgcgcgcccatggaaggaactgcggacgctgcgtttttcactactgggagtgatggggttgatgaggtggccaagtatttgccagaagggtttgtatcgagaacccgcaaagtgggactgttggttccggagtgggcccaacaggtaacaatactgaagcatcgttctattgggggttttctttcgcattgtggatggggttcgacgcttgagagcgtaacgaatggtattcccttgatcgcgtggccgctgtacgcagagcagaggatgaacgcgacgttgctggcggaggagttgggccttgcggtgaggaccacggtgttgccgacgaagaaggttgtgcgtagggaagagatagcgcggatggtgagggaggttcttcagggtgatgaaaatgtgaagagcaatggcataagggagagagtgaaagaggtgcaacgaagtgcagtgaatgctttgtcggaaggtggttcgtcctatgttgctctctctcacgtggcaaaaacaattcaaggataa

SEQ ID NO: 1363 - DNA, 2035 bp, Glycine max var. Williams 82
gtcgaatcctgatacgaacttgtgtcggttacgtaaaatgtgggtgcttcatagtatataagacttactagctagccagttagacaatacaaagccacacacaaacaaaacccaagcacatagcttattgtttctcaaaattttgctccatggaactgcaaaaacccactcacgtggctcttctctcgagccctggtctgggtcatcttatcccaacgattgagcttgggaagcgcttcgttcttaaccacaacttcaaagtcactgttctcgcggttacttcgcaaacctcacgcgccgaaactcagattctgaactcagccctcacaccctccctttgcaacgtcatcaacatcccttcaccagacctcaccggcctcatccaccaaaacgaccgcatgctcacgcgcctctgcgtcatgatgcgccaagccctacccaccattaaatccattctttccgaaattacccctcgcccctcagcactcatagttgacatattcggcaccgaggctattccaatagggaggaaactcaacattccaaactacgtctacgtggcatcacaggcttggttcctgtcgttgctcgtgtattctcctattctcgatgagaaaatagaaggggaatacgttgaccaaaaggaagcgttgaaaatcccgggttgcaacccggttcgaccggaggacgtggtggaccagatgctagaccggaacgacagagagtataaagagtatcttggagtagggaaggggatcccgcaaagcgacggcattttggtgaacacgtgggaggagcttcaacgtaaagaccttgaagcgttgagggagggaggtttgttaagtgaggcactgaatatgaacattccagtatatgctgtgggacctttagtgagggaaccggagttagaaacaagttctgtgactaagtcgctgctgacgtggctcgatgaacaaccgagcgaatcggtggtttacgtgtcgtttgggagcggaggaacgatgtcgtatgagcagatgacggaattggcttgggggctggagttgagtgagtggagatttgtttgggtggtgcgcgcgcccatggaaggaactgcggacgctgcgtttttcactactgggagtgatggggttgatgaggtggccaagtatttgccagaagggtttgtatcgagaacccgcaaagtgggactgttggttccggagtgggcccaacaggtaacaatactgaagcatcgttctattgggggttttctttcgcattgtggatggggttcgacgcttgagagcgtaacgaatggtattcccttgatcgcgtggccgctgtacgcagagcagaggatgaacgcgacgttgctggcggaggagttgggccttgcggtgaggaccacggtgttgccgacgaagaaggttgtgcgtagggaagagatagcgcggatggtgagggaggttcttcagggtgatgaaaatgtgaagagcaatggcataagggagagagtgaaagaggtgcaacgaagtgcagtgaatgctttgtcggaaggtggttcgtcctatgttgctctctctcacgtggcaaaaacaattcaaggataaaaagtacaagtgttgatatgtatcattataagattttttttatctggttacagcttttgcttctctcaaggtgctagctgatgagcgatgagactcaacaggcttcatgttccaatgttgtgtttggtttaaagaataaaataaataaaaaattaatttaaaataaactatacgaaatgtgaatctgacgacaaaaatgtaaactttttctttattattattttcattttttctttcaaacacatcctaaccgggcaattattcccgttgggattatgatagagcatccgatttaacgatccaattagctatgtaaatgttgctttaataatagattggatgctatgcctaatcaatttgcgacaaaatatgagacgcggaagaattgatgcatgtttgatgagacattcagtgtggaaaatttggtgcttgctagttgttac

SEQ ID NO: 1364 - DNA, 855 bp, Glycine max var. Williams 82
atggagtttcaaaaacctctatggctattcttgcttctcctcactctcctctcaagctcccaagccaacaaattcaacgttggtggaagcaaagggtgggttccaaacccttccgagagttacaacaattgggctggaagaaaccgattccaaatcaatgacacaatagttttcaagtacaataagggttcggattcggtgttggaagtgaagaaggaagattacgacaagtgcaacaagaccaacccaatcaaaaagtttgaaaacggtgacactgaattcaagtttgatcgatcaggaccattctacttcattagtggaaaagatgggaactgtgaaaagggtcaaaaattaatcgttgttgttttgaccccaagaacaccaccaacaccaaaaacaccaccgtttccaaaaacttcaccttcaccttcaccttcacaatctccaaaggcaaacccaccaaccgtatcgccgccgttaccgtcaccgtcaccatcggttcattcaaaatccctatctccggcgagttctcctgtgccggccgtcggtactccggcaatatctccggcgatttctattccgacactggcaccggagacggggactccaccgccgtctcttgggccttcatcatcttcaccaccgtctccgggtccttcatcttcttcaccgccgtctccgggtccttcatcatcttcaccgccgccggcggggccaacttcaccgccgtcgttagcaccgtcgtctaattcaactgcgccgtcaccgaagaacagtggattttctgtggctccttcaagcgttttgatgtattgtgttacaattgttgctggtgctgcgttgttgcgttattga

SEQ ID NO: 1365 - DNA, 1062 bp, Glycine max var. Williams 82
atgaaaaatgccttttacgatgcacattctaagatgattattgaaaactatcttagaatgttatgtctaataaaatttacgacaggtttgtacttgtaccatgaggggtggaaaaagatagattataagaagcatcttaagaagcttagtggtgtgcccgtgcttttcatcctaggcaatggtgttatattatatagtatgatgacatgtaaacataaatatgcatatctagtttgcttttttcaaagtttgaggtatgctcacttgctggccaaggtgcgatcattggcagcagaatctgatcgggcatatcagaatggcccccttgagcgtacattttaccaagaagcttccctaagacctgaagaagaagatgtagatataaatttatctagtttccaattgcccagccagtacaccagcaggttggactggtttgctttcaatcttgaaggtgaacattctgccatggatggtgcgattctggaagagcacactgaatatgttgtatatgctatacacaagatttgggaccaatataaagtttcttatgacgctggaacaagagaaagtgttgcagtttctgggagtttgccaaaaagtgtgatattagttggtcattcaatgggaggttttgttgctaaggctgctattatccaccctcgtcttaggaaatcagctgttgaaactgttcttacactttcaaccccacatcaatatgtttatttccaattatcacctcctgtggcattgcaggcttcattgggtcattactttgcacgtgcaaattcagaatggataaaaggatataaggttcaaaccactaacacgggacattatgtgtctgatccagtactctctcatgttgtagttgtatctatttctagtgcatacaatgattatcaggtacggtcaaaattaacatcacctgataatattgtgcccccaacccatggcttcatgatcagtagtacagccatgaaaaatgtgtggttgtctatggaacatcaggctattttatggtgtaatcaattggttgtccaagtatcacacacttcttag

SEQ ID NO: 1366 - DNA, 1200 bp, Glycine max var. Williams 82
atggctcttcaggctgcttccttggtttctgcttctttttctattgctaaagagggaaagtctggtgtatctctcagggacaccacaatgtttggtgtttcattgtcggatactctcaaatctgacttcagctctccctcatcgacttgcaaaagggaattccaacaaaaatttggccctttgagggttcagtcagtggcaacaacaactccaggagtcaccaaggcttcaccagaaggcaagaaaactttgaggaaaggcagtgttattatcactggggcttcctctggattaggcctggccactgctaaggctttggctgagacaggaaagtggcatgtgataatggcctgccgggatttcctcaaagccgaaagggctgcgaaatctgccggcattgctaaggaaaactacactattatgcatttggaccttgcatctcttgatagtgtgaggcaatttgttgataactttaggcaatcaggccggccactggatgtgcttgtttgcaatgctgcggtttacttgccaactgccagggaacctacatatactgctgatggctttgaactcagtgttggaaccaaccatctcgggcatttcctcctttcgcgccttttgcttgacgacttgaacaaatctgactacccttcgaagcggttgatcattgtaggctcaatcacaggaaacaccaacacattggctggaaatgtgccacccaaggctaaccttggtgacatgaggggactagctggaggcttgaatgggctaaacacttcagccatgatagatggaggatcctttgacggcgctaaggcatacaaggacagcaaagtctgcaacatgcttacaatgcaagaattccacagaagataccatgatgaaactgggatcacatttgcttccctttacccaggttgcatcgccacaacaggcttgttcagagagcacattcccttgttcagacttctcttccctccattccaaaagtacataaccaagggctttgtctcagaagatgaatcaggaaagagacttgcacaggttgtgagtgatccaagcctaacaaaatcaggtgtttactggagctggaacgcggcctctgcttcgtttgaaaaccaattgtcccaagaagccagcgatgcagataaggctcgcaaggtttgggagattagtgagaaacttactggtttggcttaa

SEQ ID NO: 1367 - DNA, 1014 bp, Glycine max var. Williams 82
atgggagttccagagagagaccctcttgcacaattgagtttgcctcctgggtttaggttttaccccacagatgaggagcttttggttcagtacctttgccgcaaggttgctggccatcatttctctcttccaatcattgctgaagttgatttgtacaagtttgatccatgggttcttccaggtaaggcagtgtttggagagaaggagtggtacttttttagcccaagagacaggaagtacccgaatggttcacgaccaaacagagtcgcgggttctgggtattggaaagcaactggaacagacaagatcatcaccactgaaggtagaaaagttggcataaaaaaagcacttgttttctacattggcaaagcacccaaaggctccaaaaccaattggatcatgcacgagtatcgccttctcgattcttcccgcaaacacaacctcggaaccgcaaagcttgatgattgggttctatgtcgtatctataagaagaactcaagttcacaaaaggttgaggctaattttttggctatggaatgcagcaatgggtcatcaccttcttcatcgtcccacgtggatgacatgctgggatcgttgccggagataaatgaccggtgcttcaccctgccacgagtgaactcactcagaacaatgcaccagcaggatgagaaattcgggtctccgaacatgggatccgggtttttctcggattgggttaactcgaccgatctcgattcgatttccgaattcgagtcgggttgccaaacccaaagaatggtgaattatgattgcaatgacttttttgttccttctctgccgcccttgggccatgtggactacatggtggatgcacctttggaggaggaggttcaaagtggtgtgagaacccgacgggtcgacgggccggggcattttcaaccgaatccagatacccgattgttaccgggctcaggtgacccattcgggtttgggtttattatgggtcagcaagttgggttcggggttagggagtga

SEQ ID NO: 1368 - DNA, 2481 bp, Glycine max var. Williams 82
atggctctatttcttgctatgttagttttttcaaacccactagtgttcttctctcaaatttcctatgcaactgataccattactcagtcccagccacttcttgatggcagcaccttggtctccaaggaaggaacctttgagttgggtttctttactcccggtaattccccaaaccactatgtcggaatatggttcaaaaacatccccatgagaacagttgtttgggttgccaaccgcgacaaccctgcaaaagataaatccaacatgttgtctctaagcaaagatggaaacctcatactcctcggcaagaatcggtctcttatttggtcgacaaatgcaacaatagcagtttcgaatccggttgtgcaacttttagacaacggaaatttggtaataagagaggaaaaggacgacaacatggacaatgaagagaattttgtgtggcagagctttgactatccttgtgatacacaattacaaggaatgaagttggggtggaaccttaaaaccggcctcaatcggtatcttacagcttggaaaaattgggaagatccatcttcgggagattttacttcagggttgaagcttggaaccaatcctgaattggttatatcgaaaggctcgaatgaatactataggagtggcccttggaatggaattttttctagtggagtgtttggatttagtcctaacccacttttcgaatataaatatgtccaaaatgaagatgaagtgtacgtgaggtacaccctcaagaatagttctgtgatttcgataattgttttgaaccaaactctttttcttcgccaacgcattacatggattcctcacactagaacttggagtgtgtaccaatctctaccacaagacagttgtgatgtttataatgtttgtggagcgtatgggaattgcatgattaatgcctcccctgtgtgccaatgcttggagggatttaagccaaaatcaccccaagattggaatcaaatggattggacaaaagggtgtgtgcgtagtgaaccatggagttgtggagtaaaaaacaaagatggttttcgtctaattgctgggatgaaaatgccagatactacacattcttggatcaatagaagtatgacacttgaagattgcaaggccaaatgcttgaaaaattgttcctgcacggcttttgcaaacatggacaccggtggtggaggtagtggttgctccatttggtttggtgatcttgttgatttgagaatttctgaaagtgggcaagatctatatgttcgaatggccatttcaggcacgggtaaagacaatgtgaatgcagatgctaaacataagcatctaaaaaaggtagtcttggtggtcgcaatcacagtttctttagtccttctgatgttattggcattttcctacatttacatgaccaaaacaaagtataaagaaaatggaacatggacagaggagaaagatgatggtgggcaagaaaatctggagcttcctttctttgatcttgctacaataattaatgccaccaataacttctcaattgataacaagcttggtgaaggtggctttgggccggtatataagggtacaatgttagacggacacgagattgcagtcaaaaggctttctaagagttctgggcaaggattgaaagaatttaagaatgaagttatattgtgtgccaaacttcagcatcgaaatcttgttaaggttcttggttgctgcgtcgaaggagaggaaaaaatgttactctatgaatacatgcccaacagaagtctcgattcatttatttttgatccagctcaaagtaaacttttagattggcctacgcgctttaacatcttgtgtgcaattgctcggggacttctgtatcttcatcaagattctagattaagaatcatacacagagatttgaaggcaagtaatattttactagacaataatatgaacccaaaaatttcagattttggcttggctaaaatgtgtggaggtgatcaagttgaagggaatacaaacagaattgtcggaacatacggttatatggcacctgaatatgctattgatggattattctctataaaatcagatgtatttagctttggcgtattgttgttagaaattataagtggaaagaaaaacagaacagtaacatatgaagagcacagtgacaatcttattggacatgcatggagattgtggaaagagggcattccagaacaattgattgatgctagtcttgtggactcatgtaatatatctgaacttgtacgttgcattcaagttggtcttttatgtctgcaacaccatcctgaagataggccaaacatgacaactgtggttgtaatgttgagcagtgaaaatagtttatctcaacctaaggtacctggtttcttaattaaaaatatttcaattgaaggcgagcaaccttgtggtagacaagagtcttgttcaaccaatgaagtaacggtctcactattaaatgctagatag

SEQ ID NO: 1369 - DNA, 1830 bp, Glycine max var. Williams 82
atgcctgaggcaccgagagactacaaccttttggagcaaaacaagaaaaccctcgagttcattgaggatgtcactgccaacgcagaccaagttcagaagagggtcctctccgaaatcctctccaacaatgcaaacgctgagtacctcaagagacacggcctccatggccaaaccgaccgcgaaaccttcaagaaactcttgcctgtcataacctacgaggacatccaacccgacatcaaccgcatcgccaatggcgatacttctccaatcctttgctccaaacccatttcagaattcctcactagttctgggacatcaggaggtgagaggaagctgatgccaacaattgaagaagagctaggtagaaggagtttgctgtatagccttctgatgccagtgatgagccagtttgttcctggtttagaaaagggcaaaggaatgtacctaatgttcataaaatccgaggccaaaacccccggtggaattgtggctcgtccagttctcaccagctactacaaaagctcatacttcaaagacagaccctacgacccttacaccaactacaccagccccaacgagaccgtcctctgcctggactcctaccagagcatgtactcccaactcctctgcggcctttgccagcacaaggaggtcctccgtgtcggcgccgtcttcgcctccggcttcataagggccatccgcttcctcgagaagcattggcccttactttgccatgatatccgaacgggtaccattgacaatacggtcacggacctgtcggtccgtgacgctgtgatgaagatcctcaagcctgatgccaggcttgcggatctcatccagtgtgagtgtgggaagagctcctggcagggaatcatcaccaggctgtggcccaacactaagtatgtggatgtgattgtgactgggacaatgtcacagtacatccccacgttggactactacagcaatggactcccacttgtgtgcaccatgtatgcgtctagtgagtgctactttggtgtcaatcttaaccctctttgcaaacctagtgaggtctcttacaccctcattcccaccatgtgctacttcgagttcttgcctgttaatagaagcaatggggtgtcccatgacaatctccacacccctagatccctcaatgagaaggaacagaaggagctcgttgagcttgttgatgtcaaacttggccaagaatatgaacttgtggtcacaacttatgctggtttgtatcgttacagagttggtgatgtgctgagggtggctggattcaagaacaaggcaccccaattcaactttgtgtgcagaaagaacgtggtgttgagcatagactcagacaagaccgatgaggttgagctccagaacgcaatgaagaatgccgtgacacacttggtgccctttgatgcatcagtgtccgagtacaccagctatgcagacaccacaacaatccctggccactatgtcttgtactgggaactctccctgaaaggctcaaccccaattccaccatgtgtttttgaggattgttgcttaaccatagaggaatcactgaacagtgtgtatcgccaaggtcgagtttcggacaaatcgatcgggccacttgagatcaagattgtggaacaggggacttttgataagctcatggactatgccataagcttaggggcttcaataaatcagtacaagactccaaggtgtgtgaagtttgcacctgtgctggagctcttgaactcaagggtggtggagaagtattttagtccaaaatgtccaaaatgggttccgggacacaagcagtggatcaaccagaattcatcatga

SEQ ID NO: 1370 - DNA, 510 bp, Glycine max var. Williams 82
atggcagcaagagcaaaaactccccttaacactctctcctctttcacattcacactctttctctcattctctctcctccaactttctctctcctcccccaccaccatccacgaccttctccgctccaaaggcttaccaccggggctcctcccggaggaggtgaaatcctacaccttctctgaaactgggcacttggaagtgttcctggacgcaccatgcctcacaaaatacgagaacagagtcctcttcgaacaagtcgtcactgctaacctcacctacggaagcctcataggagtggagggtctccagcaagaagaactcttcgtgtggctacctgtcaaggacattatcgtaaatgacccctcttccgggttgatactctttgacattggcctcgcccacaaacagctctcgctgtccctctttgaagatccacctcactgcaaaaatcaaggtgggttgaggaatcatgtgaggaaggaaaaaggtttcttcgaggccctgaggtag

SEQ ID NO: 1371 - DNA, 1707 bp, Glycine max var. Williams 82
atggacttgaatcagttttcaagtttcaacgtaattagttcagcaggattcccttgcgcatcatcttgtactcctatttcaccaatatccaaccggttgcttggatccttgaaacttgatataggaaactcacctaattcggccctttctactcattttgattctgatactgtttcttctgcattaagtgacagccaggagcagcacaactgcggggaaattcactctggtgtcaactcctgtaactctttgcaggaaagcaatcattatttgcataggccggtctcatctgtagaccatctcgaagacggattgcatctatctactaggagcttttttccacaggatgcaagttatgaccatgaaaccagacatgcattgctggaattagaaacttctttgatggcacctgatgatgaagatcaagtcaccacatcaagcacttctttgggtgatagcagtaggccaacagcatctgaccaaagaaataggtcttggagccatgagggccaatcaagtgatgttgcatatgtagagaagcgtcacaaatcaatggaggaagcgttgctacagggattcccatcaagcaatttgaaacaattgctgattgtatgtgccaaagccttgtctgaaaacaacatgaaaggttttgatcagttaatagagaaggctagaagtgctgtgtctataactggggagccaatccagcgcctgggtgcttatttggtagaagggcttgttgcaaggaaggaggcatcaggaaataacatctaccatgccctaagatgcagagagcctgagggaaaagacttactctcttacatgcagctactgtatgaaatctgtccctacttaaaatttggttacatggctgccaacggcgctattgctgaagcatgtaggaatgaggacctaattcatatcatagactttcagattggtcagggaactcaatggatgacacttcttcaagcacttgcagcaagacctggtggagctccccatgtgcggatcacagggattgacgatcaactttctaaatatgttcggggtgatggattggaagccgttgggaaaaggttggctgcaatctctcagacatttaacatcccagttgagttccatggcgtgcctgttttagctccagatgtgacaaaagacatgcttgatgttaggcctggtgaggctttggctgtgaacttccctttgcaactccatcatacagctgatgaaagtgttgatatgagtaatccaagggatggacttttgagattggtgaaatcactttctcccaaggtaactactttggtagagcaagaatcgaacacaaataccactcccttcttcaacaggtttatagaaaccttggattactacttggcaattttcgagtccattgatgtgtctcttccgagaaagagcaaggagcgggttaatgtggagcaacattgtttggctcgggatattgtcaacattatagcttgcgaagggaaagaaagggtagagagacatgagctgttaggaaagtggaagtcgagattaacaatggctggctttcgtcaatatcctttgagttcttatgtgaattctgtcataagaagcctgctgaggtgctattcagaacattataatcttgtggagaaggatggggccatgctactgggatggaaggacagaaatttgatttcagcttcagcttggcattga

SEQ ID NO: 1372 - DNA, 1791 bp, Glycine max var. Williams 82
atggcatgtatccctcctcagtcattcgtgtctgcagcgtataatgttccttccaagtctaccactctcccttcttccctgcatccattttcacaatcccaatccactaaatatagaaaatcaaaacaccatcacactcctagagtgacatgtaatagtggaaaccaaaacaaaggagaaaaaccagatattcatatagaacaaaggaggaacattctacttggcctaggagggctttgtggtgctgctactcttaacaacaacccttttgcatttgctgcgccaatatctcctccagacctaaccacatgtggtccaccagacctacctgaaggtgcagaacccacaaattgttgccccccattttcatccaccatcatagatttcaagtttcctccttctaacaaacctttgcgtgtaagaccagctgcacatttagttgacaaaaattatctagccaaatacaaaaaagccattgacctcatgaaaaaactcccagctaacgatccacgcaatttcatgcaacaagcaaacgtgcactgcgcttattgcactggttcatatgaccaagttgggttccctggccttgagctccaagtgcacagctcttggctcttctttccctaccaccgatggttcctctatttctatgagagaattttggggagcttgatcaatgatccaacatttgcccttccattttggaactgggatgctcctaagggcatgcaacttccttccatttatgcagaccccaaatcacctctttatgaccctcttcgcaatgcgaatcaccaacctccaacacttgtggactttgacttcaatcttgacaatcctatttccaatggaagaatctccaccaacctcaccataatgtataggcaacttgtgtctaatggaaaaactcctactttgttccttggaaatccttatcgtgccggggatgcgcctgaccctggcggtggctcagtagagggcgttccacatggtccggttcatctatggacaggtgatataaatcaaccaaacattgagaacatgggggatttctattctgctgcaagagatcctattttctattctcaccattccaatgttgataggatgtggtctatatggaaaacacttggtgggaagagaagggatttcaccgactcagattggttggaatctgggctcctcttctacgatgagaataagaaccttgtgcgtgtgaaggtcaaggattgtcttgacacaagaaagctaggatatgtttaccaagatgttgaaattccatggttaaaatctaagccttcaccgcgtaggtcgagggttcaaaaggtagcactaggaccacattttaatactggtgtagcacgtgctgctgagacttcgaggaatgttcagttcccattggtgttggattcagttgtgagcatagtggtgaagaggccaaaaaagtcgaggagcaagaaggagaaggaagaggaagaggaggttcttgtgattgaaggggttgagtatgacagcaacataccagtgaaatttgatgtgcttattaatgatgaagatgataagcagattcagccagaagattcggagtatgcaggaagctttgtgactgtgcctcattcgcataagcacaaaaataagaagattatcacttgtttgaggctgggactgacagatttgttggaagaattggaagcagaagatgatgatagtgttgtggtgacgttggttccgaggtatgggaaagggcgtgtccaaattggaggcatcaagatagatcttgttgcagattaa

SEQ ID NO: 1373 - DNA, 1725 bp, Glycine max var. Williams 82
atgaagaattttgcctacttgagccaaaaacaacatcgtttttgtagttttttcccacacagccttggattctttgtccattttctagccttccatgtccaccccttcttcgttcaactttgttatttcgtgatcctttctctgcttggttacctaggtctcaaggtctcaaagcctagaacccccgttagaccaaatgacttggacctcttttacacttctgtttctgcttccacagtttcaagcatggtagctgttgaaatggaggttttctccaattctcaactaattctcctcacccttctcatgtttgttggtggtgaagttttcacttccgtgctcgaccttatatttgctaggtataaattcacccaaagtgtccaaaataaagttcccacccatcattcatatcagactcaatcagaattttctccggtggaacatatatgtggtttagacaaaaataacgataacaccaatcctttttcacccacaaagaagcccccaattaatgccaatcaaattgaacttggtttagtttctattgatcactcagaatcagaaaaccacaaaccaagtgatagtaaacttcctgatacatatcttcaattcctgcagataaaaaaaactaaaagtaatattaacgttccaaagggcacggtagagtcctttaacgacagtgatagacttaagtataactgtcttagtttcctgacttttgtagttttaggttaccttgttgtggttcaatttgttggctttagttttgtttctttgtacataactttggtaccaagtgcaagacaagtactgaaaaacaaaggcataaagattgcaacgttttccttgtttaccatagtttccacgtttgctagttgtggtttcatccccaccaacgagaacatgatggttttcaagaagaattcagggcttcttctcctggtcctcccacacatccttctaggtaacaccctttacccaccgtgcttgaggcttgtaataatggctctgaaaagggtcaccagaagagaggaatactcgcacttgctgaagaatttcaaagacgtggggtatgatcacatgctttctgctcttcattgttgcctcctggttgcaactgtgttgggtttcaatcttgttcagtttgtgatgttttgctctgtggagtggaacaccaaaatcatggagggtttgaatgtgtatgagaaagtggtggcgtcgttgtttcaagtcacaaacgcgagacactctggtgaatctgtctttgatctctcctccatatcttcagccatattggtactcttcgttgtcatgatgtacctcccaccatacacaacatttttaccagtaagagagcacgaaaatgatgtgaagagaaacgaaaaaagcgtagtggagtgtcttgtattctctcaactctcttacttggtcattttcattattttgatttgcatcactgagagcaacagcttaaaagaggatcccctcaactttaatgtgttgaacatcaccctagaagtcatcagtgcttatgggaacgtagggttgtcaatgggatacagctgtgctaggcaattgaaacctgatgcgacgtgcaaagattcatgggttggattctccggaaggtggagtagcaaaggcaagttcatccttatcttggtcatgttctttgggagactcaagaaatttaacatgaaaggtggcaaagcctggaacctctcctag

SEQ ID NO: 1374 - DNA, 1284 bp, Glycine max var. Williams 82
atggcgattcgcaactcgctcaccggccaattcctccgccgcagctccgtcgccggagcaaggctcatgtcttcttcgtcctcatggttccggagcatcgagcccgctcccaaggatcctatcctcggagtcactgaagctttcctcgccgatcagagtccaaacaaagtcaacgtcggagtgggtgcgtatcgcgatgaccacggaaaacctgtggttttggaatgtgttagagaagcagagaggagggttgccggaagtcaattcatggagtatcttcccatgggtggaagcataaaaatgatagaagaatcgctgaagctggcatttggagacaactctgagttcatcaaggataaaagaatagctgcagtgcaggctttatctgggactggtgcatgtcgactttttgctgcatttcaacagagatttcatcctaatacccaaatctatataccagtgcctacctgggccaaccaccataacatttggagagatgctggagtgcctatgaagacattccgttactatcaccctgagtctagaggattggatttttcaggactgatggatgacataaagaatgctccagatggttccttctttctgcttcatgcttgtgctcataatcctactggagtagatccttcagaagaacaatggagagagatctcttcccagataaaggctaagggtcatttccctttctttgacatggcatatcaaggttttgctagtggtgatccagagagagatgcaaaagccataaagatttttcttgaggatggtcatttaataggacttgctcagtcatatgcaaaaaatatgggactgtatggccagcgagcaggaagcctgagtgtgctttgtgaagatgagaaacaagctgtggctgtaaaaagtcagttgcagctgattgctagacccatgtacagtaacccacctctccatggagcacttatagtttctactgtccttggtgatccagatttgaagaagttatggcttaaagaagtcaaggttatggcagaccgcatcatcggaatgaggactacactacgagaaaacttagaaaagaaggggtctactttgccatggcagcatataactaatcagattggtatgttctgctacagtggattgacacctgaacaggttgatcgtatgacaaacgagtttcatatttacatgacccgtaacggtcgtatcagtatggctggtcttaatacgggcaacgttggatatgttgctgacgctatccatgaggttacaaaatcattctag

SEQ ID NO: 1375 - DNA, 1068 bp, Glycine max var. Williams 82
atggcaacccaaagtgaagaaaatgctacaaaattccttcaagcttatacccagattgatgatcatagtttgagattcatacactccatgtcccttaaatgtgcaattgacttaagcataccagacatcatacacaagtatggccaacccatgccactctcacaactcattgcttcactaccaatccacccatccaagacttgctacatccatcgcttgatgcgactctttactcattccggtttcttctctcggcacgatttggtcgaaaacgaacaagaagtgatcacgtatgagctaactgatgcatctagactactcctcaaggaccacccttttagtttgaggcctttgttgctagtcacacttgatccaagtgtgattaagtcatggtgtcaattctctacttggctcacaagtgaagaccgtacaccgtttcaaacggagaatggggtgacatattttgattatgctaagcgtgaccccaaattcggtcacttttacaatgatgcaatggctaaggacactcgattcgcttctagtgtggtgattgaaaactacaaggaagtgttcgagggattgaagtcaattgttgatgttggaggaggaatagggaccatggctaaggccattgctaaggcattcccacaagtgaagtgcactgtgtttgatctcccacatgttgttgatggcttgcaaggaacagaaaacatagaatatgttggaggagacatgtttgaagtaattcctgcagctgattgcattatgctgaagtgggtattgcattgttggaatgacgaggaatgcatgaaaatattgaagaaatgcaaggaggcaatacctagcgacggaaaggttatcatcatggaattagtgatggagcataacaaggaagacaataaattaattgagatgcagctgtgctgtgatatgcttatgatgtcgctttttgcaggaaaagatagaactgagaaagaatgggcacatctgattgcctctgctggtttcagtaactacaagataactcatattttcgatttatatcatatcattgtggtttatccctag

SEQ ID NO: 1376 - DNA, 858 bp, Glycine max var. Williams 82
atgactcagtgcagtgactctgaaaacaatcatcataacatcatagtggagggacgaaaagatagcttaatcagaacttgtcctacttgtggtcaccatatcaaatgccaagaacagggtggtggaattcatgacttgcctggactgcctgctggagtgaagtttgatcccacggatcaagagattcttgaacatttagaagcgaaggtgcgatctgatattcataagcttcatcccctaattgatgagttcattccaactcttgaaggcgaaaatggaatctgctatactcatccagagaagttgccaggagttagcaaagatggcctgatccggcatttctttcacaggccttccaaggcatacacaacaggaacaaggaaaaggagaaaggtgcactcagatgaagatggaagtgagacacgttggcacaaaactggtaaaaccaggccagtctacaacattgccaagttgaaaggttacaagaaaatccttgtgctttacacaaactatggaaagcaaagaaagccagagaaaacaaattgggtcatgcaccaataccaccttggcagtgatgaagaggagaaagaaggggagctagtggtctccaaggttttctaccaaacacaacctagacaatgtggttccctcatgaaagattcatcagttcctcctgggaaacatatgaagggtcaaagtgtgcatgttgaggtaatgaataataacaaaaacagcaacaataatgggtatgttgagtactaccattcttcaaatttcatatcttttgatcaaggagggcaaaatgctcaagtaatttctcattttcctgtccatgaaggtgctcctttcattccttga

SEQ ID NO: 1377 - DNA, 945 bp, Glycine max var. Williams 82
atgatggagaagatccagcacagtgaggtggaagtgaagggactgaagctgcacgtggcagagattggaagtggctccaaggcagttgtattcttgcatggattcccagagatctggtacacatggaggcaccaaatgatttctgtggcaaacgctggttatagggctattgcctttgatttcagaggctatggactatctgagcaaccagtggagccagagaaggaaaccatgtttgaccttgttcctgaagtcgtgggtcttttagatgctataaacatcagcaaggctttccttgttggcaaggacttcggtgccatcccaggatatcttacagctgccgtgcacccagaaagagtagctgctgtcataactttaggcattccttttattcttcctggtccctctgctgtccaaaaccaccacctacccaaaggcttctacattactaggtggcaggaacctgggagggcagaagcagattttggccgctttcccgtgaaatcagtgataagaaacatctacactctcttctctaaaagtgagattccaatagcagcagatgatcaagaaatcatggacttgtttgacccatctactcccctaccaccttggttctctgaggaagacctttcaacctatgcatcgttatatgaaaaatctggattcagatatgcattgcaggttccatacaggagtgctaaggtggaaactggcttaagtgacgtgaaagttactgttccagcacttcttatcgtgggtgagcaagattatttcttaaagtttcccggcatggaagactatatccgaaaaggggtagtaaaaaattttgtgcctaacttggaaaccgtatatattccagaaggaagccattttatgcatgaacaagttccagagaaggtgaaccagctcatcattgagttcctcgacaaacaaagtatctga

SEQ ID NO: 1378 - DNA, 342 bp, Glycine max var. Williams 82
atgagcacacttgttcgcaacaccaccctcaccttcagccgcagaaacagatacgagcttcttggtttgcagggcaaagacaagatggtcaagtccatcagctacagacgcagaagggcaaagcaaaggcaaatctttctcacaacctacaagttatcttctttgaatagtaacacttttggggagccgacacaaaagcctaagctgaagctgaagaaggttgctgttaaggttaagaagattgtggcctcggttttgatgttcatgcgagttggttcttttaggtcatgcagttctaggtctcagatttctgccacctcaccaaataggaagaactcttga

SEQ ID NO: 1379 - DNA, 957 bp, Glycine max var. Williams 82
atgcaatcattcccctccactctcgcatgctttactttttcaacgtcactagtactagtactactcttatttctactacctttttctcgggccggtttactctccgaaccggtaagcgaccccaaccagccactcgaaccgggctccaacacggtccctgccttccccgtccagacccaggccctcacctgccgcctcgacctctccgacgagctattcggcggagtcaaggacgcctgcggcaaagacctcgaccggagccgctgctgccccgtcctcgccgcctggctcttcgccgcccacgcccgcaccgccctcgacgtctccgccgccccgcctccatcctccggcgaccttccgatgatgcccgacgactcacaaaaatgcgtcaactcgctccaggactcgcttctctcccgcaacatacgaatccctcagtccaacgccacgtgcgacgccattctctgcttctgcggcatcaggctccaccaaatcacgtcgctgacttgcaacgctgcgtttaacgtctcgctttctcacagaaacgccactccaaccgccgcggttcgcaacctggagaataattgtcgtaactcctcttacgctggttgcactaaatgcctcggtgccctacaaaaggtgaaggggtataaaaatgagacgaagggaagtgatagagtgaagaaaatgttcaaccgggactgtcaattgatggggttaacgtggcttcttgcaaagaacaaaacggcgtacatacccaccgtttcggcggtgctgcgtgcgatgatgtacagtgcgcaccctcacgagtccaagtgtagtcccgaccaggagaacatgccgctggccgttgattcgcttcagttcgagagcggccacgcgccatcgcggccgtccaagttttgcgtgacgattttgcccctcttggttctcttattttccgcttttgttgtgtag

SEQ ID NO: 1380 - DNA, 1875 bp, Glycine max var. Williams 82
atgcctgaggctcctagccagtacctttgcaacaagccaaatggaaaacttgatgatggtggtgctactaatactagcatcatcatcgagcacaacaataagaaagcactcaaatacattgaggatgttactagcaacgctgatgaaattcagaaaagggtccttgctgagatcctttcttgtagtgcacacgttgagtaccttcaacgccatggcttggaggggcgcacggatagagaaacattcaagaagatcatgcctgtggtgacatacgaggatttaaagccagatattgatcgtattgctaatggtgatgcctccccaattttatgttccaaacctatttctgagttcctcactagctctggaacatctggaggggagagaaaactgatgccaaccatagaagacgagctagagcgaagatcattgctctacagcctcttgatgccagtgatggaccaattcgtaccaggtttagacaaaggcaaaggaatgtactttttgttcataaaatcagaatccaaaacccctggtggactcttagctcgtccagttttaacaagttactacaaaagctcacacttcaagaacaaaacacacggtttaaattttgacccttacacaaactacactagccccattgagaccattctctgtcaagactcttaccaaagcatgtactctcaaatgctttgtggactttctcaaaacgagcatgttctccgtgttggttctgtttttgcctcaggtttcatccgtgccctcaagttcttagaaaaacactgggaaagtttgtgtcatgacataagaaatggcaccattgaccatgaaatcactgattcaaccgtgagagaggccatcatgaaaatactcaaaccaaacccaaaacttgcggattttatagagggtgagtgcaagaagggtttgtggaaagggatcattactaggttgtggcctaataccaagtatgttgatgttattgtgactggaaccatggctcagtatattcctatgttggattactatagcaatggtcttcctctcgtttgcaccatgtatgcttcttctgagtgttattttggactcaacttgaaccctttgtgtgatcctagtgaggtgtcttacacccttgttcccaccatggcttactttgagttcttgccacttaataagatgaagggacatgccaattcaatttctcacaccgagcaggaacttttggttgatcttgtggatgtggagctggatcaagaatatgagcttgtggtcaccacttatgcaggactctacaggtaccgggttggcgacatcctccgtgtggcaggattcaagaacaacgctcctcaattcaacttcgtgtgccgaaagaacgttgttctgagcattgattccgacaagaccgacgaggttgagctacaaaacgcagtgaagaatggagccaagcaccttgcaacattgggtgcatcactcacagaatacacaagctgcgctgacacgtccactataccaggccactacgtactatactgggaaattaacatgaacaataatgatcaaaccccaattccaagttctgtttttgaggagtgttgctttgcagttgaagggtctctcaacagcgtgtatagacaaggaagagtttccgagtccattgggccattggaaatcaagattgtggagaacggaacttttgataagcttatggactttgcccttagccagggtgcgtctataaatcagtataagacacctcgttgtgtgaagtatgctcccattgttgagcttcttgactccaagactgtttccaattacttcagtccaaaatgtccacagtgggttcctggtcacaagaagtggtgcatgtacccttga

SEQ ID NO: 1381 - DNA, 1446 bp, Glycine max var. Williams 82
atgcagctttttcacaaacccagcaagggtcagtctctgattaattccatattggtctcttcatcgttctgtgccctttatctcattgtgtcagtgcttcttttggggccttcaaagctagttcatgtgaataggtcatcatcacaagatgtgtccacaacaccaaccacccttgatcaccttgtgtttggaattgcttcaagcaagatttcttggttcaagaggaaggactatgtgaagctgtggtggaacaacaacaacaacaacaacaacaccaacaaaacaatgaaagggtgtgtgtttttggatagtctctcggatgaagacaatggtaggaatgagaatgacacttctcttcctcctctctgtgtctctcaggacacttcaaggtttcgtttcactcacaagggtggtctgcgatcggcgattcgcgtggcgcgtgttgttggggagacagtggcattgtacaatgattcggaggtgaggtggtatgtttttggagatgatgacacggttttcttcccggagaatgtggtgaagatgctttccaagtatgatcatgagctttggtactacattggtgcgcactctgaggtttatgagcagaatagggtgtttggttttggaatggcttttggaggtgcaggttttgctatcagctcctctctggctaaggtcttggccaaggtttttgattcttgtattgaaaggtaccctcatctctatggaagtgatggcagggtgtactcttgcttggcagaacttggggtaggattaacacatgaacccggttttcaccaggtagatttaaagggaaacacctttggcatattggcggcacatcctttaactcctctgttgtccctgcatcatcctgattacactgatccaatctttccaaacatgacaactaaacaagctctgaagcatttgtttgaagctgcaaatgtggattcccagaggatgctgcaacaagcaatatgctatgacagatggttttcatggacagtttcagtgtcatggggctatgctgttcaggttttcccaaaccatatgcttttgccggatgttctgaaggtgcaagagacattcaagcagtggaggaagggaaacatgttggcaaaatcatacactttcaacacaagagaacttcaccctgacccttgtaaaagatccactgttttctttctagacaatgtgtcttctggcaaggatggcatcataagcagttacaagaaatcctttcagaattgctcgatcgatgatgacgtatcgccgaagaaactggaagtgatcaaagtggtcacaaataagctagaccttgacatcaaacagttgcgtgctccaagaaggcactgttgtgatgtgttgccctctactgcacgggaccaaatggaaattgcaatcagagaatgcaaagatgaagaattggtttacatgcactga

SEQ ID NO: 1382 - DNA, 705 bp, Glycine max var. Williams 82
atgttaaggtccttgtcagatggaaaccatagcttgcctgggccgaccgctaggatcaatgattgcaagaatattgtccttcgttggctggctagtaaacttgacccatccactgcaaatagtgtttttagaggactctcaaactgcaacctaaaagaagttaactcagtatgcccattggtttttccaaatgtcacaagtgttgtgaaagaatgcgggaatctcataaataaccaaacagcttgctgcaaagccatcaaaagttatgtgtcctatttgcaagagcagagctttttaaccaatctgcaagccttgaaatgtgctacatcacttggaaagaaattgcaggaagcaaatgtctccaaaaatgtttattatctttgtcgtataagcctgaaggacttttctcttcaagttgggttgcaagaatctggctgccttttgacgagtttgccatcaaatgcagtatttgatggaacttctgggatcggattcatttgtgaccttaatgacaacattgtagctccatggcccacaacatcatattcacttccatcctcatgcaatagaactacaaaacttccatctcttcctacagcaacgtcttcacaaaatggtaagaaccatactactgtacttctacaaactggtttttcaggtctgatcatctcttcatttcaaagcaatggcagttgtaaaatatag

SEQ ID NO: 1383 - DNA, 720 bp, Glycine max var. Williams 82
atggggttgatcaaagcagcaattggagatggagttttaacatcaatgtgggttttcataatctcaacattgaggattgtcacaactgaggtggcacttttccttggcctccaacctctttcacttgcaggcctcataatcagcaccatcctaaacagtttctatgtcctcaccataagcttcattggaagaatcttaggtggtgcaaacttcaacccttcaacaagtctttcattctacactgcagggttgaggcctgactcatccctttcatcaatggcagtaaggttccctgtacaggcatatggtggtgctgttggcgtcaaaacccttcttctagtgatgccatccaagtataatgacatgctgaaaggacctttcttgaaggttgacttgcattctggtgctgttgctgaaggtgttttgactttcactcacaacatggctatcttctttgtcatgtttaagggtcctaggaacccttttgtgaaggtgtatttgctctctgtgacaactgctgttttggctattcttggtggtggattcactgggccttccatgaaccctgccaatgcctttggatgggcctttgtcaacaacaagcacaacacttgggagcagttttatgtctattggatttgtcccttcattggggcttcctcagctgctttgattttcaggtctatgtttatgccaccaatcaagcagaagaaagcttga

SEQ ID NO: 1384 - DNA, 1201 bp, Glycine max var. Williams 82
gtccccacaaatgacacacaccagctaaattggagtgtttcatatgtctttttaacccatcactctaaacaaaggatatggagcttttcacttgcatccacagaatcttcatctctttctctttcttccttttcttggcccatatcactagtcagagtaatgtgttagattccacctccaactccaatatctacattgacaaatagagaaaaaaaaaaagaatacaaactctaaacaaaaaaggaggaaatggggttgatcaaagcagcaattggagatggagttttaacatcaatgtgggttttcataatctcaacattgaggattgtcacaactgaggtggcacttttccttggcctccaacctctttcacttgcaggcctcataatcagcaccatcctaaacagtttctatgtcctcaccataagcttcattggaagaatcttaggtggtgcaaacttcaacccttcaacaagtctttcattctacactgcagggttgaggcctgactcatccctttcatcaatggcagtaaggttccctgtacaggcatatggtggtgctgttggcgtcaaaacccttcttctagtgatgccatccaagtataatgacatgctgaaaggacctttcttgaaggttgacttgcattctggtgctgttgctgaaggtgttttgactttcactcacaacatggctatcttctttgtcatgtttaagggtcctaggaacccttttgtgaaggtgtatttgctctctgtgacaactgctgttttggctattcttggtggtggattcactgggccttccatgaaccctgccaatgcctttggatgggcctttgtcaacaacaagcacaacacttgggagcagttttatgtctattggatttgtcccttcattggggcttcctcagctgctttgattttcaggtctatgtttatgccaccaatcaagcagaagaaagcttgaattagttaagcttttacattttgatttactagttgagtaataaataaaccattgcccttagtttcttcttcttccaatgtcactagttttaagttggaattttctaaatcttttcttttttatcaacaaagttaattattaattattagtttttattgatcaatcttatatcttgttattgtaaatattctgaaagactattgtggctagggaaatttcagtattcttacta

SEQ ID NO: 1385 - DNA, 1614 bp, Glycine max var. Williams 82
atgggttgctccgtaagagtttgttgtgtcttatttttggtgttgttggtggcatgtgttagaggggaggacccttatagattctacacttggaatgtcacatatggagacatttatccacttggtgttaaacaacagggtattttgataaactggcaatttccagggccacaaattgaggctgtgaccaatgacaacttgattatcaatgtatacaacagcttggacgaacctttcctcttatcttggaatggagtgctgcagaggagaaactcgtggcaggatggagtgtatggtaccaattgtccaattctaccagggcataacttcacttatgttcttcaagtgaaggatcagataggtagctacttctactacccttcccttgcttttcacaaggcagcaggaggttatggtggattcaaaattgctagtcgccccgggattccagtgccttttcctactccagcaggagatttcaccatattggcaggagactggtacaagagaaatcacacagatttgagggcaattttggatggtggaagtgaccttcccttccctgatgggattatcatcaatggtcgtggttccaatgcttacacattcacagttgatcaaggcaagacatacagattcaggatatcaaatgtagggctcaccacttccatcaactttagaatccaagggcataaaatgacaattgttgaggtggaagggacccacactctccaaaacgtttatgactcacttgatgttcatctggggcagacttactctgtgttggttactgctgatcaaccaccccaagactacctcattgtcgtcacgacacgattcacctcccaagtgttgaatgctacctccatttttcgttacagtaactctggtggaggtgttactggccttttcccttgggggccaactattcaagttgattggtctttaaaccaagctcgctctcttaggaggaatctgacagcaagtgggccaagacctaatccacaaggatcataccattatggtttgataaacacaactcgtacaattagacttcaaaattctggtccagttatcaatggcaaacagagatatgctgtcaatagtgtgtccttcatacctgctgatacaccacttaaactggctgattactacaagatccaaggggtgttctcccttggaagtatccctgactaccccactggtagtggtggctaccttcaaacttctgtcatggaagccgatttccgaggctttatagaggttgtgtttgagaacactgaagacactgtggagtcatggcacgttgatggccacagcttctttgtagtaggaatggatggagggcaatggtcatcagcaagcaggctaaattacaatttaagagatacagtttctcgttccacagttcaggtgtatcccaagtcatggactgcaatttacatgcctttggataatgtgggaatgtggaatgtgaggtctgagaattgggttcatcagtatttgggccagcaattttatcttagagtgtattcccctgcaaattcatggagagatgagtacccaattccaagcaatgctattcggtgtggcaaggctgtgggacactactaa

SEQ ID NO: 1386 - DNA, 4395 bp, Glycine max var. Williams 82
atggctgtgatgctgtgtggaggagcttcatcttctgcttttggccgcggatggacttatgatgtgttcttgagtttcagaggtgaggatacaaggagaaccttcacaggctctctatatcatggtttgcaccaaaggggtatcaatgttttcatagatgatgagaagcttaggagaggggaagagatatcccctgctcttattggagccattgaagagtctaggattgctatcattgtgttctctcaaaactatgcatcttccacatggtgtcttgatgagcttgcaaagatccttgagtgttacaaaacaagagggcaacttgtttggccggttttcttccatgttgacccttcggcggtgcgccatcagagaggaagttttgcgacagcaatggctaagcatgaagacagattcaagggtgatgtgcaaaagttgcaaaagtggaagatggccttgtttgaggcagccaatttgtcaggttggaccttaaaaaatgggtatgaatttaagctcatccaagagatcattgaggaggcctctagaaaattaaatcacaccattttgcatattgctgagtacccagttggaatagagaatcgcatatcagaattgaaattacttttgcatatcgaacccggtgaagatattcgtgtcattggaatatatggacttggaggcataggtaaaaccacaattgcaagggctttatacaacttgattgctggccagtttgaagctacaagtttccttactgatataagagaaagttcaaatcaaagacaaggtttagtgcaacttcaagaaacacttctttttgatacagttggggacaagaacatcaagctaggaagtatttataaaggaatccctatcataaagaaaaggctatgttgtaaaaaagtacttttgattcttgatgatgttgacaagttggagcagcttcaagcattagcaggcggacgcgattggtttggttttggaagtgtgatcattataacaacaagagataagcacttgctagctgctcagcaggttgacaaaacatatgaagtaaagaaattaaaccatgatgaagcttttgatctcttcacttggagtgccttcaaaaggaaggcacctgatgcaggctatttcgacatttctaaccgtgtggtgctctatgctgaggggcttccactggctttgaaagtaatgggttctaatttgtttggtaaaacagtggaagaatggaaatctgcactgggaaaatatgaaaagattcccaacaaagaggttcagaatgtacttagagtaacttttgataatctagaagagaatgagaaggaaattttccttgatatagcatgtttcttcaagggggagacaatggaatatatagaaaagactctgcaagcatgtggattgtatccaaagtttggtattagtgtacttgttgatagatctcttgttagtattgataaatatgacagattgagaatgcatgatctgatacaagacatgggtagggaaattgttagagaagtttcaccattagagcctggaaagcggagtagactatggtatcatgaagatgttttcgaagtactctctgaaaatacggggacttacagaattcaaggcatgatggtggacctccctgatcaatatacggtacacttgaaagatgaatccttcaaaaagatgagaaaccttaaaattcttatagttcgaagtggacacttttttggaagcccccaacatcttccaaacaatttaaggttgcttgattggatggaatatccttcatcatctctaccatctagctttcaacctaagaaacttgttgtactcaacttgtcacacagtcgttttacaatgcaagagccattcaagtatttggattctttgacttcaatggatttgactcactgtgaattgttgacaaaactacctgacattactggagtcccaaatttaacagaactacatcttgactattgtacaaatttagaagaggttcatgactctgttggattccttgagaaacttgttgagttgagggcttatggatgcaccaagcttaaagtttttccaagtgccctcaggttggcatcattgagaagtcttatcctcaattggtgctcaagccttcaaaatttccctgctattttggggaaaatggataacctcaaatccgtttctatagatagcactggtataagagaattgcctccttccattggaaaccttgttggacttcaagaattaagcatgacatcttgcttaagcctcaaggagctacctgacaactttgatatgttgcaaaatcttataaaccttgatattgaaggttgtccgcaacttcgaagttttttgacaaagttgagagacatgggacaatctactcttacctttggtaacattcagtcactgaatctagaaaactgtggccttatagatgaagatcttcccataattttccattgcttcccaaaagtatcatcattagtcctttcaaaaaatgattttgtagctcttccaatctgcatacaagaatttccttgcttggaattacttcacttggacaactgcaaaaaactccaagaaattccaggatttcctcctaacatacagtacgttaatgcaagaaattgtacatcattgactgcagagtcatcaaacttattattgagccaggaaacttttgaggaatgtgaaatgcaagttatggtgcctggaacaagggttccagaatggtttgatcatatcaccaaaggagaatatatgacattttgggtacgtgaaaagtttccagcaactatcttatgctttgctctcgcggtagagagtgaaatgaaggagagtttcgattgtgaaattcgcttctatataaatggtgatgaagtttatgaattggaaatgccaagaaacttttcagatatggtgacagatcatgtgtggctctatgacttgagaactcatccatccattcagtggcgcagtcttgatttatatctaatggatgactggaatcaggttgagatttcatgcgagaaaatacttggagcatcaaatgtgactgtgagttggtgtggagttcatgttattaagcaagaaactaacatgaaggatatactatttgcagatcctgatccagatttagattcaagcttacactctgagaagattgatatagatttggatacagatggtgaagaaagtacaaagtcaattgaagattcccaatattgcaacttagtagatgataactgctacattaactttgagacaccggatagacaaatggaggagtggtggaatataagtaaagaggcagaaaataatagagtcgtatgccacactgaaatggatcagaaccaagataagaatttattgcctgaaaagacattgtatagtgttactgaagattcattgttttcattgtatcttgaagacattggtagtgtcaaagcttccggatcaaattcaagcatactagttgttgatcatccagtgaaaaatcaaccacaatctcaagtcacaggttttatacagacaccaaatgttcaggaaccaaggactacagtatccatggatcacaaagttactagaggggagtcacctcaaaagaccaactccaccatggagctgccaacaaccattgactctctgaaaaagcaaaccaatttgactataaatgatgcagacatggaagcattctatgctgttctggatgctgagacctctgactccagagtggtttctaaattggcccacaaaattccaagcgaagagaccaagaaagcattgaagacatttcaagactttgtgaccaaagacttttctgttttgttaggccctagtgagtacagtaccatgaaagataccttggactaccttaccaatttaccagcagaagatggaatatcagtggaaataagatcgttggtaatacaagtttcaagacagttcactcattggagtaaggattacacatatgaaagcaagaaactagagtctaccacagccaagttgttgaaagctgatgaactagaagaaggtcttgaagctaataagactcacttcaaggaagtcatgtgcttggaaaatgagttgtgcagtgagttggcctatttggagcaaagaaagaaggagctagaagaacaaataaatgctgtcaaatctaacatctctgcttcacaagcagctagaaacatggctagtcaaagaaagagagaaatctttggggaagcaaagattctgaaagctcaaagagatgggttaagagaacaaatgccacacttgagagatgagcaggaattggcaaagaaaattaaggcaaatatcagagaagaatggtcaaagcttggagaaaagtttaacaacatcttaaggcatgaagggtttgattaa

SEQ ID NO: 1387 - DNA, 1191 bp, Glycine max var. Williams 82
atggccactgaaaagcttagaagttgtgcaaacttccttgagaactctaaaccctactttgccatgattgctatacaatttggctatgcaggcatgaacattatcactaagatttccctcaaccgtggcatgagccactatgtcctcgttgtttatcgtcatgcctttgccactgctgttgtcgctccatttgccttcatctttgaaaggaaagctcaaccaaggataacattcccaattttcatgcaaattttcatcctagctctacttgggccagtgattgatcaaaacttctactatgctgggttgaaattaacctccccaactttctcatgtgcaatgagcaacgtgcttcctgccatgacttttgttatggcagttttatgccggatggagaagatcaacatgaagaaggtgagatgccaagccaaggtggtgggaacattggtgacggtggctggggccatgttgatgaccttgtacaaaggtcctatggtttggaccaaagatgcacctcataatgggcaaatcaataatgcaacaaataccacaacatattcagacaaggattggttcataggctctatcctcctaatcattgccactcttgcctgggcatccctctttgttttacaagccaaagccattgaaacctacaaaaatcaccagctaagcctcacatcacttatctgcttcataggcactcttcaagctattgcagttacttttgttatggaacacaagccatccgtgtggacaattggctgggatatgaacttacttgccgctgcctatgctgggattgttacatcaagcataacatactatgtccaaggattggtaattaagaagaaagggcctgttttcgcaactgcatttagccctctgatgatgatcattgtagccatcatgggctcctttatcctttcagagcagctttttcttggaggtgttcttggtgctatcttgatcgttataggcttatactcagttctttggggaaagcacaaagaacaagtggtgaagaacgaggtagaggatatacccttgcctgtaaagggtgctcaacttgatggaaacccagaaacacttattgattccactgatcagaaatctgattccaacaagatctcttcacatataattaatgtgtctatccctgagcttcccatgaaatctaataacagttaa

SEQ ID NO: 1388 - DNA, 1830 bp, Glycine max var. Williams 82
atgaaatttttatttggaaatgatgtttcacagattggattccaattagaagtacttgtaggctctactgcagaggttgcttctaatgctgctaaggaatttcaggcgacaaggttgatactagttagacaaattcacaaagatatgaagcatttcatgcgcaacctcccttgtggtatgtataggataacaagtgacaattcaattgagaggttgaaagatccaaaatcagcagtcagtaccaaaacatttgccgacaagcaagaaaatgtaagctataaagaaatgtttccaggaagtgaagaggaggaacgttctcttctcatgtctaggtcttcatcaagtgatctgttgacaccaactgtagtttcaagtcagtggagtacagaagtctccacttctagttttggaagcttgcggcatggctgtcaataccaagagggaaagttttattcaaatatagaacaagaaacaacatggaaccgatcactatttcacatttcggagaatgaagaaacaagtcaaatagaagtaaatcaaaaggagcagaacagcagaaataacgaagcatctcatatggaggaagaattcacaaatccattttgttccgtgtgcaataatagacggccaaaaattggattgaagagagatttcagttatgcggagcttcatactgcgacacaaggattttctcctaagaactttctgtcagaaggtggatttggatctgtctacaaagggctgctgaatggaatgaagattgctgttaagcaacataaatatgcaagcttccaaggagagaaggaatttaagtctgaagtgaatgtgcttagcaaagcaagacatgagaatgtggttgtgctgctaggttcatgctcagaaaaaaacgataggcttcttgtgtatgaatatgtctgcaatggctctcttgaccaacatatatcagaacactctcgatcacctcttagttgggaagataggatcaacgtagctattggagctgccaaaggcttactatacttgcacaagaacaacataatacacagagatgtgagaccaaacaatatccttattacacacgattatcaaccattgctgggagactttggattagcaagaaatcaaaatcaagactcgatacactcaacggaagttgttggaactttggggtacttggcacccgaatatgcagaacttggcaaagtgtctgccaaaacagatgtatattcttttggggtggttctactgcaactaataacaggaatgagaactacagataaaagactcggaggaagaagtcttgtgggatgggcaaggccacttttaagagaaaggaactatccagatttaattgatgaaaggatcatcaactcttatgatgtccatcaactattttggatggttcgaatagcagaaaaatgtctaagcagggagcctcaaaggagactaaatatggtgaaggttgttgatgctctaactgacatagtggaaggcagaacatgtgacatcagattaagggattactcccctgcaaggtcagattcaaccaatggtgtatcagactctgatgaatctaaagatgaaatgcaggaacccttcaggtttgaagaggagttactaagtcacagttcagaatccatagaaaataacaacataagtcagatgatgcagatgattgtaagacagccaccatcccctccaattcagagcatcttttcatgtatctcaagctcatataagtttcattatgagtcaactagtgatggtgaagcacagaatgaaggggaaatagaaatatcaaattcgaatggagggttactatattcttag

SEQ ID NO: 1389 - DNA, 1830 bp, Glycine max var. Williams 82; identical to SEQ ID NO: 1388

SEQ ID NO: 1390 - DNA, 1437 bp, Glycine max var. Williams 82
atgacagaagagactaatattggagaaccacttttaaagaaacagtactatgagaactgccctggttgcaaggttgatagagccaaggagctggaaaaggatgtctccattcgaaatctcgtccatatatggattgtggtgttgtgcggtgctcttcctgtttcttctctctatcctttcctttatttcatggtgaaggattttaatattgcagaaggggaggaagatatcagtgcctatgctggctatattgggtctgcattcatgcttggtagatgtttgacatctatgttgtggggaatgatagctgatcgctatggtagaaaacctgttgtgattataagtgttatttctgttgtcattttcaacatactattcggccttagtacaagtttttggatggctgttattacaagactttttcttggatgtttaaatggtgtgatgggcacaatcaaggctttttcttctgaaatatttcgagaagaatatcaacctctgggactctcaaccgtctctgctgcttggggagtaggtttagcacttggcccagcattgggaggttatttggctcagccagtagaaaaatacccatatttattttcaaagggttccttttgggataggtttccctacttcttgccctgcttggttatatcaacttttgcattttccgttgcaattgcttgcatttggcttccggagacaaatcataaccacaatcctgaagctttagaaatcagaagtagggcccccgacaaagacaaggtggtccaaaacaatgaaagtgtcttccgaaattggcctttaatgtcatctatcattgtttattgtgttttttcacttcatgacaatgcttattctgaggttttctcattatgggctgtcagtcctcgatggttgggaggtttaaactttacaaccaacagtgttggtaatgttttagtagtttcaggttttgctattataatcttccaacttggactataccaatcaatacaaaaaacttgtgggcctgttagccttgctcgtatctcaggggtgttatctatacccatcttgcaaagctaccccttcatgacaatgttgtctggcttcacactgtatgcagcgatatatattgcttccattctaaacaatgtgattattgagataattacaacttgtttattaattttacaaaatagagcagtggaacaacaacaaaggggaatagctaatggcatttctatgactgctatgtcagcattcaaagttattggtccagctgcaggtggtgcaatattaacatcttcccaaaagcggttaaatgctactttcctcccaggaacacatttgatcttcttttctctcaatgttgttgaaggacttggagtgttgttgacattcaaaccattcctaacaataaagaaactgcccttagagctattaaaatga

SEQ ID NO: 1391 - DNA, 1470 bp, Glycine max var. Williams 82
atgaatctgtaccactcctccaccaccaccaccaccaccaccatcttcaccgtcatattcctcctccttgcaatattattcactctcacaccccacaaggccaacggtgccacgtgtcaccctgaggaagaagcgggcctgttgggcttcaaatccggtatccgatccgacccgtccggcctgctcagtaactggatatcgggtacggactgctgcacatggaccggagtagaatgccactataacagcacccgggtccaaagattattcttaacgggtcaaaaacccgaaaccatcttatcgggtaccatctcacccaccctctcaaaactcaaactcctcgatggactctacctcataaacctcatcaacatttcgggtcccttcccaaattttcttttccaacttccaaatctccaatttatctatctagaaaacaacaatctctcgggtcgaatacccgataacatcggtaaccttacccgattagatgtactcagtttaactggtaaccggttcatcggacccgtaccgagttcaataaccaagttgactcagctcactcagctcaaactcggtaacaattttctcaccggaacagttccccaaggaattgccaagctcgttaatttaacctatttgagtctcgaaggaaaccaacttgaaggtaccataccggattttttctcttccttcacggatcttcggattcttaatttttcttacaacaaattttccgggaatatccccaactcgatttcttccctggcgccgaaactgacgtacttggagcttgggcacaactcactttccgggaaaatccctgattttctgggaaaattcaaggcgcttgacacgcttgacctgtcatggaacaagttttccggaacggtccctgcgagtttcaagaacctgacgaaaatcttcaacctgaacctctccaacaacctcctggtggacccgttccccgagatgaacgtgaaagggatagaatcgttggacttgtcgaacaacagttttcacctggggagcattcccaagtgggtggcttcgtcgccgataatattctctctgaagcttgtgaattgcggaataaagatgaggctagaggattttaagccttcggagacttatttctatgattttattgatctttcggggaatgaaatttcagggagtgcaattgggttggtgaatagtactgagtatttggtggggttttgggcttcggggaacaagttgaagtttgatttggggaagttaaggtttggggagaggtttaagtttttggatttgtctcgtaattgggtgtttgggaaggttccaaacagtgttgttgggcttgagaagttgaatgttagctataaccatctttgtggtcagcttcccaagaataagtttccggcaagtgcttttgttggaaatgattgtctctgtggttctcctttgccaccctgcaacaaagcataa

SEQ ID NO: 1392 - DNA, 2068 bp, Glycine max var. Williams 82
aatcaatacaaacacgcatttaaattatttccatgatttatcttaaacttttgttgattgattgattgtacatctaaaagccgtatacatattaaatttccatctaagggggtccaatgccatttatgtctaggctaacttggttactgacacaatgactctcctatattaaagagaccaaaccctatctctgcatattcacttaatttcattccaaaatcttcatattcatcaaactcatcaaaatgaatctgtaccactcctccaccaccaccaccaccaccaccatcttcaccgtcatattcctcctccttgcaatattattcactctcacaccccacaaggccaacggtgccacgtgtcaccctgaggaagaagcgggcctgttgggcttcaaatccggtatccgatccgacccgtccggcctgctcagtaactggatatcgggtacggactgctgcacatggaccggagtagaatgccactataacagcacccgggtccaaagattattcttaacgggtcaaaaacccgaaaccatcttatcgggtaccatctcacccaccctctcaaaactcaaactcctcgatggactctacctcataaacctcatcaacatttcgggtcccttcccaaattttcttttccaacttccaaatctccaatttatctatctagaaaacaacaatctctcgggtcgaatacccgataacatcggtaaccttacccgattagatgtactcagtttaactggtaaccggttcatcggacccgtaccgagttcaataaccaagttgactcagctcactcagctcaaactcggtaacaattttctcaccggaacagttccccaaggaattgccaagctcgttaatttaacctatttgagtctcgaaggaaaccaacttgaaggtaccataccggattttttctcttccttcacggatcttcggattcttaatttttcttacaacaaattttccgggaatatccccaactcgatttcttccctggcgccgaaactgacgtacttggagcttgggcacaactcactttccgggaaaatccctgattttctgggaaaattcaaggcgcttgacacgcttgacctgtcatggaacaagttttccggaacggtccctgcgagtttcaagaacctgacgaaaatcttcaacctgaacctctccaacaacctcctggtggacccgttccccgagatgaacgtgaaagggatagaatcgttggacttgtcgaacaacagttttcacctggggagcattcccaagtgggtggcttcgtcgccgataatattctctctgaagcttgtgaattgcggaataaagatgaggctagaggattttaagccttcggagacttatttctatgattttattgatctttcggggaatgaaatttcagggagtgcaattgggttggtgaatagtactgagtatttggtggggttttgggcttcggggaacaagttgaagtttgatttggggaagttaaggtttggggagaggtttaagtttttggatttgtctcgtaattgggtgtttgggaaggttccaaacagtgttgttgggcttgagaagttgaatgttagctataaccatctttgtggtcagcttcccaagaataagtttccggcaagtgcttttgttggaaatgattgtctctgtggttctcctttgccaccctgcaacaaagcataagtgtagtaagctttgttgttgatgatttcaagtgtttaatttccttttactgctaagttttccaataattatgtaatttaataagtaaattgtaattttaactttcaatatatactatatatatttactttaaaacagtaagttgaatgggtataataattaatataatttgctctttttggaaggttggtgcaagatgcggtatgcatgttttctgtgtaatgctagtcctcgtgagcttatgcatgttttctgtgtaatgctatttttgctctcactttttttgtgtgcttttacgtttttttattattggcaaatgtcattttttttttagtgaaatagctttgagttag

SEQ ID NO: 1393 - DNA, 1584 bp, Glycine max var. Williams 82
atgggttatcttgcagtgtttctgacactgcttctttcaatctcatgtgttgattctaccttggttgagaagaaattcacacagtgcatgttaataaccagagttgatggcaattctgaagccattgagaaaatgctcttcagatcatcctcctcactatatacacaaatcttggaatcattggagcaaaatcctagatggctgaattcttcaaggaagcctctcctcattctaacacctttccatgaatcagaaattcaagcagccattctatgcagcaaagaacttgggctgcagattagaatcagaagtggtggccatgattatgaagggttatcatatctttgtaaggccccatttgtgatggttgacctaatcaacatacgttccatcgaaattaaccttgatgacgaaacaacttgggttcaggctggggcatcaataggtgaactttactacaaaatttctaaagcaagtaaagtgcacggattcccggcaggaacctgtccaagtgtagggatagggggacacataagtggagggggggttggtaccatgttcaggaaacatggcctagcagcagacaatgttgttgatgcttacctcatagatgcaaatgggaagattcatgatagaaaatcaatgggagaagatgttttctgggctataagaggaggtagtgctactagttttggagtcattcttgcatggaaaatcaggttggttagagttccacctattcttacagggttcaacattcatagaacactggaggaaggagccagcaagctcattcacaggtggcaacacatagcacatgaattgcatgaggatcttttcattagaatagttgctcaaaatagtggtgacaaatcaaaaacattccaagcaacctttgaatctctcttccttggaggaatagacaggttgatcccactgatgaatgcgagtttcccggaattgggattgcaggccgaagactgcactgaaatgagctggattcaatcagttttgttcttttctggatacaacaaaggggactctccagaagtcttgctcaacagaactaccacatataaaagctccttcaaggccaagtctgactttgtaaaagagccaataccaaaaactggtttagaaggaatttggaaaatgcttcaagaagaagaaacgttagccttgctgttaatggaaccatatggtggtagaatgaatgaaatttcagaatctgaaatcccttttccccacaggaagggaaacttgtacaacatacaatacttggtcaagtgggaagtgaatagcaatgaagcatccaagaaacatctacattgggctaaaagggtctatagatacatgactccgtatgtctcaaagtctccaagagctgcctatttcaactataaggatcttgatttaggcaaaaacaagcatcacaacacaagctactcaaaagctagtgtttggggcaagaaatactttaagggaaactttagaagattggcacaaattaagacaaaatttgaccctcaaaattttttcagcaatgaacagagtattcctctcctacacacccatccttcttag

SEQ ID NO: 1394 - DNA, 1584 bp, Glycine max var. Williams 82; identical to SEQ ID NO: 1393

SEQ ID NO: 1395 - DNA, 1590 bp, Glycine max var. Williams 82
atggaattgagttattgtgcagtgtttctgatactgcttattccaatctcacgtgcagatgctacatcagttgagaagcaattcaaggaatgcttgttaacccaacttgatggaaattctgaacacattgaaaaaataaccttcacctcatcctccacactatatccccaagtttgggattcattggcacaaaatccaagatgggttaatatttcatcaaggaagcctcttatgattctaacacctttccatgaatcagaaattcaagcagccattctatgcagcaaagaactgaagttgcagctaagagtgagaagtggaggccatgattatgaagggctatcataccttagtgatgtaccatttgtgatggttgacctgatcaacatccgttccattgaaattaaccttgctgatgaaacagcttgggttcaggctggggcatcaataggtgaactttactacaaaatttcaaaagcaagtaaagtgcacggattcccggcaggaacctgtccaagtgtagggataggaggacatataagtggagggggacagggtctgatgttgaggaagcatggcctagcagcagacaatgttgtcgatgcttacctcatagatgcaaatgggaagattcatgatagaaaatcaatgggagaagatgttttctgggccatcagaggaggtgatgcttctagttttggagtcatccttgcatggaagatcaagttggtcagagttccacctattgttaccgggttcaacgttcctagaacacctgaggaaggagtcaccgatctcattcacaggtggcaatacatagcacatgacttgcatgaggatcttgtcattagagtaattgctcaaattagtggccatgacaaatcaaaaaaattccgagcaaccttcaactctattttcctaggaggagtagacaggttgatcccactgatgaatgagagtttccctgaattgggattgcaggccaaagactgcactgaaatgagctggattcaatcagttatgttcatagctggatacaacatagaggaccctctagaactcttgctcaacagaactaccatgtttaaaagatctttcaaggccaagtctgacttctttaaggagcctgtaccaaaatctggtctagaaggagcttggaaactgcttctagaagaagaaatagccttcctgataatggaaccatatggtggtagaatgaatgaaatttcagaatctgaaattccttttccccacagaaagggcaacttgtacaacttacaatacttggtcaattgggaagtgaatagcgacgaagcatccaggaggcatctacaatgggccaaaatggtttataaatacatgactccttatgtctcaaaatctcctagagctgcctatttcaactataaggatcttgatttgggcaaaaacaagctggacagcacaagctactcagaagctagtgtttggggcaagaagtactttaagggaaactttaggagattagctcaaattaagacaaagtttgaccccctaaattttttcaggaatgaacagagtattcctctccttaattcccaccattcttaa

SEQ ID NO: 1396 - DNA, 3638 bp, Glycine max var. Williams 82
gttgtgtgtaatgtaaatattgtgagtgtaatgtatgtgcgtgtgagtgtgtctctgcaacacaacagcatgtgttaatgttgtgcacagtacataattatttaaccttcttttttcgccattacattacagagaaaagaagaaaaagagtagtagtaggtggtaggaggtgtagttaataggaatagtttgttgttgggagtgagagagagagagactgtgtgtggcactcactgttctttcatccttctcgtgattatcatttcaaccttttctgttttctctttcctcactcacacacacccttttgctttttctcttctctctgtgtctgtctctttcaagtttcaaacttcaaaccctagccatagacttttcaatctttcatgctccttctctgtgactcactttgcatatgttacggtttttgggggcctttcaattctccttcactccgcgctttctgggtttttggggttgtttcagtatcccactttcacattcacatcttcaaacgccgaatctgaacataatggagctccatgcttgttctcctccatcaaggatgtaaatgctaggggtagtccaagagtgtggcctccggttagaacttcatagaggaacagatgtttggatgttataatcaataaagagattcaaggcaactaaatgattctgtggaatactatgactgaagagaaatctggaggatgccctttgcggtttttttacttgtgtgcaatcctctgtgaatacatgtgagatagtggaatcaataaagagattcaaggcaactaaagccgagtttcccgttttttgttcgtcaacttatcaaatgcatctatcaaatatggatacctctggtaatacatgtgagatagtggaatcaagggaagagataatttccgagttcaaaatggatgaaaagcctgagagtagttgtgctcacaaatcaggaaagaagtattcaattgaggatgatattaatcagcttttccaggctattgaaattaaaagctcatctagaagtcgtagttcatcaagtttacaaaagagtgctcttaaaaggccaataaaagtcacttcatctcaggcatcaggaattggcatctcagagcctgtaagtttaaagcaggcacttagagggttgtgcatctctcaggcctcagaaatggctgctttgaagagactgactaagccatgcagttcatctagagtatcagaggcgggcaccatcaaaaggttgtacacagcagtggtagatgaggggaaagggaacttggttgaaatctctctagtaccagagatatctgcaccttctgataaattgtctggtgtaactatatcaagttcaattgataatcattctagtcctttggttgatgcaacaaaaccaaaagaaataataactgggttttcatcccaagatcggattgtttctccaccattagaggttgagggtgagaaaccaatcatggggattggaaaaccaatacttgcaaatttgtcaccagttgcctctgcaagtgaagaagtgccagaggtcagaatggatcctgcttcctcaagcaaagcttctcttggttcttcaatgtcagataaggggcatgaagcaaattttccttctggatcttgtccacctagctctagcactggaaatggagcagacaaatacacaagcagtaatacatgtttgtcaaagccaatatttaataacttgaacttccttaagaaaaaagtaaagcaagatttaagttctgccgcgagttgctctactccatgtacaagtaatttggacaaggagggtggcaattctgattttaagcatgaaatgaaagataatgcgaaacagtctccttgcagttcaaatcatagcattgaagttaactcaattaatggtggcacagattcaagcaaatctggtttcagcttgaattgcaataagagaactaagtttttggtgacaaaagttgatgagaaatcaagatcaaaggaaaagggtgagtactctcaaagctcaaaaagtagcattggtgaatatagtagtagcacaagcatcagcgaggaaagcagtctaagtagttccagtcgcggtggccacaggcctcacatgtcaaaacacttgagatgggaagctgttcgtgctgttcagcagcaacatggtaatttaaatttgaagcactttaagcttctaaggaggcttggtagtggggacattggaactgtttatcttgcagaactaattggtacaagctgcctttttgcactcaaagtgatggacaatgaatttttggcaagtcggaagaaaatgttcaggtcccaaactgaaagagagatccttcagatgctggaccatccatttcttcctacgctgtattcccatattgcatcagataagctctcttgcttggttatggagtattgtccaggcggagatctgcacgtgctgcgacagaggcaatcatacaagagtttctcggaacaagcggctaggttttatgttgctgaggttcttcttgccctggagtatttgcacatgctgggagttgtatatcgtgacctaaagccagaaaatatcctggtacgagaagatggacacattatgctgacagattttgacttgtcactcaggtgttctgtcaatccaatgttagtcaagtcatcttcacctgacacagatgctacaaagaagacgtccagtccctgttctgaggctagttgcatacaccctttctgtctccaaccggattggcaagtttcctgctttactcccattctgttatctgccggagcaaaatctcggaagatgaaggctgacatagcttctcaggctggtcctctgccacagcttgtagtggagcctaccagtgcacggtctaactcctttgttggaacctatgaatatcttgctccggagatcatcaaaggtgagggtcatgggagtgcagtagattggtggacttttggtatatttttgtttgagcttttatatggtaagactcctttcaagggccaatcaaatgaggacacattagccaatgtggtttcacaaagccttaagttcccgggtactccaatagtcagttttcatgcaagagatttgatcagaggattgttgataaaggatcctgaaaaccgattaggttctgtaaaaggtgctgctgaaataaagcagcaccctttctttgaaggcctgaactgggctctaatacggtgtgcagcaccaccagagctccccaagtttctggattttggaagtagtgctccatctgtggctgcaaataaggagaatgcaaatgatttagaggatatagaagattgtgaagagtttgagctgttttagttagacttgtcttctctgccctttcctacccccgttgtctttttcgtttcttcttatgaggggtgggaatttgaattgaagttgacttggttttaaaactcgaactcatccatataacacttagtatagcttatagcataaatgtaatccaaaccttgtgacaaatagataggttagtatatgtttatactgtactagaagttgcaaatcgataaaggaaacatgaggatttctttggtttgtctgcaggccatttcagcttctatatgatattatcaatggatatttctatccc

SEQ ID NO: 1397 - DNA, 1146 bp, Glycine max var. Williams 82
atgtataattactgcaaggttctttgctccttgtggctctcatcaggctctgatcacacttcgatggcaaagtttggattatctccactcttggtgctttccatattgttgctgatcatgagtggtggtgcagtgagaggccaaagagaaatggtgcctgccttgttcatatttggtgactctctcattgacaatggcaacaacaacaaccttccttcctttgctaaggccaactattacccttatggcatcgacttcaatggaggccctactggtcgcttctctaatggctacactatggttgatgaaatagctgaactgcttggacttcccttgattcctgcatacacagaagcctcagggaatcaagtgcttcatggagtaaactatgcttcagctgctgctggaatccttgatgccactggcagaaactttgttggacgcataccatttgatcagcaacttaggaactttgagaacacattaaatcaaattactgggaatcttggagcagactatatggccacagcgcttgcacggtgcatattctttgttggaatgggcagcaatgactacctaaacaactaccttatgcctaattaccccactagaaatcagtacaatggacaacagtatgctgatcttttggttcaaacatatagccagcagctcacgaggctttacaatcttggagcaaggaaatttgtgattgctggactgggagaaatgggatgtattccaagcatactggctcaaagcacgaccggaacctgctctgaagaagtgaacttgctagtgcaacccttcaatgaaaatgtgaagaccatgttgggaaatttcaataataatctacctggtgccagattcatattcgctgatagttcccgaatgtttcaagacatccttctcaatgctagatcttatgggttcgctgtggtaaatagagggtgctgtggcattggaagaaacagaggccaaattacatgtcttccattccaaacaccatgccccaataggcgtcagtacgtgttctgggatgcattccacccaacagaagcagtgaacattctcatgggaagaatggcttttaatgggaaccccaattttgtttatcctataaacataaggcaacttgctgagctataa

SEQ ID NO: 1398 - DNA, 2100 bp, Glycine max var. Williams 82
atggcaatgttcacgtaccacgttgaaacggttcaatcatggttggcactgagcagacttcacatactgatccacttagtggcagtgttgtcgctgtgttactaccgcataactcacttgttactggaacctccaacagcgccatggcttctgatgaccgtagcggagcttcttctctcggtgctctggttcttcaaccaagccttccggtggcggccggtgtcgcggagcgtcatgacggagaagctgccgagggatgagaagctgccggggcttgacatcttcgtgtgcacgctggatcccgagaaggagcccaccgtggaggtcatggacaccatcatctccgcggtggccatggattacccctccgacaagcttgccgtgtatctctccgacgacggcggctgtgacgttactctctatgggatcagagaggctgctgagttcgccaaggagtgggttccgttctgtaacatttatggggtcaagtcaaggtgtcccaaggtcttcttctctccctttggggaggaggatcaacacactcttcgccacgatggattcagtacacaacgagacctcatcaaggctaaatacgagaagatgcagaaaaatatcgagaaatttggctcagaccctaaaaatcgtcgtattgtgagtgacagacctcctcgtattgagattataaatgaccaaccgggaatgccacttgttgtttatgtgtctcgcgaaagaaggccatcccttcctcacaaattcaaaggaggagccctcaacgcattgctcagagtctcaggtttaatcagtaatggaccttatgttctagcagtggattgtgatatgtatagcaatgatccaacctctgccaaacaagccatgtgcttctttcttgatcctgaaacgtccaaatatattgcatttgttcaattccctcaaatgtttcacaaccttagcaaaaaagacatctatgataatcaatctagaactgcttttaagactatgtggcaaggcatggatggactaagaggtccaggtctttcaggcagcggcaattacttaagtagaagtgctttactatttggaagtccaaaccaaaaagacgactatctgaaggatgcacaaaagtactttggcaagtctaccgcatacattgaatcactgaaggccatccgtggacagaaaagtagcaaaaagaatatttcaagagatgaaatgttaagagaagctcaagtagtggcctcttgttcctacgaaaataacacaaattggggcacagaggtgggattctcatatggcatattactagagagtactattactggctatcttcttcacagcagaggatggaaatcagcatatctttaccccaaaacaccatgtttcttaggttgtgctcccactgacatcaaggaaggcatgcttcagttggttaagtggttgtctgaacttttgttgcttggtgtctcctccaaatacagcccattcacttatggattttcaagaatgtccataattcacaccttcacttattgcttcatgacaatgtcatccctttatgctgttgtcttcatcctctatggcattgtacctcaagtgtgcctcctcaaaggaatcactgtgtttccaaaggccacggacccttggtttgcagtgtttgcatttgtgtatgtatctactcaaattcaacatttgattgaggttctatctggggatggctctgtggctatgtggtgggatgaacaaagaatttggattctgaagtcagttaccagcatatttgcaattatagatggaatcaagaagtggctggggttgaacaaggtgaaattcaacttgtcaaacaaagccattgacaaagagaagctcaagaaatatgagcaaggtaggttcgatttccaaggtgcagctgtgttcatggctccattggtcctattactcatagccaacattgttagcttctttgttggtatatggagactattcaatttcaatgtgaaggattttgaagaaatgtttggtcaacttttcctagtcacctatgtaatgcttcttagttatcccattcttgaggccatagtaacaatgaaaagcaaaagtggatag

SEQ ID NO: 1399 - DNA, 1275 bp, Glycine max var. Williams 82
atgaagttagaagtggaggtaatctccaaggaaatgatcaaaccctcttctccaacccaggaccatcttcgtcactatccactctcttttctcgatcaagtctctcccatggtgtataaccctatggttctcttttactcttgctacggtatcactcaaactcaattcaccatttccgaaaagctgaagaaatctttgtctgatgttttaacccatttctaccctcttgccgggcgagtcaatgggaacagtactttcatagactgcaacgacgagggtatcccctacttagaagcaaaagtgaagtgcaaagttgtcgacgttattcacaaaccagttccaggagaactcaaccatttggttccatttctactagatgatatcaccaatatcacatttggtgttcagcttaatgtttttgattgcggcggtattgcaatcggagcttgcctttctcaccagattgcagatggtctgtcatttttcatgttcctcaattcttgggcagcatttgctagtaggggggaacaagctgtgttgccaaacccgcagtttatttcagcaaagctcttcccaccgaaaaatatatctggatttgatcctcgaagtggcatcattaaggagaacatcatctgcaagatgtttgtgtttgatgggtctgttgttgaaagtcttagagcaagatatgcagcaacaagctttgaaaacgagaagcaccctacccgagtagaggctttatctgctttcatttggagtcgttatgtggctgtgactggtccacagagaacatatgctgtggttcacgcagtgaaccttcgtccaaagatggaaccaccactgcctccagattcctttggcaattactaccgaatctctttgacgattccctcgttgaacactgaagagcacctagtgaaacaggcaagggatcagataaagaagattgacaaggattatgtgagaaaacttcaatatggaaacgaccatttggatttccttaaggatagctcatatagagtgcttctgaagggggaactagtcccatttaatattactagtttgtgtaggtttcctctctacgacgctgattttggatggggagaaccaacatgggtaggttcacctgctttaacttttaaaaatctggttgtctttatagacacaaagaatggcggtggcattgaggcttatgttagcttaaaggtggaggacatgacaaagtttgaagcagatgaggagttacttgcctgtgtgagtaaagcacgggtttgttga

SEQ ID NO: 1400 - DNA, 2289 bp, Glycine max var. Williams 82
atgtggaggctgaagatagcagatggaggaaatgatccatacatattcagcacaaacaatttcgttgggaggcagacatgggagtttgatcctgaagcaggcagtccagaggaacgggcccaggttgaagcagctcgtcagcatttctaccacaaccgcttcaaggtcaagccctgcgctgacctcctttggcgttttcaggttctcagagaaaataacttcaaacaaacaattcctcgtgtgactatagaagatggagaggaaatcacataccaaaaagtcacaagcgccgtcagaaggggcgcacaccaccttgcggcactgcagacctctgatggccattggcctgctcaaattgcaggtcctctcttctttcttcctcctttggttttttgtatgtatattacaggaaatcttgaatcagtatttccagaagaacatcgcaaagaaattcttcgttacacatattatcaccagaatgaagacggaggatggggactacacatagagggtcatagcactatgttttgtactgcactgaactatatatgcatgcgaatgcttggagaaggacctaatggaggtcatgacaatgcttgtgctagagcaagaaagtggattcgagatcatggtggtgtaacacatataccttcatggggaaaaacttggctttcgatactcggtgtatttgattggtgcggaagcaacccaatgcccccagagttttggatccttccatcttttcttcctatgcatccagctaagatgtggtgttactgtcgattggtatacatgcctatgtcttacttatatgggaagaggtttgtgggtccaatcacaccactcatcttacaattaagagaagagttgtttactcaaccttatgaaaaagttaattggaagaaagcgcgtcaccaatgtgcaaaggaagatctttactatccccatcctttgatacaagacctaatatgggatagtttatacatattcactgaaccgctacttactcgttggcctttcaacaagttgattagagaaaaggcccttcaagtaactatgaaacatattcattatgaagatgagactagtcgatacataaccattggttgtgtggaaaaggttttatgtatgcttgcttgttgggtggaagatccaaacggagatgctttcaagaagcatcttgcaagggtcccagattacttatgggtttctgaagatggaatgaccatgcagagttttggtagccaagaatgggatgctggctttgctgttcaagctttgcttgccactaacataattgaagaaattggtcctacgtttgcaaaaggacatgatttcatcaagaagtctcaggtgaaggataatccttttggagattttaaaagtatgcatcgtcatatttctaaagggtcttggacattctctgatcaagaccatggatggcaagtttctgattgcactgcagaaggtttaaagtgttgtctacttctatcaatgttgccaccagagattgtgggagaaaagatggaacctgaaagattatacgattcagtcaatgtcttgttgtcgcttcagagtaaaaaaggtggtttagcagcatgggagcctgcaggagctcaagagtggttagaattactcaatcccacagaattttttgcggacattgtagttgaacatgaatatgttgagtgcactggatctgcaatccaagctttagttttgttcaagaagctatatccaggacataggaagaaagagatagaaaatttcattaccaatgcagttcgattccttgaagatacacaaacagctgatggttcatggtatggaaattggggagtttgcttcacttatggctcttggtttgcacttggaggtctagcagctgctggtaagacttacaccaattgtgctgccattcgcaaagccgttaaatttctacttacaacacaaagagaggacggtggatggggagagagttatctttcaagcccaaaaaagatatatgtacctctagaaggaagccgatcaaatgttgtacatacagcatgggctcttatgggactaattcatgctggacaggcggatagagaccccatgcctcttcaccgtgctgcaaagttgctcattaattctcagttggaagagggtgattggccccaacaggaaatcacgggagtattcatgaaaaattgcatgttgcattatccaatgtacagagatatttatccaatgtgggctctagctgaatatcgaaggcgggttccattgccttccactgaagtttaa

SEQ ID NO: 1401 - DNA, 2223 bp, Glycine max var. Williams 82
atgtggctgccaggtacaaagactgcttcaataattaagaaggggggaggaaatggattggtggcagttgccatagaaaaggataacaaagggagcagacacgctctgaaatgggctgctgatactcttctttcgaggggccaaactcttgttttaatccacgtcttgcacaccacctccccatctcacgaggccataatatgcaatatcaacaccaactccccagctgcatccccacatgtcaatattacaaaggatcttttccgcaccttccattgctattgttcacgcaaagatatacaatgccttgatgtccttcttgaagacatggatgtggtcaaaggaataacagaatatgtctcttatgctgcaattgagaatttggtgcttggtcaagcctccaggcatggctttattagattcaagtcaagtacgccaagcaacatattaaagggggcgccagatttctgtactgtgtatgtgatttctaagggcagaatctcttcagttcggagtgctgctcgaacagccccacatgcctccccattgctgaggcacatacagattctacatgacgagaatgcacgtgagtctgagatatcgtctaaatataacagggcatcaatcaaaccttccagctggcagagtgaatccatgaaacaatcacaacttggcagaagaataaacttgagtggaaggtcatgcatggacttccccgaatccgactctgacatatcatttgtaagctctgagaggcccagcagtgtgcgttcatcctctgttttctatgactattttgatcttcatgcccgaaatccacgaacttcaaccagttcagatcatagcttgggatcaacccgtatgagacccaagttctctgacctcagttcaaccgacatttcattttcagaggatagccgccgatcatcagtttcttcttccttgctaaacgttgatgaagccgaagctgacatgaggagcttgaagttggagttaaagcatacattggaaatatacactactgcatgcagagaaacactagcagcacaacagaagttaggggaactgcaaaactggaaaatagaggaagaaaagaaaatggaggagatgcagttgtcccaggaagcagcagaggcaagtgtggagcaagagaaagcaagaagtaaagcagcaagggaaacagctaaagcagcaaagagaatagcaagggtggaatcgagtaaaagagaaagtgtaaaagtgaaagcccttaaagaagcagaggaaatgaggaaacaattggacaatctaacccaaaacgacaaaagatataggagatacacaatagaggagattgaaagagccacagacatgttctcagaagcaaggaagataggggaaggggggtatggacctgtgtacaagtgttacctagatcatacacaagtggcggtgaaggttctgcgtcaagattcagctcaaggggaggcacagtttcagcaagaggtgaacatactggggtgcataagacatccaaacatggtgctgctaataggagcatgtgcagagcacggaatactggtatatgaatatatggcgaaaggaagcttggaagactgtatgtttggaaagaagaaggagaaggagggaaagatgaggagttggaaggtaaggtttggaatagcagcggagatagcaacggggttgctgttcctacatcagacgaagccagaaccattggtgcacagggatctgaaaccggggaacatattgctggaccagaattacgtgagcaagataagtgacgttggattggcgaaactagtaccggcagcaacggcggggaacgggacgcaatgctgcatgacagcagcagcgggaacattctgctatatagatccggagtatcagcagacgggaatgctaggggtgaagtcagacgtatactctctggggataattctactacagttgttgacgggaaggcctgccatgggactggcacaccaggttgaggagtcgatcaagaaggacaggtttggtgaaatgctggacccctctgtcccggactggcctctggaacaagccctctgccttgcaaacttggctctccaatgtgcacagctcaggcgaaaggaccgcccagaccttgccacactcgtattgcctcgcctccaaatcttgcgagactttgcttcccttcattcatccacctcttccgatcaagggcccaatgatcactaa

SEQ ID NO: 1402 - DNA, 1146 bp, Glycine max var. Williams 82
atgtcgtcttccaactccaaaacccaaacccaaaccccttcttcactctcactctgcacctctaagcctcaggaaggtaacatggcattggaatcccaaccgcagaagaacaagtatggacacggggtgtttggagacgtctccagcatcatcaaagagatggagattgatcatcccaactctacctttgattttcaatttcaatttcccccaattgcttttcagaattttctgggctctagagaggttcgcgagtttattagcggggcccttgcaggggcgatggcaaaggctatacttgctcctcttgagaccatcaggacaagaatggtagttggtgttgggtcaaaaaatattgctggtagtttcatagacgttatagagcagcagggatggcaaggactgtgggctggaaacatgatcaatatgcttcgtatagttccaacacaggccattgagctaggcacatttgagtgtgtcaaacgggctatgacatccctgcatgagaaatgggaacacaatgaataccccaagttgcagataggttccatcaatttcaacttatctttatcttggatttcaccagttgccattgccggtgcggctgcaggaattgctagcacagttgtatgccatcccctcgaagttttgaaggaccggttaactgtaagtcctgaaacttaccctaatttaggtattgcgattagaaatatttataaagatggtggtgttggcgctttttatgctggtatctcaccaactctggttggcatgcttccatacagtacgtgtttttatttcatgtatgatacgataaaggaatcttactgccgcaccagaaataagaaatctctaagccgtccagagatgattttgatcggagcttttgcaggtttcactgccagtacaattagcttccccttggaggtagcaaggaagcgcctgatggtgggtgctttgcaaggtaagtgcccgccaaacatggcggcagcactttcagaagttattagagaagaaggtctgaagggtctctacagaggatggggtgcaagctgtttgaaggtcatgccatcctctggtatcaccaggatgttttatgaagcttggaaagatatattgcttgtccagaatggtaatcccctttag

SEQ ID NO: 1403 - DNA, 1701 bp, Glycine max var. Williams 82
ggagagagaaaatatcagtccaaaaacaacagcaataagccggcttgagccttgaagtgaatgtcaaagaaattcaaagttaaaataactttactaatctcttctcttctgtgtatatatatactttccaggacatggttgaaacttgaaacttgaaaggaaccctaataaacatgttgtgacctgtgaagcaacaatatagagcagagaagtgaaaaagaattttacagaacccacccccaaataaaaaaacaaaatgtcgtcttccaactccaaaacccaaacccaaaccccttcttcactctcactctgcacctctaagcctcaggaaggtaacatggcattggaatcccaaccgcagaagaacaagtatggacacggggtgtttggagacgtctccagcatcatcaaagagatggagattgatcatcccaactctacctttgattttcaatttcaatttcccccaattgcttttcagaattttctgggctctagagaggttcgcgagtttattagcggggcccttgcaggggcgatggcaaaggctatacttgctcctcttgagaccatcaggacaagaatggtagttggtgttgggtcaaaaaatattgctggtagtttcatagacgttatagagcagcagggatggcaaggactgtgggctggaaacatgatcaatatgcttcgtatagttccaacacaggccattgagctaggcacatttgagtgtgtcaaacgggctatgacatccctgcatgagaaatgggaacacaatgaataccccaagttgcagataggttccatcaatttcaacttatctttatcttggatttcaccagttgccattgccggtgcggctgcaggaattgctagcacagttgtatgccatcccctcgaagttttgaaggaccggttaactgtaagtcctgaaacttaccctaatttaggtattgcgattagaaatatttataaagatggtggtgttggcgctttttatgctggtatctcaccaactctggttggcatgcttccatacagtacgtgtttttatttcatgtatgatacgataaaggaatcttactgccgcaccagaaataagaaatctctaagccgtccagagatgattttgatcggagcttttgcaggtttcactgccagtacaattagcttccccttggaggtagcaaggaagcgcctgatggtgggtgctttgcaaggtaagtgcccgccaaacatggcggcagcactttcagaagttattagagaagaaggtctgaagggtctctacagaggatggggtgcaagctgtttgaaggtcatgccatcctctggtatcaccaggatgttttatgaagcttggaaagatatattgcttgtccagaatggtaatcccctttaggctaataaggttatgtggattattttgtactctataagaaggaatgataaaacacaatgccgggtaagaaaaaataattattcggaaagttgttttgccatggcagccagctggttagctcgttggaatggtcacatctactgacgagttaggtacctagcttgtaagtttccagattttgatattgatttgggaagattatcatcgaagaaaaaggttaaagaatgagtttgggagaagtttcctatgttcattcattgtttctttccattccatcaccacgtttatatgttatcaaa

SEQ ID NO: 1404 - DNA, 1872 bp, Glycine max var. Williams 82
atggcatcctctgcttgtaccaaacccatcttcccctctgccttcaccgtctctaagtcaaagctctctcgtcatgttcatgtctccttcacctcccccaaacccatctactaccactacagaaagctctctcatgcctctcaacgttccttggtggtcaacagcgttttgaaaacagttgacccgacacaaacctctttgcggagatccaactccgaggatgttgggtctctgggagaaaagcccaccatcctggtctccgagaaacttggagaggcagggctgcaggtgttacgtggcgttgggcacgtggaatgcgcgtatgagctctcacaggaggagctatgcacgaagatctcgtgctgtgacgctctgatagtcaggagcgggacgaaggtgacgagggaagtgtttgaagctgggaaagggaggttgaaggtcgtgggaagagccggcgtggggattgacaacgtggatctgcaagctgccactgaatttggttgcctggtcgtcaatgctcccactgccaacactattgctgctgccgagcatgggatcgctctccttgctgccatggcccgcaacgttgcccaggctgacgcctccaccaaagctggaaaatggcagagaagcaagtatgtgggagtttccatggttggaaagacattggcggtgatgggttttggaaaagttggatctgaagtggccaggcgcgcaaaagggttgggcatgcacgtgattgctcatgacccctatgctcctgctgacagggcacgtgctattggtgtggatctggtgtcctttgatcatgccatcgccactgcagatttcatctccctccacatgccactcactccaactactaacaagatcttcaatgacaacacttttgctaagatgaagaagggtgttcgcattgtcaacgttgcaagaggaggtgtcattgacgaagacgcattagtaagggccctcgacactggaatcgttgctcaggctgctcttgatgtcttcaccgaggagcccccatccaaagacagtaagttagtgcaacacgagaatgtcactgttacccctcatcttggagctagcaccaaagaggcacaggagggggtagctattgaaatagctgaggctgtgctaggagcattgaaaggggaactttcagcaactgctgtcaatgctcctatggttgctcctgaggtgttgtcagaattggccccatatgtggtgctggctgagaagctggggaggctagctgtgcagttggtgtgtggaggaagtggaatcaaatctgtgaagatagtgtatcgatcagctaggggcccagatgacttggacaccagacttctgcgagccatggttacaaaaggcctgattgaaccaatatcaaacaccattgtaaaccttgtgaatgcggatttcatagccaagcagaaagggcttcgcataagcgaggaaagagtggttgttgattcatctcctgagatgcctgttgattcaatccaggtacagatatccagtgtggactccaaatttgcgagtgctgtatcagagagtggtcagatcagcattgacggaagagtgaagtttggagaaccccacctgacatgtgtggggtctttcgatgtggatgtgagcttagaagggaatctaatcctgtgccggcaggtggatcagcccggcatgattggccgtgttggaaacatactgggtgaacaaaacgtgaatgtgagctttatgagtgtgggaagaacatcgcgtaggaacaaggctattatggctattggtgtcgatgaagaaccaaacaaggaggctcttgacaatattggagccgtgcctgccattgaagagttcgtcttcctcaagctctag

SEQ ID NO: 1405 - DNA, 1659 bp, Glycine max var. Williams 82
atggcttcagctccatcatcgccagaaactcctcccaacacaaacttcactgccacctctactcctccactcaagatttctcccgcaactcttcccaatcccaataacaaacgcttgctgatcggattatctatagggtttgcccttttatcttttgttttgatccttgtgattgcctttctcgtctacttccttcatcgggtaaggaaaaataaacgacataagagcttcgggagaataccacttcaagatgacatggctggtggcacacttcagcttcagccacagcaacaatcacccgctgttctcaccagaatcgttattagttgcatagaattttcacgtgaggaattatatgtggcaacagatggattctacgacgttcttggtgaaggtggttttggccatgtctacaaaggacgtctcccaaatgggaaatttgttgcagttaagaaattgaagtctgggagtcaacagggtgatcgtgagttccaggcagaagtcgaggccattagccgtgtgaatcacagatatctcgtaaccctagttgggtactgcacctcagacgatgagaggatgcttgtctacgagtttgtgccaaataatacactaaaatttcatttgcatgaaaaggacaaaccatcgatggactggtcaacaaggatgaagattgctctaggatctgcaaaaggatttgaatatctgcatgtgtactgtgatcccataatcatacaccgtgacatcaaggcatccaacatccttcttgataaagattttgagcccaaggttgcagactttggacttgcaaaatttttatcagacacagaaagccatgtttctactcgagtgatgggaactaatggatacgtggatccagaatatcgtgatagtgggagactcactgcaaaatcagatgtttactcctttggtgttgtgcttttggagttgattactggacgaaaacctattgatgaaaagaaacccttcaaagagcgcgacttggttaaatgggcaagtcccttcctgctccaagctttgagaaatatcaccgttgtacctcttgattcaaggttgcaggaaacttacaatcctgaggagttcctctgccaagctttgaaaaatggcaggtttgatggacttattgattcaaggttgcaggaaactaattacaatcctgaggagatgatccgaatgatcacttgtgctgcagcttgtgtgcttaactcagccaagctccggcctcgaatgagcctggttgttctagctctgggaggatttattcctctaaaatttctaaagccggagatcacacctggaaccagcaatgtttctgaatacttaagtgatagtatccaatcctatgaagacctaaagaagatattcatgaatatggcacagaaaggcagagagaatgtcattgatgagaatgagtacagtgatcccagaagcaagtacggtcaagatcaatgtgcgtcgtctatggctggacccagcaatgtttctgattcctttaataatggtgtccaatccatgaatatggaacagaaagacaaagagaaggttattaatgagaacattgatcccagcagcaagtatgattctgtgtctactcacggccagcaaaatacaaaagaaatggggaaggtgaacggttcgtag

SEQ ID NO: 1406 - DNA, 210 bp, Glycine max var. Williams 82
atgattctaatgcctctgatgctgcgttcactggtggagctggcaacagcactagtgtgtgaacctacatccactctcacaacaattctatattacggcaatttgcttccccgcaatcttaacttgggtcgattagtgcgacgtgaatttcttcaccaagaaaaccatttcttccattttctcaccactatgctcaggtgcgtttggtag

SEQ ID NO: 1407 - DNA, 2580 bp, Glycine max var. Williams 82
atgacaggtgggatgtttggaaggaaggggcaaaagataaaggggacagtggtgttgatgccaaagaatgtgttggacttcaacgccataacctccgtcggaaaaggcagtgctaaggacaccgccaccgatttcttgggcaaaggcttggacgcattaggtcatgcagttgatgctctcactgccttcgctggccatagcatctccttgcagcttatcagtgctactcagactgatggtagtggaaaaggaaaagttggaaacgaagcctatttggaaaaacatcttccgaccttgccaacgttgggagcaaggcaggaagcattcgatattaactttgaatgggatgctagttttggaattccaggagcattttacatcaaaaactttatgactgatgagtttttcctcgtcagtgttaaactcgaggacattccaaaccatggaaccattaacttcgtttgtaactcatgggtttataacttcaaaagttacaaaaagaatcgcattttctttgtcaatgatacatatcttccgagtgctacaccaggtccactagttaagtacagacaagaagaattggaggttttaagaggagatggaacagggaagcgcagagactttgacagaatctatgattatgatatctataatgatttgggcaatccagatggtggtgatcctcgcccaatcattggaggctctagcaactatccttaccctcgcagggttagaaccggtagagaaaagaccaggaaagatcccaacagtgagaaaccaggcgagatatatgttccaagagatgaaaacttcggtcacttgaagtcatctgatttccttacatatggaatcaaatccttatctcagaacgtgatacctttgttcaaatctataatatttgacttaagggtcacatcgagtgagttcgatagcttcgacgaagtgcgtggtctctttgaaggtggaatcaagctgccaacaaatatactgagccaaattagccccttaccagtcctcaaggaaatcttccgcactgatggtgaaaatacccttcaatttccaccacctcatgtaatcagagttagtaaatctggatggatgactgatgatgagtttgcaagagagatgattgctggtgtaaatccaaatgtaattcgtcgtcttcaagagttcccaccaaaaagcactcttgatcccgcaacctatggtgatcaaactagtaccataacaaaacaacagttggagattaacttgggtggggtcacagtagaagaggcaattagtgctcacagattattcatattagattaccatgatgcattcttcccgtatttgacgaagataaacagcctacctattgcaaaagcttatgccacaaggacaatcctgttcttgaaagacgatggatctttaaagccacttgctatcgaattaagcaagcctgcaacagtgagtaaagtggtgttgcctgcaacagaaggtgttgagagtacaatttggttgttggccaaggctcatgtcattgtgaatgactctggttatcatcagctcataagccattggttaaatactcatgcagtgatggagccatttgccatagcaacaaacaggcatctcagtgtgcttcaccccatttataaacttctttatcctcactacaaggacacaataaatatcaatggccttgctaggcagtccctgattaacgcaggtggcattattgagcaaacatttttgcctggaaagtactccattgaaatgtcatcagttgtttacaagaattgggttttcactgaccaagcattaccagctgatcttgtcaagagaggattggcagttgaggatccctctgccccacatggtcttcgccttgtgatagaggactacccttatgctgttgatggacttgaaatatgggatgctattaagacatgggtccatgagtatgtctctgtgtattacccaacaaatgcagcaattcaacaagacactgaacttcaagcatggtggaaggaagttgtggagaagggtcatggtgacttaaaagataagccttggtggcctaaactgcagactgtggaggatctcattcaatcctgctctattatcatatggacagcttcggctctccatgcagctgttaattttgggcaatacccttatggaggttatatcgtgaaccgtccaactctagccagaaggtttatcccagaagaaggaaccaaagaatatgatgagatggtgaaggatcctcaaaaggcatatctgagaacaatcacacccaagttcgagacccttattgacatttcagtgatagagatattgtcaaggcatgcttctgatgaggtctaccttggccaaagggataatccaaattggactacggattcaaaggcattggaagctttcaaaaagtttggaaacaaactggcagaaattgagggaaaaatcacacagaggaacaatgatccaagtctgaaaagccgacatgggccagttcagcttccatacacattgctccatcgttcaagtgaggaagggatgagtttcaaaggaattcccaacagtatctccatctaa

SEQ ID NO: 1408 - DNA, 366 bp, Glycine max var. Williams 82
atggaattcagatcaaaatcatgcaggaatgagagtctgcagattgaaaactacagtggtggaagggtggcaccaacaagcatgcaagatctgaggtcttatagttacagtgcaagctatgctggttctgcttatccatacaagataggtaaggaaaaggaagtgaaggtggataaagggaaaagcacagttagcaatagcaaagtatcaaagagttggagcttcaatgaccctgagttgcagaggaagaagagggtggctggctataaaatatattctgcggaagggaaaatgaaaggctcactaaggaagagtttgaggtggatcaagaacacatacactcaagctgtccatggatggtggtga

SEQ ID NO: 1409 - DNA, 795 bp, Glycine max var. Williams 82
atgaaagtcattgttttcttcgttgctataataattttaggtgcagaatggcaatgcaatgggtcagagcatgagcatgagcatggccacagctaccaaattttccctttgcgaatgaaaaccggccccggtggccactacattccggaggtatcgtgcaaaagttggaggcttggtgtggaagcacacaacgtcattgactggagaaccattcctcaagattgcgagggatatataggaaactacatgcttggccaccaatatagatcagactccaaaacagtttgccgtgaagcttatttttatgctaaaaccatcaacatcactgccaaaaccacatgggtgtttgatgtagatgagactacactctctaatctcccttactttgctgatcatggatttggggtggagctatataatgcaacagcgtttaatgaatgggttgaccttggcgaggcaccggcactgccagagagtctcaaactgtacaataaactgttgtctcttggcatcaaaattgtattcataacaggaagaccactgtatcaacaggctgtaactgctaccaacttaaagcttgctggatactacaaatgggaaaagttaattaccaaggatacagataaatacaatggtaagacagcagttacatacaaatcaactgagaggcagaagctggaggaaaatggatacaacatcattggaaacattggagaccaatggagcgatatattaggaaccaacacaggccttaggacctttaagttgcctgatcccatgtactacattagttga

SEQ ID NO: 1410 - DNA, 312 bp, Glycine max var. Williams 82
atggcgaacacttcttgtcccattgaactggagcctaggacactgaatcaagtgcagctcactcaagcaagggaagtagctgcaaaggtagttcaaaagttggaaccgtgtgaagcatcagcactgtttattgaggggctgatgcatccaatacaggaggtgatgcatatggatgaaaatggaagcctagctgagaagcttgttgattgcatgaagaaggctgagtccatccctgatgacaaagcttgccattgccaatgctcgtgcgctgctgaaaacccatttaaagaaccactttctgcaccgttttga

SEQ ID NO: 1411 - DNA, 624 bp, Glycine max var. Williams 82
atgacacaacaaacaacaacctcttcctcctcacattcgggcccaagggcccaggcccagaaacagagcaagaggcccagggactgcagcaagcacccggtgtaccacggcgtgcggaagcggaactggggcaaatgggtgtccgaaatccgggagccacgcaagaagtcccgaatctggctcggaacattctccactcccgaaatggcggcgcgagcccacgacgtggcggccctcaccatcaagggccagtcagcaatcctcaacttccccgaaattgcagacctgctccctaggcccgtcacgtgctccccacgtgacatccagaccgcggccacggccgcggcctccatggttaagttcgaccctgtgacacaatcctcagactcggagactccagagtcttcggagctgagcgagattgtcgaacttcccaacattgaagacagcagcgttgactcgacaccggagttcgtcttggtcgatgttgttgacagttgggtgtttcccccaatgggaatgggttcagagggaatcgagttctgtgccgctttttctgatgagttatttccgcaacagagttttattggttccgagatagagatactacccatttgggattga

SEQ ID NO: 1412 - DNA, 1272 bp, Glycine max var. Williams 82
atgagaacatccaaatttccatgtaggggattggattatcgtctattccttctgatttttgctgtatgtttggtgttgtatggaacagtttcaagattgaatgctccaaatgtttcttatgccacaatatctaagttacggcacttcaatcctaagcatgttatatcaaaaggaaaagggtaccctcctgtgcttgcatattggatacttggcagcaaaggagagagtaagaagatgttgaggctgctgaaggctttataccatccaagaaatcagtacctacttcagcttgatgatcgttcctctgagtctgaaagaatggatttagctatttcagttaaatccattaaggtgtttgaggaatatggaaacgtgaatgtcattgggaaaagttatgccatcaataggatgggatcttctgctctttctgctcctctgcatgctgctgctttgcttcttaaactaaacccagattgggactggttcatcaccttaagtgcttcagattatcctctcatgactcaggatgatatccttcatgctttcacatttttgccaagatatgtcaacttcattcattacactaacaagacagttcggaacgagcaacgagacattaatcaaattgtggtagaccaaagtttacactatgaaaagaatagtccacttttctttgctgtggagtcccgagataccccagatgcttttaagctatttcgaggttcaccctggatgattcttacaagatcctttatggagtactgtgttagaggatgggacaatttaccaagaaaacttctaatgttcttcagcaatgtggcttatcctctggaatcatatttccacacagtgctgtgtaactcccacgagttccagaataccactgtggacaataatctaatgtacagtctttgggacactgatccatctgaatcccaattacttgacatgtcacactatgatacaatgctggaaactggggctgcatttgcacacccatttggcgaagatgatgtggttctggagaaaattgatgatttgattcttaaccgatcatctagtgggttggttcaaggagagtggtgttcaaactcagaaataaacaagacaacaaaggtttcagaagctgaggaagagttctgctcgcaatctggcaatattgatgctgtaaaaccagggccatttggcatcaagcttaaaactctactagctgatattgagaacacaaggaaattcagaactagccagtgcaaatcctttgaaagttggtga

SEQ ID NO: 1413 - DNA, 513 bp, Glycine max var. Williams 82
atgggaggctcatggtcatggcagctcacatgtgccctcttgctactcttctccgccgtagtcaccgccactgaccacattgtgggtgcgaatcgtggctggaaccctggctttaactacactctttgggccaacaaccacactttctatgttggcgatcttatctcattcaggtaccaaaagaaccaatacaatgtgtttgaggtgaaccaaactgggtatgacaactgcactacagaaggggcagtggggaattggagcagtgggaaggatttcataccccttaacaaggccaagagatattacttcatttgtggcaatggccaatgcttcagtggaatgaaggtttccgttgtggttcatcctcttcctcctcctcccacctctgcagttgctgctcaacattcatcgccaaagtctgcttctcctgtgctcttaaaacgaggatttcgctcactgttggtgtctactgtttcagcttgctttggaattgtttggatttatcacttgtag

SEQ ID NO: 1414 - DNA, 1986 bp, Glycine max var. Williams 82
atggaaatctttcaagccacagcagaaaagatggagattaatcccaagagatttacaacattattctttgttgtacttttcatatcatttcctgttgctttcatagtttcttcaatctatcgaaactcaagtttcgctattttttatgaggggttaacagaatcatcggctcaaaacgttacaaacaatggttttccgttgggaggaagagtccacaatactacatcggatgatgagattgagactcacttaagaacaagacacaatgataccgtgtcggtggtgttgccgggcaatattcaaaacggtagcactgtagaagaaagagctagaactatgaatagtactgcatcaggaatagaaggcaaagtagaaagaggaacagatcggaacgtaactgctgagttgctgaatggtggagttaaggacctgcaagagagatcccaaaataatttcgctactgaaggaagatctgagaatatcacagcagcatatgctggctcgaaaaacgcttcactggcaagttcaacaaatgtgtcaaccacagaacctgttaatcttgatgacaatgacaaactgcttgggggattgttaacttctggatttgatgaagcatcatgcaaaagtaggatgcagtcccatttgtaccgcaaagcttctcctcataaaccttctccatatttgatatctaaactacgtaaatacgaagaaattcatagaaggtgcggaccaaatactagagattacgacaaaagcatgaaaaagattgtaagctccaagaacaatggtgctgctaccaaatgtaagtacattatctggaatactgccaatggtttggggaatcaaatgattagcatagctgcaacatttctttatgccatcctcactgatcgagtgctgcttgtaaaatttaataaagacaagcatggcctattttgcgagccatttctcaattcaacttggatattgccgcagaagtccccctttagttcttggaatgaacacaataccgaaacatatcagaccatgctagacaaggatagggctagcaattcaaagaagggtttaccatctgttctgtttattaatctacaattcagcttcgaaaaccctgagaaatattttcactgtgatcatagtcaagatcttctccggaagatccctatgttgattctgcggtctgatcaatactatgtcccatctatgttcatgaacccatttttcaacttggagattgccaacatgttcccagagagagacattattttccaccatttgggtcgctacctgtttcacccttccaacgatgcatgggaactaatcagcagttactatcaggcacacttggccagtgcaagtgaacggataggcttacagataagagtatttaatgctgctactactccaaagcaagcaatcatgaatctagttttaagctgcacattacagcaaaagatactgccagaagtggatttgaaaacttcagtgtcttctgctggaaaaaacatgactactgtaaaagcagttcttgtggcatctttacataaagagtacggggataatttacggagtatgtatctgaagaaaccaacagttagtggggaagtcatagaagtttatcagccaagtcatgaagggaagcaaaagtttaatgataatgggcataacctaaaagcatggacggatatgtatctgttaagtttatcagacgtgttggtgactacctctctctcaacatttggctacgttgctcaaggattgggaaatttaaagccatggcttctctacaggctagtcggtaaccatagcggcgattttccacgctgtgaacgggatttctcaacagagccttgctttcatatgcctcccaagcattactgcaacggagagcccatgaatgatatcgtttcttctttccccaatttgagggagtgcaaggatttaaggtttggtgtgaagctggcggccgttaacggttccatgtag

SEQ ID NO: 1415 - DNA, 1797 bp, Glycine max var. Williams 82
atggaaatctttcaagccacagcggacaagatgaggatgagttccaaaagatttgcaacactctttgttgtattcttcatatcattttctgtttttctcattgtttcttcaatataccgaaactcaagttattatgctatttttgaggggttatccaaaggcagggaagccggagaatcagctcaaaacgttacaatcaatagatttccattggaaggaacagtccacaatacatcagaagagaacttagtgtcggagcatgttaaggtgctgccaggaatttttcaaaatggttcagaagaaacgacaacgactaacaatagtattgcatcaagagtaggcccgaaaaatgtttctttgactagttcaacaactgagtcaactccagatcttgaagacaaagacaaattgctaggtggacttttaaccactggatttgatgaagcatcatgcataagtaggatgcagtcccaattgtaccgcaaagcttctcctcataaaccttctccatatttgatatctaaactacgtaactatgaagatattcacagaaggtgcggacctaatagtagagcttacgacagaagcatgagaaagattgtacgctcaaagaacaaaggtgctgcagctacattgtgtaagtaccttatctggacacctgctaatggtttggggaatcaaatgattagcatggctgcaacatttctttatgctatgctcactgatcgagtgatgcttgtaaaatttgacaaagacaagcagggcctattttgcgagccgtttctcaattcaacttgggtattgcctgagaagtctcctttctggaatgaaaagcatatagaaacatatcagaccatgctagagaaggataggaataggactagcaattcaaaggatgatttaccatcagttctgtttattaatctacagcacaccctcagtgagcctgagaaattttttcactgtgaccatagtcaatatcttcttcgggaagttcctttgttgattttgcagtctgatcaatactttgtgccgtctctgttcatgaacccatttttcaaccaggaggttaccaaaatgtttccagagaaagacacagttttccaccgtttggggcgttacctttttcacccttcaaacgaggcatggaaactgatcagcgattactatcaggaacacttggccaaggcagataaacggataggcttacagattagagtatttagtcccgtttctactccacaacaaacagtcatggatctagttttaagctgcaccttgaagcataagatactgccacaagtggatttgcaaacttcagccggaaaaaatcatagtgtaaaggcagttcttgtggcatctttacatagagagtatggagataatttacggagtatgtatctgaagaaagcaacagttagtggggaagtcatagaagtttatcagccaagtcacgaagagcatcaaaagtttaatgataataagcataatctaaaagcttggatagacatgtatctaataagtttatctgaggagttagtgactacctctctctctacttttggctacgttgctcagggattggggaatttgaaaccgtggcttctttacaggctagtcaacaatgacacccattttccatcctgtgaacgagatttctcatcggagccttgttatcatgttcctcccaagcattactgcaacggaaaacctatcaaagatgttgtttcttctttcccctatttgagggagtgcaaggattattgttatggtctgaagctggttaacagtacgtag

SEQ ID NO: 1416 - DNA, 1404 bp, Glycine max var. Williams 82
atggctgcaacttattatctacttccaagtccgaaaactttctcacctctcctcagaaatccactttccattccttcaggtcatgtttcactgttgggttcattggactatccattccattgttccagcagaagaggaaatagtgttgaggccaattgcaatgcaaagaagaagaacccttggttagacccttttgatgatggggaggatcctgagatggagtatggttccttgtttgcagatgggaagcaggaggaggatcctaggccaccggatgaccctgacaacccttatggattcttgaagttcccttctggatatgctgtggagatagcatccttggcattgaaagtgagaggggatgtgaggagatgctgctgtgtgatatctggtggtgtttatgagaacctcttgttctttccagctattcagttgatcaaggataggtaccctggtgttcagattgatgtggtggcgtccgagagggggaagcagacctatgagttgaataagaatgtgaggtgggctaatgcttatgatcctgatgatgagtttccagaacctgcggagtatactgatatggttggagttctaaagaataggtactatgacatggtcttaagcaccaaattggcaggccttggccatgcagcatttttgtttatgacaactgccagagatagagttagctatatctatccaaatgtgaatgccgcaggagccggattacttctgtccgatactttcgtacccgatagtctaaatctctcagatggaggatataatatgtatcatcagatggttgactggctaggaagaccatttcgagaagttccaagacaaccagtgccaccacttagggtctcaatctcaaggaagctgaaggaggttgtggaggcaaaatacgaaaaagcaggggcaaaaaaaggaaaatatgttgtaattcacggcataaaatcagattcaaaggcctccatgcagtctaggggtgatcctgatagcttgctacccattgaagtgtgggctgaaattgcagacgctataagggatgttacgccactttttgtcattccgcatgaaaaagaaagggaaaatgtggaggaaatattttcagaagatgcctttgttgtcttcatcaccacccctggacagctggctgctcttattaatgactcagctggagtgatagctacaaatacagctgctgttcagcttgcaaatgcacgccagaaaccttgtattgcactattttgctctgaagagaagggaaacaagtttgttccgcaggctaaagagaagaaatgcattataatatcatccaagacaggaaagttgatagatattgatgttgaggctgtaaaaaacgcggttcaaacattcaatttgtctccagctttagtatag

SEQ ID NO: 1417 - DNA, 1730 bp, Glycine max var. Williams 82
taacttctaatccaagaacaaacttgtaagttgagtacaagcaagcaaggcaaaagagaagcaacattgaaaagctcaatggctgcaacttattatctacttccaagtccgaaaactttctcacctctcctcagaaatccactttccattccttcaggtcatgtttcactgttgggttcattggactatccattccattgttccagcagaagaggaaatagtgttgaggccaattgcaatgcaaagaagaagaacccttggttagacccttttgatgatggggaggatcctgagatggagtatggttccttgtttgcagatgggaagcaggaggaggatcctaggccaccggatgaccctgacaacccttatggattcttgaagttcccttctggatatgctgtggagatagcatccttggcattgaaagtgagaggggatgtgaggagatgctgctgtgtgatatctggtggtgtttatgagaacctcttgttctttccagctattcagttgatcaaggataggtaccctggtgttcagattgatgtggtggcgtccgagagggggaagcagacctatgagttgaataagaatgtgaggtgggctaatgcttatgatcctgatgatgagtttccagaacctgcggagtatactgatatggttggagttctaaagaataggtactatgacatggtcttaagcaccaaattggcaggccttggccatgcagcatttttgtttatgacaactgccagagatagagttagctatatctatccaaatgtgaatgccgcaggagccggattacttctgtccgatactttcgtacccgatagtctaaatctctcagatggaggatataatatgtatcatcagatggttgactggctaggaagaccatttcgagaagttccaagacaaccagtgccaccacttagggtctcaatctcaaggaagctgaaggaggttgtggaggcaaaatacgaaaaagcaggggcaaaaaaaggaaaatatgttgtaattcacggcataaaatcagattcaaaggcctccatgcagtctaggggtgatcctgatagcttgctacccattgaagtgtgggctgaaattgcagacgctataagggatgttacgccactttttgtcattccgcatgaaaaagaaagggaaaatgtggaggaaatattttcagaagatgcctttgttgtcttcatcaccacccctggacagctggctgctcttattaatgactcagctggagtgatagctacaaatacagctgctgttcagcttgcaaatgcacgccagaaaccttgtattgcactattttgctctgaagagaagggaaacaagtttgttccgcaggctaaagagaagaaatgcattataatatcatccaagacaggaaagttgatagatattgatgttgaggctgtaaaaaacgcggttcaaacattcaatttgtctccagctttagtatagtggaagagggaaacgggaaagtgttctgaacctctggttaagtgatatattaactgtctatttttaattaataaagacaaatgtatatctacaaatttatagctcagttcatgttctgaatgagaagacgggaatgaaagtgaaaacattgtaaaaataagggttgagaaaacagagcaagacacaaagaaaaggtaaatccatatattctttgatccacatacaaaacaagagaaaaaaaaaaaggt

SEQ ID NO: 1418 - DNA, 1134 bp, Glycine max var. Williams 82
atgtcgggcccacccagagttcgatccatgaacgtggccgtcgccgatgccgacgcgcgcccggtgctcgtccccgccggcaacaaggtccgacccgtcgtcgaaggacggaagccggtgaagaaatcgtcgacggagacggagaaaaagccggtggcgcattcgccgcaatgcgtctccgttccggcggtggcgatttcgcggcagcaggagcaccaccaggcagtgctgaaaagcatgtcgtcgatgaacgcctcgttctcctccgacacgtcatcgacggattcctccactcacagcagcggcgcgtcgtcgagcgggaaggtgacgcgtcgggttagtgtggcgttgaggaagaagcaggttggtcctaagacggagaaggcgagttgtgacaatgtggctggttctgatgatgctgatttgagtgatagcttggagggcaagaaaagatgtgcttgggttacaccaaatacagagccatgttatattgcttttcatgacgaagaatggggagttcctgttcatgatgacaggaaactgtttgagttgctcagcttctctggagccttggctgaactcacatggcctactattcttagcaaaaggcagttatttcgggaagtctttttggattttgatccaagtgctgtttctagaatgaatgagaaaaagatagctgcaccaggaagtcctgccaactcattgctatccgaactcaggttgcgatccataattgaaaatgcacgtcagatgtgtaaggtaattgaagagtttgggtcctttgacacatttatttggaattttgtgaaccataagcctatagtcagccagttcaggtacccacgtcaggtacctgtcaaatctccaaaggcagaattcataagtaaagacctcgtaaggagaggattcaggagtgtcggtccaacagtcatctatactttcatgcaagtggctggcctaacaaatgaccatattatcagttgcttcagattcaaggagtgtacctccaatgcagaagcaatgggcaaagagagctccctcaactccaaggtcaaagagaaagcaaacgaggaaccaacctcggtgggtctgttgctgtctgtgaacaaattgagcttcacctctaagtag

SEQ ID NO: 1419 - DNA, 612 bp, Glycine max var. Williams 82
atggaggagtcaggggaaaattggccttccgataattcttatctggatgaggtcaacgatgaatttggtagtgaagatgaagagggaggttcattttctggaatgggcgagaccgacagaaagaagagaaagcgagaactcgcagagaggttccttgcactttcagccaccatacctggcttcaccaagacggacaagacttcaatcctggccaatgctagtagctatgtgaaacaacttcagcaacgtgtgagggagctagagcaagaagttcaatccaacgtttctagcaatgaaggtgccaccagctcttgcgaagtgaactcatccaatgattattactctggtggtggaccaaatgaaattcttcccgaggtcaaagtaagagtgttacagaaggacgttctcatcataatccactgtgagaaacagaagggcatcatgctcaaaatactttcccagcttgaaaatgttaatctctctgtagtcaacagtagcgtcttgcgatttgggaaaatcactctcgacatcaccattattgctaagatgggtgagggttacaagatgacggtggatgaactagtgaagaccctgagagtagcgatatcttga

SEQ ID NO: 1420 - DNA, 948 bp, Glycine max var. Williams 82
atgttacttagaagctcctccgcaccaattctaacttcattgttattctattccaaggagttcccctccgaaccagaacacattcttcaccttcctaaaacagcatcagctttaagtctaagccaaagcttggtggatatagaccttaaaaactcatcaagtcccaggagaaaaaatcgtgtgccacttagtaatgttcctaataatcaacagagtataaagatcaatgaaagatatgaagggaaagatccacaacaaaaaactttcatgaaagcaaaaccttcaattctagaactgttttcaagcttcgatttagacaagggagtcctggatcatgaagagtgtggtgcggggaagaaagatagttggttacagacttcagtgatgggtgctggaatggggagtgatggtggttggatttgtggtggttgtaatggtagtggaagaggctcagatggtggacatggaagaaggtggggtttcgatgaaggaaatgatcacggtagagataggacggatgcttattaccagaacatgattgaagcaaaccccagtgatgctcttttgctaggaaattatgctaagtttttgaaagaggtttgtgaagattatcctaaagcaaaagagtatctcgaaagggcgattttggctaatcctgatgatggtcatattctgtccctctatgcggagttaatatggcaaacagagaaggatgctgatcaagctgaaggatattttgatcaggccattaaaagtgccccagatgatagctatgtcctagcttcatatgctaatttcctttgggatgtcgaagaagacgacgaagataaagactgcaaaaataaatcggatcacagccatacatatccaaccgatctctttcatggaactaaccatcaccttcattcaactgtagccatagaagccttaccactgtttcttaagtga

SEQ ID NO: 1421 - DNA, 435 bp, Glycine max var. Williams 82
atgagcaggccaggagactggaattgcaggtcatgccagcacctgaactttcagagaagagattcatgccagcgatgtggggacgcaaaatatggagatagagttgattttggtggctttggaggaagaggagggtcttcatttggtttaactggctcagatgttcgccctggtgactggtactgtgctgctgctaactgtggtgcccacaactttgctagccgctcaagctgcttcaagtgtggtgctttcaaggatgacttggctggaagctacaacagttctgacatcttgcgctccagagcttttggtggcagtggaagacctggatggaaatctggtgattggatatgcaccagatcaggatgcaatgagcacaactttgctagcagaatggaatgttttaaatgcagtgctccaagggacacgtactag

SEQ ID NO: 1422 - DNA, 945 bp, Glycine max var. Williams 82
atgggttcagaagccactctaaagcttccggtcatcgacttcactaacctcaaattggaagccaacaatcctaattgggaggcaataaaatcccaagtccacaaggcactagtagattatggttgctttgaagcaatttttgaaaaagttcctttagaacttcgcaaagccatatttgctgcactacaagagctctttgatctccctctacaaacaaagatactcaatgtgtctaagaagccttatcatggttatgttgggcaatatcctatggtcccactttttgaaagtatgggcattgatgatgcaaatgtctatgaaaatgtagaaagcatgacaaacatcatgtggcctcatggaaacccaagttttagcaaaactatacaatccttctctgagcagctatcagagttggatcagattatcaggaagatgattttggagagtttgggtgttgaaaagtacttggaggagcacatgaactcaaccaattatcttctccgggttatgaaatacaaaggccctcaaaccagtgacacaaaggttggcctcacaacacactcagacaagaacatagtgaccatattgtaccaaaatgaagtggagggtttagaggtgatgaccaaagatggaaaatggattagctacaggccttcccctgacagtttcgttgtcatgattggtgactctctccatgcatggtcaaacggaaggctgcattcaccctttcaccgagtgatgatgagtgggaatgaggcaagatactctgcagggctgttctctatccccaaaggagggaacattataaaagccccagaggagcttgtggatgaggaacaccctctgctctttaagccttttgatcatgttgagtttctcaagtattattacactgaaaaaggccagagagatcaatttgcactgcgcacttattgtggtgtttga

SEQ ID NO: 1423 - DNA, 630 bp, Glycine max var. Williams 82
atgtttatccacattgtgttcctccttttccttctctcatccacttcccatgccactgtccaagacttctgtgtggcagacctcaaaggtgcagacacccctgcaggctacccctgcaagccacctgctaatgtcacttcagatgactttgtgtacactggcttagctgaagctgcaaatgtcacaaacataatcaatgctgctgtgaccccagcttttgttgctcaattcccaggtctcaatggccttgaactatctgcagcaaggttggaccttggtcctagtggtgttatcccactccacactcatccaggtgccaatgaactactcattgtgcttcaaggtcacatccttgctggattcatatcttcaggtaacatagtttatcagaaggtgctgaaaaagggagagctcatggttttcccacaagggctgttgcacttccaaattgctgttggtaagagaaaggcccttgcttttcctgttttcagcagtgcaaaccctggcctccaaatccttgactttgcactgtttgccagcaacttctccactcctttggtgacacagaccactttccttgatcctgacctagtgaagaagcttaagggtgttcttgggggtagtggctag

SEQ ID NO: 1424 - DNA, 1142 bp, Glycine max var. Williams 82
accattcattcccacattcccatttttcacaccaccaacacaagatgtttatccacattgtgttcctccttttccttctctcatccacttcccatgccactgtccaagacttctgtgtggcagacctcaaaggtgcagacacccctgcaggctacccctgcaagccacctgctaatgtcacttcagatgactttgtgtacactggcttagctgaagctgcaaatgtcacaaacataatcaatgctgctgtgaccccagcttttgttgctcaattcccaggtctcaatggccttgaactatctgcagcaaggttggaccttggtcctagtggtgttatcccactccacactcatccaggtgccaatgaactactcattgtgcttcaaggtcacatccttgctggattcatatcttcaggtaacatagtttatcagaaggtgctgaaaaagggagagctcatggttttcccacaagggctgttgcacttccaaattgctgttggtaagagaaaggcccttgcttttcctgttttcagcagtgcaaaccctggcctccaaatccttgactttgcactgtttgccagcaacttctccactcctttggtgacacagaccactttccttgatcctgacctagtgaagaagcttaagggtgttcttgggggtagtggctaggctagccttatggttaattaataattgcttattattttgctcaattcattacttttgtgctttcaattcgctaaacttgtccagctcaattgactgagctacgtgagtgactagttttaaatcctttaatatttatgtttgattcttacgtataaaaaaataaattcattagacttgtccaggtctcatggtcattgaattgctcgtgttaatgtgaagtaatttaataaactctcgtgcttgatttttgttttccatttctctgttccaaaactaaaaatgtgttgagatttgagtattgctatcttaagaagggttgtttgccaatgttgcctgagagtcttatccacattttccctggttgatacatgtcgggctaaggatgctatttgtcctttactatcacgcatgttttaattattacagttgtccacacgtctcgaaatatgttgttttattttgtttgcc

SEQ ID NO: 1425 - DNA, 465 bp, Glycine max var. Williams 82
atggcttctgttctgtccacttcgtcaatttcattggctactctctccttcaattctggggtcagaagaacaaccactcaccaaattaagaacctatccataatgggaagctctatgtttggtgagctaaaacttgtgaataaagtccagttaaaaagggcaacaaaaacgtcatttgcactctctggtggcattaacactataatctcgtgctccacggctgaactagaaactctgcaaattgtacaaagcacaattgcgaagcagctttctattgatgaagccactgtgactccccaaactaaattttcagatttgggtgctgattctcttgacaccgttgaaatcatgatggctttggaagagaaatttgacatttccattggagagggtggagctgagaacatctccaccgttcaagatgctgctgatctgattgagaaggtgacgaatgcttcaacctaa

SEQ ID NO: 1426 - DNA, 675 bp, Glycine max var. Williams 82
atggctaatgaaggaaagaaaagcaataacttctattcgatcttgggcttgagcaaggagtgcactgaattggagctaaagaatgcttataggaaacttgcaaagaaatggcacccagatcgttgttcagccaccgggaatttagagttagtggaagaagctaagaaaaaatttcaggaaattcgggaagcctattctgttttatctgacgccaacaaaaggttaatgtacgacgtgggagtctacgacagtgatgacgacgaaaacggcatgggggacttcttggacgaaatgttaacaatgatgagtcataccaaatcaaatgaaaatggagaggagagctttgaggagttgcaacagctttttgaagacatgtttcaagcggatattggattggatggaggcccttctcttgcttcttctgattcctcaacttcatctgcttacatgacttacagtgaaagttctagttcaaataaacgcaattcctctgagatgaatttcgggaaggcagagaattcttctgtctttgatgccagttaccagaatttctgttttggggtgaaccaactccaagatataaagaagggaaaggggggaattctaggaggaggaggtagaagtagacacagaagtggcagaaagcaaaaaatgttctatggccatgatgtttga

SEQ ID NO: 1427 - DNA, 1533 bp, Glycine max var. Williams 82
ggagtgttcatgaggccttttttgtgctcttcacctttcactccacggaatcaaaagcaagtgctaagaagttccgtgttcctattctcaaacctgtagcaccaaacccaagttgtcatccaagttttataatactacatatattattattatacgatacataacaatagtattaatattgttgtgattgtgtgtgatttttggtgtcgtccttttttcttatattaaggtggtacggagcttatatgtgttgattcaattcgtcgacaagaaaccttagtttgatatttgattggttctgtggagagttttcctttggtgtggttggtttgtgctgtttttggttgggaataggaatggctaatgaaggaaagaaaagcaataacttctattcgatcttgggcttgagcaaggagtgcactgaattggagctaaagaatgcttataggaaacttgcaaagaaatggcacccagatcgttgttcagccaccgggaatttagagttagtggaagaagctaagaaaaaatttcaggaaattcgggaagcctattctgttttatctgacgccaacaaaaggttaatgtacgacgtgggagtctacgacagtgatgacgacgaaaacggcatgggggacttcttggacgaaatgttaacaatgatgagtcataccaaatcaaatgaaaatggagaggagagctttgaggagttgcaacagctttttgaagacatgtttcaagcggatattggattggatggaggcccttctcttgcttcttctgattcctcaacttcatctgcttacatgacttacagtgaaagttctagttcaaataaacgcaattcctctgagatgaatttcgggaaggcagagaattcttctgtctttgatgccagttaccagaatttctgttttgggacaggtgaaccaactccaagatataaagaagggaaaggggggaattctaggaggaggaggtagaagtagacacagaagtggcagaaagcaaaaaatgttctatggccatgatgtttgatctaatgactaccctggaatttccaccaagtaatgacctgcaactaaaaatttggggggggaaggactaaggaagagcatagtttatacaacggccattgtaacttcctgccataccatgcaaaatctatggtggtggatattaattctataaatggattgggcctacagcacgtggagagagaccccacatggagctgggtacaaataaattgtcaattcaaaataaagcagatattcagatagacacttctagttcacttttgggtttgaaagcatttggggaccccaattcctagcaagtagccaagtatttttcattgccagagttgtgatttgtgggtccttgatgcacaataattggctggcttttgttacacaagttgtgtaacttgtgcttaacatagaatctggatgggcgtgcatagtttccaagtatttgagcaaaaaagggaaaaccacggcacccacaacttgtagtgttgtcattctcgttgat

SEQ ID NO: 1428 - DNA, 1065 bp, Glycine max var. Williams 82
atggaagaagaaaaaagcttcacctatgcaatgcagctggtgaactctagcgtgctatccatggccatgcactcagccatagagcttggcatttttgacatcatagccaaagcaggtgaaggtgccaaattatctgccaaggacattgcagccaagcttccatgcaagaattcagaaggagccacaatgttggatcgtatcctaaggctcctagtatgtcactccatcattgactgcacagtggttgctgatcaacaacatggtcctcctccacatctgcaacggttctatgccatgaaccctgtggccaaatactttgcttccattgatggtgctggctcactaggccctttgatggtcttgactcaggacaaggccctccttcatagttggtaccaattgaaagatgcaattctagaaggaggtattcctttcaacagggttcatggaaaacacgtgtttgaatattccgacatgaactcgagcttcaatcagcttttcatggcagctatgacaaaccgtgcaactttaataatgaagaagattgttgaatcctacaaggggtttgagcacctcaatagcctggtggacgttggaggtggccttggtgtcacacttaacatagtcacttctaaataccctcacattaagggtatcaattttgacttgccacatgtcatagaacatgcctctacctatcctggtgttgagcatgtgggaggagatatgtttgaaagtgtgccacaaggagatgccattttgatgatgtgtgtacttcatgattggagtgatgaatggtgcttgaaggtattaaagaattgttatgcttctattcctagtgatggaaaggtgattgttgtggatggaattcttccatttgaaccaaagacaacaggtgcatcaaagagcatttcccaatttgatgtactgatgatgactacaaacccaggagggaaggagcgaagtgaagaggaattcatggcattggcaaaaggagctggatacagtggcattagattcacatgctttgtctctgacttatgggttatggagttcttcaagtaa

SEQ ID NO: 1429 - DNA, 507 bp, Glycine max var. Williams 82
atggcctcaacctcttctgctctcactatatcctcttcttccacccttcttgatggcaaggctccaagacagtcaccagctgcttcccctcaatgtgtgagcctcccccctccccctttgcactctcagaaccgttcatggaagaccactgcttattgtcgcaaggttgctcgaaaagttatggcaatggccacaggagaggcaccagctgaagctaccccaactgaggtgccagagattgtcaagactcttcaagaaacttgggacaaagttgatgataagtatgcagtgagttcacttgccttggttggggtgattgcattgtggggctcagttggattgatctcagcaattgataggcttcctttgattcctgggattcttgagattgtaggcattggatacactgggtggtttgtatacaagaacatagttttcaaacccgacagggaagctttggtacggaaagtaaaagaaacatacaatgaaatactcgggagcaactga

SEQ ID NO: 1430 - DNA, 939 bp, Glycine max var. Williams 82
atgaaaacagagcatcatagaagaccttcaccttcgttaacacctatactcgtcaaaagagcaaaacccgccgcgtattttattctccttttgctaacgtacaccttaggttacttatcccaccacccttcttccacttcattaccactctcaccatcatcgtcgccatcgccatcgtcgttagaacctattattcggttctcaattaacaccaccgaggtgaacccgttccgagtcacaactcgctgcgccgatccaattccgccggagtccgttcgccggacgctcgttgaccgcctcttcaacggcacctcgccgtttgaaaactttccgccgccgcatgcggcggcaaagctccggcgaacgactaaagtcaagggatggggctccaccggcaaggttttcgagaatctcatccgccgggtgcggccgcgaaccgtcgtggaagttggcacgttcctcggcgcgtcggcgatacacatggccgagttgactcggcgactcggcctcgaaactcagatcctctgcgtcgacgactttcgaggctgggccgggttcagggaccggttcagtaaaataccgatgcaaaacggtgacgtttggctcttttaccagttccttcagaatgtggttacttttaaccagaccgggtcggtaatgcccgttccattttcgagcgggtcgaccctgatgttgttttgcgagtggggggtgtttgcggatttgattgagatcgatgctggccacgattttttatcggcctgggccgatattaatcgtggatttcggatcctccaacccggtggggttatattcgggcacgattatttcaccgcagcggataatagaggtgttcggagagccgttgatttgtttgccaaagtcaacaatcttaaggtaaatgttgatggtcaacattgggttatttattcttcctaa

SEQ ID NO: 1431 - DNA, 1425 bp, Glycine max var. Williams 82
atggctaacccaattccaattcgtgcatggtctcgcttggcctctctaagatcttcatcagctcccaatccagagtcacatcctaaacctcacacttcagaaccttctcttaaagcaacaaacacttgctctcgtgacaataatgaaagtgccaccaaatctctaccaacatcaccaaatgttcacaacccaatgcactctcaaaagctcaaactaattacccctatgacctttccacccgccaaattgaaggttcaccctcagccaagggtagaagtgaccattgaaaagcctaatggcaatgcttcactgaagactgaaccaggagaaatccaaaagcaaggcaatggcccaaatgaaaaacaagtgacaaacatagaaaatgaaaccaaagggaatggtattcaatcaaagctttcgagttctgagggaaatggcataagggtcataacaatttcaggggaaaacagaggtgcacacatgcaaataaccaaatcccgaaagaaacaacaacaacccattcatcacaagatgggaaattctgatggtgagaaagtgagaacactatcttcgcctccaatgagaggtgtgtacgggaacagcaatgtgcagtgtgtcaacaactcaatgttgttccacactagtttaaccaaccatgatcctggaatgcaccttattatcccaaaaaagccaattggtcaaggattccatctcaaggaacgtgttggtgtattgagagcatttcaaaacgccatggctaacccaattccaattcgtccatggtctcgcttggcctctctaagatcttctcctgctccagagtcacatcctaaacctcacactgcagaaccttctctcaaaacaacaaacattttttctaatgacaacaatgaaagtgccaccaaatctctatcaccaacaccaccagatgttcacatcccaattcaacaaaacctcaaacccactacccccatcacctttccacctaccaaactgaaggctcaggctcagcttcagactaagatatctgaagaagaagggaacattgaaaagcctaatggaaatggcaatggcatcggccaaaaaaatgaaaaagagatgacaaccacagaaaacgaattaaagaaagagaaaggtattcagacaaagatttcgggttctgggggccaatatggcataagggtcataacaatttcaggggaaaataaaggtgcatgcatgcaaataaccaaatcccacaagaaaccctatcccaaaatgagatctctgtatgctaacagcaatgtgcagtgcgtgaacaactcaatggtgttgcacagtagtttaacacaccatgatccaggagtgtaccttgttatcccaaaaaagccattaggccaaggattccacctcaaggaacgtgatggtagtggtcaacgcaattga

SEQ ID NO: 1432 - DNA, 738 bp, Glycine max var. Williams 82
atgaaccaagaaatgaatggggttgaggctgagaagaggcaagagaatggacatgagaaagtggattatgatgtgcaggagaaaatagactatgtgtttaaggtggtggtgataggggactcagcagttggcaagactcaaatactctcaaggtttgcaaagaatgagttctgctttgactcaaagtccaccattggggttgaattccagactaggactgtcactattaatggcaaagtcatcaaagctcagatctgggacactgctggccaagaaaggtatagggctgtaacaagtgcatactacagaggtgcattaggggcaatgctggtctacgacataacgaagaggcaatcgtttgatcatgttgcaagatgggttgaggagctgcgtgcacacgcagatagctccattgtgatcatgttggtggggaacaaagctgaccttgtggaccagagaatggtgccaactgaggatgcagtggagtttgctgaggaccaaggcctcttcttctctgagacttcagcactcagtggtgacaatgtggagagtgcatttctcaaattgctagaagagatcaatagggtagtgtccaaaaaggctttggaatgtggttatgggaaggagaatggtgacaacaatgttgttgcctcactcaatggaacaaaggttgatataatcttgggtcctgaattggaaattagtgagatgaagaaattgtcttcgtgctcttgttaa

SEQ ID NO: 1433 - DNA, 2013 bp, Glycine max var. Williams 82
atggcctattctgcagtttcagttcccatctctataacttcgtctgcaacgatggacatcacaaaagagaataaatttcttctccattcactctccaacaaaggcttattatgcaaacattcaacaagtgtaaggtcttactctactagcaataactgcatccaagccacatcaatgcaaccaaagcataaaagcaggaactccataatagtatttccacttcaactttcagtttccattcttccaaatccacttcgctccttcttatttgacacagaaacgaggagggaaatgaacatggggcagaagggtatcaataatattaaggaaaacatggtggaaagcagtgaagaagtgatgataaatagagctcgctgggttcagagattaacgggaattaagagatactggagaagaaaagtacctaaagagagcatggaaacagatataatatgcaaacacaacacgaatagtgagtgtgattgtgatgaagatgacagtgtttgtgtggcaggttatgaagaaggagatgaaaaagaggaaaatggacaagaagtggcatgtgatcgtgactcattctcaaagtttctggtcccggttccttggcctgataccaaactattctctaagctggctttcctgtgcagcatggcttatgtcataccacaaatcaaggctaaggacttggggagaaactatggtcttgaattcgtaacatcatctttggaaaagaaaggtgatgtgactaagataaaagcaaaacttgatcaggactccatttgtgtgcctatggatgcctcagactcagcagcctctcaagatgattcagagaaagagaaaggtgatgataatgaacagaagcatcaaatcaagcttgcctatgatattactgcctcagctgcttcttatgtccaatcacgcactaaggaccttctgtctcttgcttcgaagtcaaagaagcatagtggcaatggggatttcagtggaagagaagactctccatatgaggaggctgatgaaacaccaccggtttacaagtcaaagtatggagttaatgctgcagcattaacaatgactgttgtggctgcagcaggaacagcagtggaccttcagtcacttcgttcatcatcttgtgaatggtttgtttgtgatgatcccgacacacacactcgatgctttgccattcagggatcatattccgtggcatcttggaaagcaaacctctactttgagcctactacatttgagggcacggatgtacttgttcacaggggaatatatgaagctgccaagggaatatatgagcaattcatgccagaaataatggaccatttgaagaaatatggggatagtgctaagctccaattcactggccattccctagggggtagtctctcaattttggtctatttgatgctactgactaggaaggttgtcagtccctcaactcttctgccagtagtgacttttggttctccatttgtgttatgtggaggccaaaaattactcaatgagcttggcctggatgagagctacattcaatgtgtaataatgcatagagatattgttcccaggatcttctcatgcagttttcctaaccatgttataactgtccttaagcgcttaaatgggtcatttgtgtcacatccttgtcttgtaaaaaataagctattgtactcaccattgggtaaaatattcattctccaaccagatgagaaaacatctcctccacatcctttactcccattaggaagtggcttttatgctgtagacagtagcagatgtggatactctccaaatgttctcagagccttcttcaatcaaccacaccctattgaaacactaagcaatccaaaagcatatggctcagatggcacagttttaagagaccatgattgtaacaactatctaaaagcagtcaatggagtttttggacaacattcaaagattgttgtcaggacagggagatcaaagcagccacgaaaaacatttaagaaaaagatgagaaaataa

SEQ ID NO: 1434 - DNA, 2305 bp, Glycine max var. Williams 82
taggttctcgttgaaaacaggaaacgattctaatacgttttcttgcaaaatcaatatcaacacattaaactatagtctcaagaaccaaacttaaaaaacatcaaagcttagagctatgatgatccatgtgttacaaagacaagtgcagtgaagaatcttgcatacttacatagaagttacaagtcatggcctattctgcagtttcagttcccatctctataacttcgtctgcaacgatggacatcacaaaagagaataaatttcttctccattcactctccaacaaaggcttattatgcaaacattcaacaagtgtaaggtcttactctactagcaataactgcatccaagccacatcaatgcaaccaaagcataaaagcaggaactccataatagtatttccacttcaactttcagtttccattcttccaaatccacttcgctccttcttatttgacacagaaacgaggagggaaatgaacatggggcagaagggtatcaataatattaaggaaaacatggtggaaagcagtgaagaagtgatgataaatagagctcgctgggttcagagattaacgggaattaagagatactggagaagaaaagtacctaaagagagcatggaaacagatataatatgcaaacacaacacgaatagtgagtgtgattgtgatgaagatgacagtgtttgtgtggcaggttatgaagaaggagatgaaaaagaggaaaatggacaagaagtggcatgtgatcgtgactcattctcaaagtttctggtcccggttccttggcctgataccaaactattctctaagctggctttcctgtgcagcatggcttatgtcataccacaaatcaaggctaaggacttggggagaaactatggtcttgaattcgtaacatcatctttggaaaagaaaggtgatgtgactaagataaaagcaaaacttgatcaggactccatttgtgtgcctatggatgcctcagactcagcagcctctcaagatgattcagagaaagagaaaggtgatgataatgaacagaagcatcaaatcaagcttgcctatgatattactgcctcagctgcttcttatgtccaatcacgcactaaggaccttctgtctcttgcttcgaagtcaaagaagcatagtggcaatggggatttcagtggaagagaagactctccatatgaggaggctgatgaaacaccaccggtttacaagtcaaagtatggagttaatgctgcagcattaacaatgactgttgtggctgcagcaggaacagcagtggaccttcagtcacttcgttcatcatcttgtgaatggtttgtttgtgatgatcccgacacacacactcgatgctttgccattcagggatcatattccgtggcatcttggaaagcaaacctctactttgagcctactacatttgagggcacggatgtacttgttcacaggggaatatatgaagctgccaagggaatatatgagcaattcatgccagaaataatggaccatttgaagaaatatggggatagtgctaagctccaattcactggccattccctagggggtagtctctcaattttggtctatttgatgctactgactaggaaggttgtcagtccctcaactcttctgccagtagtgacttttggttctccatttgtgttatgtggaggccaaaaattactcaatgagcttggcctggatgagagctacattcaatgtgtaataatgcatagagatattgttcccaggatcttctcatgcagttttcctaaccatgttataactgtccttaagcgcttaaatgggtcatttgtgtcacatccttgtcttgtaaaaaataagctattgtactcaccattgggtaaaatattcattctccaaccagatgagaaaacatctcctccacatcctttactcccattaggaagtggcttttatgctgtagacagtagcagatgtggatactctccaaatgttctcagagccttcttcaatcaaccacaccctattgaaacactaagcaatccaaaagcatatggctcagatggcacagttttaagagaccatgattgtaacaactatctaaaagcagtcaatggagtttttggacaacattcaaagattgttgtcaggacagggagatcaaagcagccacgaaaaacatttaagaaaaagatgagaaaataacgttgtggtcaactttttattttcatgatagaaaaaatgtaaaaatcccttttattcataagaaaagaaaagggtaaaaatcagtttggaagtccatttatgtctag

SEQ ID NO: 1435 - DNA, 645 bp, Glycine max var. Williams 82
atgcaaatggcaattttgttaagaggaggagcacttggagattctagctttcgtttgtgttcattaacatcaacttcttctttgcatgtctcccaaaatgttgccatacccacctcatcatcatcatcatcatcactagtactacctttgattgcaagtaaatttaaaacggtcagcagaatcagaatcacctgctctgctgttcaagaatcatctcctagcacagcagctactgctgaaacaaaggaggaggtaaaggaagctccaaaagccgaaccggcaaagaaacctcctgctaaagctccagctaagcctctgcctcagatgatggaggaggatgtgatcccttcactgaaatcaatatttgaagcccaagaagatttctcaaatattgagctggtcttcaaggacaataagttggaaggttcctttttgaagaaaggcaacccctattcattttgggcattttttcccacaggaaaccttattggtccaaaggggttttctctgtcatcgtataactcgggagcaagcaccgttgagccatttctcattgatgaaaagaagattactgcaagacacattatcttttgggttaaaaaacgtttggcagcacaagggatcattcctgtatgggaagattaa

SEQ ID NO: 1436 - DNA, 492 bp, Glycine max var. Williams 82
atggcagcggcggcggcagtgacggtgctactcccacctaggattccgaccaccaccaacgttacccgctgctctgctttgccttctctccctcctcgcgtctccaacaccaaaaccactttgttctcaccttccctcaacaacttttcagtgtcccgaaaatcttctctgcttcagaccagagcttcttcagaggaatcatcctcagtagatgccaatgaggtgttcacagatttgaaggaaaagtgggatgctcttgaaaacaagtccacagtacttctttatggtggaggggctatagttgctatttggctatcgtcaattcttgtgagcgccatcaactcagttcccttgcttccaaagattatggagttggtagggcttggatacactggatggtttgtctaccgataccttctgtttaagtctagcaggaaggagctagctacagacattgaatcactgaagaagaaaattactggaactgaatag

SEQ ID NO: 1437 - DNA, 492 bp, Glycine max var. Williams 82
atgatttttgaaaatcggcttgcagccacaattttgtctgaaacaaatattttttactttcatattgtgatggaaagtgcagttacatataaaaaaaattatcccgtaggaattaaaaacgttatcagaaagttatatttgtctataatttcttggaacgttaatgatcacaacaaaatagaaacttcaaccacaactcatcaatataaacctcagattatatatatgtcatgctttcatggttgcaggtgttatgtttcacatcctcttttcatatgtctctcttttttatgttttatctttttaatttccatgacatccttttgtaacttttgtttagcttattttcttgttcttatctctctcctttttctgggtgtatatccacttggtatgaaattaataattattttcctacgtacatatgttgttaaccgcatgtcgcaggttttcccgaagaggcgagaacagttgctacacagttgtttttga

SEQ ID NO: 1438 - DNA, 510 bp, Glycine max var. Williams 82
atgggttttccggtcggttacgtggaggtgttcttcccgaacccgttcctgcacacgctggccctcctcggcctcctccgaaacctcgtattcttcctcttccacctcctcggactctccgacttcttcgaaaccgaggtcgcctggccggacccccgcccctcagacacggcggaggcacggcccccctccgtgtcggcgctcctgatccgggacctcctgcccgtcgccaagttcggagactccgacattgccgcccgacaaaacggctgcgcctgcgcggtttgcctgttcgagttctccgaggaggaggagattcggtgcatgcgcaactgcaagcacattttccaccgtacctgcgtggaccgttggatcgaccacgatcagaaaacttgccctctctgtaggaccccctttgtgccagatgatatgcttgatgattataatcaacgcctctgggctgctactggggttaacgagttttacaccgattacacttcttctttctga

SEQ ID NO: 1439 - DNA, 450 bp, Glycine max var. Williams 82
atgtggatgctgcatcgtgtgcattttgtgcgttccacaaccctagcaaatatggaatctgaagcactgatatggggtgacaaactcatactgaagggattgtcattccatggttttcatggagcactaccggaagaaaggaagctaggccagaagttcgtggtagatgttgatgcatggatggatctgaaagcagctggcaaatctgatcacttatcagatacaattagttacacagatatatatgatatagctaaggaaattcttgaagggtcacctcaaaaccttctggagtcagtggcacaaaaaattgcagtgactactctgacaaatcataagcaaatatctgctgttcgagtgaaggttgaaaagcctcatgtggcagttcaaggtccacttgattacttaggcgttgagatacttagacgcagaagcgatttgtcagaatag

SEQ ID NO: 1440 - DNA, 732 bp, Glycine max var. Williams 82
atgatgtcatcttttgttgttcttcatggcctgcatggctctcttctccgctcccagttcctaggccaagacaccctcactcatctctaccctcgtaacaaggcttccaccattcataacaagccaacaacagcacaaccacgtgccaaatttgacatgctgcaagtcttgggaggaagaggactatgcaatggagaagcaggtcttaaacaagagctgaagagggaacttggtgttgatgagaaggcaccagcatcagcaacaagtgacaaagagcaagagttagaggaggaatcatcaacaacacagtccttggcaagtgttgctgcagaagatggttttgagaaggaactgatggggttaactggggggtttccggggggtgagaagggtttgaaaaagttcattcaggaaaaccctcctcctctaaaaccaagtcaagggagcaaaagcctgaaactagcactgtctaagaagcctaaaccaccagaattgcctttgttgctgccagggatgattgccattgtgaagaacccgaataacccgttttacatgtactgtgggattgtgcaaagaatcactgatggaaaggcaggggttctctttgaaggagggaactgggacaggttgatcacgttcaggttggaagaacttgagcgcagagaaaaaggcccccccatgaagaaccccaagtcagctgtgctcgaaccgtttcttgaaaagaagtcatag

SEQ ID NO: 1441 - DNA, 492 bp, Glycine max var. Williams 82
atggcaaccaaaccaaaagttctggagctaactgttttgtccgcggagggtctccacgtaaggggtaaaccggcgaacaagaacgtgttcacggtggttcgcgcggagtcgttaacgagccacacgacggcgatggcaaacgggaacgagaacgggttccacacgtggaacgagaagttcagggtggagttggggccgcaagcgaggtgcttgacgattgaagtgaagtgcaagacggagaccggagtggtgagagacatcggagtggcgagaatagcggtttcggattttcttggagggtcggtgcctgatcatagcttgcagtctttgtgttacaggttgagggattgggatggcagagaaaacggagtcgttaatttctccgtcagggtggcggggccgccggctgctgctgagaatgattgttcgtcgtcttctggtggagttgttactgccattccggtttatttgaataactcaatcgacaactag

SEQ ID NO: 1442 - DNA, 540 bp, Glycine max var. Williams 82
atgggaataaacacacgtacactagaaatcaccgttatctccggcgaaaacctccgcgtaacggaggacgcgtacgtcgtcgttcgggcggagtccttaaactgctgcaccacgagaaccgccaaggacgacggcaccaaactcctctcgtggaacgagaagttcctcttggacatgcccatgcatgcaaggtccataaccttcgaagtgcaatgtaacaggttcaagggctttcggccgctcggggtggcccgaatcgccgcctccgatttcctcggcggcgccgtgccggaaaatggcttgcaggtgctgagttacgggctgagggactgggaagggaggcggaacggggtcattcattttgccgtgagggtggcggcgacgtcgtcgtcgacggaggagtgtttgaattcgaagcccgccgtggaaccggtggtgccgagaaagggttgcggtgatcgaatcaatgtcggtggcaataagtccgatgaagttgctgttggtgttccgatatggtggaactaccccaacattatttag

SEQ ID NO: 1443 - DNA, 3333 bp, Glycine max var. Williams 82
atgagtataaccttatggtttttcttgttgcccttctgcctcataaacttgagcaccaacatcattttggcaactggtcattgtcttggccatcaacaatctttgttgctccaattgaggaacaacctcatattcaattccaccaagtccaaaaaactgattcactggaaccaaagtgatgattgttgtgaatggaatggagtggcatgcaaccaaggccatgttatagctcttgacttgagccaagaatccatctctggaggtattgaaaatttaagcagtctcttcaagttgcaaagtttgaatttggcctataatggattccattctgggattcctccagagtttcaaaagctaaagaatttgaggtatttgaatttgtcaaatgctggctttgaggggaaaattccaattgagatctcttacctgacaaagttagtaactcttgatttgtctagcacagttacttcacaacatgctttaaaacttgagatgccaaatattgcaatgcttgtgcagaacttcacagaaatcaaagtgctacatctggatggcatagcaatatcagctaaaggaaaggtgtggagccatgctttatcttcacttacaaacttgcaagtcttaagcatgtcatcttgtaatctctctggtcctcttgattcttcattagcaaaactacaatctctttcaatacttcaattggaccagaataatttagcaagtccagtgccagagtctttgggaagtttgtctaatttgaccatcttgcaacttagtggctgtggattgaatggagtttttccaaaaatcatttttcaaataccatcattgcaggtgattgatgtgtctgataatccaagtcttaatggttctctagcaaactttcgaagtcaaggttccctctataacttcaaccttagccacacaaatttttctggacctctgccaatgtctattcacaatttgaaggaattgtctaaattagatctttcgaactgcaagttcatagggacacttccttattcaatgtcaaacctcacccaacttgttcatctagatttgtcattcaataactttactggtcctattccatcatttaataggtccaaggccctcacagttttatcccttaatcataatagattcaagggtacacttccatccacccattttgagggccttacaaatctcatgagcattgatttaggagataactcctttgatggaagaataccctcatctttatttagacttcaatctcttcagcatctcatgctttattacaataaatttgatggtgtgttggacgaatttccaaatgcttctttgtcatcattagagatgcttgatttgagtggcaacaattttgaagggcctattcccatgtctatcttccaactcaaacgacttcgtttgctgcaactttccaaaaacaagttcaatggcaccatacaacttggtatgcttgggaggctgcaaaatttgtcttcactggatctaggacacaataacttgttagttgatgcaggcattgaggatgaccatgacgcatcatcctttcccagtttgaaaactctttggttggcttcatgcaatttgagagaattccctgactttttgagaaataaatcttcactactctacctagacttatctagcaatcagattcaaggaacaatacccaactggatttggaaatttaattctatggttgttttgaatatttcttacaactttttgacagatattgaagggtctttacagaaacttagttcaaatttgttcaaacttgaccttcactcaaaccatctccaagggcctgctcctacttttttgaaaaatgccatttacttggactactcaagcaatagattcagctctattaactcagtagacattggtagtcacattcctttcttgtattttctctccctttcaaacaacagttttcaaggaagaatccatgaatccttttgtaacatttcagatcttcgagcacttgacctttcccataacagattcaatggtcagatccctatgtgtttgacaagtagaagtagcactctcaggctactaaatcttggtggaaatgagctcaatggatatatttcaaatacattatcaacttcatgttctttgaggtttttggatctcagtggaaatcttttaaggggaaccatcccaaaatctttggctaattgccataaactacaagttctaaaccttggaaacaatcaactagttgacagatttccatgcttcttgaagagcatctcctccctcagagtcatgattttaagatcaaacaaattgcatgggcctattggatgttccaatagcattggcagttgggagacacttcaaattgttgatttagcctctaacaatttcagtggtacattaccagcatcactcttactgagttggaaaacattgatgcttgatgaagataagggtggacaatttggtcatctatattttgatctctatgatgactttaatcctatgaattttataactgcaattgtagatctcaaccatgagctacaaatcaagttagccaaaattatagcattagagccacatttaataatagaccacataatctctcatatctttgaggagggtgttggtgttcgagcttatgaggattcggttacaattgtcaacaaaggtagacagttaaatttggttaaaatcctcattgccttcacgtctttggatttctcatccaacaattttgaagggccaataccaaaagagcttatgaatctcacagcactacatgctcttaacttgtcacaaaattctttctcaggtagcatcccttcttccataggaaatctaaaacatcttgagtccttagacttgtcaatcaactctttaggtggagagattcctatggagcttgcaaagttatcatttcttgctgtcatgaacatctcttataatcatttggtggggaaaataccaacaggtacacaaattcagacatttgaggctgattcatttatagggaatgaagggttatgtggacctccattgaccccaaattgtgatggtgaaggagggcaagggttgtcaccaccagcatctgaaacacttgattctcataaagggggttcaattgaatggaatttcttaagtgtagagttggggatgatttttggttttggaattttcatctttccccttattttttggaagagatggaggatatggtattccaagcatgtagatgacatcctttgcaagatcgtccctcagcttgattttgtttatgtgcagcgtgggggacaaaattatagaattatgaggtggaagccttattga

SEQ ID NO: 1444 - DNA, 1902 bp, Glycine max var. Williams 82
atgggttccgaagagagcggcacggaaattcagaatccaacacacacacaaacacaacaacatagtaatcctactaatgtttcttcccccgaaaatcacgctaacggctaccaacacgtcaccgccaacaacaatgacactgaaatcacttcccatcatggcggtgaacacgcccagagtgacaggcaagtaactctagttgtccaccctcattcccttcttcccatgcccgtgccaccgcagagtttcaaagtaagccataacgacgtcgtttccttgaacgactcgaacttctccgtaggaagcttcctccgccagcgcagcagcgacctctccgccgcgatcgtgaaacgcgtctcctctctccgccaatccatggaagaaaacaacgacaacgatatcgacggggaagagaatcgcgaagtgacggagttcaacctctccggcgtcaaggtcaccgtgacgcccaagccggagaaggaaacctccatcaaaggacgcatcagcttcttctcgaaatcaaattgcagagactgcaccgcggtgcggagattcttcaaggagaaaggaataaaatacgtcgagataaacgtcgacgttttcggcgagagagaaagagagctgcgcgagagaaccgggagtggttcggtgccgcagattttcttcaacgagaagctgatcggaggtttggtggcactgaactcgctgcggaacagcggggagtttgaccggagagtggcggagatcgtcgccgggaaggtcgccggcggcgacgcgccggcaccgccggtttttgggtttgattacgtggaggaggagcgcgcagacgagatggttggggtggctagggttttgaggctgagattgccgattcaggaccggttgaggaggatgaagatggtgaagaactgcttcgaagggaacgagttggtggaggcgctgcttcagcacttccactgttcgcgtaacgaggccgttgacatcgggaaacaattatccaagaagcacttcatccatcatgttttcggtggaaatgattttgaggagggaaatcacttataccgtttcctcgagcatgaaccctttatacccagatgctttaattttcgtggtaccacaaatgatactgaaccaaagactgcagattcaatatgcgcgaggcttaccaagattatgtctgccattcttgaatcttatgcctctgatgataggcaacatgttgattatgaggccattagcagaagcgaagaatttcgtaggtatgtaaatttgactcaggatctgcagcgagtgaatctcttggaactatcagagaacgagaagcttgcgttcttcttaaatttatataatgccatggtcatccatgctgttattagcgtagggtgtcaagaaggcgtaattgataggagatccttcttaagtgatttccagtatctggttggagggcatccttattctcttaatcttattaaaaatggtatcctcagatgcaatcggaggtcaccatattccttagtaaagccctttagcacaagggacaagcggttagaggttgctcttatcaagttgaatccgctattacactttggactttgcaatggtacaaagtccagcccaaacgttaggttcttcacaccacatagagttgtagatgaattaagaggtgctgcgagagagttctttgagaaagatggaattgaagtggacctggagaagagaacggtttatctaactcggattttcaagtggttcagtggggattttggacaagagaaagagatattgttgtggataattaattacttggatccaaacaaagccggccttgtgacacatctcatgggagatagtggaccagttcatatctcttaccagaattatgattggtcaataaattcttga

SEQ ID NO: 1445 - DNA, 1146 bp, Glycine max var. Williams 82
atgcctattttgggcattatatttttatctttcacgcggttgaccaataatgcattttccacgagcctgtttgttttaatatataaaaaaggaatttatcttctgagagaaattgcaagacataaccattggaagagaataatggagttactgggtttacttgtgttgttattgggtagtagcatcatggcaaatggtgcagtttctgaagtttcttggagagaaatcagcaatatcaatagtgaagggccttaccttggtatagtggtgccaaattcctttgagcttggtcctcttcttcgttcatctagctttgtgcctcataacaagtttccttactttgattttgccggaaaacattttcgcattggtgtattggaaaagaaaagggttattgttgttatgtgcggattgggaatgctaaatgcaggtctttccacccaattgctgcttaccttatttaatgtgaatggagttctccattacggaattgcagggaatgcaaatcctaaactccagattggagatgttactattcctcaatattgggcccacacaggactttggcattggcagaggttaggagaagtaaatgtatccggagatttcagcagagactttggctatcttgagtttgccaattacaataactgctcaaaagatttcaagtcaaatacaaatcttttgaacaaagtgtggtatcaaccagaggaaatttatcccgtgaatggaattcctgaagctaggcacgagattttctgggttccagttgacaagacttactttaaaatcgcaagcaagctcaagaatgttaagttggaaagttgtgtcaacacaacttgtttgccaaggaagcctattgtgacaagagtagagaaaggggttactgccaatgtgtttgttgacaacaaagcttatagagaatttttgtattccaaatttgatgcaactcctgttgagatggaaactgctgctgttgctttagtatgtctccaacaaaagaaacccttcattgccattagatcactatctgatttagctggtggaggttctgcattgtccaacgaagtagatgtgttttcctcattagcatcccaaaatgcatttgaagttcttgtcaaattcatctccctgttaactcagtag

SEQ ID NO: 1446 - DNA, 1032 bp, Glycine max var. Williams 82
atgaagatgaagttattaggtttacttgtgttggtattgggcagtacaatcagtgccaatggtgcagtttctgaagtttcttggagagaaatcagcaaaatcaatagggaaggaccatacgttggtatagtggttccaaatgcctttgagctgaatcctcttcttcgttcacctagctttgtgccacataacaagtttccttactttgattttgccggaaaacactttcgcattggtgtattggaaaaaaagagggttatagttgtgatgacaggattgagtatgctaaatgcaggcatttctacccaactgttgcttactctgttcgatatagaaggagttgtccattatggaattgcaggaaacgcaaatcctaaactccaaattggagatgttactattccccagtattgggctcacacgggactttggaattggcagagatttggagatggtcctaaggatgcactagctttagaagccagtggagattatagcagaagatttggttatcttaagtttgccgattacaataacaacacaaaacattccaagtccgcgacaaatcttctgaacaacgtctggtttcaagcagaggaaattttccccgtgaatggaactgctgaagttaggcaacatgctttttgggtttcagttgacaaaacttactttgagattgcaagagagctcaagaatgttaaattaagtaattgtgtcaatacaacttgcttgccaagaaggcctattgtggtgagagtagagaaaggggttagtgctaatgtgtttgttgacaacaaagcttacagagagtttttgcactctaaatttgatgtcactgctattgacatggaaagtgccgccgttgctttaatctgtctccaacaaaagaaacccttcattgccattagatcactatctgatttagctggtgacagttctactttgtctaatgaagtggatgtgtttgcctcgttagcatcgcaaaacgctctagatgttgttgtcagatttatctccttattaaatcagtag

SEQ ID NO: 1447 - DNA, 1608 bp, Glycine max var. Williams 82
atggaagagaattctgctctggaacaccattgttactaccctcttcctgcttctgctgcaaaagctgatcatcccaatcataatgatggtgaaaaagaagaaacttgtgcagaggaaggtagctctcaacatcagcctaacacatcacagaattgtgtttcataccaaagcaataagcctcgcctcaacagatatgcacttggtggtgctatcttggcttccacaaactccatcctcttaggctatgatattggggtcatgagtggtgcttctcttttaataaggcaagatctaaagatcacatcagtccaagtagaaatccttgttgggtgcttaaatgtgtgttccctgataggatctcttgcttcaggcaagacctctgattggattgggagaaggtacaccataatggttgctgcagcaacattcctgattggtgctattctgatgggtttggccccttcattcccattcctaatggcaggtcgtgtagttgcaggcattggtgttggttactccctcatgatctcaccagtgtatgtggctgagctctctcctgctctcaccagaggctttctcacatcactccctgaagtcttcatcagtgttggaattctacttggttatgtctccaactatgccttctcaggtctcccaaatggcatcaactggagactcatgcttggccttgcagccttgccatcaattgcagtggcacttggtgtgttggcaatgcccgagtcgcctcgttggcttgtagtgaaaggaaggtttgaggaagcaaagcaggttttgattagaacatcagagaacaaaggagaagctgaattgaggcttgctgagatacaagaagctgctgctgcttctgcttccatcacaaacatggacaaagcaacaacttctgatggttcttttaatggacaaggggtttggaaggagttgcttgttacacctactagccctgtgttgagaattcttgtggttgctattggtgttaacttcttcatgcaggcttctgggaatgatgctgtcatgtattatagcccagaagtgtttaaggaggctgggattaaggatgagaagcagctttttggtgttacaatcatcatgggaatagccaagacttgctttgttttgatatcagccttgttcttggacccggttgggaggaggcccatgttgttgttgggctcatgtggcatggcaatctcattgtttgtgctgggcttgggctgtaccttgcttaagttatctggtgataacaaggatgaatgggtcattgctttgtgtgtggttgctgtctgtgctacagtatcattcttttctattgggcttgggcctacaacttgggtctactcttcagagattttccctttgaggctaagggcccaaggttccagcttggccatttctgtgaaccgtttgatgagtgggattgtgtccatgacattccttagtgtttcagaggcaataacatttggaggcatgttctttgtgctttgtggggtgatggtgtgtgccacacttttcttttatttctttttaccagagaccaaaggcaaaagcttagaagagattgaagctttgtttgaagatcaagcacattga

SEQ ID NO: 1448 - DNA, 732 bp, Glycine max var. Williams 82
atggcaagttatcagaagcactacgatgatcagggtcgcaaggtcgacgagtatggcaatgttgagaggcaaactgacgaatatggcaacccggttcatgccactagtgtcacttatgtagccactaaaagtgttggtggctacaatgatgacactaataagcaacatgataccaccggtgtctatcctgagaaagataccggtaggcatcattttggtcgtggttacgatggtgacactaataagcaacaacatgatgctattggtgtttatcccggaatagacattggtagagatcatgagactaccggtgtttatggcctaaacaccgatagacatcatggaacgactggtgtcaatcccggaatagacacccataaccaacaacatgggactaccggtggttatgctggtgacactggaaggcagcatgggaatacaggtggcctttactatggaaccgacaccgcggacacaggaaccggtcctagaagtggaaacaccggtggcaccggttatggaggcactggtggtactgattatggaacagctggtggcactggttatggaagtggaactggctatggaatcaacactgggggtgcgcacactgaagcagggtatgggaaggagcatcgtcagcatgagcaatctcatggtggtcagcacgagaagaaagggatactggacaagattaaggagaagcttcctggaggacacagtgacaagtag

SEQ ID NO: 1449 - DNA, 177 bp, Glycine max var. Williams 82
atgtacggatccaaaatgggcattacatattgtagggcatatactttgcaggattttccaagtgagtataccccgcaattgttcagtgattcgcaaaggtggcctctgtatcagtcaatggacaacgtacggatgcattacaaagggatcaggcttctcattccagatttcatgtga

SEQ ID NO: 1450 - DNA, 2032 bp, Glycine max var. Williams 82
gataaaataaatataaaatttctcttctatattatttctctcctctttactaacaaaaaaaatgattgaatgaatgaatagcgtaaaaaacaatacgtagtaacatgtgaaggtgggtgtgtattatatatgtaaggaagtgcgcttacatagtaaaaaaagaggggccaaggctcatcccgtcaaagaaaaaaatgacgggaaagctataaatggaggtaagaacgaacgaagttgcaaagcaaagaatagaagacgaagggtatagagctcataacaatccatttggtcttaatttgtttctgttttcttcattctgtcagccatatatggcttccttggcgacggtgcaagatgaacgttgcgttcagagaagctactggattgaacataccacagatttgtccgtagagtcaatgatgctcgattccaacgcctctgatctcgacaaggaagaaagacccgaagttttgtccctactaccagcatatgaaggaaaatcagttgtagaacttggagcaggtattggaagattcacaggtgaattggccaagaaagctggccagttgcttgctgtggatttcattgagagtgctataaagaagaatgaaagcattaatggacaccacaagaatgtcaagttcatgtgtgctgatgtcacttctccaaacttgcatatttctgaaggatcagttgatctgatgttctccaattggttactcatgtatctttcagataaagaggttgagaatttagctgcaaggatgatcaaatggttaaaagttggtggatatgtattcttcagagaatcatgtttccaccaatctggagattccaagagaaaatacaacccgactcactatagggagcctagattttacactaaggtatttaaagagtgccatacgagtgatgatacccggaattcctttgaactttcccttgttggatgtaaatgtattggagcttatgtccgaaataagaagaatcaaaatcagatttgctggatatggaaaaaagttagatcacaggatgatagggggttccagaggttcttagatagtgttgagtataatcataaggatattttactttatgagagtgtttttggtcaaggttttgtgagcacaggaggacttgaaacaaccaaggaattcgtggcaaagttgggactaaaacctggccagaaagtactggatgttggttgtggtactgggggaggtgacatttacatggcagaaaattttgatgttgaggttgttggcattgacctctccataaacataatttctcttgccattgaacgtgctattggactcaaatgctgtgtagaatttgagtgtgccgattgcactaaaaaaacatttcctgtgaatacatttgatgtaatctattcccgtgacacattgttacacatcaaagataagccatcactattcagatcattttacaaatggttgaagcgtggaggtacacttctgattactgattactgcaaaagtgaaggaagtctatcattaggatatgctgagtatataaagaaagggggatattatattcatgacatgaaaacatattgtcggatgctcgagaatgctggatttgatgatgttgttgccgaggatcgaactaatttgttcatgaaaacactacaacaggagttaaatgcccttcacagcaagaaggatgatttcattgatgacttctcggaggaagactacaatgaaattactgaaagatggaaggccaagcagatgcggggggcagatggtgaacaaatatggagcttgttcattgccaagaaataataattcttcttctcatgatatgtcttactttgcctatatttagttcagtgtgaacagttttccaaatgatagtttggataactattttgttgttatttatatcttctgagcaaaatgtttctgcgttctagcaaaagataatcaaaacttctatccgttctcttctatttgaatgtgatgtttactaattatggcttccatgctcaaaatagatttggttgccc

SEQ ID NO: 1451 - DNA, 318 bp, Glycine max var. Williams 82
atgaacaaagatgaaaggtttgcacaaaagggtgtcccaatacatagccaggttatgaagatcaggcaagagtcagagaaaattgttgattggtccccgggcaagccagagataagacccgttctccgtgaaataagccggcagatttcccggtcgccgttggggatctccggcagaccgatttccgttggtggaagagggaggatttgtgtgcttcccctgctcctgttctgttttcctctgttcctcaattttgaatggtttagtcatatacttagaaagaggtttaaaagaagaagaaaagtaagattcaattag

SEQ ID NO: 1452 - DNA, 318 bp, Glycine max var. Williams 82; identical to SEQ ID NO: 1451

SEQ ID NO: 1453 - DNA, 1071 bp, Glycine max var. Williams 82
atgtctttactttcagacctcatcaacctcaatctctcagaatccacagaaaagatcattgctgagtacatatgggttggtggatctggtatggacctcagaagcaaagccaggactcttcctgggccagtgagtgaccctgcaaaacttccgaagtggaactatgatgggtctagcacagatcaagctccaggggatgacagtgaagtcattctatacccacaagctattttcaaggacccctttaggagaggaaacaatattcttgtcatttgtgatgtgtacaccccagctggtgagccacttccaaccaacaagaggtatggtgctgccaaaattttcagtcaccctgatgttgctgctgaggaaccatggtatggtattgagcaagagtataccttattgcagaaagatgtaaattggccacttgggtggccccttggtgggtttcctggaccacagggcccatactactgtggaattggtgctgataaagcctatggccgtgatattgtagatgcacattacaaagcttgtatttatgctggcattaacattagtggcatcaatggagaggttatgcctggccagtgggaatttcaagttggtccttctgttggtatctctgctggagatgaggtgtgggctgctcgctacattttggagaggattacagagatagctggagcaattgtttcatttgatcccaagcctattccgggagattggaatggagctggagctcactcaaactacagcaccaagtccatgagagaagagggtggttatgaggtgatcaagaaggccattgaaaagcttggattgaggcacaaggagcacatcgcagcatatggagaaggcaacgagagacgtctcacgggaagacatgaaactgcagacatcaacaccttctcttggggtgtggcaaaccgtggaagctccattagagttggaagagacacagagaaaaatggcaaaggttacttcgaggacagaaggcctgcttctaatatggatccctatgtagtcacctccatgatcgcagagactaccatcctctggaaaccatga

SEQ ID NO: 1454 - DNA, 537 bp, Glycine max var. Williams 82
atggtatccaaacctgtggccaactcgatgctttttctgaggattgttgctctcgctgcctcagctgcaactgtggccttactatttactaacaaggtcaaatttgatgatggaacaaagttgagatttcaagatttctattcataccggtatgaagcagtgatagcaataattggtggtgcatattgtatactgcagttaccatttgccatatattatgcggtaaagcagaagaggttgatacgtaatgggttcttgccagaatttgacttctttggagacaaggtaatttgcgtgcttctggccacgggcgttggtgttgggtttgcagtgtctttggaatttaagaagttcttcgatgacatatttgactctgtgggtaccccaaagaaggaccctacaaggaccacatatgacaagttttttgttcgaggcatagtggcttcagctattctccttgttgcatgcctttccatgactatcgtttcaatcatctcctccattaatcgaagcagaagcaaaggcgtttttaattaa

SEQ ID NO: 1455 - DNA, 801 bp, Glycine max var. Williams 82
atgagaaaacgtatcaatatggaaagtgatgctgacttcaattcctttgccacatcctcctcttccaccacaccttcaatcttctttgacactaacacttctagcacatcctcctcctcaacatctcctacctcaaattcagaatcatgcaccaaagaacactccaaaacacctcaaaatgactcaaccacttctcaaacctcattggaaaatggaaaggactcaaaagggtgcaagaagaggcagatagacaatagcaaccagaatcaccaccctacttataggggtgtaaggatgaggaattggggcaaatgggtgtccgaaatccgtgagccgagaaagaagtcaagaatatggctaggaacataccctacagcagaaatggcagctagagcacatgatgtggctgccttagccatcaagggccattcagcatacctcaattttcctgaattggctcaagagcttccaaggccagttagcacatctcctaaggacattcaagctgcagctgcaaaagctgcaaatactgcctttgaggaggttaggcattgtcaaataactgaagaagaagcagaacaaaaccaagcagaacaagcttcatcttcaactctctcaatggacaatcctcaagagccttcaagttctcattctaccattgatgatgacactttgtttgaccttccagatcttttccctgatggaaacaatggactttgctccttttcttcttcttggcatttgtgtgcagttgatagtggctttaggcttgaggagtcatttttttatgagaaccattag

SEQ ID NO: 1456 - DNA, 2883 bp, Glycine max var. Williams 82
atgggagaggggtccgtggaacttgaggctattgtaaaggaagctgttgatctggagaacattcctcttgaggaagtttttgataatctcaaatgcacaagagaaggtttaagctctgagcaagtacaacagaggcttgacttgtttggatacaataagcttgaagaaaaaaaggaaagtaagatactgaagtttttgggctttatgtggaatcctctgtcatgggttatggaagctgccgctctcatggccataggcatggcacatggagggggcgaaggtggagattatcaagattttgttggcatagttcttttgctacttataaactccaccatcagtttcatagaagaaaacaatgctggcaatgcagctgctgcccttatggccagattagctcccaaagcaaaggtacttcgcgatggaaaatggagtgaagaagacgcttcagtgttggttccaggagacataattagcatcaagcttggtgacatcattcctgctgatgcacgcctccttgaaggtgatcctttgaagattgatcagtctgctcttactggagagtcacttcctgtctccaaacatcctggagatggagtatattccggttcaacttgcaagcaaggagaaattgaggcagtagttattgcaactggagttcacaccttttttggaaaggcagctcatcttgtggaaaacacaacccatgttggacattttcaaaaggttctaacatctattgggaatttctgcatctgttcaattgctgttggtatgatttttgaaatcattgtgatatatggaatccataaaaagaaataccgaaatggtgttgataacctgcttgtgctattaattggtggcatccctattgcaatgccaactgtcctttctgttacaatggctattggttcacacaagttggctcaacagggtgccataacaaagagaatgactgccattgaagagatggctggaatggatgtgttatgtagtgacaaaacaggcacattaactcttaacaagctttcagtggacaagaatatcattgaggtttttgctaaaggggttgataatgatatggttgtacttatggctgcaagagcatcaaggctagagaaccaagacgcaattgattgtgctatagtttcaatgttggcagacccaaaggaggcacgagctggaataaaagaagttcacttccttccattcaatccaactgataaaagaactgcacttacataccttgatgctgctggtaaaatgcacagggttagcaaaggtgcaccagagcagattctcaatcttgcacataacaaatcagaaatccaacagagggttcatgcaattattgacaagtttgcagaacgtggacttcgttctcttgcagttgcccgccaggaagtacctgagggaactaaagacagtccaggaggaccatgggagtttgttggccttctccctctttttgatcctcctcgccatgatagtgcagaaacaattagaagagctcttgatcttggcgtgagtgtaaaaatgatcactggtgatcaacttgcaataggtaaggaaacaggaaggcgtctagggatgggaactaacatgtatccttcttcatcactgcttggtgaaaataaagatggattgggtgctgtcacagttgatgatctcattgagaatgctgatggttttgctggagtttttcccgagcacaagtatgagattgtgaagaggttacaagctagaaagcacatttgtgggatgactggtgatggggtgaatgatgcccctgccctaaagatagcagacataggtattgctgtagcagatgctacagatgctgccagaagtgcttctgacatagtcctaacagaacctgggttgagtgtgatcataagtgcagttttaactagccgtgctattttccagagaatgaaaaattacacaatatatgctatatctatcactattcgtattgtgcttggtttcatgttactgaacagcttttggaaatttgactttcctccctttatggttcttgtcattgccattctcaatgatggtaccatcatgacaatatctaaagatagagttaagccttctccacttcctgatagttggaagcttagtgaaatttttacaactgggattgttcttggcagctatctagctctaatgactgtgatcttcttctatatagttgttgaaacaaacttctttcctgaccattttggtgtgaaacacttttcctataatccagatgctgatataaaagatccaaccaaaagaatgttgggatctgctgtctatcttcaagtcagtacaattagtcaagccttaattttcgtgacacgctcaaggggttggtcctacacagaaagacctggtcttttgcttgtcactgccttcatcattgctcaagcgattgcaactgttgtatctgccactgtcacctggcaacttgctgggatcaaaagtattggttggggctggacaggagtcatttggttatacaatactataacttatctatttctagatcctttaaagtttgctgttcgttacgcattaagtggaagggcttggaatacagtgataaaccaaaggactgcattcatcaacaaaaatgactttggtaaagaagctcgtgaggctgcatgggcaaccgagcagagaaccttacatggcctccaatctgctgagtcaaaagggtttacagacaagcacaccttcagagaaattaatacattggcagaagaggctaggaggcgtgcagagatagcaaggttgagagagcttcacactctgaaaggtagagtggaatcatttgccaagctaaggggtctggacattgatgccatgaacggacactacactgtttaa

SEQ ID NO: 1457 - DNA, 969 bp, Glycine max var. Williams 82
atggaagagtcaccggaaaggtggcttcgttttttggaaatggatgagtgcaatttatttggtcacatgcactctcttgtggaagtgttcaagggggagaatctagtgcaacaagaaaaatcttgcaaaagtcacccttgtgattcaaatatcactaaagaaagcaccaccatccttcttaggaaccctataaatgattcatcatctttggaaaagaaccctggctttgataaccgtagtagtctcaaacaacatgcatctcaagatgaacctctcttctcatcctcctcaatgccctacactctttcatttgaagattcaacggcagtgccatatgttctcaataaaacatgccaatgttatcatggtgaaaattcaaaggaaacccaagaagaaccaaaaaataatagaaaatctaagaggggtagaagctcttctgagatacaagatcacataatgagtgagagaaagaggagagagaatatcgccaagctgttcatagcactttcagctgttattccggtgttgaaaaagacggataaggcttctgtccttaaaactgctatcgattatgtgaaatatcttcagaagcgtgtaaaggatttagaggaagagagcaaaaagagaaaagtagaatatgcagtatgcttcaaaacgaacaaatacaatattggtactgttgttgatgactcagatatacctatcaatatacgtcccaaaattgaagcaagagtctcaggaaaagatgcgctcatcaaagttatgtgtgagaaacgaaaggacattgttgctaagatcctgggcaagcttgcagctcttaatctctcaatagtttgctgcaatgttttgccgtttgcaaattccgctctgaacattacttgcattgctcagatggatcatgaattcaccatgacactggacgacctagtgaaaattttgactgaggacttgttcgactgctgtaactaa

SEQ ID NO: 1458 - DNA, 4554 bp, Glycine max var. Williams 82
atgcctttggaggacttctacaagatatttggtgccaccaagttcaaaagtctgttttggacttcatggcagcccttagaatcaacatgcttgttggagcatattattttacctgtggaacttggtttcttagtgatcttgttattccaactcctaagaaaatatgtgagccagttcagcaagcaaaccaaggtcccagatggtgccacaaaaatgatgcatccaactgcaatcaaatttggttttgcatacaaactcacctttgtttgcaccacattgttgttggttgttcattcatcacagctattgctgatgctcaataatgagactcaatgcacctcaaaacttcaggccttcacatcagagatagttcaagtgctatcatggtcaattagtcttatagcaatatggaagatatcaaaatcacacacatatttcccttggattctgagggcttggtggctttgcagtttcattttgtgtatcataaccacagcccttcatgcccatttcagtgtcatcaacaatggtcagattggtttaagagaatgtgcagatttccttggtttgcttgcttcgacatgccttttggttatttccacaagagggaagacaggcactgtccttcttgccacaaatggtgcatctgaaccacttcttggagagaaagctgagaggcattcagagtgtctaaaggaatctccatatggaaaagccacacttctccaactcataaatttctcttggctcaaccccttgtttgcagtagggtataagaaaccccttgagcagaatgacattcctgatgttgacatcaatgactctgctgagtttctaacatgctcctttgatgagagccttaggcaagtcaaagagaaagatggcactgctaatccatctatctacaagtcaatctacttgtttgctaggaagaaagcggcaatcaatgcattgtttgcagtggtaaatgcttcagcatcatatgttggtccatacttgataactgactttgtggatttcctaggagaaaagggatcgcgcggcttgaagagcggataccttctgtcactggcttttctgtgtgccaaaatggttgagaccatagctcagaggcaatggattttcggtgccagacaattaggccttcgccttagagcggcattgatatcgcatatatatcagaagggcttacatctttcaagtagatcgcggcaaagtcacacgggcggtgagataatgaattacatgagtgtagatgtgcagagaatcacagattttgtttggtatgtgaatgtgatatggatgctgcctattcaaatttctttggcagtgttcattttgcatacaaatctaggactaggttcattggctgcattagctgctacattggcagtgatgactttgaacattcctcttacaaagatacagaaaagataccaagccaagatcatggacgccaaggacaacaggatgaaagccacttcagaaatcctcagaaacatgaggactttgaaacttcaagcatgggacagacaattttctcaaaggatagaagcacttaggcagatagagtacaattggttaatgaagtcattgaggcaagcagcattttctgctttcatcttttgggggtcacctacattcatttctgtgataactttttgggcatgcatgttcatggggattgaactgacagcaggaagggtcttgtctgcatttgccacgttccgaatgttgcaggatcctatatttagcctgcctgacttgctcaatgccattgctcaaggaaaagtttcagtcgataggatcgcttccttcctccgcgaggaagaaatccagcatgatgtcattgaaaatgttgcaaaggacaaaacagaatttgacatagttattgagaaagggagattcagctgggatcctgaatcaaaaactccaaccattgatgaaatagagttgaaagttaagaggggaatgaaggtagcagtttgtggatctgtaggttcaggaaagtctagtttgctatcaggccttttgggagaaatatataaacaatctgggactgtgaagatcagtggaacaaaggcttacgtgccacaatcagcatggatactgactggaaacataaaggacaacattacctttggaaaagagtacaatggtgataagtatgagaagactattgaggcatgtgcattgaaaaaggactttgagctattctcatgtggtgacatgacagagattggagagagagggattaacatgagtgggggacagaagcaaaggatacagattgctagagcagtttaccaggatgctgacatttacctttttgatgaccctttcagtgctgttgatgctcacactggcacccacctctttaaggagtgccttatggggattctcaaagagaaaactataatttttgttacacaccaagttgagtttcttccagcagcagacctcattctggtgatgcaaaatggaaggatagcacaagctggaaaatttgaagatcttctaaagcaaaatataggatttgaagttttagttggtgctcacagcaaagctctagagtcaattattgtggctgaaaattcaagtagaacaaatttaaattcaatagctgaagaaggggaatctaacttcagctccaagccaagtcatcaacatgtgcaaacacagcatgactcagtgcaagacaatcctccagagggcaaaggaaatgatggaaagttggtgcaagaagaggaaagagaaacaggaagcatagcaaaagaagtttactgggaatatttgaccactgtcaaagggggaattctggttcctctcattctcttggcacagtcttcattccaaatacttcagattgctagtaactattggatggcttgggtttgtcccacaagtagtgatgctaagcctatatttgacatgaatttcatactacttatttatatggcactctcagttgctggttcattttgtgttttgctgcgagccatgatggtgttaaatgctggactttggacagcacagacacttttcacaaagatgttgcatagtgtgctccgtgcccccatggcattttttgattctacaccaactggaagaatattgaacagggcttccacagatcaaagtgtgctagacttggaaatggcaaacagaataggatggtgtgctttctcaataatacagattctaggcactattgcagtgatgtgtcaggtggcatggcaagtatttgtcatcttcattccagtaactgcagtctgcatatggtaccaacgatattatacgccaacagcaagagaactggctcgcttagcacagatacaaatcactccaattctccaccatttttcagaatcattagcaggagcagcatcaatacgagctttcgatcaggaaggccgtttcatatacacaaatcttctccttgtggatggcttctcaaggccatggtttcataatgtgtctgcaatggaatggctttctttcagattgaatttactttcaaattttgtttttgccttctcactagtcatgctagtgagcctccctgaaggaataatcaatccaagtattgctgggttggcagtaacatatgggatcaatctgaatgtgttgcaagcttcagttatatggaacatatgcaatgcagaaaacaagatgatatcagttgaaaggatccttcaatatacaaatataacaagtgaagcacctcttgtgattgaagacagcagaccacctagcaactggccagaaactggaacaatatgtttcaaaaatttgcagatacgttatgctgaacatctgccatctgtgttgaaaaacatcacttgcacatttcctggaaggaagaaagttggtgttgtagggcgtaccgggagtggaaaatcaactctcatacaggccattttcaggattgttgaaccaagagaaggaagcattataattgacaatgtggacatatgcaagataggtctccatgacttaaggtcaaggcttagcattattccacaagaccctgccttgtttgaaggcactgttagaggaaacctggacccattgcagcaatactctgacattgaagtgtgggaggctctagataaatgtcagctaggtcacctagtaagggccaaggaagagaagttggaattcccagtggttgaaaatggtgataactggagtgtgggccaaaggcaattattttgccttggaagagccctgctgaagagaagcagcatattagtactagatgaagcaacagcctcagtggattctgcaactgatggggtgatacagaacatcataagccaagagttcaaagataggactgttgtcacaatagctcatagaatccacacagttattgatagcgatttggttttggtgctcagtgatggaagagttgctgagtatgatgaaccatcaaagttactagagaaagaagattccttcttctttaaacttataaaggagtattctggaagatcacataacttcagcaacttggcaactcaacatgtccaaagcagggagcaattatag

SEQ ID NO: 1459 - DNA, 6097 bp, Glycine max var. Williams 82
atttatattgttccctttatgtttactaattaatcttctgatttttgtcacaggccaatttttatcttctgtataaatccgtatgtttgttttgggtaataaatagcaatgctcttctatgattacatgaggatcacatgttcaaattcaagaaacaatctctcttataatatgaataagacaatatacatctgcgttcctagacttaacaagtaaaaatatcgtgtacttgatcgttctttttttaatagttacttagaaatttatttgtcaatagattatttttttaattaatgtaattatgaaggttggtttctaggtgaaattctaagatatctttcgatttcttagactggttatgttattagtcttcaatcaagacttaatcacacataaaactttttatgttgaaaacatgttgggggaaaatcaaacttaaatattttttatgaactcaaaaatatgttgtcaattaagttaatcattaaagttattaattgaactctagtacattcatctcttcatcttgatttgcttttaacattcatgggtccatcagatctgttttttgtaatatgcttctcagcttttgctatccttctttgcatactgaagaccacgaactaacatcgaacataacttgccaaaatccaattatgtagacacgcacgtgacgtctaacagtccaatttcctttctcaacacgaaaattgaccagaaaaataaatatatattttggtcacataattttgcctttaaaaacttgttccttccctctttctattgatgaaaagcactatagtactcttagaaatctcctctgcctcttctctctctatatgacaccctcgccttttccctttttctctaattcccatgcttgcttcctctgctctcaaaagctctaaacccattaaaatgttagtgaactaaaaatagaattggagcttcaagttgagaagcaagcatgcctttggaggacttctacaagatatttggtgccaccaagttcaaaagtctgttttggacttcatggcagcccttagaatcaacatgcttgttggagcatattattttacctgtggaacttggtttcttagtgatcttgttattccaactcctaagaaaatatgtgagccagttcagcaagcaaaccaaggtcccagatggtgccacaaaaatgatgcatccaactgcaatcaaatttggttttgcatacaaactcacctttgtttgcaccacattgttgttggttgttcattcatcacagctattgctgatgctcaataatgagactcaatgcacctcaaaacttcaggccttcacatcagagatagttcaagtgctatcatggtcaattagtcttatagcaatatggaagatatcaaaatcacacacatatttcccttggattctgagggcttggtggctttgcagtttcattttgtgtatcataaccacagcccttcatgcccatttcagtgtcatcaacaatggtcagattggtttaagagaatgtgcagatttccttggtttgcttgcttcgacatgccttttggttatttccacaagagggaagacaggcactgtccttcttgccacaaatggtgcatctgaaccacttcttggagagaaagctgagaggcattcagagtgtctaaaggaatctccatatggaaaagccacacttctccaactcataaatttctcttggctcaaccccttgtttgcagtagggtataagaaaccccttgagcagaatgacattcctgatgttgacatcaatgactctgctgagtttctaacatgctcctttgatgagagccttaggcaagtcaaagagaaagatggcactgctaatccatctatctacaagtcaatctacttgtttgctaggaagaaagcggcaatcaatgcattgtttgcagtggtaaatgcttcagcatcatatgttggtccatacttgataactgactttgtggatttcctaggagaaaagggatcgcgcggcttgaagagcggataccttctgtcactggcttttctgtgtgccaaaatggttgagaccatagctcagaggcaatggattttcggtgccagacaattaggccttcgccttagagcggcattgatatcgcatatatatcagaagggcttacatctttcaagtagatcgcggcaaagtcacacgggcggtgagataatgaattacatgagtgtagatgtgcagagaatcacagattttgtttggtatgtgaatgtgatatggatgctgcctattcaaatttctttggcagtgttcattttgcatacaaatctaggactaggttcattggctgcattagctgctacattggcagtgatgactttgaacattcctcttacaaagatacagaaaagataccaagccaagatcatggacgccaaggacaacaggatgaaagccacttcagaaatcctcagaaacatgaggactttgaaacttcaagcatgggacagacaattttctcaaaggatagaagcacttaggcagatagagtacaattggttaatgaagtcattgaggcaagcagcattttctgctttcatcttttgggggtcacctacattcatttctgtgataactttttgggcatgcatgttcatggggattgaactgacagcaggaagggtcttgtctgcatttgccacgttccgaatgttgcaggatcctatatttagcctgcctgacttgctcaatgccattgctcaaggaaaagtttcagtcgataggatcgcttccttcctccgcgaggaagaaatccagcatgatgtcattgaaaatgttgcaaaggacaaaacagaatttgacatagttattgagaaagggagattcagctgggatcctgaatcaaaaactccaaccattgatgaaatagagttgaaagttaagaggggaatgaaggtagcagtttgtggatctgtaggttcaggaaagtctagtttgctatcaggccttttgggagaaatatataaacaatctgggactgtgaagatcagtggaacaaaggcttacgtgccacaatcagcatggatactgactggaaacataaaggacaacattacctttggaaaagagtacaatggtgataagtatgagaagactattgaggcatgtgcattgaaaaaggactttgagctattctcatgtggtgacatgacagagattggagagagagggattaacatgagtgggggacagaagcaaaggatacagattgctagagcagtttaccaggatgctgacatttacctttttgatgaccctttcagtgctgttgatgctcacactggcacccacctctttaaggagtgccttatggggattctcaaagagaaaactataatttttgttacacaccaagttgagtttcttccagcagcagacctcattctggtgatgcaaaatggaaggatagcacaagctggaaaatttgaagatcttctaaagcaaaatataggatttgaagttttagttggtgctcacagcaaagctctagagtcaattattgtggctgaaaattcaagtagaacaaatttaaattcaatagctgaagaaggggaatctaacttcagctccaagccaagtcatcaacatgtgcaaacacagcatgactcagtgcaagacaatcctccagagggcaaaggaaatgatggaaagttggtgcaagaagaggaaagagaaacaggaagcatagcaaaagaagtttactgggaatatttgaccactgtcaaagggggaattctggttcctctcattctcttggcacagtcttcattccaaatacttcagattgctagtaactattggatggcttgggtttgtcccacaagtagtgatgctaagcctatatttgacatgaatttcatactacttatttatatggcactctcagttgctggttcattttgtgttttgctgcgagccatgatggtgttaaatgctggactttggacagcacagacacttttcacaaagatgttgcatagtgtgctccgtgcccccatggcattttttgattctacaccaactggaagaatattgaacagggcttccacagatcaaagtgtgctagacttggaaatggcaaacagaataggatggtgtgctttctcaataatacagattctaggcactattgcagtgatgtgtcaggtggcatggcaagtatttgtcatcttcattccagtaactgcagtctgcatatggtaccaacgatattatacgccaacagcaagagaactggctcgcttagcacagatacaaatcactccaattctccaccatttttcagaatcattagcaggagcagcatcaatacgagctttcgatcaggaaggccgtttcatatacacaaatcttctccttgtggatggcttctcaaggccatggtttcataatgtgtctgcaatggaatggctttctttcagattgaatttactttcaaattttgtttttgccttctcactagtcatgctagtgagcctccctgaaggaataatcaatccaagtattgctgggttggcagtaacatatgggatcaatctgaatgtgttgcaagcttcagttatatggaacatatgcaatgcagaaaacaagatgatatcagttgaaaggatccttcaatatacaaatataacaagtgaagcacctcttgtgattgaagacagcagaccacctagcaactggccagaaactggaacaatatgtttcaaaaatttgcagatacgttatgctgaacatctgccatctgtgttgaaaaacatcacttgcacatttcctggaaggaagaaagttggtgttgtagggcgtaccgggagtggaaaatcaactctcatacaggccattttcaggattgttgaaccaagagaaggaagcattataattgacaatgtggacatatgcaagataggtctccatgacttaaggtcaaggcttagcattattccacaagaccctgccttgtttgaaggcactgttagaggaaacctggacccattgcagcaatactctgacattgaagtgtgggaggctctagataaatgtcagctaggtcacctagtaagggccaaggaagagaagttggaattcccagtggttgaaaatggtgataactggagtgtgggccaaaggcaattattttgccttggaagagccctgctgaagagaagcagcatattagtactagatgaagcaacagcctcagtggattctgcaactgatggggtgatacagaacatcataagccaagagttcaaagataggactgttgtcacaatagctcatagaatccacacagttattgatagcgatttggttttggtgctcagtgatggaagagttgctgagtatgatgaaccatcaaagttactagagaaagaagattccttcttctttaaacttataaaggagtattctggaagatcacataacttcagcaacttggcaactcaacatgtccaaagcagggagcaattataggactttatggatattaactaatatattggagaggaactttgtgacaccctctaccccacacatatatgtactaataataaaaggaataggaatgcggaattaattaaaagttttaaaacacatttaaataaaagcatttcaaaaagggtaaaagattcacatttacttttctaacatcataatagaacttgttcaaataaataataaaatcatctcgatcatacccggttcggcctggccgatcggaccagtccaaccgggactagtttcactattggatcgctcatgcatgtgacccgggatggcccggccaagcccggccaattttgtgaaaacccggtgacccggctggttttaaaaacccagactgggttgtgcacattaaaaaaataatgggagtgcagaaaacaataatgggggtgcttaaagtttattcacactctttttgtttattaggaaattgggcttctgggctcattttgtttacgaaaattggacttgtgttttaatttaggttgttgttatttatacttttttattactaatacacttcacttgtgttatcaactttaatac

SEQ ID NO: 1460 - DNA, 1302 bp, Glycine max var. Williams 82
atggagagcagctgcattctggcttttcttttcctcctcattctccactcaagtacaacaaaagctgccttcagtgttggtggtggagttggtgtaggtgtaggtgtaggtataggtgttggtgttggtgttggcaatggaaatggtggcagtggtggagtggtttgggttggtggagggattaacagcccagagccacctagatcttcagtgccaaagcttgaaggagcatacacagcacttcaggcatggaaatctgcagtcactgaggaccctcttaagattttatcaagttggattggtcccaatgtgtgtgcttacaaaggagtcttctgtgctgcaaaccctcaagatgaaacggttggtgcatcagcagcattcccagttgtagtagcaggcatagatctcaaccatgcaaatctgaaaggaactcttgtgaaggagctctctctactcagtgatttgtcccttctccacctcaacagtaacagattcactggcactgttcctgaaacattcagtgaccttgtgtttctggaagagttagacctcagcaacaaccaactctcaggtcctttcccttctgctactttgtacatgccaggcctcatctacttggacctcagattcaactacttctccgggtccctccctcaggaacttttcagcaagaaccttgatgcattgttcctcaataataaccaatttgaaggtgaaattcctcaaaacttgggcagttccccagcctcagtgataaacttagccaacaacaagttaagtggaagcatcccagcaagtttgggcttcatgggttctaaaataaaggagattctgttcctcaataaccagttaactggatgcattcctgagggagttggactattcacagagatgcaagttctggatgtgagcttcaactcactcatgggtcatttgccagacacactatcatgcctgcaagacatagaagttctcaatttggctcataacaagctctctggggagttatcagatgtggtgtgctctttgagaagccttgcaaatctaactgttgcttacaatttcttttctgggttcagccaggaatgctcaaggcttttctttaggaatgttggttttgatttctcactaaactgcattcctgatagggacatgcagagacctccacctgagtgctctggcataccaggtggaagtcttagttgtctcagaatccccacaccaaggcctcttgtttgtggttcaatggctgtaagtaagtctaagaacattattgatcccacttcatcatctcctccttga

SEQ ID NO: 1461 - DNA, 951 bp, Glycine max var. Williams 82
atgtctgtcagcgttgagggctctgcctttggggcactatttgaagaaaaaaatgtccattctgaagacagcaacgagcttgtgttgcatggtgcatttccattggctaaacatgagagacagaatggatttaatgccacagacatgaatgcatttggaaactccttcaggaactatgatgcagaaagtgaaaggcaaagaatggtggaggaattatataggatgcaacacatcaaccagacatatgactatgggaagagaatgagggaggagtatgggaaattggacaaattagaaatgggtatatgggagtgttgtgagctgctcaatgaagtgacggatgatagcgatcctgatttggatgaaccacaaatacaacatttgttgcagtccgctgaagccattagaaaagactatcctaatgaagattggttacatttaactgctcttattcatgatcttggaaagatccttatgcttccaagctttggtggccttcctcaatggtctgttgttggagatacatttcccctcggatgtgcttttgatgagtcaaatgttcaccacaagcatttcaaggacaatccggataacacaaatcctacttataacacgaaaaatggaatctacaaagaaggaattggactagacaatgttgtgatgtcatggggacatgatgagtatatgtatttggttgcaaaggaaaacggcaccactttgcctccagtagcattgttcattatcaaataccattctttttacgctttacatagggcaggagcatatacacatttgatgaatgaagaagatattgagaatttgaagtggctcaaaatatttagcaaatatgacctctacagcaagagtaaagttctagtagacatagaaaaagttaagccatactatatgtcgctcatcgagaagtatttcccagcaaagcttaggtggtga

SEQ ID NO: 1462 - DNA, 2479 bp, Glycine max var. Williams 82
accaaagaagtgacatggagagaggagtgagtggatcaccccaaaagaaagaaccggtcgcatccaagtggtttttgctgacacaacctgttgtagccggtcatttggcaccatgttactggctagtcccttcctaggatatttagtggtcaaatttttgcaaacaatttagttggggttgcgaggggtttaagaacaaacacaggcttggggtggttttcaggtgggttttgtttgatcagacaatagcctaagtctctaggagtgattatatgagatatggtgttgcagaagaggttgaactatggttttaatggctatcaggtgcctgtcattcctagagcttcaaggtcagctagagggaggggcacaatcaagaagaaacccgacaacaatcagatacaggcttttgaaatgttggctagcgtagcgggcaactttttgcagaagaatgagagttctgatcctaaaaatgttgtgtttgtggaagatccttgctctttctgtggtactaacataaaggacaaatatgaggatgaaaggaggtcatttatgagggactcgtttgaccatggagcttgcagtgaaattgcctctgcctttgtcccaagtatgcaagggaaacatgacaaccatagaggcatgggggattcatcttttcttgacaatcatcttgaaggccaaggacaaaatgtccttgagagggaagatgaaaggatcaaaaggagaagtgtaaatgggaaaaccatccacattaaaggttgctccgatgggttaatagaaccatgccacaaagtatccaaacattgtagtttagctaataatgcggaaaaaccatcgttggagtgtcgcaagcatcttgattcttttcccaatggttttacttctaggaaattagttaatagagatgatgatgaaaacttagttaggtgcacacaactgaactccaagaataataatacatctggcgcaccacctgatatgccaaaattgaaggatgcaagtcctattatgagtgatgagaacaacagtagggacattttcgagtttgaaaatttacaacggatgtatccatttaagaagaggaaattcttcaatcagaattcatcttctacatctgatagggggtctcaatgtcaaggcatgtttgattcttctgacaccaccagggttaatggcacaaaccatgcaattgaagaatcgtcctctatagttggtcaacaagcacattctgggtccagggcttgtaatgtgaagctcagcataaaatcctttaaagtcccagagctttttattgatataccggaaactgcaaccattggttcattgaaaaggacagtaatggaggctgtgacaactatacttggagatgaattacatgtgggcatccttcttcagggaaagaaagttcgagatgatagcaaaactctaatccaaactgggatatctcaagatgacaaacgtcatagattgggatttatgttggagccaaggcatactccaatttctccaacttcatacaatgatgacccttgttttctaaccactagttcgcgaaaaaaattatccaggcaatcaacatctttaacattacaacaaggaacgtataatgtatccaaagaacgttctatgatcaaaattgaaagttgtgctaagggtgatcttaatatagtctcctctctggaagatacttcaactaacaataacatgtcaaagtgtcgtgctctagtggcagttcctgccattaacatggaggcattggcggtggttccattctggcgcaaatctggaaatcctgactttgcacaacgccgaatcaggaggccattctctgttctagaagtagaagcattggttcaggctgttgaaaaacttagaactggaaggtggcgtgatgtcaaacaacgtgcttttgatcacgcaaagcatcgaacttatgtggatttgaaggataagtggaagacactagtgcacactgctagaatctccccgcagcaaaggaggggagaacctgttcctcaggagcttctggatagggtcttagctgctcatgcctattggtctcaacaccagtgtaagcatcaacttaaaccactgtgagtcatttcaatcattgaaggacgcagaagaacaaacacattgttgcaaaagtacagtttccagagtgaagtagtgtagttatgataaaagttgatagtatataacgtttacataatatactcatgtgattccataatttatcctccctaagcctgataatgttttggttgcttgtacatgattgttttggcctaaaggaatatggtgtcactcataccaccccttgtggtcgattgctggtatgctatcaatatgcatactagaatatataataaataatgtatagtagttaaacctcttagaacttgtttcttggttgtatcttcattgttactagccattacaatgacataaaggaatacatatgaacaaatacaaa

SEQ ID NO: 1463 - DNA, 1740 bp, Glycine max var. Williams 82
atggattccccccactttccttcatttgcatctctcagagttcttctgtttggtttctgcgttataactttgtttcctgagtttgtagtgagcataacaaggcactacacatttaatgtggagtacctgaacgtcactagattgtgccacacaaggaacattctgagtgtgaatgggaaattcccaggacctcgcttggtggcaagggaaggtgatagggttgtggttaaggtggttaaccatgtctcaaacaatgtatccattcattggcatggcatccgtcagataacaactgggtgggctgatggaccagcatatgtgacacagtgccccatacaaaccaaccagtcatacacatacaacttcaccatagttgggcagagagggactctgctttggcatgctcacatatcatggctgagagcaaccatctatggacccatcatcatcctccccaagcacaatgagtcttttccattcgagaagccacacaaagaaatccccatactttttggggaatggtttaatgttgacccagaagcagtcataagtcaagccttgcagacaggagggggacccaatgtttcagatgcatacaccatcaatggacttcccgggcctttgtataattgttcttctaaagatacatacacattaaaggtgaagccaggcaagacatatctgctaagactaatcaatgctgcactcaacgaagagcttttcttcagcatagccaaccacaccctaactgtggttgaagcagatgccagatacaccaaaccatttgacacagacacactcctcatagcccctggccaaaccacaaacgtgcttctcaaaaccaagccatattttcccaatgccacattccaaatgtctgctaggccttatttcacaggccgtggcacctttgacaactccacaactgcaggtaccctaatctacaagcaacccttgaaaaattccagtgtaaaaaatctcacccttctcaaaccaactttgccaccaataaatgccacaagctttgtggcaaacttcacagcaaaattcagaagcttggctagtgccaaattccctgccaaggtacctcaaaaagtggacagaaaatttttcttcactgtggggctagggactagtccttgccccaaaaacacaacatgccaagggccaagtaataacaccaagttcgcagcctcggttaacaacatttcttttgcacttccatcatctgtttccatcatgcaggcctactattcaggccaggccaatggggttttcaagactgattttcctgccacccctttgaaccctttcaattacaccggaacgcctccgaacaacacaatggtcaccaatgacacaaagctggtggtgctcaaattcaacaccagtgtggaggtggtgctgcaggatactagtattcttggtgctgagagtcaccctttgcatcttcatggctacgacttctttattgttgggcaagggtttggaaactatgaccccaacaatgaccctgcaaagtttaacctgattgaccctgttgagaggaacactgttggtgttcctgctggtggctggattgcttttagattccttgcagacaacccaggggtgtggttcatgcactgtcacttggacctccacacaagttggggattgagaatggcatggctagtactagatgggcctgggcccaagcagaagcttcaaccacccccttctgatcttccaaaatgctga

SEQ ID NO: 1464 - DNA, 339 bp, Glycine max var. Williams 82
atgttggaaggaaaagctgtggtgagagagacagacatgccagagggaatgcagagctatgttatggaattagcacaccaagctctcgatgcacatgaagtttctgattgtcagtccattgctcatttcatcaaacagaaacttgatgaagcatatggacctgcttggaattccgtggttggaaaagactttggatcttgcatcacacatttatgtggaagtttcatattctttcgtgtggagatgatggaatttctgatcttcaaagatgggaagaatttcacagaaagcagggaagaagctattggagtgctgcagaaggctagaaattgtgattag

SEQ ID NO: 1465 - DNA, 789 bp, Glycine max var. Williams 82
gaaaagaaaagaacaaaccaaatgggaagattttatcaatctcaaaatctcgaccactgaagattttgttgtcacaagcattgtacttcttatggtttgtacttaacaggctatataagaggcagtcagtgggttaccataaccctttgttgtgtttgtgctatcattagagagtgaagtgttcttccctcagttgcttaagatgttggaaggaaaagctgtggtgagagagacagacatgccagagggaatgcagagctatgttatggaattagcacaccaagctctcgatgcacatgaagtttctgattgtcagtccattgctcatttcatcaaacagaaacttgatgaagcatatggacctgcttggaattccgtggttggaaaagactttggatcttgcatcacacatttatgtggaagtttcatattctttcgtgtggagatgatggaatttctgatcttcaaagatgggaagaatttcacagaaagcagggaagaagctattggagtgctgcagaaggctagaaattgtgattagtaaattccaaaatttttagttgttatagaacaacctaaactctttaatattcctaattaatctaagctaaacatgttcaaattacctttttaaaaaagttataaaaatagcttacgacataaaaagcaaaaatggtgcttcccaattatctctggttatcacatatgaagaataaaatattgtcgacgtacttctgtttctagttacttgtaagcagtttgatgacactaacgaacaaagtacatatt

SEQ ID NO: 1466 - DNA, 681 bp, Glycine max var. Williams 82
atggcaactaatcaggaagaggtgtctcttttgggagttgttggaagcccatttgtgtgcagggtgcagattgccctcaagttgaagggaattcaatacaagttttttgaagaaaatttggtcaacaagagtgaactgcttctcaaatacaaccctgttcacaagaaggttccggtgtttgttcacaatgagaagcccatagcagagtctcttgtgattgttgaatacattgatgagacatggaagaacaaccccatcttgccttctgatccttaccaaagagccttggctcgtttctggtccaaattcattgatgacaagattgggggtgctgtatggaaatctgttttcacggttgatgagaaagagcgtgagaagaatgttgaagaatcgttggaggctctgcagtttcttgagagtgagatcaagggcaagaagttctttggaggagaggagtttgggatggtagatattgctgctatcttcatagcattttgggtccctatggttcaagaaattgcagggttggagttattcacaagtgagaaatttcctaagctctacaattggagccaagagttcatgagccaccctgttgtgaaagaagttcttcctcctagagacccactttttgccttcttcaaagcccgctacgaaagcctgctcgctgattcaaaatag

SEQ ID NO: 1467 - DNA, 678 bp, Glycine max var. Williams 82
atggcagctactcaggaagatgtgaagcttttgggtattgtgggaagcccatttgtgtgcagggtccagattgcccttaagttgaagggagttgaatacaaatttttggaagaaaatttgggcaacaagagtgatttgcttctcaaatacaaccctgttcacaagaaggttccagtgtttgttcacaatgagcagcccatagcagagtctcttgtgattgttgaatacattgatgagacatggaagaacaaccccatcttaccttctgatccttaccaaagagccttggctcgtttctggtccaaattcattgatgataagattgtgggtgctgtatcgaaatctgttttcacggttgatgagaaagagcgtgagaagaatgttgaagaaacatatgaggctcttcagtttcttgagaatgagctgaaggacaagaagttttttggaggagaggaatttgggttggtagatattgctgctgtcttcatagcattttggatcccaatttttcaggaaatagcagggttgcagttattcaccagtgagaaatttcctatactctacaaatggagccaagaattccttaaccacccttttgtgcacgaagtccttcctcctagagacccactttttgcctacttcaaagcccgctatgaaagtctttctgcttcaaaatag

SEQ ID NO: 1468 - DNA, 678 bp, Glycine max var. Williams 82
atggcagctactcaggaagatgtgaagcttttgggtattgtgggaagcccatttgtgtgcagggtccagattgcccttaagttgaagggagttgaatacaaatttttggaagaaaatttgggcaacaagagtgatttgcttctcaaatacaaccctgttcacaagaaggttccagtgtttgttcacaatgagcagcccatagcagagtctcttgtgattgttgaatacattgatgagacatggaagaacaaccccatcttaccttctgatccttaccaaagagccttggctcgtttctggtccaaattcattgatgataagattgtgggtgcagtatggaaatctgttttcacggttgatgagaaagagcgtgagaagaatgttgaagaaacatatgaggctcttcagtttcttgagaatgaactgaaggacaagaagttttttggaggagaggaatttgggttggtagatattgctgctgtcttcatagcattttggatcccaatttttcaggaaatagcagggttgcagttattcaccagtgagaaatttcctatactctacaaatggagcgaagaatcccttaaccaccctttagtgcaagaagtccttcctcctagagacccactttttaccttcttcaaagcccgctatgaaagtctttctgcttcaaaatag

SEQ ID NO: 1469 - DNA, 1724 bp, Glycine max var. Williams 82
taaaataaatgattcatttgtcactaacgacatcaaaatcatgaatatgataaaggcagggcataggtactccgaagacgtatatgtcatgatgcaagaaaatcaacacattgctacctcacattatgttcgcatgtatgttcgagaaacaaaggagtttgaggttcaagaaattgcaaatacgcgacttggtcgacgaggaatggcatgcactgtcaaattgaatgaatggttgtgtgattatggacaatttcaagcacttcgactaccttgctcacatgcaattgcagcgtgtgctttttgcaatttaaattatgatgactttgttgaccctgtatacaagttggaaaatattttcaaagtttatcaacatcattttcattcccttggaagtgaagacacgtggcctcaatatttaggtccgcattttatgtctgatccttcgaaacgacgacagatatcaggcaggccagccactactcggatacataatgagatggatgaatcaattccaaataggcttaagaaatgctcattatgtaaaactgaaggacataatcagagtaactgtccatacaaacaaatccttctcatgtgcaatgtctccgcattcatacgcagcaatcaaaatggaattaatacacggtagcactttcccatttttttgttatcgtccccactattgactatacccatgatatgtatataggtatatcttttctaattgattacgtatctgctgaatactagctagtcctgattcctagctctataaaaggagaataccataggaattcatcacagacaaacaaacaatttaccagctatacttgttccttttgaaggttagaagtgctacaatacaaacaatggcagctactcaggaagatgtgaagcttttgggtattgtgggaagcccatttgtgtgcagggtccagattgcccttaagttgaagggagttgaatacaaatttttggaagaaaatttgggcaacaagagtgatttgcttctcaaatacaaccctgttcacaagaaggttccagtgtttgttcacaatgagcagcccatagcagagtctcttgtgattgttgaatacattgatgagacatggaagaacaaccccatcttaccttctgatccttaccaaagagccttggctcgtttctggtccaaattcattgatgataagattgtgggtgcagtatggaaatctgttttcacggttgatgagaaagagcgtgagaagaatgttgaagaaacatatgaggctcttcagtttcttgagaatgaactgaaggacaagaagttttttggaggagaggaatttgggttggtagatattgctgctgtcttcatagcattttggatcccaatttttcaggaaatagcagggttgcagttattcaccagtgagaaatttcctatactctacaaatggagcgaagaatcccttaaccaccctttagtgcaagaagtccttcctcctagagacccactttttaccttcttcaaagcccgctatgaaagtctttctgcttcaaaatagacttatttaaggatatttgttgaacaacttgtgtcttgttgagttattgatgtttgaatttcatgtcaaatgatactagctatatgtaaatcccaaaaaaaaaaaaaaagaatcctaggatcttgttttcgttttggccatttcagttaataaagaaattatatttttcgatataaa

SEQ ID NO: 1470 - DNA, 1227 bp, Glycine max var. Williams 82
atggttgcaatggcagcagcaacagcatccacccagttgattttctcaaagccttgttccccttcacgtctatgccccttccaactatgtgtctttgacactaaacaagtgctatcaagtggcaggagaaggcatgtggggggttctggagttaggtgcatggctgtgggggaagcagcaaccactgggacaaagaagagaagtggatatgagcttcaaacactcactagctggttgctgaagcaggagcaagctggggtgattgatgcagaactcactattgtgctgtctagcatttccatggcatgcaaacagattgcttctttggtgcaaagagctaacatttccaacctcactggggttcaaggtgctgtcaatgttcaaggggaagaccagaaaaagcttgatgttgtttcaaatgaggttttctcaaactgcttgaggtcaagtgggaggacagggataatagcatcagaggaggaagatgtgccagtggcagtagaagagagttattctggaaactacattgtggtgtttgacccacttgatgggtcatccaatattgatgctgcagtgtcaactgggtccatttttgggatatacagccccaatgatgagtgtcttgctgacattgatgatgaccccacccttgacacaacagaacaaagatgtattgtgaacgtgtgccaacctggaagcaaccttcttgcagctggttactgcatgtattctagctcaataatctttgttctcacacttggaaatggagtgtttgtgtttacattggacccgatgtatggcgaattcgttttgactcaggaaaacctccagatacctagagcaggcaaaatctatgcattcaatgaaggtaattatcagttgtgggatgagaagctaaagaaatatattgatgatctcaaggacccaggtccaagcggcaagccttattctgcaaggtacattggtagcttggtaggagatttccacaggacactgctatatggtggcatttacgggtaccccagggacaagaaaagcaagaatgggaaactaaggctcctgtatgaatgtgctcctatgagcttcattgtagaacaagctggtggaaaagggtcagatggccatcaaagaatactcgacattcaaccaacagagattcatcaacgtgtgccactgtacattgggagcgttgaagaggtagagaaggtggaaaagtacttggcttaa

SEQ ID NO: 1471 - DNA, 1515 bp, Glycine max var. Williams 82
atggcttctttgtattcagcaccacccctcttgcgtttttcctccaggaggtcttcatctttggcacccgatttgagtttggtcaatttgaggaaatcccatttaagatttgagtccaaaatctcaccaataaaattgcaatggaaaagtatagaagggaagtggcagagaaagagaaagatacaatggggtgtgaggtgcactgcagatggcatagatggtggaatgtttttgggtggcagaaaagaaggtgcaggtgttagcatcccagagaggttgaaggtggtgtctttgattgcatgtgttatgtgtctgtgtaatgctgatcgtgtggttatgtctgtggctattgttcctcttgctgccaaacatggctggtccaattcttttcttggcattgttcagtcatcattcctgtggggttacatattctcttcagtgattggaggagctttggtagatagatatggagggaagagggtgttggcctgtggtgtatttatgtggtctttggcaactattctcacacctttggcagccaaccactccacagtgagcttgttggccattcgtgctttctttggattagctgaaggagtggcctttccatctatgagcactctcttatcaaggtggtttccaactaatgagagggcaagtgcacttggaatgtcaatggctggatttcatctaggcaatgtcataggcttgttgctaacaccaattatgctgtccactatgggaatttcgggtcctttcatcttattttcatcccttggattgctctgggtgataacatgggcatatcgagttacagatgatcctacggaaagtaattttatcagcagattagaacaaaggttaatccaagctgggaaaactggttctccaaagaaaagtaacaagtttcctcccatacgccttctgttatcaaaattaccgtcatgggctataatatttgccaatgcaactaataactgggggtactttgttctcctgtcatggatgccggtttatttcaaaagcgtatataatgttaacttgaagcaagcagcttggtttagcgcggttccgtgggccacaatggctatgtcaggttatctagccggtgttgcatcagacttcttaatcaatgcagggtaccctacaatatttgtccggaagttcatgcagacaattggattcatcgggccggcagtgaccttgctctgcttgaattatgccaatacacctgctgttgctgctacactcatgactattgccttgagcctgagttctttcagccaggctggctttatgctcaacattcaagatattgctcctcagtatgcaggaattctacatggaatctcaaattgtgctggaactatagcagctatcataagcacaattggaactggttattttgtacagtggctgggatcatttcaggcattcttgactataacagcttgtctgtattttgtgacaaccattttttggaatctttttgctacaagcgagcaaattttgtga

SEQ ID NO: 1472 - DNA, 1491 bp, Glycine max var. Williams 82
atggtcatgggagcctttcgccacttcgaaccggtttccaaatgcagcaccgaaaaccggtttaaccaaaccgtggcctcggacttggacggcaccctcctggtgtcccctagcgcctttccttactacatgctcgtcgccatcgaagccggcagcttcctccgtggccttgtcctccttggatccgtccctttcgtgtacttcacgtacatattcttctccgagaccgcggccatcaagtccctgattttcattgccttcgcgggcctgaaggttaaggacattgagatggtcgcgtcctcggtgctgcccaagttctacaccgaggacgtgcaccccgagagctggagagtcttcaactccttcgggaagcgttacattgtcactgctagtcctagggtgatggtggagccgtttgttaagacgtttcttggggctgataaggtgcttgggactgagcttgaggccacgaaatcggggaggttcactgggtttgttaaggagcctggtgtgcttgttggggagcacaagaaagtggctgttgtgaaggagtttcagggtaatttacctgacttgggactaggagatagtaaaagtgattatgacttcatgtcaatttgcaaggaagggtacatggtgccaaggactaagtgtgaaccactaccaagaaacaaacttttaagtccaattatttttcatgagggtaggtttgttcaaaggccaactcctctagcagccctcttgaccttcctatggttgccaattggcatcatactctccatcttaagggtctaccttaacatccctttgcctgaaagaattgcttggtataactataagctattaggaatcagagttattgtgaagggtacccctccaccacccccaaagaagggtcaaagtggtgtcctatttgtttgtaaccaccgcacagttttagaccctgtggttactgcagttgcacttggaagaaaaattagctgtgtcacatatagcataagcaaattcactgaaataatttcaccaattaaagctgtggcactctcaagggaaagagagaaagatgctgccaatatcaagagactacttgaggaaggggacttggtgatttgccctgaaggcacaacttgtagagagcctttcctcttgaggttcagtgcactatttgctgaactcactgataggattgtcccagttgctattaacacaaagcaaagtgtgttctacggaaccacggtttgcggacacaagttgttggacccgtactttgtgttcatgaatccaatgccaacatatgagatcactttcttgaaccagcttcccaaggagctcacatgcagtggagggaaatcagctattgaagttgcaaactacattcaaagggttcttgcagggactttgggatttgagtgcacaaatttgactaggaagagcaaatatgccatgcttgcaggcacagatgggacagttccatctaaggagaaggcttga

SEQ ID NO: 1473 - DNA, 1203 bp, Glycine max var. Williams 82
atggcatgtccagcaatggcaaatgggaacggctcattgaagaacttgaagctaaatgacaccaagggaaagaccatcacttgcaaagctgccgtggtatatggtcctggagagccctttgtggtggaaaacattcttgttcatcctcctcagaaaatggaggttcgaatcaagatcctctacacttccatttgtcacaccgatcttagcgcatggcgaggcgtgaacgaggctcaacgtgcttatcctcggatttttggccatgaagcatctgggattgtggagagtgtaggggaaggagtgagtgaagttgaggaaggggacatagtagtgccaatattcaatggggagtgtggagagtgttcgatgtgcaagtgtgagaagaccaacttgtgtgagaggtttggggtggatgccacgaagaaggtgatggaaggagatggcacaacaagattctccactgttaatgggaaacccattttccatttcttgaacacttcaactttctcggagtacacggtggtggattcggcctgtgtggtgaagtttctggactccgatcacagtctcagccacaagaacctcaccttgctcagctgtggcgtctccacaggggttggaggcgcttggaatacagctaatgtgcattctggttcaactgtagctattttcggcttaggagttgttgggctcgctgttgctgagggggcacgagctagaggtgcatccaaaataattggcgtagacatcaatcctgacaaattcatcaaagcccaaactatgggagtgacagacttcataaaccctgatgatgaagagaagccagtatacgagagaattagagaaataactgatggaggtgtacactacagttttgaatgtactggaaacgtggacgttttaagggatgccttcttgtcatcccatgagggttggggattgactgtaatattgggagttcatgcgtcaccaaagttgcttcccatccacccaatggagctcttagacggtcgcaacattgtaggatgtgtatttggaggtttcaaagggagaagtcaattgcctcactttgccaaagaatgtggacaaggagtggtgaagctggataatttcatcactcacgagctaccctttgaggagatagacaaagccttcgatcttttgatcactgggaagtcactgagatgccttctgcacttctaa

SEQ ID NO: 1474 - DNA, 672 bp, Glycine max var. Williams 82
atgctcaatgatacgatacaggttgatattgatttgcgaggatatgctggttggaattcaaggcgtgctgtgcaggttctggataaagtttttcccaaggatgcccctatacaaccttcattggttattgtctactttggtggtaatgattcttctgctcccctctcatctggcctaggtcctcatgtgcctctccaagaatacattgaaaatttgaggaagatcgttgaccatctcaagagcctctcagagaacactcgcattctacttctcagtactcctcccctcaatgatgcagcaattacgccaaacagtgatgggaagccaacaaagacaaatgaagcttgtcaaatatattcagaagcatgtttggatgtgtgccgcaagatgaatatcaaggccattgatttgtggtctgctattcagaaaagagataactggcaagatgtttgcttcattgatggaattcacctctcatctgagggaagcaagatagtgttgaaagagatactgaatgtcctcaaaggtgcagaatgggaacctagtctatattggaaatcaatgccaagtgagtttgatgaagattcaccatatgatccagttacaactgatggaaagtcaactattaatctttccagctgggtcttccctgacaatgacaaatgggactag

SEQ ID NO: 1475 - DNA, 1461 bp, Glycine max var. Williams 82
atggctacacccttggcctaccaagagcaccttccggcggcacccgaatggctgaacaaaggtgacaacgcatggcagctaacagcagccaccctcgtcggtcttcaaagcatgccgggtctcgtgatcctctacgccagcatagtgaagaaaaaatgggcagtgaactcagctttcatggctctctacgcctttgcggcggttctaatatgttgggtgcttgtgtgttaccgaatggcctttggagaagaacttttccccttctggggaaagggtgctccagcactaggccagaagttcctcacgaaaagagccatagtcattgaaaccatccaccactttgataatggcactgttgaatcacctcctgaggaacccttttaccctatggcctcgcttgtgtatttccaattcacttttgctgctattactcttattttgttggctggctctgtccttggccgaatgaacatcaaggcttggatggcttttgtgcctctttggttgatcttttcctacacagtcggggcttttagtctttggggtggtggctttctctaccaatggggcgttattgattattctggcggctatgtcatacacctttcttctggaatcgctggcttcactgctgcttactgggttggaccaaggttgaagagtgatagggagaggttcccaccaaacaatgtgcttctcatgcttgctggtgctgggttgttgtggatggggtggtcagggttcaacggtggagcaccatatgctgcaaacattgcatcttcaattgcggtgttgaacacaaacatttgtgcagccactagcctccttgtgtggacaactttggatgtcattttttttgggaaaccttcggtgattggagctgtgcagggcatgatgactggacttgtatgcatcaccccaggggcagggcttgtgcaatcatgggctgctatagtgatgggaatattatctgggagcattccatgggtgactatgatgattttgcataaaaagtcaactttgctacagaaggtagatgacacccttggtgtgtttcacacacatgctgtggctggccttttgggtggtctcctcacaggtctattagcagaaccagccctttgtagacttctattgccagtaacaaattcaaggggtgcattctatggtggaggtggtggtgtgcagttcttcaagcaattggtggcggccatgtttgttattggatggaacttggtgtccaccaccattattctccttgtcataaaattgttcatacccttgaggatgccggacgagcagctggaaatcggtgacgacgccgtccacggtgaggaagcttatgccctttggggtgatggagaaaaatatgacccaactaggcatggttccttgcaaagtggcaacactactgtctcaccttatgttaatggtgcaagaggggtgactataaacttatga

SEQ ID NO: 1476 - DNA, 465 bp, Glycine max var. Williams 82
atgaaagacggtggaacaaatgttgaggtttcagaagatggatctaaaagagaagatacaacctcagagagtggtggtggaggaggccttattaacaacttggtttccactttgatagcacccttgagtccaagcattgggaaagccactgagcatgaaagtggtgctgatgatgatggagaaaaagaaggggttgatggttgtgaagagggaggagggatcatcagaaaaatggtttccaatttcttccatcaaagtgaaggtgaaggtgtggttgaagctgaagaggacaaggaagaagaggatgaaatcatggctggtggtgaaaaaatcaaacggttgaagacagagactggaggcatcattcataacattgtttctcatttacctgcttcaatcccagatggtgcggttcccacagcagacgaggccactattttaattaactctcttgttcgtgactaa

SEQ ID NO: 1477 - DNA, 1059 bp, Glycine max var. Williams 82
atgaagactaataacaacgtttctggagagaggaaatcgcggaagagacgcagtggtgaaagtgattctgtggaggacacacttgaaaagtggaaggagtacaacaggcagcaacaacttggctctagagaaaatggggtggaagtgattcacaaagttcctgcaaaagggtcgagaaaaggatgcatgagaggaaagggagggcctcagaactccgattgcaagttcagaggtgtgaggcagaggatttggggtaaatgggttgccgagattcgagaacctatcaatggcaagcttgttggtgagaaagcaaataggctttggcttggtactttctccactgcacttgaggctgctcttgcttatgatgaagcagctaaggccatgtatggcccttgtgcccgtttgaattttcccgagccaatagactctaatggatcatcatcttctagtggaagtgataaaaaatcaccaagtggttcttcggagaatggtggtgatgttgcaatagctgaggagttggaggtgaaccatcgtcggtgtcatgaagacagaccaagattttctaaggttggtgtctttgagaaagcagaagagatgccggttctttctgtaggttgtgtggctgatgactcaatagaggagttgaaggaaatcagtaatggctttgaacagtgtcaaacaagtgaagaatgtaaggcaacatctttgaatgatgttaagtctgaagtaccgagagaaaatgaaggaatagagaaagaattggaggaggttttgaaaaactctggcataggtggagagggtagacacttgcagaaggagcctatggatatacctatgaatacaagaagtaacttttgtagctcttctgcctcttcggatgctgctaccattctgataaagagtgaagaaacaagaggagaatcagttgaaactttgaactcttatgagttgagctgcagcaaccattgccttggatatatgcataataatatgctgccagataccaatccaagaccaaattctgagacatctattgcaaagaaacatactgagtaa

SEQ ID NO: 1478 - DNA, 570 bp, Glycine max var. Williams 82
atgttcacccaattcctcatcttctccctcttcttcactcccttcatcttcaccgcagcccatgacacccatgattttgtgcgcaccttagaccgcaaaatgttgggtttggacgaaaagcaagaaaagctcagccatttcagattctattggcatgacgtggtgagtggacgcaacccttcttcaattgaagttgtgccaccacccttgaagaactcaaccacatcctttggatcggtgaacatgattgagaaccctttgacattagaaccccaattgaactcaaaattggtggggaaagctcaggggttctatgcttccacgtcacaaagtgaaatcaccttgctcatggctatgaatttcgccatcactgaagggaagtacaatggcagcaccatcacaattttggggaggaactctgtttacgacaaggagagagagatgcccgtgattggtggaagtggactctttcgatttgctaggggatatgctcaacttagaacgcattggttctcacccaccaccaaggatgccattgttgagtacaatatttatgttttgcattattga

SEQ ID NO: 1479 - DNA, 375 bp, Glycine max var. Williams 82
atggcaatggccagtgcaacaactccagccacaatcactgttgtggccatctccagtgttgccagcacaaaaagaagggagaggaatgtgcacttcatcagaggtttgaattcctttggagggttgaaggctcagaacagtgtgacatcactaggtcttcctgtgtgcactgaacagtgttttgcaaaggtggtgagctcattgaaatatcaatcatcatctaagggcagaggtggaggtgctgcctcttcaacatgcaatgctgctggtgagattttccagattgcagccatcatgaatggtcttgtgcttgttggggtagcaattggatttgtccttcttcgagttgaagcgtttgtggaagagtctgagtga

SEQ ID NO: 1480 - DNA, 1197 bp, Glycine max var. Williams 82
atgcactatcttgctttcaatccaagttcactttggtggcagttgaacgagtttgcaaccccacacacaaaaaccaaacccttaaaaatgtcatccccctcgccggtggccacggtggtctccgccgccgcgctgtacgaccgcgccaaagccgtgaaagaattcgacgaaaccaaggtcggagtcaaaggtttgatcgattcgggaatcagaaccatcccccctttcttcgtccacccgcccgaaaccctagcggacctcaagcgcggaaccaaacccgggtccgcgccggagatccccacggtggacctcgccgccgaggagagctcccgcgccgccgtggtggagcaggtccggcgggcggcgagcaccgtgggattcttccaggtggtcaaccacggcgtcccggaggagctgctattgcgaacgctggcggcggtgaaggcgttccacgagcagcccgcggaggagagggcgcgggtgtaccgtagggagatggggaagggtgtgtcgtatatttccaacgtggatctcttccaatcaaaagccgccagctggcgcgacaccatccagattaggatggggccaaccgcagtggattcgagcgagattccagaagtgtgtaggaaagaggtaatggagtgggacaaggaggtggcgcgtgtggctcgtgtgttatacggtttactgagtgaagggctgggattgggtacggagaggctcacggagatgggtttggtggaagggagggttatggtggggcactattacccgttttgtcctcaacctgatctaacggtggggcttaactcgcatgcggatccaggggctcttacggtgttgctgcaggaccatattggggggttgcaggttgagactgaacagggttggatccatgtcaagcctcagcctaacgccttggttattaacattggagatttccttcagataatttctaatgaaacatacaagagtgctcatcatcgggtgttagccaattattctaacgagccacgagtctctattgccgttttcctcaacccaagtgatagggagaaacattttggaccattaccagagctaacatcaacagagaaaccagctctttataggaacttcacgttccatgaatttatgacaaggttcttcacgaaagagttggacggtaaatcattgacaaatttcttcaggcagtga

SEQ ID NO: 1481 - DNA, 504 bp, Glycine max var. Williams 82
atggctgcactttcggataaacttgctttctgtttggtgtctgcctgtctggtgacagttgcacccaagcttttccaatggtgcataccttacagatataaagaagataatgatggcaatgtgagcaatgaattggaggtgcttgtggttagttcacaaaagggtcaagcattaatgttcccaaagggagggtgggaactcgatgaatctgtagaagaagcagcttccagggagtccctcgaagaagcaggagttacaggaatagttcagcatgaattgggccaatggagcttcattagtaaaagacttggaacatactatgaagggcacatgtttcctttgcttgtcaaagaacaacttgacttgtggcctgagaaagatctaaggagaagaatatggatgagtattaatgaagcccgggaagtttgtcagcattggtggatgaaggaagcattagacattctcgttgaacggctcactttacagaaaaataggaacatatag

SEQ ID NO: 1482 - DNA, 2115 bp, Glycine max var. Williams 82
atgttgacaattctacgtcatgccacacgcaaaagagtaagagcaacacttattaaacccccaccgaatctactccaaatctcatccacttcagtaaacagtcacacttacactatcacacagcattactctcactcaacaacaatgttgccgccagcgggaaccatcgtattcaacaccgtcggaagagtccaatacggtttcgacgttttctctgtcgacctcaatcaccaacagcctccgccccacgccaccgcagaccaccgcctcaccgacggtgtctcgattaacttcaacgcacaattcattaacccccaaaacgacgtcgtcttcgtatccgaaagaaccgggtcgccccgcttctacattacaaaacccgacactaaaccccagcctttaccctttctgcccaacgctctcttccacgatcgcccaatcgttaaaaacggaaagctctacttcgtttccacgcacgaagaaaacgacgccgttttcactagctggagcgccgtttactccaccgccatagatgactccaccgccaccgtcaagagactcaccccgcgcggcgaggtggactacagccccgccgtctccctcaccgggaaattcctcggcgtcgcttcttaccgctctcgccgctggcaaaccaacgatttccgcgaactccaaacggagatcgtcgttttccccgagtccgatccaaaaaaccgagtcacggtgagcgagcgcggtggctggccatcgtggtcccaagattcaaccattttcttccaccgaatcgccgaagatggatggtggagcatcttccgcgtcgatttaaccgattccgaactttcagaatctcgaaactcgccgattcgcgtcacgccgccggggttgcactgtttcactccggcagctttccacgacggaaagcgcgtcgcggtcgcaactcgccggagagaaagcaatttaaggcacgtcgaaatcttcgatctcgaatcgcaaacgttccaacgaatcaccgaagacataaaccctaactttaaccattacaacccgttcgtctcgttggactctcgccacctcgggtaccaccgattccgaggcgagtcgattcagggcgagccaatatacccgcacctcgacaaagtcctctctccggttcgcgacctacagttactcagactcaacggttcgtttcccaccttctcccccgacggcgatttcatcgctttcaaccacggcttagacggcaacgttaacggcggcgttaaaatcgttaaatcgaacggttccaaacgctggacgttgctcaaaggacgaacgtgcttccacaacgcgtggagcccaacggagaagaacgtgatatacacctccgtcggtccaatcttcgagtcggtttataaaacggttcaaatcgcgcgcatcgagttcgacccggttcatttaactaacgaccgtgaagaggttccgtttaagttaacgattctcacgagagaagacacagggaacaatgcttttccgtcatgctcccctgacgggaagagcattgtgtttcggtctggaagggaaggatacaagaacttgtacatagttgacgctgttaaaggggagtttgacggcgggataaggaggttgacggagggggagtggatcgatacgatgccgtgttggtcgccgaaaggggatttgatagcgttttcatcgaacaggcatgaccctaagaatagtgaggtgtttgggatatatttggtggggccaaatgggagtgggttgaggagggttgaggtggcaaagggggtcgaaggaatgaaagagaggttgaaccacgtgtgcttcagccgcgacggagagtggttgctgttcacggcgaacttgggtggcgtgagtgcggagccggtggggctgccgaaccagtttcagccgtatggggatttgtatgtggtgaggttggatgggagtgggttgaggaggctgacgtgtaatgcgtatgagaatgggacgcccacgtggcaccatggggatttggcgctgtgtgctcctagagaagatgatggcgaaggaggtcaggattgggataagttgaagggtgagtttcaagaaccactttggatcacgtgtgatatttga

SEQ ID NO: 1483 - DNA, 894 bp, Glycine max var. Williams 82
atggaaatggtggtggcagtgcctcctcctccaccttcttcttccatggactttaactttgatagcaactgttcctctccttacatcactgcaccttctagcccccaacgctttggcaacttcttcttcagtgctcccactagccccactcgcagacactcctctgcttccactcccaacaccaccgaagacgagtttgaattcgacttcagtggtcaactccagagaccttccctttccgccgaagaactgttccttggcggaaagattagacctctcaaacccctttccccttcgtcgaataaaagaagagagaaaagggttatcgaagaatcatcatcactattatcatcaccacctccacaacgtaagctaggtagggaaagagcttcatcattttccatttcctctgctacccctttaaaaggtcgcagaggaagtggaattcaagtcgtgtcttgtgatgacacgtcatcacaaggggagaagagtaacagcagcaaaacctcggaaagtgtttctaactcctcgtttttgtcgtcgatttcgttcgggaaagggtaccgaaagtggaggctgaaggattttcttttgttccgaagcgcctccgagggaagagcttcggacaaggatccctttcggaagtacgcggttctgtccaaaacgacggcgcacgaggatgtccggaacgtgagtttccggtccgcggagagttccggttcggtttcgagacggagaggaccggtttcggctcacgagttgcattacaccgtgaaccgggctgcttcagtggagttgaagaagaaaacgttgttgccttataagcagggcttgttggggtgcttgggcttcaaccctggcatgcatcacttaagcgcaagaattgggtcttag

SEQ ID NO: 1484 - DNA, 864 bp, Glycine max var. Williams 82
atgggagaaatagatgcagctttcattcaatcaccagagcacaggccaaagctctccatcattgaagctgagggcattcctgtgatagacctctcccctttattatcaaacactacttcttccatcacaaaccattcttcccttgaagagcttgtgaaggaaataggcaatgcatgcagagagagggggttcttccaaattgaagcagctgcaaggaagttctttggccagagcaaggaggagaagagtaaggtgagaagggataatgatggtgtaaaggtgatggggtactatgactcagagcacaccaagaatgttagggactggaaggaggtgtttgattacactgtggaggaacctaccatgatgccggcttcacttgaccctaattatcataaagaactcactcattggtataaccagtggcctcaatacccaccagagttcagagaggcattccaagagtatgctcagcacatggaagaactagcactcaagttaatggagcttattgctttgagcttaggaccaaaccctaaccttgttttgggattaggtcgtcacaaagacagtggtgctttaactgttcttgctcaagatgatgttagtgggttagaagtgaagcgaaaatctgatggcgaatggattcgggtcaagccaacaacacctgattttatattatcaatgtttggagcaatgatgcatatgagagtgttgagcagagttatggtgaacccagagaaggaaagactttcatatcccttctttctcaagccttcacactacaccatggtgcagcctctagaagatctggcaaatgagcaaaaccctgccaaatacaagccttacaattggggcaattaa

SEQ ID NO: 1485 - DNA, 1032 bp, Glycine max var. Williams 82
atgggagacattgatcctgcttttatacaatccacagaacaccgtcccaaagcaaaagtggtggaagtttgtgagattccagtgatagacctttcagaaggtagaaaagaattactcatttcacaaattggcaaggcatgtgaggagtggggatttttccaagtaataaatcatggggtaccctttgagattagtagagaggttgagattgaggccaagaagttctttgagatgagcttagaggagaagaagaaattgaaaagagatgaatttaatgcaatgggttaccatgatggggagcacaccaagaacgtgagagactggaaagaggtgtttgattaccttgttgaaaacactgcagaagttccatcttctcatgaaccaaatgatatggatttgaggattctcaccaaccagtggccccaaaactctcctcgctttagggaaacattgcaggagtatgctcgagaagtggaaaagctagcttacaagttgttggagctgatttcactgagcttgggtttggatgctgaaaaattccatggctgtttcatgaaccaactcagcatggtgaggctcaattactatcccacatgccctttccctgatttggcacttggtgttggtcgccacaaggactccagtgctttaactgtgcttgcccaagatgatgttggaggattacaagttaaaagaaaatcagatggagaatggattccagttaaacccaccccaaatgcatttattatcaatgtgggggatatagttcaggtttggagcaatgacaagtatgagagcgtggagcacagggtggtggtgaatacagagagggaaaggttttcaattccattcttcttttccccagctcactatgttatagtaaagcctgccgaggagctggtaaatgagcaaaatcctgcaagatatagagagtacaactatggcaagttctttgccaacagaaaccggagtgatttcaagaagcgtgatgtggagaatatccaaatttatcacttcaggatcttggattag

SEQ ID NO: 1486 - DNA, 285 bp, Glycine max var. Williams 82
atggcctctctccgttttctcttcttagcttctttcttcattgttttgtcactttccatcaacattggtgaggtccaaggggcaaatagaaaacttttggcaccaacatttcctgacctagggaacattcctggcctggaatatcctcctctccccccaatcaccaattggccagaatacaggttgccatcatacttaagacctaattaccccgcaattcctgcaagttattaccgttacactccacctgcgaaaacaaccacaatcacatcttccaagccttga

SEQ ID NO: 1487 - DNA, 369 bp, Glycine max var. Williams 82
atggcctcaagcaaacccttcatcactgctttccttcttcttgtgaccttctcaagcatgagtttgagcctagcatcatctcgtcacctcttgcaaacaaccacaacgccaaatttgcctggcactcccactttgcctaacccaacaacactgccacctttgccttcaaaccctacactgcctcagggcaatgttccccctttgcccactatgccaactcttccatcacttccttccattttcccaacactcccttccctcaatctccctccattgccagcctcttcattccccaaaatgccctcaatcccaaccaatatcccctccttccctttcttctccccaccaccttcaacctctatcccttga

SEQ ID NO: 1488 - DNA, 240 bp, Glycine max var. Williams 82
atggcctctcagagttgcatcattttggctttgttcatcgctattttttccttctcaagcatggacacagcatttgcagcacgccatctcttgcagaatattccagggctaccagatttctctacaccccccaccttgccacctttaacaatcccaaatgtactatgcaatggatccatattcacattcttacccatcttatgtccaccatcttcaagcaccagtactactatcccttaa

SEQ ID NO: 1489 - DNA, 534 bp, Glycine max var. Williams 82
atggaggacgtagaacgggtgaaggccgaggcactgcaaataatgggagtattttcactgctcccaaggctcgtcgttttcgatctcgattacactctctggcctttctactgtgagtgccggtcgaagcacgacacgccttctctgtttccacattcaagagggatattgcatgcactcaaacaggagaggattgatgttgccattgcttccaagtcgccaactcccgacatcgcaacaacgtatcttgacaaactcagcatcaggtcaatgtttgctgccgaggaaatattttacacctggaaggacaaaactgagcattttcagagaattcattcaaagactggggtcccctataactctatgctcttctttgacgatgataataataacatcccaggggcctcagaacttggagtgacaagcattttggttagaaatggggtaaatcttggagcattcagagacggcctcacaaaattttctcaaaacaaggatgcatcaaagaagaacagaccgaaaaggcccaagtaa

SEQ ID NO: 1490 - DNA, 1605 bp, Glycine max var. Williams 82
atggattatcagtacattctaggagggattatggcttgtagttttgcttttttgtatgttgtgtacagttttggagcaaaggtcacagattcaagttcaatacatgtaaagagtaatgaatgtgcaaagatatcatcagagaatggaatatgctcacatgaggatgcaggaagtgctgacatcattattgtgggtgctggggttgctggttcagctcttgcttgcactcttggaaaggatggacggcgagtgcatgtaattgaaagggatttaagtgaacctgacaggatcgtgggtgaattgctacaacctgggggctatcttaagttaattgagttgggtcttgaggattgtgtggatgaaattgatgctcagcaagtctttggctatgctctgtataaggatggcaaaaataccaaactctcttatcccttggaaaattttggctctgatatttctgggagaagctttcataatggccgtttcatacagagaatgcgagaaaaggcttcatctcttccaaatgtaaaattagaacaaggaactgtcgcatctctacttgaggaaaaaggaaccatcactggggtgcactacaaaaccaaaagtggtgaagagttcacagcaaaggctcccctcaccatagtatgtgatggttgtttttccaacttgagacgttctctttgcaatcctaaggttgaagtaccctctcattttgttggtctggtcttggagaattgtaatcttccatatgcaaatcatggacacgtcatcttaggtgatccttcccccattttgttttatcccatcagtagcactgagattcgctgtttggttgatgtgcctggccaaaaattaccttcccttggtagtggtgaaatggcccgttatttgaaaactgtggtagctcctcaggttcctccagagctgtatgattcatttattgcagctgttgacaaaggaaacataagaaccatgccaaatagaagcatgcctgcctcaccttatcccacaccaggtgcccttctaatgggagatgccttcaatatgcgtcaccctttaaccggaggaggaatgactgtggctttatctgacattgttgtgctaagggacttacttaaaccccttcatgatctccatgatgcttctgctctttgcagataccttgaatcattctacaccctacgcaagcctgtagcatctacaataaacacactagccggggcattgtacaaagttttttgtgcatctcctgatccagctagaaaggaaatgcgccaagcatgtttcgattacttgagccttggaggtgttttctcagatggaccaatagctctactctctggtctaaatcctcgtccattgagtttggttctccatttcttcgccgtcgctatatatggtgttggccgcttgctcataccatttccttctccaaaacggatgtggattggagctagattgatttcaggtgcatcaggcatcattttccccattattaaggctgaaggggtgagacaaatgttcttcccagcaactgtgccagcatattacagaacccctcctgtccatccattgaacacacatgaaggaaatacatggaattaa

SEQ ID NO: 1491 - DNA, 2550 bp, Glycine max var. Williams 82
atgaccaccaaacgcaaacatgcaaattttctgcttcctttattcttcttcttcttcttctgttctcacactttgttctctcatgcagccgattccatcacaggagatacagtaatcagagacaacgatggtggtgatactttggtgtccaaagacctcacctttgaaatgggtttcttcagtttcgataactcttcaagatacgttgggatttggtaccacgagattccggttaaaacattcatatgggttgcaaacagagaaaaacccatcaaaggaagagaaggtttgatccaaatcaaaactgacggcaacttggttgtcctcgatggagagagaaacgaggtgtggtcaacaaacatgtcaattccaaggaacaacacaaaagctgttcttcgtgatgacggcaaccttgttctttcggaacacgacaaggatgtgtggcaaagctttgaggacccagttgatacatttgtgccgggtatggcacttccagttagtgctggaacgagcatgttcaggtcgtggaaatcagcaacggatccttcaccgggaaactactcaatgaaggttgactctgacgggtcaacaaaacagattttgattttggagggagagaaaagaagaaggtggagaactgggtattgggatggtagagtgttcactggtgtctccgatgtgacaggaagctctctatttggttttggagtaaccacaaacgttgaaggagaagaatactttacatacaaatggaatagccctgagaaggtgaggtttcagataacttgggatgggtttgagaagaagttcgtgtgggatgaagatgggaaacaatggaataggacacaatttgagccttttaatgactgtgagcattataacttttgtggcagttttgcagtgtgtgatatgggtaactctcctgtttgtagttgcatgcaagggtttcagccagtgcattgggaggagtggaataataggaattggtcaagggggtgtgggaggaagactccactaaaggctgagactgagagagctgctaatagtagttcttctggagctgaggttagtgttggagaagatggtttcttggagcaaaggtgtaccaagttgccggattttgcacggttggagaattttgttggttatgcggattgtcagagctattgtctgcagaatagttcttgcactgcttattcatatactattggaattgggtgcatgatttggtatggggagttagtcgatgttcaacacactaaaaataatcttggaagtttactcaacatccgtcttgctgatgctgatttaggcgaaggggagaaaaagaccaaaatttggataatattagctgttgtggtggggttgatctgccttggaatcgttatatttctgatatggaggtttaagagaaaacctaaagcaatttcctcagcttctggttacaacaacaatagcgaaataccagtctttgatctaacgagaagtacaggcttatcagaaatttcaggtgagttaggcttggaagggaatcaactaagtggagcagaacttccattgttcaattttagctacattctagcagcaacaaacaatttctcagacgaaaataagcttgggcaagggggatttggtcctgtctacaaggggaagtttccagggggagaggaagtagctgtcaagaggctttcaagaaagtctagccaaggtttagaggagttcaagaatgaaatggtgctaatagccaaactgcaacatagaaatctggttagactattaggatgttgcattcaaggggaagaaaagattctggtatacgagtacttgccaaacaaaagcttggactgctttctatttgatccagtgaagcagacacaactagactgggcaagacgctttgaaataattgagggcattgcaagagggctactttatctgcaccaggattcaagacttagaataattcatcgcgatctaaaagcaagcaacattttgttggatgaaagcatgaatccaaaaatttcagactttggcttggccagaatatttgggggaaaccaaaatgaagccaacacaaacagagtggttggtacatatggttatatgtccccagaatatgcaatggaaggtctgttttcaattaaatctgacgtctatagttttggcgtattgctacttgagattatgagtggccgcaagaacactagctttcgtgacacagaagactcaagtcttataggatatgcctggcacctttggagtgagcagagagtaatggagcttgttgatccttccgttcgagattcaattccagagagtaaagcgttgaggttcatacacatagggatgttatgcgtgcaagattcagcatctcgtagaccaaacatgtcatctgtgttgttgatgctgggaagtgaagccatagcacttcctttgcctaagcaacctttgcttactacttccatgaggaaacttgatgatggagaatcttatagcgaaggccttgatgtgtcaaatgatgtcacagttacaatggtgacagggagatag

SEQ ID NO: 1492 - DNA, 189 bp, Glycine max var. Williams 82
atgggtatgcgagtggtggtgatcacaagaagggatttaatcaacgacaattatttgtccaacaggaacatcgctggccgtttgattcccaagaggggccaagtgaagttgggaattgtggtgggcttgtttcatagagtctcctccgtcttctcctccatcactacacgatgtgttcatttgtcttga

SEQ ID NO: 1493 - DNA, 4080 bp, Glycine max var. Williams 82
atggcggatgctgacgtggacctttcggaactgttctctggtaatgccgacgaagacgacgacatgttttatatagatattcagaccgtccagaaggttcttgatgaagacgatgattgttactttcaggagacggcatcatgtgatccttgtagccaacctcaactacagaatagtcccgaggattcttcatcaaaaaatgtttcacctagtgaatctggcattcatgacacttttcagatacaaaatgggtctcaagtgttagaagaaccatatctttctaagttgggctttgcaaattcagtcacgagctgttctccattctgctcagatgtgtcagatttcggggtcagaggttcagttggtgtatctgattctgcagctaattctatgcttgattgtgaacgtgaaaaccagggacctcaatctcgggcttgctcttccccaaatgcttttcctggtaatttcagtgattcattttctccaggtgaaagtgatgaggtttttcgcacagaaaggacccaagtttctaaacatgagatacctgcatatagtgtagaaacaagtttccctgaggcacagtcaaacaatatatcaatttgtggagataatttgaatctgagtatgtggattggtgaaaatgagagccaattcaagcatgtgagagaggatgttgaatctgaacatgcttcactcagttctattgttgacaatgatgatgtaaatattgaaggttatgttgaagacatcattgcaggagtttctgggcaacaggaaaatgactcgtgtacatcttttgaagcatcatttatggatgctgatagatctttgcatgtcacaacttcaactgattctagtgttggtcaaggttcccatgtttccagtgatttcattgactaccatgtatctccaaactgttaccagggaacacatgatggaccctttgttgctgactcttctcttggttttgtgcctaatgctattaattctcaattgtggccatatgaagaaatgatgaataacattaaggctgaaaatgtggagttaaatgctgatattgcatatatgagtaatggcatgccttcaagcactactgggtggatgccttttcaggatagtcaacttatgttagctgataatggttatccatcatttcattctggtaattttgatgacatgtcatcactgtctctttcagcttgtgcttcatacatgtcatatggagaccattaccagaacaattttcaccgtgatgatgccgagttcaatgtaggccaagaggtgaaacaaacacctggtattttttcttctgaagggtgtcaagcttaccagtgttttcagaatgaggataattatgcagttatatctgggatatccaatcaatatcaagatagcattggcagaactgctagttttcaaggaaactttgacaatttgaatttaaaagctgcagataattcttggctccatccccaagaactaattaccagtgagaagcagtttggttgtgttaagagagaaggagggattcaacataactttattgattctcatctttcaaaaggaagaactgagaatttccatgttgaggaagaccctgatgtttgcattattgaagacatcagtcatcctgctccgacgagtcgacccgcaggcattgggaattcccttaatatatctcaatcttgtagatatgttggaagtacggtcggaagtacaaggatgaaggcatgtgatgaacgaaatatattacgagttgcattgcaggatctatctcagccaaagtctgaagttagtccaccagaaggattgttggcagttcctcttttaagacatcagagaattgctttatcatggatgattcaaaaggaaacatcaagtttaaattgctcaggaggaattcttgcagacgatcagggacttggaaaaacagtatcaactattgcattaatattaaaggaaagacctacattacttaatgggtgcaccactgcccgaaaaagtgaattggaaactctggatgtggatgatgacatgcttcctcagaatggtatagtaaaggaagaatctaatatgtgtgaggataagccaagtggatatccaatgaatttgttgaagcaagcaaagggaaggccatctgctgggacccttattgtttgcccgactagtgtcctgcgtcaatgggctgaggagttgcgtagcaaggtaaatggtcaggcaactctctctgtgctagtataccatggaagcaatcgaacaaaagatccttatgaggtggccaagcatgatgttgtcctaacaacttattccattgtcagcatggaggtccctaagcagcctccagctgacaaagatgacgaggaaaaggaaatttttgaagatcatgctacaccaagtaggaaaagaaaaagcccttctaattctagtaaaagtggcaagaagaaattggatggcacaaatcttgaagctgttgctcggccacttgcaaaggtgtcatggtttagggttgtcctggatgaggcccagagtataaagaatcacaaaactcaagttgcaagggcctgttggggtcttcgtgctaagcgaagatggtgtttgtcagggactcctatccagaatgcaattgatgatctctacagttacttcagatttctaagatatgacccttattctgaccatgcatcattttgtactagaattaagaacccaattagcagaaatccagcaaacgggtatagaaagttgcaagctgtcttgaagacaataatgttacgccgaacgaaaggtacacttcttgacggggaacctattatttccttgccgcctaagtatatagagctgaaaaaagttgatttttcaatggaggaacgtgatttctattccaaactagaggctgattcacgtgcacagtttcaggaatatgctgatgctggaactgtcaagcaaaattatgtcaacattttgctgatgcttctgcgccttagacaagcttgtgatcaccctctgcttgtcaagcgatacaattcaaactctctatggagatcttcggttgagatggcaaagaagcttcctcaggaaaaacaaatctctcttctgaaatgtttagaggtttccttggccctctgtagcatttgtaatgatcctcctgaagatgcagttgtctcagtttgtggccatgttttctgtaaccaatgcatctgtgaacatctttctggtgatgacaatcagtgccctgctgcaaattgcaaaagtcaactgagcacatctatggtattttcaaaagccacactgaacagttgtctttctgaccagggttgtgataattcacccagttgctctggtcctgaagccgaagaagctgaaccttggtccgaaagtaagccatatgattcttcaaaaataaaggctgcacttgaggttttgaagtcattgtgtaagccacagtgctacacatcaaaaagtacttctgagcatagcactttcagggaagataaaaattgccttgggaacccctccattgctaagaatgggaaatccttaaaagattctcctgagagtcaaaatttgtctgatgagaatagaagctctaatgcttcagttactgttgtaggggagaaagctatagtgttttctcagtggacgaggatgctagatttgcttgaagcgtgtctcaagaattcttcaattaattatagaaggcttgatggaacaatgtcagttgttgcaagagataaagctgttaaagattttaacaattgtcccgaggtaactgttataattatgtctttgaaagctgccagtcttggtctcaacttggtagtagcatgccatgttcttatgttagatttatggtggaatcctacaactgaagaccaagcaatagatagagcacatcgaattggccagactcgtcctgtgactgttttgcggttaactgtgagagatacagttgaagatcgtattctagctctgcagcaaaagaagagaatgatggttgcatctgcatttggggaggatggaactggtgatcgtcagactcgcctcactgtggatgatttaaaatatttgttcatgatgtga

SEQ ID NO: 1494 - DNA, 1665 bp, Glycine max var. Williams 82
atgtttccaacgtctcaaaaaccatgccaacctagcaaaccaaaacgtggtcgtcatgcttcaaaagttgcatgcaatggtaaccctaaccctagaaataggagggacattttgattggccttggaggactttatggtgctactactcttagtggtaacagcaccggttcagcctttggtgctccggtgtctcctccagacccaactaactgtgttccgccactattgccgggcgaaaatgatgtcaattgttgccctccatccccaatcgtagacttcgagttcccttcacacaaaagacttcgacatagacgacctgcacaatgggtcgatgatgattacctaaacaagtacaaggaagccgttaggctcatgagagcccttccacttgatgatcctcgaaatttcatgcaacaggcaaaaattcattgtgcttactgtcataatggctatcgccaaaaaggtttccctgatcataatctccaagtccacggcaattggctattcgcccccttccatcgttggtacctctacttccatgagagaatcttggggagcttgatcggtgacccaacttttgctcttccattttggaactgggacaatcccccaggcatggcaatgccagccatttacactgatgaaaattcccctctctatgaccctttcaggaatgccctccatcaaccaccagttattgtagacctagccaacgaggccaatattcttgacccaagtaagcaaatcgtgaacaacgaaattacaatgttcaggcatgttgttattgaggggataagccctagcctcttcctcggaaaaccctactatgctggatgtgagccaaataaccctggtgctggctctctagaaaaaggtccgcacaataatgtccacagatggactggtgatcccacacaacctcataggatcgacatggggtatttggcttgggctgcaagagaccccattttctttgctcaccattcaaacgtggataggatatggaacatatggaaaacaataccgggagggtttagaagagatttcaacgatgatgattggttagagtccagctttctcttctacgatgagaacaagaaccttgtgcgtgtgaagatcaaagattgtcttgactccagaaagttggggtatgattacgaatatgttgatgacacgccatggctgaatgttcgtcctagacccaaatatgcggttcctctccccctcccgtttccacttccacaacctttgccgttccctctcactttgaattccattcaacgtacaactgtgaagaggccaaagaaggaggagtcatggagcgaggtagaaaaggcggaggtgttagtgatggaagttgagtatgatatgactgaggatgtgaaatttgatgtgtttatcaacgaccaaggtgacgatgagataggacccgaggattcggagtttgcgggaagctttatgaccttggctcattcgcatgggcaccaaagcaagaggacaacaacttctcttagattggcaataacggatctgttgaaagatttgcatgcactggacgatgaaagtattgcggtcacactggctccaagatatgggaacaagcctgtcacaattaagggcataaagataaagcttgtccctctggtggagtatgttaatgtataa

SEQ ID NO: 1495 - DNA, 1815 bp, Glycine max var. Williams 82
atggcttcttctacatcacatccatccttttggtccctcctgaacctgtctgcatccattcccatttcttcttccgtatgcatgttcccaccgtctaaaaaacctagcaaagcaacaaaacggcgtcatgcttgggaagtagcatgcaatggtaaccctagaaataggagggacattctgatcggccttggaggactctatggtgctacaacaagtctcacaagtaacaacactggttctgcatttggtgcttcattgtcgcctccagatccaactaactgcgttcaaccggacccagaaaaagaccctttttgcccaccaccccccttcaaagactacgagctccctccacacgatgacaagacattaccccttcgaattagaccagctgctcatttggtcactgatgattacatagccaagtacgaggaagccgtgaggcgcatgcaagaccttccacctgatgatcctcgcagtttcatgcaacaggccaatgtccaccgtgcctactgcgatggtcgcggctataatcaaaagggcttcgctgactacaagcttgacgttcacggctcctggatattctttccttggcaccgctggtatctctatttctatgagaaaatcttggggaagatgatcgatgaccccactttcgctcttccgttttggaactgggacaatcccgccggcatgagaatccctcccattttcacagacaaaagttcacctctctacgacgaacacaggaatagcgatcatgtaaatgctttcatcgacctagactacaagaaggaccattctcctgtgaaacctcctcaaacaattatatggccgccagtggtgaaaaagaataactcgatcgtcgacaacttgatcgtcaacaacttgataaaagtttatacggcagttgcaagcaaaaccaactctagcccagactccttcctcgggccagcattcgaagttggttctgatcctaagaaacactttggatctctggaatctttgcacaatactgtccacagctggaccggtgaattagaaaaacctaaccacgacatggggttgttggctacggctgcaagagatcccattttctttgctcaccattcaaacgtcgataggatgtggaacatatggaagacagaattgctggatggaagaagatttgatcacaaaagtgacgaatggttggaatccagtttcttcttctacgacgagaacagtaactatgtgcgtgtgaaggtcaaagactgcctcgactccaagaagatggggtatgattaccaacgtgttgaccttccatggctgttggctggggaactcatcaaaccaaagaaggagattattccccttcgttcaaaaccagaagcttcaacattcaagacattacagctccctctccttctggaatccattgagcgtacaaacgtgaagaggccgaagccgcgatccaggaacgagaatgaagaagaagaaggcgtagaagaggtgttagtgatagatgttgagtacgatagcactgatggtgtgaggtttgatgtgttcatcaacgaccaaggcgataatgagattggaccccaggattcagagtttgcgggaagctttgtgactttgcctcactcgccgcatgtcaaccataacaacatcaccagagcttctttcaaattgccattaacgtatcagttgaaagacttgggagtaacaaaagacgatgatagtatttctgtcacactggctcccatatatggagacaagcctgttacaattaaggacgtaaggataaagcgtgtttatcctgaggtagacgatgaataa

SEQ ID NO: 1496 - DNA, 969 bp, Glycine max var. Williams 82
atgggtgccacctctatggtccgaggaggagtcacgaggtttctaccccgaagggaatatttggggtgcgagaaattacaacttggagatgtggagtttgaatttctcgatgatggtgagatcatgtcgttggccaaaagtgaaggttctggcgatgagtttcatcaatccaatgaaatggaattggatgatgaagatgatggtgagagggttgatggtggcagcgttgaggagaatagaagcttttgggataatcaacaccagcttttgcagaccaacctatatagaacaacttcagttgagtcaaggataagaaatgtcaccaaagaagccgttcaggatatacaaaacgcggaaatagtgtgcagttgcagtagacagataatttccagatcctgtagaaactgtttcatgatacaagtctcaaggcgccttcagaagtctggttatgacagtgccatttgcaaaacaaaatggagcagctcaccaagtattccatcaggggagcatacttttctagatgttatagacagcagaagcaaaaagcaagaaattagggtgatcatagaactgaatttccgagcagagtttgagatggcaagggcaagtgaagagtacaacgggcttgttcggaagctccctgaggtgtatgtggggaaaatagagagattaagcaacatcatcaaggtgttgtgcatgggagcaaaaaggtgcatgaaggaaaacaaaatgcacatgggaccatggaggaagcacaagtacgtgcacgctaagtggctaggtccatgcaaaaggaacacctcaacaacttcactttcaaattcaatgatgggaaattccgaggtgatgatgccaaaaccaaagcctagggcatcactgctaacagtggatctgatgctagaaacgaattctaagacagaaatgttgaagcttcccaatatgcattgttcagctgttgcagttttgtaa

SEQ ID NO: 1497 - DNA, 1276 bp, Glycine max var. Williams 82
gtatatataaatagcccttttccttaatccaatttccacacaccaatttgttttaagtcaaaaaaataaagaccaccttgttcggttgtttttgttgttatgggtgccacctctatggtccgaggaggagtcacgaggtttctaccccgaagggaatatttggggtgcgagaaattacaacttggagatgtggagtttgaatttctcgatgatggtgagatcatgtcgttggccaaaagtgaaggttctggcgatgagtttcatcaatccaatgaaatggaattggatgatgaagatgatggtgagagggttgatggtggcagcgttgaggagaatagaagcttttgggataatcaacaccagcttttgcagaccaacctatatagaacaacttcagttgagtcaaggataagaaatgtcaccaaagaagccgttcaggatatacaaaacgcggaaatagtgtgcagttgcagtagacagataatttccagatcctgtagaaactgtttcatgatacaagtctcaaggcgccttcagaagtctggttatgacagtgccatttgcaaaacaaaatggagcagctcaccaagtattccatcaggggagcatacttttctagatgttatagacagcagaagcaaaaagcaagaaattagggtgatcatagaactgaatttccgagcagagtttgagatggcaagggcaagtgaagagtacaacgggcttgttcggaagctccctgaggtgtatgtggggaaaatagagagattaagcaacatcatcaaggtgttgtgcatgggagcaaaaaggtgcatgaaggaaaacaaaatgcacatgggaccatggaggaagcacaagtacgtgcacgctaagtggctaggtccatgcaaaaggaacacctcaacaacttcactttcaaattcaatgatgggaaattccgaggtgatgatgccaaaaccaaagcctagggcatcactgctaacagtggatctgatgctagaaacgaattctaagacagaaatgttgaagcttcccaatatgcattgttcagctgttgcagttttgtaatcgtaattaagacagaaaagtagctaggtttcatttctctctctttaaataatttatttgtagcaataggttggtacttcaaagttgccctgaatttgaaagatccattaaacatgtacctattttttttatattttttttattgatatgttgctttacatatagggtgactcaattgagggttaaaatcatatttattttgccatta

SEQ ID NO: 1498 - DNA, 1962 bp, Glycine max var. Williams 82
tcaatttcatccgttgccgaaaaagaagcatatgatataccaaacgttgtcgtgtcaacagggttcacggtcctaattcatccacgcgtcacaatgtgattggaagaggtgccgttgccgtgacgaagcaacgctacgtttttttgttataaaatcgaagtaatacgcaaccattcttcgtaccaaagctgaatagccattcgtattgtcgcagagaaagaaaaccctagctcaccgtttcaagatgcaaatcttcgttaagaccctcactggtaagaccatcactctcgaagtcgagagttcagataccatagacaatgtaaaggccaaaattcaagacaaggaagggatcccaccagatcagcaacggctcatttttgctggcaagcagcttgaggatggacgtacccttgctgattataacatccaaaaggagtccactctccacttggttcttcgtctccgtggtgggatgcaaatctttgttaagaccttgacgggaaagacaatcacccttgaggtcgagagctccgacaccattgacaacgttaaggctaagattcaggacaaagagggtatccctccagatcaacagaggctgatctttgctggaaagcagcttgaggatggccgtacccttgctgattacaacatccagaaggagtccactcttcacttggtactccgtctacgtggtggaatgcaaatctttgttaagactctgaccggaaagacaatcacccttgaggtggagagctctgacaccattgacaatgttaaggctaagattcaggacaaagagggtatcccaccagatcaacagaggctcatttttgctggcaaacagcttgaagatggccgaaccttggctgattacaacatccaaaaagaatctaccctccacttggtgctccgtctgcgcggtggtatgcaaatctttgtgaagacccttactgggaagaccattactttggaggtagagagctcagacacaattgacaatgtgaaggcaaagatccaagacaaggagggtatcccaccagaccaacagaggctcatttttgctggcaaacagcttgaagatggccgaaccttggctgattacaacatccaaaaagaatctaccctccacttggtgctccgtctgcgcggtggtatgcaaatctttgtgaagacccttactgggaagaccattactttggaggtagagagctcagacacaattgacaatgtgaaggcaaagatccaagacaaggagggtattcctccagaccagcaaaggttgatttttgctggaaagcagcttgaagatggacgtacactggcagactacaacatccaaaaggagtccacccttcaccttgtccttcgtctcaggggaggtatgcagatctttgtgaagactttgacaggcaagactattaccttggaagttgaaagctcagacacaatcgataatgtcaaagcaaaaatccaggacaaggagggtatcccaccagaccagcagaggttgatatttgctgggaagcaattggaggatggaaggactcttgctgactacaacattcagaaagagtctactcttcaccttgtgttgcgtcttcgtggtgggttttaaaagtctgagaatgttctgtaggtgtcttgaagtctaagcatgtggaagttccgaagatctttgggttttttttttttaatgttcctgaaaggtttactcttgttaaagtgtttccatggtcaatagtggcctttgaaaaactgttgtttgttctggtctttttataaattctgtttggttcgtgaatttgtgaagctaccttttatgaaatttagttctttgctatgaataagtacaatctgttgtcatgtttgatgaaatttatgttcaatatcttccgatttagcagcacaaatcttttaataatatctatataagcagatagaatactgtaattcgttttc

SEQ ID NO: 1499 - DNA, 3024 bp, Glycine max var. Williams 82
atgacaaacccaaaaccactcatagtcatagtttacattctcttgtcactactagcaacaacaacaacaacaacgttggtgtcgtgtctgaaccaagaaggcttatacctctaccagctgaaactctcctttgacgacccagactcgaggctctcctcatggaactcgcgagacgccactccctgcaactggttcggcgtaacctgcgacgccgtatcaaacaccaccgtaacggagttggacctctccgacaccaacatcggaggcccattcctcgccaacatcctctgccgtctccccaacctcgtttctgttaatcttttcaacaactccatcaacgaaaccctacccctcgaaatctccctctgcaaaaacctcattcacctcgacctttcccagaatctcctcactggcccactccccaacacgctccctcaacttgttaacctcaaatacctcgacctcaccggcaacaacttctccggctccatccctgattccttcggaaccttccagaacctcgaagtcctctccctcgtttcgaatcttctggaaggcacaatcccagcctccttgggtaatgtgagtactttgaagatgctgaacttaagttacaacccctttttcccgggtcggatcccgccggagattggaaacctaaccaaccttgaagtactctggctaacgcaatgcaacctcgtcggcgtcatcccagcctccctggggaggttgggaaggctccaggatctggacctcgcgctcaacgacctctacggctccatcccgagttcgctcactgagttaaccagcttgaggcagatcgagctgtacaacaactcgctctccggggagcttccgaagggaatggggaacctctctaacttgaggctcatcgacgcgtcgatgaaccacttgaccggaagtattccggaggagctctgttcacttccgttggagagtcttaacctttacgagaatcgcttcgagggcgagttgccggcgagcattgctaattcgccgaatttgtatgaattgaggcttttcggtaaccggcttaccggaaggttaccggagaatctcggcaaaaactcgcctctccggtggcttgatgtttccagcaaccagttctgggggcccattccggcgacgctgtgtgacaaggtagtgctagaggagcttctggtgatttacaatcttttctccggggagattccgtcgagcctcggcacgtgcctgagcctgacacgtgtgaggctcggcttcaaccggctctccggggaggttcccgcggggatctgggggctgccgcacgtgtatctcctcgagcttgtggataactcgttttccggttccattgcgaggaccattgctggtgctgcgaacttgtcgctgttgattttgtcgaagaacaacttcactggaacgattcccgatgaggttgggtggttggagaatcttgttgagttttcagctagtgataataaattcactggttctcttcctgatagtattgtgaatcttgggcagctcgggattcttgattttcataacaataagctctctggggagcttcctaaggggattcgttcgtggaagaagctcaacgatttgaatttggcgaacaatgagattggtgggaggattcctgatgagattgggggtttgtccgtgctgaattttctggatctttctagaaaccggttttcggggaaagtgcctcatgggttgcagaatctgaagctgaatcagctcaatttgtcttataatcggttatccggtgaattacctcctttgttggctaaggatatgtacaagtctagttttctagggaatcctgggttgtgtggggatttgaaggggttgtgtgatggtagaagtgaggagaggagtgtgggttatgtttggctgcttcgaacgattttcgttgttgccactttggttttccttgttggtgtggtttggttttactttaggtacaaaagtttccaggatgcgaagagggcgatcgataagtcaaagtggacattgatgtcgtttcataagctgggttttagtgaagatgagattttgaattgtcttgatgaggataatgtgattggaagtggatcgtctgggaaggtctacaaggttgtgcttagcagtggggagtttgtggctgtgaagaagatatggggaggggttaggaaggaggtggagagtggggatgttgagaagggtggtagggttcaggacaatgcttttgatgctgaggttgaaactttgggtaaaatcaggcacaagaatattgttaagctgtggtgttgctgcaccactagggattgcaagctcttggtttatgaatatatgcctaatggaagtcttggtgatttgcttcatagcagtaagggagggtcgttggattggccaacaaggtacaagatagctgtggatgctgcagaaggcctctcttatctgcatcatgactgtgttcccgcaattgttcatagagatgtgaaatctaacaatattttgttggatggggacttcggtgcgagggtggctgattttggagtagctaaggcggttgaaaccacaccgataggaactaaatccatgtccgtcatagctggctcttgtggctatattgcaccagaatatgcatacactcttagagtgaatgagaagagcgacatatacagttttggggttgtcatactcgagttggtcaccggaaaacacccagtggaccctgaatttggggagaaagacttggttaagtgggtgtgcacaacctgggaccagaaaggtgtggaccatttaattgactcaaggcttgatacttgtttcaaagaagagatttgcaaggtcttcaacattggactcatgtgtactagtcctcttcccatcaaccggccttcaatgagaagagtggtgaagatgttgcaagaggttagcacagaggaccaaaccaagcctgccaagaaagatagcaagttatccccttattactatgacgatgcctcggatcatggaagtgttgtttaa

SEQ ID NO: 1500 - DNA, 1854 bp, Glycine max var. Williams 82
atggttgcgggtaaggtaagagtagcaatggggtttcagaagtcaccggcggcggcgcatactactcctccgccgcagaagaagcagcctcctcctccgtcgccgtccaccgcgaaatcctcgtctcacaagtcctcattctctcgctctttcggcgcttactttccgcgctcttccgcgcaggttcagcctcggccaccggacgtggcggagctgctccgcctggtggaggagctccgggagagcgagtcgcgcttgaagacggagctgctggagcacaagttgctgaaggagtccatcgccattgtccccgttctggagaacgagatcaccgcgagggaaaccgaaatcgaaaggagcagaagaagagcggaagaagcggaatcagagaacgagaggttgagaaaggaattgcaggaactgaaggtgaaagcagaagaagagaaaaaagagaacgagagaaaaatcaaagcgctggaagaggaaatagcagagttgaagaaaacggcgtcgtttagtggtagcagtagcagcagcaacagaacagaggcattggagattcacgagcaagaagaagctacacataagctcgtggaggtatcgtttaggtcgaatctgatgaggagtttgaagaaaacagcgtcagatctcggaagcgggaatttgaaaaaagaggtttcggaaatttctgaaaggccacgtcactcgcggtgtaactcggaggaactcgttgattgctctgactcagttctgtttggttctgttgggtcacgggcgccacgtgttccgaatcctccgccgaagcctacgtcttcttcttcgccgtcgtcaccgtcgagcgtttcctccggcgaaacagagcgaaggattccgccaccgccacctcctccgccgaggaagcctgcgtcgaatgcggcggcggcacctcctccaccgccgcctccgcctccggcgaaggcggtaagagtggctccggcgaaggtgcggagagtgccggaggtggtggagttttaccactcgctgatgcggagggactcgcattcgcggcgagactctggctccggcgcagagatgccggcgacggcgaacgctcgtgacatgatcggcgagatcgagaaccgttcgactcacttgttggcgataaaaacagatgtggaaacacaaggagactttattagatacctgatcaaagaggtggagagtgcagcattcacggacattgaagatgtggtgccttttgtcaaatggcttgacgacgaactctcttatttggtggatgaaagggcagtgctgaagcacttcgattggccagagcagaaggctgatgctttgcgtgaagctgcgtttggttattgtgatttgaagaagttggtatctgaggcttcgtctttcagggatgatcctcggcagctgtgtggtccagctcttaagaagatgcagactctcttagaaaaattagaacatgggatttacaatatctcaagaatgagagagtcggcgacaaagagatacaaagtgttccaaattcctgtggattggatgcttgacagtggctatgtcagccagatcaagctggcatctgtaaaattggctatgaagtatatgaagagagtctctgctgagcttgaaacaggtggtggtgggcctgaagaagaagagcttattgtccaaggagttagattcgcgttccgagtacatcagtttgctggaggttttgatgtggagacaatgagggcgtttcaagagttgagagataaagcgaggtcatgccatgttcaatgccacagccagcaacagaaattcttttgcaggtctgcaacatatgatggagcaaactcagcttcagagaattag

SEQ ID NO: 1501 - DNA, 1425 bp, Glycine max var. Williams 82
atggagatcattgttgccattttcttttgcattctcctcttcttctcatcccttattctttcgtatccactaataaagaaacacaagaaacgtcaacacgtagctaagcctaagcttccccctggctcaatgggttggccttacataggagagaccctccaactctattctcaagaccctaacatcttctttgcttcaaagcaaaaaagatatggagaaattttcaagacacacatactaggttgtccatgcgtgatgttggcgagccctgaggctgcacggtttgtgttggtgactcatgctcacttgttcaaacccacataccccaaaagcaaagagaagctaataggcccttcagcattgttcttccaccaaggagaataccacactcgcatcaggaagctggtgcaaacctctctctctcctgaatccattcgaaaactgatcccagacatcgaaaacgaggtcgtttcctccttggaattgtgggtttccgctgctggacaagtcattaacgctttccaagaaatgaaaaagttctctttcaatattggcatcctctctgtctttggtcatttggaagacaattatagagatcagcttaaggaaaactactgcatagtggagaaagggtacaattctttccctaacaggatacccggaactgcatactccaaagcactcttggcaaggaggagaatcagagagattataagtgagatcatttgtaagagaaaagagcagagattgatggagagggatctattaggccacttgctgaactacaaggatgaaaaaggacaaatgctaagcgatgaccaaattgctgataatgtaattggggtactatttgcagctcaggatactacagcaagtgttctaacctggattctcaagtatcttcatgatgaccagaaacttcttgaagcaataaaagcagagcaaatggcagtatatgaagctaatgaaggagggaagatgccattgacatggggtcagaccagaaatatgccaattactcatagggtgattttggaaagccttagaatgtcaagtatcatatcatttacttttagggaagctgtggttgatgtagtatacaaaggatatcttatacccaagggttggaaagtcatgccactgttcaggaacatccatcataatccagaattccacccttctcctcaaaattttgacccatcaaggtttgaggttgctccaaagcccaatacttttatgccatttggcaacggagtgcactcttgtccaggaaatgagcttgccaaattgaacatgttccttttaattcatcatcttgtaaccaaatataggtgggaagtagtgggatatcagaacggaatccaatatagcccattcccagtccctctgcatggtctacctacaagattttggagaaacgaatag

SEQ ID NO: 1502 - DNA, 321 bp, Glycine max var. Williams 82
atgaggcctttcctctattttgctacctacgcaaaaatcaaaggctttgtcgaggggttcaaagccaacttgtggcataagaaatttggatctatctctagcatgtcactagaacaccatgcaaaaacattcgagttacgctttagcacctttaaaaggccatcttcaagcaggggtataagagtcgtgtcgatctttaccttcttcccctctgcaatctctagttctttcacttcctctatcggagtcggacgtcgatcgacaactcttcggggcatcattaaattctttaggactttcaagtcaacaaaagcgccctaa

SEQ ID NO: 1503 - DNA, 360 bp, Glycine max var. Williams 82
atgataggtttcagagaaagagaaaggacaagagaaagaaggctttcttgggccagagttgcaattttcttcttgtgggtcatcctagttttttctctaataagcttgtttttctccatcaacaacgaacgcagaaccagaaccagaaccagccattcaattcctccaaaacgacgtagtttcagcagggccttgtttcacacaccctcaagaagaaccaccaccaccaccactaaaaaaaccaagcttgttgtgagctcaaaaaatggtgatgatcgtgatccacaccacactactaatctttatggggatgagaagagaataattcacacaggtccaaaccctcttcacaacaagtag

SEQ ID NO: 1504 - DNA, 1066 bp, Glycine max var. Williams 82
attataagaagcttccaggaatcaagggtcaagatcatgtgactagacccataagagaaggaaataacccaaacttttttgtgttttatttttatttttttgtactatacattttattttgtttgactctctttctttctagctaatacctctcttcacagttttcccctctcccaatcatccaaaaaccacagtcactactacttactttgtgttgtttccacacactgtgcttcgggtcaaggagacatcttttttttttttttttttgtgcactttcatggtgcccttgttgtgggtgttctgaaagcttctttgtgtgagtgacacatctacagcaactgcaatgataggtttcagagaaagagaaaggacaagagaaagaaggctttcttgggccagagttgcaattttcttcttgtgggtcatcctagttttttctctaataagcttgtttttctccatcaacaacgaacgcagaaccagaaccagaaccagccattcaattcctccaaaacgacgtagtttcagcagggccttgtttcacacaccctcaagaagaaccaccaccaccaccactaaaaaaaccaagcttgttgtgagctcaaaaaatggtgatgatcgtgatccacaccacactactaatctttatggggatgagaagagaataattcacacaggtccaaaccctcttcacaacaagtagtagtgtggcaaattccatccatggtaggaggttaatttatttttgtatgctagctagtagtgtttaatgcatgctagttattaagttctagtgcatatcaatgtaatccatccaatatccctatgttgttatatcctctttttttgttttttgtttttagccttttatcttacattttgtatttggaaaaagaatgagagcatagctttagccttttcaattacttggagaaaaatgaagaggctagtgttaatgctctagtttctttcttttgcagtaatgaattttccttcctttcttttctgtgtatctatctgtgcaaaactgaaaaccacagtgtgtgagaattaattggcaaga

SEQ ID NO: 1505 - DNA, 1308 bp, Glycine max var. Williams 82
atggcaacatttatccgaagaatggcaatcagctatattcttctgacattgtttttctctgcagatattggattttttggacgtgttgcatcatttggaatcaactatggccaagtagctaacaatttgccgccgccagacaaagtccttgaactcttgaccaacttaaaggtgacaagaacaagaatttatgacaccaatcctcagattttgactgcttttgctaactcaaacattgaggtaattgtgacggttgaaaacaacatgctaggccagttaaacgatccccaacaagcccttcaatgggtgagtggccatatcaaaccatacctcccagacacaaagatcacagggattcaagtagggaatgaattattcaccaatggtgacaccactctcattcagtatcttgtgccagcagtggtgaacattcacaatgctctagttcagctaggcctagactccaacatccacgtttcgacgccgagttccttagaggtgcttcaggaatcttaccctccttcagctggtagtttcaagagtgagatctcagggatcatgtcccaatttttgaacttcttggccaccactaaggcacccttttggatcaatgcctatccttactttgcatacaaggatgaccctaataggattccattggactacgttttattcaatcctaatgaaggaatggttgactccaacaccaacctacactatgataatatgctctatgctcaggtggatgcagtctcatttgccattgctaaattgggttttagtgggattgaggttagggtctctgagactggttggccatccaaaggagaccctaatgaggttggtgccacagtgcagaatgctcaaacttacaacaggaatttgctgagaaggcaaatggcaaatgaagggacacctctgagtcctagaatgaggttggaagcatacttttttgcattgttcaatgaggacatgaagactggagcaacctcggaaaggaactatggtttctttcaacctgatgcaactatggcttacaatgtaggattggctgcttttgcagactcatccacttcatccacttcaatttctcttacctcctctgccactaaaacaaagaaatcaggaccaacacactttctgaatgatgggggcaacaacaaaatctgcaatacggcgaagaggcaaggcaattcaattggaaaatcaactttctcagagtggctacactttcattcacttaccctaccattagtcacattccagcatcaagcatgtggcggtgacgttagattgagcttattttag

SEQ ID NO: 1506 - DNA, 1872 bp, Glycine max var. Williams 82
atgaggaaacatggatggcagttaccttaccatcctcttcaggtggtagctgttgctgtgtttctggctctggggtttgccttctatgtgttcttcgctccttttgttggaaagaagatgtatcagtacattgtcactggcctttactcacagctgattattagtgtctttggactgtacatatggtgtgcagcagcagatccagcagatccaggggtttttaagtccaaaaagtatcttaaaatcccagacagtaaaaagcttgctgaactaaagaattctaaactaggtgaagaatcaacttcatcaatgcatgaagcaaatgcttcaatggttggatctaattctgtggataaagaggcattgggaaaaatacgaacttcaaaagatgcttcgaattcagtagagaagagtacatcatcgtcttgttcatcctgtatcctcttggtttcttctccttgtgcatatatctgcagctgctctagtccaactgagaaatcttctgataaacaaacaagtgaagatggcatgttctattgcagtttgtgtgaagttgaggttttcaagtacagcaagcactgtagagtctgcaacaagtgtgtagaccactttgatcatcattgccgatggcttaacaactgtataggcaaaaagaattatcgacaatttttcaccctcatggttgcagctatgctcttgtttattcttcaatggttgactgggatacttgtgcttatctgctgttttgtcaagaggaaggaattttctgtggatatctcctccaagttgggaaccagtttctctttggttccctttgttcttgtggtgtctatctgcaccattctggctatgattgctaccttaccggttgttcagcttttcttctttcatattctcctcattaacaagggactcagcacatacgattacatcatagcaatgagggagcaagagcaggagcagctaggaaatggaggtcagcaaagtccccaaatgtcaactgttagctcatttactggattgagtagtgcaagctcctttactactttacaccgaggtgcatggtgcacaccccctcgcctgttgcttcaagatcagtttgatgtggtgcccccagaaacagcatctgtaagttcagtggggaagaagacaatgagagaagatccattaaagaaaaagaatcctggaacagtcaaaattagtccttggacattggcacgcttaaatgcagaagaaatttctaaagctgctgcagaagcaagaacaaaatccaaagttctgcagcctgtaacaagacatggtgaggctatcaggctagaaccagaaagcagttttagtagcagtggccgaagaatggttcccagaattgagagcaataagaaaggagctagtaagcggattcatcatcccgccaacttgtctatggagtccttgacaaaagtttctgccagtaatactgataaaggcttgagtgggatgtctaggttggcccctctcccatttgaagcacacaacacatttcaaacaagtcaaccaatgtcaagctcagctgggattgttccttcatctcctgaaagcagtttagactctcctgatattcacccttttagggtgtcttcatcaggtgctgaaaaagcaagacagcttgcagttgcaggtgcttcaggtgctggtgctgcaactctgaaggaaatttcactgtcaggttcaactagtgatggatatgaggcttctggtggggaagatagtgaccgggttgttccttttaggattgttcagagatctacaaattggactaatcttttcagagctgatcaggatgagagggcttttaaaaagcctcaatcttcaaccattgttggtcatagatag

SEQ ID NO: 1507 - DNA, 702 bp, Glycine max var. Williams 82
atggaaggtagcacaacaagctctgaactccctcctggctttaggtttcacccaacggacgaggaactgattgtgtattacctttgtaaccaagccacctcaaagccatgccctgcatctatcatcccagaagtggatctctataagtttgatccttgggaattgccagataaaacagaatttggagaaaatgaatggtatttctttagtccaagagacaggaagtacccaaatggggtgaggcctaaccgagcaactgtgtctgggtattggaaggctactggcacagacaaggcaatctatagtggatctaagaatgttggggtgaagaaatctttagtcttttacaagggtaggccaccaaagggtgccaagactgattggatcatgcatgagtatcgattggctgaatcaaaaataccagctagcaggaaaattgggtccatgaggctggatgactgggtcttgtgcaggatctataagaagaagagcatggtaaaagcattggagcacaaagaggcacacccagaagtccaaattgctaatcttgcgcctgcaaatcatgatgttgaacagaaaatgatgaaccttcctaggacttggtcccttacttaccttttggatatgaattacttgggtccaattttatctgatggctcttattgctcaaccttggattttcaaattaacaatggggattag

SEQ ID NO: 1508 - DNA, 2313 bp, Glycine max var. Williams 82
atgggttctagaaaccttgttatggtcaaaactcacattggttcaatcaatgtgtcttttgctaatggttttgtctatgaaaacgtgctttgggcattgccttctctttgtgttttcttctgcagctatgtgctgtattccttggggttgattctcagatacatcttcagatttcatgtagaagataggaaaagtgagcaccttgttccacatgatctgcttgatcaaaccaagagatatcggattgaagattctaaggttgatgggttcgcagaggagttagcaaatttgttttctgttttaaaggaactagaagaagaaatagagttctctgttttagaggagaaagactctgatatgcatgaagatagtaacgaaagagaaggagaagcatgcgagtctgttttcttggagactgttgcatatgttcatgaagatgttaagaaaattggtgaaaatgaaacagagagctttgttttcatggaggatgattccaatactcctcaagataataaggagaaagtagaagaagaaaaaacagaagagtctttcttcacagatactgactctgttgaagctagtagtttggtagaagaaccaaggatcttgaccttctctttccaacaaaattatatagctgcaaatgattctgataatatattttccagaactgaaaatattgctaaaatggaatttccagagaagaatttggagaaagcccttgttgctcaagaagagaaagagcaatttgttcaagatgagagaagcatcacatccaattccactttcggtcaaatctttcaaattaatgcggtcggtggaagtgattcatcaaatgatgaccaccttcaacacgataacacacttcaatatgattttgggtcagaatcatgcagcagcggcattgatgattcggtaagtcataaagatgaaagagttgaagacggagaggaaactcaatattcatgggacagtgaagtctcatacaatcacaattttcatcttgatgaaaacaaggatgtaatggaaggttcttcatattgtggagaagaggaatgcaggggaagcatggagaaaacaaaagaaaccatgtgggaagataacttggatgaatcagattttgatgaagaagaggatgaagatgaggatgattttgagtgggagcatgatgaggtactggaacaattgaaaatggagcttaaaaacgcaagacaaggagggcttgccactattttggaagaggaagaagaagaggaaacagagtctccaaaagttgttgaggatcgaaagccattgaagattgaagagaagaaagaattcaaggatcacattgttgaaattcaaaaggtttatcggtgctatgcagagaaaatcaggaaactggacgttttgaattaccagaccatgcatgcaatagggcttcttgaactaaaagaccctctaaaattaatgttaatcccaaaatcaaccgtccaaagtgccaagcctctatctcagaatttgtggccacggaaaacacaaaagcaaatatctgacccaatgttgaagtttgttcaagaactccatggagatttggaattggtgtacgttggtcaggtttgcctctcatgggagatcctgtgttggcagcacaagagagttcaagtgttaaaacaatgtgattcacaatggcctcgtagctataatcttgtggcgggtgattttcaactctttcaagtcctcatgcaacggtttttggaggatgaaccatttcaaggcccaaggattcggaattatgtcaagaaccgttgtcttattcgcaacttgctccaagttccagtcattaaagatgataatacaaaggacaagaaaataattaagttgggtgaagagcatgcaattgatagtgaaaggttggaacagatcatcaaagagtccatgcgggtgttctgggaatttgtcagagcagataaagattatgggaatgtaatcaaagtttttcatcaaacaggaattcatgtcaaggacccagcaatttcagatcttcttgggaatgtccgaacccaattgcaaaagaaggagagaaagctcaaggacacggtgaggagtgggaattgcatagtgaggaagttcctaaagcacaatgaggaacaaattcaacttgatcaagagcagttgcttgctcaagtgggattgagattggtctcaagggtgatgcacatgaaaaaattgagaaaagatcaactaatgtggtgtaatgaaaagttgaaccgaatcaaattcgatggcaggaaggtccaggtggagccttcttttttgttttttccttgttga

SEQ ID NO: 1509 - DNA, 381 bp, Glycine max var. Williams 82
atgcgtcgttcaagatggttatttccatacaaacccccacttccatacatcacttcaaattctttgtttcttcatcacttcccaccttcacttcacttgtgttgtgtgttaatttctctctctacccaaacaaagaaacagagtcacgcacacaaaaacatgtcccgccatcgccggcaagcttcccaggtcctgccgccggagattctcgccggcgaagacctcgcaaagtcacttgacctgacccaacaagttgctgatcaagttggaaccaccaaaagcaccactatttccaccaccaaccaacaacaccaaggcaggcaaatcccttctccggcgaccgccgctaagaagtcactgccaccgggaaaatctacctga

SEQ ID NO: 1510 - DNA, 2845 bp, Glycine max var. Williams 82
cttgttgtaaaatgtaaagagcttcgctgctcatatgtaaacggacggacacctatctcgattccccagtaagtgcctccgccattcaaacggaattttcgcaagaaaacaagttccggccaccatggcaggaaagtttggattaggggaaagtttacttccatgtaaggtcgaagaagaccatcacactgagcaaggatttatggcagggatgaataaaaaagtataccagactcgtagttctagtgacaaagagaaagcaaagtacatggtttggacaaatgaaatggacaagtgcctcaccaaggtactcgctgagcaagtaaaaaaggggaataaagtggataacattttgaagccagcagcatttgcaggtgcactgaaaacattgaatgaaaagtatggtttgtatttgacaaaagaacacataaaaaatcggctgaagacatggaggaagcagtttggggttttgaaggaactgcttgctcatagtggatttatgtggaatgagacaaaaaagatggttgttgcggataattctgtttggaatgactacatcaaggcacaccctgatgcaaggattttccgagcaaagtccatagaaaactatgatcaattatgtactatccttggaaatgatcaagcaattgcaagcctttctgacaatgttacagacatagatgtaacatttgcagttgataagggggatccagatcttgccattgtgtctgaaatacaaactgatggaaaccagactaaaaactttaggtggacagttgcaatggaccattggcttggaaagattcttgtagaccaagtgaggaaagggcttaaagtagataaagtttttctgacagaagcatataacacagctgtttcagccgtaaatgcaaaatttgggctgcatctaacaaaattcaatgttaaaaatcgacttaaaacttggaagaaacagtttgaacagttaaaggaaattctgtctcatactggatttaagtgggatggaacaaagaaaatgatcattgcaaatgattctacatggaatgactacatccggacacatctagatgcaaggactttccgtggtagagtttttgagaactatgatcagttctgcattatttttggccatttttatgagcctttgcattgggatgaatctgggacttgtgatgagacagttgaggctctaagtgtctacccagttaactatgatatcagtgtaggaaggcacataaggtggacaagtgacatggacagttgtctatctgcaatccttgtgcagcaaataaaacaaggtaacagaagcaaatttgactacacattgagacctgatgcatttgaagcatctgtgttggctattaatgagaagtttcagctttatttgacgaaagaacatgttaaaaatcgtcttagaacatggaagaaacagtatgccattctgaaggaacttatgacccagagtggctttgaatgggatgagaagcgaaaaatggtaattgcaaatgattctgtatggactgaatatattaagaaaaatcctgatgctcgaattcttaaaggacgagttatcagaaactacaatgaattgtgcataattctaggtcattgtgatccagcagatagttccattaatggtgcttgtgctaatatgggtatgactacagacgatggtgttatggaggttcaagagacaaaagaaaaagaaaaagttaagaatgttgtgacatggacagatgagatggatcattgcttgacagagttgctagtcaatcaagtaatgttgggaaacaggcttgagaaatttttcaagacctccgcatatatagctgctctaactgctctaaatgagagatttgacctgaatttaacaaaagaaaacattataaaccggttgaaaatatggaagaaacagtatgacgttttgaaggaaatgctctctcaagggagatttgagtgggatgagggatgtaagatggttgttgcaactgacttagcatgggatgaatacattaagaaacatccttatgctaggcatttgagagaccggcatatagagaattaccatgaattaggtatgattgttggtgatgagcaaggaagtggaaattggtctgaaaactttgagaggtttgatgtaaatcttacacctaactatgaagagcatgcagaagctcctgcactggtgttggctgatgtacagataagccctgatgctaatgcaagtgatgaagtgcagggttcatctgagcagacaagggcaaggccttcatcatcacaatcacattcaaagcaaccatcaaaaagaagacgcaccagtgatgttatgctagaaatgatgagtgttatggctgcagatatcagtcgaatcgccgatgcattgagtgaaaataacaagaccgtgtgcttggaggaagtggttgaaaaggtacaaaatatgccggactttgacgacgatctcatcattgaagcttgtgagtatttatgttttgacgaaaagagggcattgatgtttttgaaattagatgagagattaaggaaaaagtggttgttgaaacgattgcgtggtcaaggtagttaaatagatcttcttttggtgtgtatgtaggtagttaaaatagatgtttgaagatgttggcatgtactttaggtacccctagtttaggttgttactttctgtaataagaaactaacattgaggggaaatgggaaaaagttatggaaagacaagctgctttagctttccttctgctgttgttggcttattgctttgtacttatggggtctgattttgtatgtagagtaaatgtcccttaataccgacttgcactcgccctaagttgaa

SEQ ID NO: 1511 - DNA, 2040 bp, Glycine max var. Williams 82
atgactagtggtagttgtattggaatctctaccatgaagccttgttgtagaatcctatgtaactataaaagtccatctatttttgggttttctccaaccaagttgagtgattcagcaatcatgggcatgttgtccagatcatgtcgtcacaactcaacccatcgccataggtacaatacctgtaatactcagaatgtagggtacataaatgggatccatccgaatcggagagattttagtgtttccggttcgaattggggtcttgctaggaattttagcactagtttttgtgtcaatattggtagttttaggcctagggttgtgtccttgataccgcatgtagcgtcggattttaggaatcactctacatcagttgattctaatgctaatgacacgagctttgagaagattttcattcaaagcagcttgaatgtcaagccattgataattgaaagaattgagactgatcaaagtaaattggaggaagtcgctgaagaaagatgtgacgagtcaaatgtaaatatagataatttgaaggatttaagtgagaataaggttcagagggaggtatctgagattgaaaaggaagcttggaagttgcttcaggatgctgtcgtcacttactgtgggaatccggttgggacagttgcagctaatgatcctgcggacaagcaaccgctgaattatgatcaagtctttatccgtgattttgttccatcagcacttgccttcttgctcaatggtgaaggggaaattgtcaagaattttctacttcacacattgcaattacagagttgggagaagactgttgactgctacagtccagggcaagggttgatgccagcaagcttcaaggttagaactgtgcctcttgacggtagcaatgaagcatttgaggaagttttggatcctgattttggtgaatcagctattggtcgtgttgcgcctgttgattcaggattgtggtggattatattgttgagagtttatgggaaattaactggtgactatgctttgcaagagagagtggatgtccaaacaggcataagactgatccttaagttgtgtctgactgatggatttgacatgtttccttctctattagtcactgatggttcctgcatgattgatagaaggatgggcattcacggtcaccctcttgagatccaggcattattttactcagctttacgctgctctcgtgagatgctgatagtcaacgatgcaactaagagtttggtggctgctgttagtaatcgcctgagtgcactctgttttcacatgagagagtattattgggttgatatgaagaagattaatgaaatttaccggtacaagacagaagagtattctactgatgctgtcaacaagtttaacatctatccagagcaaattccttcatggctagtagactggatttctgaggaaggtggatacttcattggcaatttgcaacctgctcatatggacttcaggtttttctcacttggaaacctttgggccattgtatcatctttaggcacaacaagacagaatcagggcattttgaatttaattgaggccaaatgggatgatattgttgctcaaatgcctctcaagatttgttatccagcactggagggtgaggaatggcgtataaccactggctgtgaccccaagaacaccccttggtcataccataatggaggatcttggccgacacttctatggcagttcacgttagcctgcatcaagatgggaaggcctgatttggcacaaaaagcagttgattcagcagagaaaaggctttcagcggatagatggcccgaatattatgatacccggaacggaaggtttattgggaagcaatcacggttgatgcagacatggaccattgctggtttcgtgacctcaaagatgcttctagagaatccagaaaaggcatccttgttgttttgggaggaggattttgaacttcttcagaactgtgtctgcaagctaagcaaaagtggtagaaggaagtgttcccgttttgctgcaaggtctcagtttattgtttaa

SEQ ID NO: 1512 - DNA, 1203 bp, Glycine max var. Williams 82
atggttgacactttcagtatagagagcgggcttcttataagagagtttgatgaagatagagatgttaaggtggtggggaagcttgagaggaactgtgagattgagactaaaaagggggtctccattttcaccaacatgatggatgaccctttatctaggattaggttctatccccttcatgttatgttggtggctgagctgcttgaaagcaaggagcttgtcggtgtggttcgagggtgcattaagagtatgcgaactccttctgaatcattgctgaagataggttgcatattaggccttagggtctctcctacgcacaggagaaagggggttggactaaaacttgtcaactcagtagaagaatggatgctgagaaatggggctgaatatgcattcctagcaacagaaaagaacaataatgcctctataaacctatttaccaacaaatgcaaatatatgagcctcagctcacttgtcatatttgtccatccaataattagtttccctgcaaagcacatttccaaggatataaaaattgagaaggtgaacatggaccaggcaatttccttatacagaagaaccctgagggccaaagagttgtacccattagacatggattctattttgaaggagaagctcagcttgggcacctgggtgagctattacaaagatgaaggctgcaggctcaacttgcagaggatggtagagagtgaagacataattaccaatgaaatcacaagctcatggatcatctttagcatatggaacacttatgaggcttataagcttcaacttaaaaagtctcagacgactcttaggcttcttcacacaacattaaatcatgcaagagacaaaatctttccttgtctgagaatgtcggtgagtgaatcactctgcacaccctttggatttctcttcctctatgggctccatggagagggagagaaccttggggagctaatggaatccatatggaggttcacatcaaggttgggagaaagcttgaaggactgcagagtggttataactgagttagggtttggggatccacttgtaaaccatgtccctcaaacagcttctatgtcatgcttcgatgatatctggtacaccaaaagaatttcaagccatggtgatgaaaaggatgatgaactgctgatgaagagacaaatcgggaacgtgttcgttgaccctagagatttttag

SEQ ID NO: 1513 - DNA, 498 bp, Glycine max var. Williams 82
atgggtgttttcacattcgaggatgaaatcaactcccctgtggctcctgctactctttacaaggccctagttacagatgccgacaacgtcatcccaaaggctcttgattccttcaagagtgttgaaaacgttgagggaaatggtggcccaggaaccatcaagaagatcactttccttgaggctgatgttaatgaatggatagatggagaaaccaagtttgtgctgcacaaaatagaaagcattgatgaggcgaacttgggatacagctacagcgtggttgggggtgctgcattgccagacacggcggagaagatcacattcgactccaaattggttgctggtcccaatggagggtctgctgggaagctcactgtcaaatacgaaacaaaaggagatgctgagcccaaccaagacgaactcaaaactggaaaagccaaggctgatgctctcttcaaggccattgaggcttaccttttggcccatcccgattacaactaa

SEQ ID NO: 1514 - DNA, 477 bp, Glycine max var. Williams 82
atgggtgttttcacattcgaggatgaaatcaactcccctgtggctcctgctactctttacaaggccctagttacagatgccgacaacgtcatcccaaaggctcttgattccttcaagagtgttgaaaacgttgagggaaatggtggcccaggaaccatcaagaagatcactttccttgaggatggagaaaccaagtttgtgttgcacaaaatagaagcgattgatgaggctaacttgggatatagctatagcgtagttgggggagatgggttgccagacacagtggagaagatcacattcgaatgcaaattggctgctggcgccaacggagggtctgctgggaagctaactgtcaaataccaaaccaaaggagatgctcagcccaaccaagacgacctcaaaattggcaaagccaagtctgatgctcttttcaaggccgttgaggcttaccttttggcccatcctgattacaactga

SEQ ID NO: 1515 - DNA, 486 bp, Glycine max var. Williams 82
atgaggcgaacttgggatacagctacagcgtggttgggggtgctgcattgccagacacggcggagaagatcacattcgactccaaattggttgctggtcccaatggagggtctgctgggaagctcactgtcaaatacgaaacaaaaggagatgctgagcccaaccaagacgaactcaaaactggaaaagccaaggctgatgctctcttcaaggccattgaggcttaccttttggcccatcccgattacaactaatcctcttcaacttacttgtcatcactttcttgcttggagacttatccaatcactctgttctcaacttaagttgccttccaatgtatccagtctttcctttcttctttccttttcccatataattgtgagacttatgatatatctgtatctcacttcatcaataataaattataataaagatgagcaatcattacaacttttgtttctcttatgtttactattgcgagtttaa

SEQ ID NO: 1516 - DNA, 2175 bp, Glycine max var. Williams 82
atgggtagcagcagaggacacacgctcatggaggttggacccgacggggttgccgtcatcaccatcgtcaaccctcccgttaattcactttcctttgatgtattgcgcagtttaaaggagagttttgatcaggcgatacagagagatgatgtcaaggcaattgttgttacaggtgcaaagggaaaattttctggaggttttgatatttctgcatttggtggtattcaagaggcaaaagagcgtccaaaacctggttggatatcagtagaaatcatcactgatactattgaagcggctaggaaaccatcagtcgctgccattgatggccttgccttgggtggaggattagaagttgcaatggcatgcaatgctcggttatcaactccaactgctcagctaggcttgcctgaacttcagcttggaataattcctggatttggaggaacacagcgacttcctcgtcttgttggtttgacaaagggacttgagatgatactggcttcaaaaccagttaaagggaaggaagcttttagtttggggcttgttgatggtttggtgtcacctaatgatttggtgaacactgcacgccaatgggcactggatatgttgggccaccgacgaccatggattgctagtctttataagaccgaaaaattagaaccccttggggaagcaagagagattttgaaatttgcacgagctcaggctcgaaagagggctcctaacctccagcatcctttggtttgcattgatgttattgaagcaggaatagtagctggtcctcgtgcaggactttggaaggaagctgaagcatttgaaggacttgtaaggtcagatacttgcaaaagcttagttcacgtattttttgctcaaagaggaacatccaaggtacctggggttacggattgtggtctggctccaagacaagtcaagaaggttgccatcattggtggaggactaatgggctctggaatagcaacagctttaattcttagcaactatccagtcatcttgaaagaagtaaatgagaagttcttagatgctggtatcaataggattaaagcaaacttacagagccgtgtaaagaaaggtaaattgaccaaggaaaattttgaaaagaccatctctcttctcaaaggttcccttgactatgaaagcttcagggatgtggacttggtgatagaggctgttattgagaatatttccttaaagcaacagatattttctgatcttgaaaagtattgtccacctcattgtatacttgcaagtaacacttccacaattgacttgaatctgattggagagaagacaaagtctcaagatcgaattgttggagcccatttcttcagtcctgcacatgttatgccgcttctggaaattgtacgtaccaagcagacctctccccaagtgatagttgacgtgttagatatttcaaagaagataaagaaaactccagtggtggttggaaactgcacaggatttgctgttaataggatgttcttcccatacacgcaagcaggtctcttgcttgttgaacgtggtgcagatgtttatcaaattgatagaataataaccaaatttggaatgcccatggggcctttcagattggctgaccttgttgggtttggtgtggcgattgctactggcacccaatttattcagaattttcctgagcgaacttataaatcaatgcttattccacttctgcaagaagataatagagctggcgaaacaactcgcaaagggttttatttgtatgatgataaacgcaaggctagtcctgatcctgaattgaagaactatattgagaaggctaggagcatttctggtgtctccgttgatccaaagcttgccaaattacaagaaaaggatatcatagagatgatattctttcctgtggtgaatgaggcttgtcgggtccttgatgaaggtatcgcagtcaaagcagcagatcttgatatttctgctatcatgggcatgggttttcccccttacaggggaggcatcatattctgggctgattctcttggatccaagtacatatattcaagattggagaaatggtcagagttgtatggggaattcttcaagccttgtgcctacttggctgcaagagctgccaaaggaattcctctgagtgcctctttggagcagcaggcaaagtctcgcatgtaa

SEQ ID NO: 1517 - DNA, 726 bp, Glycine max var. Williams 82
atggctgatttaagagttaagaaaggaagcaacaagaagcatggatctgtgtctgtcaccaccatcaaatctcttccgaaggagttgcaagtggagatttttgccaaggtggccactcgctccatatttgaccactgcatgataaaactatgttgcaaagaatttcttcacgccgccgaggatgattacgtgtaccgtcacgcctccatggagaattttgcgttggtgccgctgccatggttcactggcaataaagaatcctcctttctgaagcgttgcagggagagcggtaactcggagattttgtaccgtgaaggaatgcttcaatatttcacttcttcaagggtagaattgggtctcaagaatttgaaagaggcggcgctggagggtcacgatgatgccaaatatgtttattgcatgcttttgatgtgtggtgaagatgaaggacaaagaaagcaaggttttgatctcttttgttccttgaaagagtccacgtctgttatcagatgcagaaagagggtcaaatcttttgttcgaagcatgtggctgaaaaataagccaaatggcaagtcatctttctgcggttctggtacgtgcgatagtgagagacagaagcagctttcaaaaagatggtcgtcttttgaggataaagatggtggtatttcatgccaacgctgcggtgctgatcatgaacttggtttcttttgcaacatgtttggagtctaa

SEQ ID NO: 1518 - DNA, 309 bp, Glycine max var. Williams 82
atggatcgtgtggcgaaattggcatcacaaaaggcagtggtgatcttcagcaagagttcatgtgggatgtgccacgcgataaagcgactattctacgagcttggggtgggtcccacaatatatgaggtggacgaggagtcgagagggaaggaaatagagtggtgtctgatgagactagggtgcaacccttctgtgccagcagtgtttattggtggcaagtttgtgggtgcacccaacacagtgatgacccttcacctcaatggctcactaaagaaaatgctcagagatgctggagcactgtggctttaa

SEQ ID NO: 1519 - DNA, 756 bp, Glycine max var. Williams 82
atgggttgtgggaaatctaaacacgatgtagcttctggaaacaccgttctccaacgcaagaaatccactgtcaattccaaggacaatgagactcaaaacgtggagaaaaacaatgatgctaatgttgacaatgtacgtttcgaagtggaagagaagaacaaggaaaatgtcaaggagattgaagttgaaggcaagggtgattatgagtccaatgatgttgctgggaatataacaaaggtgcagcaagaagataaggcattggagactagtgcacaagctgaagctgaagagaacaaggcaccggaaattgttgttgctgaaggaccaaatgaagagtctgaacgtggaaaagacgaatcattattgggaaaaaatgaacaggaaaaagtgaaggatgttgctgttgcagaagagaaacaaccaacggaagaaaagaaagaccttgaaaatgaaaaagtggatctgagcgtaaaggaagagaccttgcctttgatgaaggaagaagaaagcaaagacacaaatgaagaggctttggtgaaggaagaagaaaacaaaaacacaaatgaagaggctttggtgaaggaagaaagcaaagacacaaatgaagaggctttggtgaaggaggaagaaagcaaagacacaaaagaagagacattggaaaaggaagaagaaaccaaagaaacaacagagcagggaaagactttggtcaaggaaggagaaaccaaagacgcaaatgtttcaacttcaacctcctaa

SEQ ID NO: 1520 - DNA, 1257 bp, Glycine max var. Williams 82
tgggcaattgaggagcacaaggatgttgatagtggagaagccaataggattcagggtttgcaagagcccttcattcaacatgagaaggatgctgctgcctgtaaagatgttgaatctaatacaacagtggaaaatggatctatcggaatggtgttgttgctgtttgtggtgggctattcagctcccactcaagcggctatcagggaagatcttaatctatctcttgctgagttttctatgttcggttctttagtaaccattggtgcaacgcttggggctataacgagtggccggattacagatttcattggccggaaaggggcgatgagaatgtcaacaggattttgcataacaggatggctagctgttttcttctcaaaggatccttactcacttgacctgggaagatttttcacaggatatggaattggagttatctcattcgtggtgcctgtatatatagctgaaatagcacccaaaaatcttcgtggtggacttgcaacaacaaatcagcttatgattgttattggatcatcaatctcattcttattaggaagtttcttaagttggagacagctagcactagcagggcttgtgccttgcatttcattgctgattggtttgcactttatcccagagtctcctagatggctggcaaaggttggcctcaagaaagaatttcaagattatattgaaactctacaaagccttcctaaaactaagtttctggctctgttccaaagcaaacatgtgcgatcagtagttattggagttggattaatggtatgccaacaatctgttggaattaatggtattggattttatacagctgagacttttgttccattcactgtattgggagccatgttgatggataagtctggaagaagaccacttataatggcttcagcaagtgggacatttttaggctgctttattacaggagttgctttctttctcaaggatcagagcttattgcttgattgtgtaccaatattggcagttgccagcgtgctgatctacgtaggggcgttttcaattggaatgggaccggttccttgggtaataatgtctgagatctttctcatacacgttaagggaactgcagggagcttggtggttttggtgaattggctaggagcttgggtagtttcatatactttcaactttctaatgagctggagttctcttgcaaagttactcccagaaaccaaaggaaaaacactggaagaagttcaggcatgcatcaattcatag

SEQ ID NO: 1521 - DNA, 3281 bp, Glycine max var. Williams 82
aagatctggctgatgggtacatgagaatagaatttagaaatacgttcagcccaaaattaccatttattattattttttttcgtgaggaagaggcgttccatgcttaaagcctccatccaagctctccgacctcagcatctgcacaaaaataaacaaaaaataaataaaggagaaaaaaaaaacaatgacaaaagaagtgtgaattttctttctgattctccaattttctaagatcgatcgcacctttgattattggaaaaattgctccaatcggttgtagcagtcaaatgtctccttcagtttcttgtcaagaaaaaggaagtaggaacaaaagaaaattcagagttgatccacctctaggggagccaaataagttcattcctgcacctcaactcaagtgcttcagttatgaattctctgctgagaggtttgaaataaccccaggtcatggacaagctgctgcttgtgacctgtgtggtgttagccaagattattctgatggattgaaacttggccttggattgtataatcctggaacatctgaggtcgggcctagtcaatctaaggacgaacctgagacagatgaaattaatgatgcagattggagcgatctcacagaagcccagctggaagaacttgtcctgactaatttggacaccattctcaagagtgcaattaaaaaaattgtagcatgcggctacactgaagacgttgctactaaggccattttaagacctggcatctgttatggatgtaaagatactttgtctaatattgttgataattctttagcatttcttagaaatggtcaagagattgatacatcacgagagcactattttgaagatctagtgcagcttgagaagtataacttggctgaattggtttgtgttcttcgagaggttaggccattcttcagtgttggggatgcaatgtggtgtttgttaatttgtgacatgaatgtgtcacatgcttgtgcaatggattgtaaccctttaagtagtttaggtaatgataattctactggtggtccatctaaccaagctgaatcactatcaaaagcagaaaccaaatgtcctgaaccgagtcttataagtcctagtaaatcaattcctacatgttctcataattctcaatcaaagaaaccctttgtgacaagaattcctggtgtgaacaacttgaatcctcaaattattggtggagcctcagagaaggagggtgccagttgtggatctgagtgcattaataaagcattcagcgctgcaggaacatctcaatctggcctgatgaaagaaaagcgtggaacagttagaaaggtccattctggtagcaccaagagagactacattcttcaacacaagtcatttcacaaagaaaaaagttatcgtacttatggattaaaagggtcttcaagacgaggaaaagtgaatggcttgagtggtttggtcttggataaaaaacttaaatctgtgtcagaatcttctaccataaacttaaagagtgcatccttacagataagtaaggcagtgggcattgatactacgcaagacagtattagtgttaacttttcatgtaatgctgggacttctacatccactgcatttagcctggtgaattcttctgattctgtttgtagatcaaccaatacttcatttgcaataaatgcagcaaatactatacccgtattcagttgtccagcttcattatcagctaccaatacagatctttctctctcattgtcttcaaaaatcaagccttctacggaatctgtctgcagcaataatgaggcacctaatagtagttatatgggaatactgtataataataataataataataagtccccaaggcagtggataccccacgatggaaaggatgagatgattttaaaactgcttccaagggttcgggagctgcaaaaccagcttcaagaatggacagagtgggctaatcagaaggtcatgcaagctgctcgtcgtctgagtaaggaaaaggctgagcttcagacactaaggcaagagaaagaggaagttgaacgtctaaaaaaagagaagcaatctctagaggaaaataccttgaagaagctttctgagatggaaaatgccctgtgtaaagttagtgggcaggtagagcgagctaatgccactgtccggaagctcgaggtggagaaggctgcactgaggaaagaggtggaggctgctaagatacgtgccacagaaactgctgcaagctgtcaagaggtctcaaggagagaaaagaagacacaaatgaagtttcagtcatgggaaaagcagaaatccttgtttcaggaagagctaacgattgaaaaacggaaattggcacagctgctgcaggaattagaacaagctagaatgcagcaggagcaagttgagaaccaatggaccgtgcctgtatgttaaatgatatgggcctcaaaccaatttcccccttgccagagtgttagcaaatacctatgaccaagggaaaatatcacagggtagatggcagcaggaagcaaaggcaaaggaagagtttatcctgcaggccagttctataaaaaaggaaagagaacaaattgaggaatcaggaaaatccaaggaggatgcgatcaaattaaaagcagagaggaatcggcaaatgtacagagatgacatccataaacttgaaaaggaaatttcccaactaagactgaagactgactcttcaaaaattgctgcactgaggatgggcattgatggatgctatgccagcaaatgcttggacatgaaaaatggcactgctcagaaggaaccccgggcttctttcatctcagagctagtcattgaccactcagcgacaggtggtgtgaaacgggaacaagaatgtgtgatgtgcctttcagaggagatgtctgttctgttcatgccatgtgctcatcaggttgtttgcaaaacatgtaatgagctccatgagaagcagggtatgcaagattgcccttcttgcaggagccctatccaacagcgtattgctgtgcgctttccacgtatttgatttatttatttgcttgagtgagttaagcatttttgaataataataataataataatgtctatgggactcatgctatgaataatgcattcatatcatgtttcttgagctgagatacattaatttacttctgctgttttgatgttttcaggatttgttttgttgttgttgcacttgtctttgcttgtttgatagtatgtaatggtcagcttctcatgatgaccctcttcatccaagccaagtatttttttttt

SEQ ID NO: 1522 - DNA, 939 bp, Glycine max var. Williams 82
atgggcactctagtgggacatgtggctccaggttttggtttcttgttgataggtttgtggcacctctttaaccacatcaagctccacgcccttaacccaaagtcctacaagggcccatcatggttcccaagtgccaagttcagatacatagagcttgtgctcatcatggttggctccacagcctccgtagccatggaactcttcataggccctgagcggcaccaacctcttgacccagatggaaccattccctccaaccatctccacaacttcgagcactcttcaatctccatcaccttcttcctctacgcagcatgtgccatcatcttggaccgggcccgagtccaggcccaattcgaactaacccaattgcttggggccatagcctttgcccaacaactgcttctcttccatcttcattccgcggaccacatgggcccagaaggacaataccatcttttgttacagattttggtctttgtttcagtctccaccgccctcattggaattgtgctcccccatagcttcttggtcaactttgttcgctccgtcagcatattcttccagggtttgtggcttattgtgatgggcttcatgctttggacaccttcactcatacccaaaggttgttacatgaacgacgaggatggtcacatggtcgttagatgctcttctcacgaggcacttcaccgcgctatttcacttgtcaacatcgaattcagttggttcattatcggtgtgaccgtttttgcggtttctttgtacttggttttggtaaaagtttatggggagaagaaggtggagtatttttcgttggggaatgaggatgaagagtcaaacgacgacgttgagtcacaaaagagcggtgcctttgatcacagcagcaaaagcttcattcaggtgggcaaaatcttttctcaaaatgacatggaaaggtag

SEQ ID NO: 1523 - DNA, 1575 bp, Glycine max var. Williams 82
atggagctgtcttccagtgcatttgtggtaatattgttggcagtcgcagctacagcagtactctcaaatgggttggatctatctttcttgcccagcgatttcctctttggcattgcttcttcctcttaccagtatgaaggagcttacaagagtgacggcaaaggactgagcaactgggataactacactcacggaccaggtagaagtgtaataatggatggaagcaatggggatatcgcgattgatcattatcatcgctacctggaggatatagatttaatggaaactttgggagtaaacagctaccggctatccctgtcatgggcaagaattctaccaaagggtagattcggagagcccaaccatgctggtatcgagttctataacagactaattgatgttctactactcaaagggatccaaccctttgtaactcttagtcactatgacattccccaagagcttgaagacagatacgggagttggctaagtccccagttacaggaagattttgctttttatgcggacctatgttttaaaacctttggtgacagagttaagtactgggtcacattcaatgagccgaatttcctagtgtcacttggttaccgttctggtttatatcctccatgccgttgctctggccaattagcaatggctaaatgcagtgaaggagactcagaaaaggagccctttgtagcagctcataatgttatcctgtcacatgcagctgcagttgatatctatagaaccaaataccagactgagcaaaaaggaagtattggtatagtccttcaacatgaatggtttgaaccaatgagcaattcaacagctgacaaattggctagcgaaagagcaagagcattcaacttcaattggttcttggacccaatcatattcggaaagtaccctacagagatggagaacgttcttggaagcctcttgcccaaattttccagctacgaaaaagagaaactcaagagaggattggatttcattggcgtcaattactacacggctttctatgtccaagattgcatgtactccgcttgtaaaccaggacccgggatctccagaacagagggttcatacaagaaaagtggagaaaagaatggtgtcccaatcggtgaacctactccatttagttggtttaatatttacccagatggcatggaaaagactgtaacatatgtgagagatagatacaataacactccaattttcctaactgaaaatggatatgccgaagaagttgatccaaatttcacttcggaagaacatctcaatgattttaaaagaataaagtacatggtggatcacatagaggctctgttagcagcaataaggaaaggagcagatgtgaggggatactttgcctggaccttaatcgactcgtttgagtggatatatggatatacggtaagatatggattccatcatgtggattatgcgacgctgaaaagaactccaagattgtcagcaagttggtacaagcaactccttgttcagtacaagaaaacctttttattaggcacgagcatgacagggcatgaaaaactcgtacaacacacttga

SEQ ID NO: 1524 - DNA, 1353 bp, Glycine max var. Williams 82
gaaagttgatgctgcaaagtaaaagtgggccacagacacattctgttgtggactgtctggtaaactagctattatctctctcttctcacactcacccttcagactcagcatggacgctgttttctacttcctatgcgctgcttatgctctcgtctcttccatcgctttgaattgaagttagagtacctgagtatggctggactacgcagaaaatttttcatctcatgaacttcattgtcaacggagttcgtgctgtggtgtttggattgcacaagctagtttttcttttgcatcctaaggtgttgatttcggtgctattagatctgccaggactactttttttctcaacatatacacttcttgtccttttctgggcagaaatttatcaccaggcaaggggtttaccaactgataagctcaagatagtctatatttcagtaaatgctgccctgtatcttatccaggtttgtatttggatatacctctggataaatgacaacagtgttgtggagttcattggagagtcatttattgcagttgtgtcttttatggctgcactaggcttcttgatatatggaggaagattatttttcatgctgaggcgcttcccaattgaatctaaaggaagaaggaagaaactcaatgaggttggatctgtcacaaccatctgtttcacgtgttttctgataagatgcattatgggttttctgtctgcatttgattcagatgcatctctagatgttttggatcatcctattttggacttgatttatttcatgctggttgaggtcctaccttcagctttagtcctctacatcctgcgcaaattgcccccaaagagaatatcagcccaatatcatcccatccgttaactgctgttcatattggatcctaatttattaatttacctgcccattgtttattatttcaatggttcttggttagatagatacttttaagctcatcaggaaaaacagataaagaaaaaggatccagataaaagtctcatggcagcagttcctatgtgtgtgatactcagcagttgctacctgggaaggaaaatttggattcaggttttgtacggtatacatgcaatgacaagtctcaagaacttgagttattctctgcagtttggatgctgtagtgtttcaggcacaagcttgtcaatgacgcatctacttcaacgtcatacaaagttgattgtctcctaaatattctggatttgtttattagtcagaaatagttcaatttgaacaaaatgaacattgtctcttgaattatattatggggtgtaacttggaatcttttgagttcttgattttatgcaacaaaactaaaaactaaaatgatgtg

SEQ ID NO: 1525 - DNA, 1707 bp, Glycine max var. Williams 82
atggccaggtccaccactcctccgacgatcaaaccggaaaattacggccacagtccggttcactacgccgtcgctttgggcgaccacaccaccctctccagaatcacctcctcactccctcgtctccccgatccctctctaattcaaaccgaatccgattccctcgctcaagaaaaaatcgctgatcagatctccctcgtcctcgaccgccgcgacgttccttatagagaaactcctctccacctcgccgtccgacttaacgaccttttcgccgctcgcgccctcgctaccgccggcgccgacgtctccctccagaactccgccggctggaactctttgcaggaggcgctatgccgccgcgcctccgacatcgcgctcgtcctcctccgtctccaccaccgaaacgcctggtccaagtggcgccgccgcctcccgcgcgtcatcgccgcgctccgccgcatgcgcgacttttacatggagatctccttccacttcgagagctccgtcattcccttcgtcggcaagattgccccctccgacacctacaaaatctggaagcgcgacggcaacctccgcgctgacacctctctcgccggcttcgacggccttaagatccagcgcgccgaccaaagcttcctcttcctcggcgacgtcgatcacacgcacgacgtcccctccggttcgctcctcgtcctcaaccgcgacgaccgcaaaatcttcgacgccttcgagaacgccggaggaccgatgaatgagtccgacgttgccggattctgctcgcagacgagcgtgtaccgtcccggtatggacgtgacgaaggcagagcttgtaggcagaacgaattggcgaagacaagagaaaatagagagcgtgggggagtggaaggcaaaagtgtacgaaatgcacaacgtggttttcagtttccgatcacggaaagtggccggcggagattctgacgtggcagggagcgagcaggtgctgccgttggaactggacgaagacgacgacggttttctcgttgcggagaatccgaatttcgggttcccaatgccagacaagagaagacacagtagcttcgttcgagaagagagagagtgggtcccaatgggaaggaaaagcgtcgacctaacgtccgtaacggccccacagccgcgaaggtcaccgcaaagcgtgaccatgccacagaccaaggaaaaggagtacgttagaagcttacggccgtcagtgtggctaacggagcagtttccattaaagaccgaggagcttctgccgttactcgacatactcgctaataaggtcaaagcagtgaggaggctcagagagttactcactaccacgttcccgccgggaacattccccgttaaggtggctataccggtggtccctacggtgagggtggtgattacgttcacaaagttcgtggagctgcaacctctggagcaattctacactccattctcgagcccaaggcatttgctcctcagtgcaagcagaggaggagatgagcaacagagcaaagcagaaaacaggtgctcttcttcgagctcatcgacgtggctgagacgaaataatagcgtgtcgaataagcaacgatgtatggcattggattcggacccttttgcgattcctgcgggatacacatggaccagtgtggatgataaatctcgtaaaatgaagaaatccaagtccgtcagaaagtctaagtaa

SEQ ID NO: 1526 - DNA, 1224 bp, Glycine max var. Williams 82
atgagggggagcttgtggcaacttgggcaatcgatcactcgccgtcttgcccatggagataagaaggctgttgctcgccgatgttttgcctcagaagctgagctgaaaaagacagtgtttcatgacttccatgttgctcatggtgggaagatggttccatttgctggatggagcatgccaatccaatacaaggactcaatcatggactctaccatcaactgtaggcagaatggtagcctttttgatgtttcccatatgtgtgggctgagcctcaaggggaaggatgctgtcccattccttgaaaagctagtcattgctgatgttgccgggcttgcccctggaactgggacattgactgttttcacaaatgaaaaaggaggggcaattgatgattcagtaattactaaggtgacggatgaccacatatatttggttgtgaatgctggttgcagggataaagatctggctcatattgaggaacatatgaaggcattcaaggccaaaggtggtgatgtgtcttggcacatccacgatgaaagatccctacttgctctgcagggtcctcttgctgctcccgttcttcaacacctaacaaaagaggatttgagcaagctattctttggggagttccgtgtgttggacatcaatggctcacagtgctttcttacccggacagggtatactggagaagatggatttgagatctcagttccttcagagcatggactagatcttgccaaggcaatactggaaaaatctgaagggaaggtaagattgacaggattgggagctagagatagtctgcgacttgaagctggattgtgcttatatggaaatgacatggaacagcacattacacctattgaggcaggactcacatgggctatagggaagaggaggagagcagaaggtggttttctaggagctgatgttatcttgaaacagctcgaagaaggtcctaaaatcaggcgtgttggtttcttttcttctggtccacctcccagaagccacagtgagattcaagatgaaggaggcaacaacattggggaaatcaccagtggtggattcagtccttgcctccagaagaacatagccatgggatatgtgaaatctggattgcacaaggcaggcaccaaagtaaagattattattcgaggaaaacccaatgaaggagtccttacaaaaatgccatttgtaccaacaaaatactataagccatcctga

SEQ ID NO: 1527 - DNA, 1525 bp, Glycine max var. Williams 82
ttgtctctaatttccccgaaactcttgtttcctaattgaggaggcatttttgtaattaaaaaagggatttccttcttgatttatgttgtgttgctgacaggaagcttcgttagagagaaagttggtatatgctggaagcattattcctgaacgaacccagccaaatgtggagtagagtagaaattacataagagagaatggggttcgggaaggacttgtactagtaatgcacattgcacaagcatctttgtctccgcatattccaattccatgcacaaacccaaggacttgtattctattcaactcgtgttacacggtatataagttgacttctgaaccctgatttgagagtgagagcagggtgcgcttcaagttgaagttctcaatctgattgcaaaggagaaaatgggtgataatgattcgctctccgaattcctcgcatctgcagtcgacgctgcttgcaaggctggtgagattattcggaaaggtttctatcagaccaagaacgtgcagcacaaaggactggttgatttggtcactgaaactgatcaagcatgtgaagatctcatatttactcatctcaagcaactttactccactcataagttcattggggaggaaaccacagctgctggtggcaatgcagaacttacagatgaacccacgtggatagttgatcctctcgatggaactactaattttgtgcatgggttcccctttgtttgtgtctccatcggtcttacaattgggaaagttcctacagttggcgttgtttacaatccaataattaatgagcttttcactggaattcgtgggaaaggtgcttttctaaatgggaaccctataaaagtatcatcacaaactgaactaatgagcgctcttcttgtgactgaggttggaacaaaacgtgacaagttaacaatagatgcctgtacaaataggatcaatagcttgcttttcaaggtgagatcccttcgaatgactggctcctgtgctttaaacctttgcggaattgcatgtggaaggctggatgtatgctttgaacttggctttggaggtccttgggatgtggcaggcggtgctgtcattgttagagaagccggaggtgttatatttgatccgtctggtgcagattttgacatcacatctcagcgggtggcagcttccaaccctttcttgaaggatgcccttgttgatgttctgcaccaaatcgtgtgagaagcttactattaatcaatgacaaggagaaattgagtcagccttatgttaattcatttcccttttgttaaaatgctttgaattgtgggattcatggcgtcaattatttttctaattctcttgtgaccttaccaaaatattagtatttattctttattttttttctccaaaaatctcacataggtaacgatgcaacttgctttaaaataattccatcgcatagcctatgagctgctgcttcaacttgtcaatgctctgtttattctcatccgtaactcctttttgaatttcatgttatttaattatt

SEQ ID NO: 1528 - DNA, 1456 bp, Glycine max var. Williams 82
ttgtctctaatttccccgaaactcttgtttcctaattgaggaggcatttttgtaattaaaaaagggatttccttcttgatttatgttgtgttgctgacaggaagcttcgttagagagaaagttggtatatgctggaagcattattcctgaacgaacccagccaaatgtggagtagagtagaaattacataagagagaatggggttcgggaaggacttgtactagtaatgcacattgcacaagcatctttgtctccgcatattccaattccatgcacaaacccaaggacttgtattctattcaactcgtgttacacggtatataagttgacttctgaaccctgatttgagagtgagagcagggtgcgcttcaagttgaagttctcaatctgattgcaaaggagaaaatgggtgataatgattcgctctccgaattcctcgcatctgcagtcgacgctgcttgcaaggctggtgagattattcggaaaggtttctatcagaccaagaacgtgcagcacaaaggactggttgatttggtcactgaaactgatcaagcatgtgaagatctcatatttactcatctcaagcaactttactccactcataagttcattggggaggaaaccacagctgctggtggcaatgcagaacttacagatgaacccacgtggatagttgatcctctcgatggaactactaattttgtgcatgggttcccctttgtttgtgtctccatcggtcttacaattgggaaagttcctacagttggcgttgtttacaatccaataattaatgagcttttcactggaattcgtgggaaaggtgcttttctaaatgggaaccctataaaagtatcatcacaaactgaactaatgagcgctcttcttgtgactgaggtgagatcccttcgaatgactggctcctgtgctttaaacctttgcggaattgcatgtggaaggctggatgtatgctttgaacttggctttggaggtccttgggatgtggcaggcggtgctgtcattgttagagaagccggaggtgttatatttgatccgtctggtgcagattttgacatcacatctcagcgggtggcagcttccaaccctttcttgaaggatgcccttgttgatgttctgcaccaaatcgtgtgagaagcttactattaatcaatgacaaggagaaattgagtcagccttatgttaattcatttcccttttgttaaaatgctttgaattgtgggattcatggcgtcaattatttttctaattctcttgtgaccttaccaaaatattagtatttattctttattttttttctccaaaaatctcacataggtaacgatgcaacttgctttaaaataattccatcgcatagcctatgagctgctgcttcaacttgtcaatgctctgtttattctcatccgtaactcctttttgaatttcatgttatttaattatt

SEQ ID NO: 1529 - DNA, 1866 bp, Glycine max var. Williams 82
atgttgtcacctgaaccctgtgatccgaactttctgctgtgtctacccgatgatgtgtttggcatggtgtcacggttcctcttgcccagagatgtttgcaatctcagcctctgctgcaagagtctctatgctctttcatcctctgaaaaagtgtggttccctcagtgttacatggtgggagtggtgccccaaaaagaccttgttgagtggagagagggtgtctcatcttaccaggcactttgccgtttccttttgagtgttaaaccattgcttgggatatgggttcatcagaaccctgagcttggtaaccttgtctatgtcatgcctggttttgtttcggttgtcggctgccggataattcctcaggagcttggtccattagggattcaagatggtcctatccaatggtcatctgtgtttgaggttattggtgattttgatggttcagctaccttttttctccatggaagggaagaggggatggactatgtttatcgtggctcggtcaagtatatagatgaatcttgcaatgtgctgttgcttgaggttgaacctagggaacaaaattatggtattaatttgttgcagagtaggagcttggatgactcgggtgggacggtatcaggagaggtttgtaggtcaaacagggagctttctaggttacaaaaggtgggtggaaatgatgaggaaatggttcccttcagcaagttagcttttagtgatagaagaaagttgcttgaggtcactatcagcctagttcgacaagaggttcctagtgtagccgctggaccgttgtttcctaggttgagagatgattgtgacaattttcagaaagattttgtgctcttgaaggaaagaagagaagtcttttgtcaaatgaacaactttggtaatggtcagattgacaatgaggaaatttctcaagggacagttggtccggtgcaattagagctggatgacataagaaagagttgtaactggtcaaaggatatctctgatcttctgagcaaggaggatggtcacacacaattcaccaagaaaaaaagtcttggtggatatctctggggtagctttaaacagattgttggaagatctagttcaataaacgagagtcatgcaattttcaagaagcttaccacaagacgtgagataaagcatgcgcggcttgaagactttcttagatcaagtgatgcaatagagctatcattaaaggcatcaactgtaaaattatcttcttatcgagcatggccaaatatgcctgatacttggtttgcactttacaagatgcccttgcaagttccctcagcggaccaaatttatgcgggtttgtggggaggaacttttggttggcctcctggaaaaccttctgaagacaagcctggaaaagctctattctttcttctgctctcttatgaggagtcccaggaacaacagcttcttattgcaacaaaaatattggaaggcactcactatggcttgcatcctaatggttcagcaatgtttatagtggatgtcaatgagccttcatctgatccctttccctgggacatcaataaagactccttgtcagtggatatcaaacatgtttttacaggagagggtatttcaaatggatatgggttcagataccctggatcaaagcccggttccctctttgtatttcaaaatggtgtccttgcctttgtttggaaggacactagggctgtcttgactttgcagagacttgacttgcaagatcttttgaagaaaggagaaagaataccttctctgcctcccatcaacaatttttcatatttgaccaagtcctactcaaatgtgtttacaggctttcctggtgcttccacttggtcgccttcaccaaggtaa

SEQ ID NO: 1530 - DNA, 2115 bp, Glycine max var. Williams 82
atgacgtcatcagagaaggaaaattgggtggctttggtgattctgctgctagggtcttggacattagcaatggcagaggtcacatatgatgggagatcccttatcatcgatggccagaggaaaatactcttctccggttccattcactatcctcgcagcactcctcagatgtggccagcgttgatatcgaaagcaaaagaaggaggactggacgtgattcagacatatgtgttttggaatctacacgagcctcaatttggacagtatgatttcagcggcagatatgacttggtgagattcataaaggaaatacaagttcaaggattatatgtgtgcctcaggattggaccttatatcgaaagtgaatggacatacgggggattcccattttggttgcatgatgttcccgccattgtataccgaactgacaatcaacccttcaagctctacatgcaaaactttacgacgaaaatagtgagcatgatgcagtcagagggtttatatgcttctcaaggaggcccaattatattgtcacagattgagaatgaatatcaaaacgtggaaaaagcatttggagaagacggatcgcggtatgttcagtgggctgcagaaatggcagtgggcctcaagactggcgtaccgtggcttatgtgcaagcaaactgacgctcctgatccactgattaatacatgcaacgggatgagatgtggagaaacttttacaggaccaaactcccccaataagcctgcattttggacagagaattggacttctttctatcaagtttatggaggtgaaccatacataaggtctgccgaagacattgcattccacgtcactctttttattgcaagaaaaaatggaagctatgtcaactactatatgtatcatggtggaactaacttggggagaacgagttcttcttatgttataacatcttattatgatcaagctccacttgatgaatatggtctgttaaggcaacccaagtggggacatctcaaggagttgcatgcagctatcaagtcttgttctaccactttattggaaggaaagcagagcaatttctctttaggtcaactacaggagggctatgtttttgaagaagaaggaaaatgtgttgctttccttgtaaacaatgatcatgtgaaaatgttcaccgtccaattccgcaacagatcatacgaattgccttcaaaatcaattagcattttaccagattgtcaaaatgtgactttcaatacagcaactgtaaatacaaagagcaacagaagaatgacaagtacaatacaaactttcagctcagcggataaatgggagcaatttcaggatgtcatccctaactttgaccagactacattaatatcaaactcattacttgagcaaatgaacgtaaccaaagacaaatcagattacctttggtatactcttaggtttgaacataatttatcttgcagtgaatcaaaactcactgctcagtctgccgctcatgttacccatgcttttgcagatggcacatacctaggaggagcacatgggagtcacgatgtgaagtcattcaccacacaggtccccctaaagctaaatgaagggacaaataatatatctattctaagtgttatggttggactcccggatgcaggagcatttcttgaacgaagatttgctggcttaactgcagtggaaattcagtgcagtgaagagtcctacgatttgaccaattctacatggggatatcaggttggattactgggagagcaattagaaatatacgaagaaaaaagtaacagttctattcaatggagtccactagggaatacttgcaatcaaacactcacttggtataagacggcatttgattcacccaagggtgatgagcctgttgcgttgaaccttgagtccatgggaaaaggtcaagcttgggtgaatggggaaagcattggtcgttattggatctcgttccatgattccaaaggccagccttcacaaacgctgtatcacgtgcctcggtcgttcctcaaagacattggaaacagtttggttttgtttgaggaggaaggtgggaatcctcttcatatctccctcgacactatttcatctacaaatatttcatag

SEQ ID NO: 1531 - DNA, 1949 bp, Glycine max var. Williams 82
gagaatcaggtcaagacgtggaaactggaatgctatcttatcctggataacatttcaactacttactcccactcttcagtcatacaaactcaaaatcacaatggccttctcatcgtccatatggtcttcttccatctttgttcccaacccaaacagaaccaccatttccactcgattctctcacacaccctccaaaccccctctctcgccggcattcgccattccgccgctctccacggccaccgccacggacgtctcgggcgtcatcgacgggacgacgatcgcggtggtcagcggggggttcgtggcggcacttgcggcggtgctgtcgctgacggaccccgagcggcggcggcaaatgcaagcggaggaggtgggcggcggcgacaaggaggtggtgagggagtacttcaacaactccgggttccagcgctggaagaagatctatggagacaccgacgaggtgaaccgggttcagcgcgacattaggttgggtcacgccaagaccgtggagaacacgctgagcatgttgaaggacgaagggtcccttcagggaattacggtttgcgacgctgggtgcggtacgggctcgctctctattcctcttgctaaagagggcgctgttgtgttcgccagtgatatctccgccgctatggttgctgaagcagagaaacaggcaaaagaacagcttgtaaccagtgaagatggttccgggcctgtgatgccaaagtttgtagtgaaggatttggagagcttagatggcaagtatgacacggtggtctgccttgatgttttgattcattacccccaaagtaaagctgatgggatgattgcacaccttgcatcattggccaacaagcgattgattctgagttttgccccaaagacgttttattatgatctgctaaagagggttggagagttgttccctggtccttcaaaggcaacaagggcatatcttcactccgaggcagatgtagagagagcattgcaaaaggttggctggaccataaggaagagaggcttaaccactactcaattttactttgctaggcttattgaggctgttcctatgtagtggggattgaaagaatatgctgacgaattgaggctatgttttcttggggaaatagactgaagtggttcataataaatttgtgtggagctagtgagttggcggtccattgggttggtggaatggaggcaagctccctataagttgttcagacgttacaacgcttattactcaagctgcatctagagtagaaagaataaacatcaaccacatgaaaacaaataatatgaagagtagtattccccaaaaaatgaggtaaaaagctgagaagtactaatttaaaagaggaaaaaaatgatgatgatgaaatctagtgcctaattaagttctttcatttgtcttttgatgtgaattcatttatagcttgtcagcaatttttgtaagagcatctgtgagcttgccaagggctgcaactataatatcagtttgctgcttctgctggtccctggccaattggtaatttatgttctgagtcccaatatgagcttttagtatgtcactgttcctccttagtagtttggtaatgttgttgaaatctgtgctgtcctcactaatgtccgatgataaccgctttctcttgtatcccattccctcctggaatataggttccctctgaatgcctgaaccaaaatatactttacatgagattgtgaaaaaaggccaattatgttggaatcgaattcggtgcagtctacttttcgtgtattcacgcaatcaatgaatcataatcaatagatgaagattggacaactcaaatctcaaaatgttttataaccaatttgggtgtgtttgaaaaacgttgggttcaatgtgtaacccatgttttttaatttttccaatccaacatatagttacttttcagtttgccgctttg

SEQ ID NO: 1532 - DNA, 1425 bp, Glycine max var. Williams 82
atgaagaacttagcaacatggaaaaccatggcaattactgttgtgttgcttcagctgagcttttccttggagattttctgcctctcttatcatgcagatagaattgttcggcttcccgggcagcccaacataggcttccaacagttctcaggatatgttacagtggatgacatgaaacacaaggctctcttttactattttgttgaatcagaaactgatccagcttcaaagccgcttgttctctggctcaatggaggaccaggttgttcttctcttggagtgggtgcattctctgaaaatggaccttttagaccaaatggagaagttctgattaaaaatgagtacagttggaacagagaaacaaacatgttgtatttggagacaccagttggagtggggttctcttatgctaaaggtggctcctcctatgacactgtgaatgatgagacaacagtacttttgatttctcaagccagggacaatcttgtattcttgcaacgctggttcaacaagttccctcattacagacacacagatttgtttctagcaggtgaaagttatgcagggcattatgttccacaacttgcaaagctcatgattgaaataaacaaaaaggagaagatgttcaatctgaaaggaatagccttgggtaatccagttctagaatatgccactgattttaactcaagggctgagttcttttggtctcatggattgatatcagattcaacatacaaattgttcactacaggttgtaattattcgcggtatgtcagtgaatactatagagactcaatttcgccactttgttcaaaggttatgaagcaagtaagcagagaaaccagtaaatttgtggacaaatatgatgtcacccttgatgtttgtatttcctcagtgctttcacaatccaaagctatttgtcctcaaagccaacaaacaaacgagagcatagatgtatgtgtagatgacaaagttacaaattacttaaaccgaaaagatgtacaagaggcactccatgccaagcttgttggagttcaaaagtggaatgtttgcagcactaacagcattctggactatgatatgctcaacttggaggtacctacactccctatagttggatcactcataaaagctggagttcgggtcttaatttacagtggagatcaagattcagtaattccactgactggaagccgcaccttggttcaaaagcttgctagacaactaaggctgaatacaacaatccattatagagtatggtttgagggccagcaggttggtgggtggactcaagtttatggcaatatcctctcatttgcaacagtcagaggagcctcccatgaagctcctttctcacagcctgaaagatcacttgttttgttcaagtcattcttggaagataggcccctaccagaaattttctga

SEQ ID NO: 1533 - DNA, 429 bp, Glycine max var. Williams 82
atggcctctgtttcagcaacttctctcagcttccaaccctctctcaagttgtctacaaggactagccaggggtgttacaaaacttcaagtttggaggtagtttctgtgggatggaataggagaacctttccctctttgagatcctcccgtttctgcatttgtgcagtcaaggcacaaccggagacagtgcagaaggtctgcaatattgtgaggaaacaacttgctctgcctgctgaatctgagcttaccccagacaccaaattttcagcacttggtgctgattcccttgacacggtggaaatagtaatgggtttagaggaagagtttggcataactgttgaggaggatggctctcaaaacatctcaaccgttcaagaggcagctgatttaatagagaaactggttcaagacaaaagtggagctagttag

SEQ ID NO: 1534 - DNA, 790 bp, Glycine max var. Williams 82
ttccaactaagcacaagctagactttggtccaaaaatattggacactttccacatcaaaaacccaaaccctatctcttattggcctttgtccatccttctagtttagcttagcttcaatggcctctgtttcagcaacttctctcagcttccaaccctctctcaagttgtctacaaggactagccaggggtgttacaaaacttcaagtttggaggtagtttctgtgggatggaataggagaacctttccctctttgagatcctcccgtttctgcatttgtgcagtcaaggcacaaccggagacagtgcagaaggtctgcaatattgtgaggaaacaacttgctctgcctgctgaatctgagcttaccccagacaccaaattttcagcacttggtgctgattcccttgacacggtggaaatagtaatgggtttagaggaagagtttggcataactgttgaggaggatggctctcaaaacatctcaaccgttcaagaggcagctgatttaatagagaaactggttcaagacaaaagtggagctagttagttaggagttagaacgtgatagctctagggaaaatgcattgagtgtgtaactgaatgaggttaattattcagcccattggctggccccgtttttgtgcttatgcgtattctttagcaagtttttgttattttcttttatccccattctgactttgttcttcaatttgctatttgatgaagatgttagcccaaaacgcttgtttttttctctctcacgataagcatctcatttggtttggtggggc

SEQ ID NO: 1535 - DNA, 1668 bp, Glycine max var. Williams 82
atggggtgcaagctcggaaagccggcggacgccggtgaccgtctccggcataacactgcgactaccagcggcggcaataatgccgttaaggttagggagaagcagaagcctccggacgccggcgaactttccggcgtaataccggcaccggagcgccggacacttcgacttgactcattcacggcgagccatcaggggtggccgccgtggctaatggccgtcgccggcgactccatcggagattggactcctcgccgtgccaacacgttcgagaaacttgctaagattgggcaagggacttatagcaatgtgtacaaagcaaaagaccttgtgagtgggaagatagtggctttgaagaaggttagatttgataatttggaggcagagagtgtgaagtttatggctagagagattcttgttttgaggaggcttgatcaccccaatgtagtgaagcttgaagggttggttacttcaagaatttcatcgagtatttacttggtatttgagtacatggagcatgatcttgctggtctttcagccagcgtaggtgtcaaattctctgagccacaggtcaaatgctatatgaagcaattgctatctggccttgagcattgccacagcagaggtgttttgcaccgtgatattaagggttcaaatctgcttattgacaatgaaggaatacttaaaattgcagattttggactggcaactttctttgatcctaagcaaaagcatcccatgactagtagagtcgtgaccctttggtaccgtccacctgagcttcttctggggtctacgtcttatggtgttggtgttgacctttggagtgttggctgcattttggccgagctacttactggaaagccaatcatgcctggccgaacagaggttgagcagctgcacaaaatatttaagctatgtggctctccatctgaggaatactggaagaaatatagattgccaaatgctgcactctataagccacaacaaccatataaaagaaacactttagaaacgttcaaggattttccatcttcttcattacctctgattgaaactcttcttgcaatagatcctgatgatcgtggttctacctcagctgctttaaatagtgaattctttaccactgtgccctatgcttgtgaaccatctaatttaccaaagtatcctcccaccaaagaattggatataaaactgagagatgaaaaagcaagaaggcagaaagctctaagtggaaaaactaatgcagttgatggtgccagaagggttagagtacgtgagcgaggtttggccgatccagcccctgaagccaatgtagagatccaaaataacttagataggtggagagttgtgacccatgcaaacgcaaaaagtaagagtgagaaatttccacctcctcatcaggatggagctgttggatatccactggatgattcaaacaaaggagctgtttcgtttggagccactgaaacttcctctgtctctaccatatttgattcaaaatcttgtggatcggttataagtcatgatgctgcaagagacaaagggaggaaaactagtaaagcagattcccagatggcatcatcttggaaatttatgcgttcattcaagctatcagcagttggccattcatttgatttattatttagaagcaattcaagcagataa

SEQ ID NO: 1536 - DNA, 1308 bp, Glycine max var. Williams 82
atgccgccaccgccgccgccgcctccggcatatccagattccggcgccacctccgctccctcgctggtcagaaattatcgcgtctggcaaggcagtaacgtatttctttgtggagggaggcttatttttggacctgatgtgaaatctatatttatatcgatatttctgattgttctcccggtggctatgttctgtggtatggtagcaaggaaactgttagatgattttcctcatcacaccggatggtcaataatggctgtgcttatggctctcacactcttcgttctgatcacccttgtagtgacctctgcaagagatcctggcatagtacctcgtaatgcccagcctccgcagccagatgaccatcatgggactgataatagcaacaataggcaaatttcattgtcacgatttccacgaacaaaggatgtaattctcaatggtataacattgaaagtcaaatattgtgatacttgcatgctctacagacccctccgcgcttctcattgttcagtctgtgataactgcgtggagcgatttgatcaccactgcccatgggttggtcagtgtattggactgcgaaattacaggttctactacatgtttgttttctctgccactctgctttgcttatatgtacatgccttttgctgggtctacatcgtgaagatcaaggactccgaggcaatatcaatttggaaagcaatgtccaaaactatagcatccatcgtattaatagtttacacctttctttgttcctggtttgttggtggtctcactattttccacacgtacctcatcagcacaaaccagtctacttatgaaaattttaaaaaccggtatgacccacaaaccaacccatataacagagggatggttaacaacttcaaagaagtattctgcaccagaattcctccatccaagaataatttcaggtctaaggttccaagggagcccttagaatcatatcaaagaacgggtattaggcccttaagcccaatgatgaaaagaagaaccagaaccagaagtatggaattagtagggaatgcagtttataatgagcaagacgaggaggaaagtaattatagagatggattcgacaatgaagcacgtagcaaagatagtggattgaccgataagtccctggatttaagcaggatccttcacacggaaggagtggagggagaagaaagttcaattagacaccatcaatgggaaggaactacagaagttcaggacagcataacagaagttggggaatcaaattcggctactgcgcctaattgctcaactagagaagttgtatag

SEQ ID NO: 1537 - DNA, 3261 bp, Glycine max var. Williams 82
atgttcagatggaggagtgagagacacagggtcaaagctgttttcaaactccacttccatgtcacccagatggtgcaatctggggtggatgctttggtgctgtctatagttccaggggacattgcaaaggtaactacgaggttagagaaagcagcagttcgtggtggagtttgtagatgggataatcctgcctacgaaacagtgaagtttgttcaggagccaaagactgggaaattcagtgagagattatattattttgtggtttcaacggggttatcaaaagctagctcctttggggaagtttctgtggactttgctgagtatgctgatgctacaaagccctccactgtctctcttcccattaagaattctcattgtgatgccgtcttgcatgtatccatccagagactacaagaaaataatgataaaagagaggaagaggatagtgaagatgccaaactaaaacccaatgatagaagtttgaggacctacttaagcaatggagagatagatgcaaactctaaaagtgattcttctgaagatgtgtctgccaaagcaaacaccaatggagctgcattgagtgctgattgtagaacatctagtggatctgacattacattgtcaagttctgatggcagttctggacttgatactccgcgagaaaatggactaagaaatggtggcatccaccccaacaacaatggttttccttcagacgtcagtcacccttcagagccccaaaaacctgctgtaaatgcctctgcagtaatgtatgatattcatcagagatcacaatgggactggtcagctcgctcagaacacagtttgagtacagacggttcaactaatggttctcaggatgcgcttcctagggaaagatcccttcaagcatctgatatggaaattgaaagactcaaggctgaactcgctgcattggccaggcaggcggacatgtcagacttagaactacagactcttaggaagcaaattgtaaaggaaagcaaaagaggacaggagctctcaaaggaaatcattagcttgaaagaggaaagagatgcactcaagattgaatgtgacaatctcagatcttttcgcaaacaaatggaggaggccaaagtgagtagcaggcctccattggatagtggggatctttgtactcttgttgaagaaattagacaagaactgaagtatgagaaggagctgaatgcgaatctccaattacagttaaagaagacccaagacgcaaattctgaactagttcttgcagtgcaggacctggatgaaatgctggagcagaaaaatagggaaacatgtagtctttccaataaacatgaagagggtaaaaactcctatgagttagggtcgaagctctctaattgtgaaacagatgacgaagaacagaaagaattggaagagctagttaaggagcacagcaatgccaaggagactcacttacttgagcaaaagattatagatctctatggtgaaatagagatgtataggagagacaaagatgagttagagatgcagatggagcagcttgcactagactatgagatattgaaacaggaaaaccatgatattgcatataagctggaacaaagtgaactgcaagaacagttaaaaatgcagtatgaatgctcatctcctcctgctgttgatgatgttgaggcccatattcagaatctggaaaatcaactcaagcaacagtctgaagaattctcaacttctctggctaccatcaaggaacttgaaacccaaatcagcagattagaggaggaactggagaaacaagcccaaggatttgaagctgatctagatgccgtgacacgcgacaaagttgagcaggagcaaagagccatccgtgcagaagaagctttgcggagcaccagacttaaaaatgctaacactgctgagaggcttcaagaagaatttagaaggctctcaacgcaaatggcctctacatttgatgcaaatgagaaggctgccatgagggcattgaccgaagcaagtgaacttcgtgcgcagaaaagactagtggaagcaatgctgcacaaagtcaatgaagagcttcagtctgccaaagctgattatgaggtaaaactgaatgaactatccaaaaaaattgacatgatgacagctcagaaacaacagatgttgttggaaattgatgacaagtccaagcagcttgaaaatcagaagacgcacgaggaacaagttagtagggatttctctgaagagatcctgattctaaaagcagaaaatgaaaggcttaaagtggagatatcatgcctctctcagcaagtagaacaaaaagaaatgttaagaaatgacttggagcttatgaagaaatcacttgaggaatccgaggctcggttacaaactcaaacagtggaaagaaatgagctggtgagtgaaattgctttgttgaagaaggaagcagaaaggtcacttgatgagctaaataggatgaagaatctcaaggatgaaaaagagatggcaggtagagtgttgcagtcagagttagaagcacttagagctcaatacaatgacttgaaaagttctcttattgaggatgaggctgagaaagaaaatctgagaaagcaagttttccagctaaagggtgaactaaagaagaaagacgacgcattaaccaacattgagaagaggttcaaggatagcaatggacgcacacagctttctgagggaactaaaacaaactcaaagaacaaaaaaggtgcttcaattcctcagagttcaaaagaaatggcaaatctgagggagaaaataaaaacacttgagggcatgataaagtccaaggaaactgctttggaaatgtcaacttcttcatttttggagaaggaaaaggagctccaatccaaaattgaggaactggaggacaaagtggaggaattcaaccagagcatagctttgcaaaaggttgttgaggacacgaatactattacttcaaatggtgttgcagtgtcattattcaagagtgatgtacatttgtcggagaaagaagcagaaatatccacaatagatagtaatgggggtggcaacctttgtgacactttagctgaattatcgttgctgaaggaaagaaacaactcaatggaaacggagctgaaagagttacaacaaagatactcagaaatgagtctcagatttgcggaggtagaaggtgaaagacaaaagcttgttatgactgtacgaaacctcaagaatgccagaaaggcccaaatgactactagttcatga

SEQ ID NO: 1538 - DNA, 870 bp, Glycine max var. Williams 82
atggagagtaaagaggaagatgttaacgttggagcaaacaagttctcagaaaggcaaccaattggtacagcagctcagggtggtggtgacaaggactacaaggaggcacccccagctcctttgtttgaacctggtgagctcaaatcatggtccttctacagagctggaattgctgagtttgtggcaactttcttgttcctctacattaccatcttaactgtcatgggtgtcaacaggtcaccctccaagtgtgcctctgttggcattcaaggcattgcttgggcctttggtggcatgatctttgcccttgtctactgcactgctggaatttcagggggacacatcaacccagctgtgacctttggtctgtttttggcaaggaagctgtccctaacaagggcactgttctacattatcatgcagtgtcttggagccatctgcggggctggtgtggtgaagggctttgagggcaatgctaactatgagttgttcaaaggaggagccaattttgtgaattctggatacaccaaaggtgatggacttggagctgagattgttggcacttttgttcttgtctacaccgttttctctgccactgatgccaagagaaacgctagagactctcacgttcctattttggctccacttcccattggatttgctgtgttcttggtccacttggctaccattcccatcacaggaactggcattaacccagctaggagtctcggagctgccatcatctacaacagagaccatgcatgggatgaccaatggattttctgggttggacctttcattggagctgcccttgctgctgtgtatcaccagatagtcatccgagccattcctttcaagacaagggcttag

SEQ ID NO: 1539 - DNA, 1186 bp, Glycine max var. Williams 82
ggactttgaactacactacatattctctgaccaccctagctagctaattagatttctgagagaaaggaaagggtgtgagaagagaatggagagtaaagaggaagatgttaacgttggagcaaacaagttctcagaaaggcaaccaattggtacagcagctcagggtggtggtgacaaggactacaaggaggcacccccagctcctttgtttgaacctggtgagctcaaatcatggtccttctacagagctggaattgctgagtttgtggcaactttcttgttcctctacattaccatcttaactgtcatgggtgtcaacaggtcaccctccaagtgtgcctctgttggcattcaaggcattgcttgggcctttggtggcatgatctttgcccttgtctactgcactgctggaatttcagggggacacatcaacccagctgtgacctttggtctgtttttggcaaggaagctgtccctaacaagggcactgttctacattatcatgcagtgtcttggagccatctgcggggctggtgtggtgaagggctttgagggcaatgctaactatgagttgttcaaaggaggagccaattttgtgaattctggatacaccaaaggtgatggacttggagctgagattgttggcacttttgttcttgtctacaccgttttctctgccactgatgccaagagaaacgctagagactctcacgttcctattttggctccacttcccattggatttgctgtgttcttggtccacttggctaccattcccatcacaggaactggcattaacccagctaggagtctcggagctgccatcatctacaacagagaccatgcatgggatgaccaatggattttctgggttggacctttcattggagctgcccttgctgctgtgtatcaccagatagtcatccgagccattcctttcaagacaagggcttaggctcttgtttttgtatgtgcttgcttgtattagttgttatttatgtgtctggtgtcttcttcattttgaaaattcatgtcaatctttttgcctttgtgttaatccattgtatggatgtaaattatgacatgattacttccttgattgtatttgtggcactctgaatggatttcttcttttattttattttttttataatggatttcttcttttaaggcggcttcaatagaa

SEQ ID NO: 1540 - DNA, 966 bp, Glycine max var. Williams 82
atgggtcaccattcttgctgcaaccaacagaaggttaaaagaggactttggtctcctgaggaagatgaaaagctcatcagatacattactactcatggatatggctgttggagtgaagttccagaaaaagctgggcttcaaaggtgtggcaagagttgtcgcttgagatggattaattatttaagacccgatattagaagagggaggtttacacctgaggaggagaagttaattataagccttcacggggtcgtaggaaacagatgggctcacattgcaagccacttgccaggtcgaactgacaatgaaataaagaactattggaactcatggataaaaaagaaaataagaaagacttcttcggtgtcttcaacaaccattgcacaaagtatcgatcacaattcttctgaccagttcaattacaattccaatctagtactagaccactttcccaaccatgataacaatctacaaacaaaaccaccagttcaagaaaccttgttttcctcaacatgccctctgttcatgtttgacactactagttcactagaagctggcacagcaatagactgcaatagtactactgtgcgagcagaacattttcaagatgctgtgggtttgagcactgaaacatggaacttgagccaccatcaggttcatgcacttccacctctcacagtgagtgtaggtttggacaccacaaattatttgccaccattgattgagaacgtggacaacatggtcccaattgaggtacaatcttgtaccatggatgagcaaggagatatagcactagagtgcttgcagaggcgaggcttaaatgaatggatggtggagacgcagcaacaatgtcctaactttcttttttgggacagtgttgaaggacagcttggtggggaagaactagcaccaaattcatcaaatgtggaagcaaatatgctttctccttttccttcttctttgtga

SEQ ID NO: 1541 - DNA, 2049 bp, Glycine max var. Williams 82
atggacgcgaggttcaagaactttttaggatttgctgctaatcattctgcaaatgcattcaagattttgggcaattctatgcaagttgaaggaaggggagctaattatcatgggacagataccatcttacgacttgattcccctggttcttcaattcccacctctgtgccctcttataagggaacaaaaaggaagtgggatttaattgatggatgtatgggtcaaagagttgactcttctttgtcacttgggcttgggcgttcaagcagttcctcagacagcaaggggagttcagctgctgcctgcactgctatgtcttcagccaaagatattgatgaggaatcatctttagatattgaactggacttttctcttcatcttggctgtgagaaggtacacagccagaagaaacctgttaatccaagtttgaagacaatggagctgcaaccaaaatttgatttggagttaagcctttccactgggccctgtgagtcggatattacaagtgtacatctaaatccatcacctcttcaattgaatatggagatgccattagcattcagtgggacacaaaatacagatgagggatcaacttcatgtagttggaagccagggattgctttgccatcttctaagacatcatcaaatacaggcactaattttcttttaaatcagtcttcaaagcagtttgatcatagtcctattgttgtggaactctcgtctaccagaccaaaaagtttggtcacctgcatttctgagcttacacagcagcaacaggcactacatcgccccagtaattctaaaacatgtcaagtagagggatgtgggaagggtgccagaggtgcttctggacgttgtatatctcatggtgggggtaggaggtgtcagaaacctggctgccacaaaggagctgagggccgtacagtgtactgcaaggcacatggaggtggcaggcgatgtgaattccttggttgcacaaagagtgcagaaggacgtacagatttctgtattgcccatggtggtggccggagatgcaatcatgaaggttgtacccgggctgccagagggaaatctggattgtgcatccggcatggtgggggcaagagatgccagagagaaaattgcaccaagagtgcagaaggcctatcaggcctttgtatctcacatggtggagggcgtcgatgccaagctcctggatgtacaaaaggggcacaggggagcacaatgttttgcaaagcacatggtgggggtaaacggtgtactgcaccagggtgcaccaaaggtgctgaggggagcaccccatattgcaagggccatggagggggaaaacgctgtacataccagggtggtggagtatgcactaaaagtgtgcatggaggtaccaacttctgtgtggcacatgggggtggaaagaggtgtgctgtaccaggctgcacaaagagtgccagaggaaggactgatcattgtgtccgccatgggggaggcaagagatgcaagtttgaaggctgtggaaagagtgcacaaggcagcactgacttttgcaaagcacatgggggaggcaagagatgctcttggggccatccgggttcagaatatggcatccaacaggatggtccttgcaattcatttgcaagggggaaaacaggtctatgtgcacttcatagtgggctagtgcatgacaagagggttcatggaggcatctcactgggatctgttgttcaggatcctcattccagtaaaacagatgaactaaagcaggtactcgttgacaaaaacatgggtatagatatgatgaaaatagggagtagtctaggcactgcaacctgttccgacttcgaacagtttgaagctgcaactgctcatgtctcagccaaggaaggtagtcacttgccagtgtcagttgctgttcctgaaggcagggtgcatggtggtagcctgatggcaatgctaacggggagttctagccgtggctcaagcagcggcagaggtctagttggcgatccatctgaaccaatcaaaggttacgccatgccccagagttggatttaa

SEQ ID NO: 1542 - DNA, 1917 bp, Glycine max var. Williams 82
atggaatttctacccattttgtcttccatttcccttttgttgtgtttggttttgtggcaaggaagtggtgaacctgttgaagataaggaggctttgcttgactttgtgaacaagttccctccttcaaggcctttgaattggaatgagagttcccccttgtgtgattcttggactggagtgacttgcaatgtagacaagtccaaagtaatagcaattaggttgccaggggttggatttcatggcagtattccacctgatactattagccgcctctcggcactgcaaactttgagcctcagatccaatgtaataactggccattttccttctgattttttcaatctcaagaacttgtcttttctctatcttcagttcaacaatatttctggtcctttgcctgacttctcagcctggaagaacctcactgttgtcaatttgtccgataaccatttcaatggcaccatcccttcctcccttagcaaattgactcagcttgctggtttgaaccttgcaaacaacaccctttctggagaaattcctgacctcaacctgtcaagactgcaggtgctgaatttgtccaacaacaacttgcagggcagtgttcctaaatccctgctaaggttttctgagtctgcattctctgggaataacatttcctttggaagttttcccacggtttctccggcgcctcaaccagcttatgagccgtctttcaagtccaggaagcatggaaggctcagcgaagcggcgctgctgggagttattgttgctgctggtgttttagtcctcgtgtgttttgtttctttgatgtttgtgtgctgctcaagaagaggtgatgaggatgaggaaacattcagtggaaagttgcacaagggagaaatgtctcctgagaaagcagtttcaaggaaccaggatgcaaataataaactggttttctttgagggatgtaattatgcctttgatttggaggatttattgagggcttctgctgaggttctgggaaagggaacgtttggaactgcctacaaggcaatacttgaggatgcaaccacggttgttgtgaagaggctgaaggaggtagccgttggaaagaaggattttgaacagcacatggagattgtaggaagtcttaagcatgagaatgtggttgagctcaaggcatattattattccaaagatgaaaaactcatggtatatgattaccacagtcaggggagcatctcttccatgttgcatggcaaaagaggagaggatagggtgcctttagattgggatactcggctgaaaatagccttaggtgctgcaagaggcattgctcgtatccatgttgagaatggtggcaagcttgtgcatggcaacataaaatgctcgaacatcttcctcaattccaaacagtatggctgtgtgtctgaccttggcctggcaaccatatcaagctcacttgccttaccaatatcacgagcagccggttaccgtgcacccgaagttacagacaccagaaaggcagcacagccctcagatgtttacagctttggtgtagtgttgctagagcttctgactgggaaatcccctatccacacaactggtggtgatgagattatccaccttgtgaggtgggttcattcggttgtgcgcgaggagtggacagctgaagtgtttgacttggagctgatgagatatcctaacatagaagaagagatggtggaaatgttgcagatagccatgtcatgtgtggttaggatgcctgatcagaggcctaagatgtctgaagttgtgaagatgattgaaaatgtgaggcagactgatgcacagactcactcatcatctgggaaccaagcagaacaacttaaattttctcaacgtgacaatggtaactctccttccactccctcctacttccagagaggaagtgaatga

SEQ ID NO: 1543 - DNA, 1437 bp, Glycine max var. Williams 82
atgggtggcacagttgttgctgaagtacccacaaagaggggaaggggcagaagggccctgaaggagaaaaccccatcaacgaacgatgctaacatcatcatagccacaccaatttcgccatcatccgaaaaggcggcacaagttgttccctcaaagaaaaaacaagattcaaagaagcagcaatctttcgaaaaagaattgctggagatgcaggaaatgctgcagcagatgcgcctcgagaaggagaagaccgaagagctcttgaaggtcaaggacgaggctctcaagctgaaggaagaagagcttgaaaaccgtggccgggagcaagagaagcttcagaccgagctcaaaaaattgcagaagttgaaggagtttaaacctaccatgaatttgcctgtgttgaaagataatgaagaaaagaaggataagaagaagaaggggtgctctgagaagaaacggccttctccaccttacattttgtggatgaaagaccaatggaatgagatcaagaaagcgaacccagaggctgaatttaaggaaatttcaaccatgctaggtgctaaatggaagactgttagtgcagaagagaagaagccttatgaggggatataccatgcggagaaagaagcttatttgcaggtgattgcaaaggaaaaacgtgaaactgaggcaatgaggttgttggaagacgagcagaagcagaggactgcgatggaattgcttgaacagtacatgcaattcaaacaagaggcagaaaaagatggcaagaagaacaagaaagagaaggatccattgaaaccaaagcaccccatgtcagcttatttcttgttcactaatgataggcgagcagctcttgctgccgagaacaagaatttcttggaggttccaaaaatcacatccgaagagtggaaaaacatgacagaagaacaaaaaagaccctatgaagagatggcaaagaaaaataaggagcaatatgccctagaaatggaggcttataaacagaagaaagatgaggaggctgcccatttcatgaaggaagaggaggagcagatgaaacttcaaaaacaagaagcattgcaactgcttaagaagaaggagaaaactgaaaatataatcaagaaaacaaaacagaaccgccagaagaagaaacagaacaaggatgacaagaattctgatccaaacaggcctaagaagcctgcatcctcattcatcttattcagcaaagaagcaaggaaaactttacaggaggagcgaccaggaatcagcacctcaacccttaatgcacttgtttcattgaagtggaaggaactgagcgaggaagatagacaattctggaatggccaagcatcaaaagcaatggatgcatacaagaaggaattggaggaatacaacaaatcccttgctgcaactgcatgccaggagcagaaaaccgaataa

SEQ ID NO: 1544 - DNA, 603 bp, Glycine max var. Williams 82
atggcttctgttcagtgtgagaaacccaacaccacagttgaagttagccaaccaaaaagccatcacaaacccaatactgcaattgaagtatgccaacccaaaacccaacacagctcgttcggccaaaaattatctgagataactagcaaggctttcaaagggcgtcatggcagcaaccaaaatcaacttcaatactatagccaaactcaggttgagtcccaaggccacaatggcaccaaaacagaggctcactactatggccaaactcagacccaaaatgacaaaaaacatggggtctccaaaacccagatcacagttactgtcgtccaagcacaaattacccacaccgagaagaaggacccttatccttatgataccactacaacatgctttggggctcatgcaaagaagaatggagagctcaacaacaataagaaggatatgaacttgttccggaggattaagaatggcttatcccgccataataacaatgaaggaggcaacagcagcagcagtgatagcgaaagtgatgatgagaagtgcccaaagacaaagaaaggaggaaactgcaagcaggacgcaactaagacaaagccagtttaa

SEQ ID NO: 1545 - DNA, 1878 bp, Glycine max var. Williams 82
atggaaaagcttattcgcatgttccctttgctccttgttcttcttctgtgccccaattttgcctttgctggccatgactacggccaagctcttagcaagagccttctgttctttgaagctcagagatctggttaccttccccacaaccagagggtcacatggagagcacattctggtttgcaagatggcaaagcaagcggggtggatctagttggagggtactatgatgcaggggacaatgtgaagttcgggttacccatggcgtttaccgttacgatgatgtcgtggagcatcattgaatacggcaaacaaatggctgctagtggtgaacttggtcacgccatggaagccgttaagtggggtacggactacttcatcaaagcgcaccctcaagccaatgttctctatggagaggtgggagatgggaacactgaccattactgttggcaaagaccagaggacatgacaaccgaccgtcatgcctacaaggtcgatccgagcaatcccggttccgatctcgccggagaaaccgccgccgcaatggccgccgcatccatagttttcagacgctctaaccctgcctatgccggcgaacttctccgccatgcctaccagctatttgattttgctgacaaatacagaggcaaatatgacagcagcatcacggttgcccaaaagtattacagatccatcagtggttacaatgatgaattgctctgggctgctgcttggttgtatcaagcatctaacaaccagtattacttggattaccttggaagaaatggtgattccatgggtggaactggttggagcatgactgaatttggttgggatgtcaagtatgctggtgttcagacattagttgccaagttcctgatgcaaggcaaatctgggcatcatgctccagttttcgagagataccagcagaaggctgaaactttcatgtgttcatgccttgggaagagtaatcgcaatgttcagaagactcctggtggcctcatcttccgccagagatggaacaacatgcagtttgtcacaagtgcctcatttttagccactgtctactctgactaccttgcttcatctggtagaaacctgagatgcagttcagggaatgtcccccctgctgagcttctctcccttgcaaagtctcaggtggactaccttcttggggacaacccaagagctactagttacatggtgggctatggaagcaacttcccacaaagggttcatcacagaggttcatccattgtttccatcaaggttaacccttcatttgtcagctgccgtggaggttatgctacatggtttagcagcaaaaggagcgaccccaacctgctcactggtgctcttgttggtggacctgatgcatatgatgactttgctgatgaaagagataactatgagcagacagagccagcaacatataacaatgctcctcttattggtattctggcaagactaggtggaggtcatggtggctataaccagcttcttccagttgttgttccagctcctaagcctgctgttaccaagcctcaaccaacccccagtcccaagacaactccttctccagcttcatggtcaggcccaatttccattgaacagaaaaggaccacctcatgggttgccaatggaaaaacttattacagatactcaacagtcgtgactaacaaatctaacaagagtctcaattctctcaatctttcaatatccaagctttatggtccaatctggggtgtcacaaagtcaggtgattcatacacattcccatcatggctcagctcattatcagctggcaaaagccttgaatttgtctacatccattctgcttctccagcagatgtctccgtggcgaactacgtgttggcctga

SEQ ID NO: 1546 - DNA, 1152 bp, Glycine max var. Williams 82
gactttcaatttatttgaaataagtcactcaatctagctcagtttaggtcctcgtgccatcaacggactcgaagaaaattaaggagggctttcatgttaaacttgtttactccacggcggctgtcatggggttccaatactggaggtcaggaaaaggttgagctaacagctgcagagttagagtcacttcgattggagcttgctgatatagaggagagggaagctcacttgaaagctcagttggaacatattgatgaagttttgcggtctgctcgtctatctggatatttatacattcgaactagatgggcaacactaccaggagaacctccacctttagatgatactgaagtagatgattggcttcctcgttttgtcattctccatggagcatgtatatttttatatttgttgtgtacagacctaagcccccaggactcaacccttctatctgatattgttgaagttggaagattaccatgttttaagcgagaagatggtgaaattcaatatgccttttatattttaactcgccatggattgcgctatgagtgctcaagcaattctaaaatacaggtggactcttggttatcggctttacaaagtgactgcaaattggaatctgatacattttgtaaagctgactgcaaactggaatctgatacatcagttcccaatggttcgattgagatgtaacataattacaccttgtttggcatataactttggtgtactgagcgtggttgatggctgagaaactaaaagaggccttgtatatcttttgaaaagaagggcaatctggacctggaaagctcttgtaactgtcagaaaaggaaggacagataggagatcacattttgcctacatttgtggagggtttgtagacctaatctgttgtaatctgcaatgccctagcacccttttttgttgccataggcataggtacaatttgtaaatcaccatccaaccagtaaccaatgggaaagcagtagttaaggaacatatgaaatgggaaccatttgaggtgtttgtttcaagatagaagatttcattcccgtgaataacattcgttacatgcgagtaaattagatttaatatttttcaaaattcaaataatgggatgaagaagtgggagtgggagtaaaagttgat

SEQ ID NO: 1547 - DNA, 348 bp, Glycine max var. Williams 82
atgagaaagtttgtccttaacatggaaaagggagttccacttttgcctaaatggttatccttctctagggtgaatgcacgtgcctggacgggcgttgagataggtcctgctcgccttcatttaagcttaagccagaagctaggggtccagattgtgctttgttggaccaccagttgttggaaagacatcactggcatcctctatagttgctgcacggggtgtaaaatttgtgtgcatatccctagtggagtcaaggatgaggctgatattagaggacataggagaacatacattggaagcatgcctgggaggcttattgatggactgaaggttcagaatctaacttag

SEQ ID NO: 1548 - DNA, 978 bp, Glycine max var. Williams 82
ttctaataaaaataagcttgctatcaatgttattaaccacttaatggcacattgttgttggttgaatgtgcgtacatactgtcccaccacatggagttgtcttcgaaataaggggtgctggtgaatatggtgcacattggacaaaagatggaagtaaggtgtggggatacccactaaattctgtcataaattgatgatttgcttattttagttaaactgtgcaatcaatagtcagaatatttctgccatatgcataaattaaatgttaatatgatatagattatattatactactgatttttttccttcaaaaattctatatcatttcagcttaccggagtacgtgatgagaaagtttgtccttaacatggaaaagggagttccacttttgcctaaatggttatccttctctagggtgaatgcacgtgcctggacgggcgttgagataggtcctgctcgccttcatttaagcttaagccagaagctaggggtccagattgtgctttgttggaccaccagttgttggaaagacatcactggcatcctctatagttgctgcacggggtgtaaaatttgtgtgcatatccctagtggagtcaaggatgaggctgatattagaggacataggagaacatacattggaagcatgcctgggaggcttattgatggactgaaggttcagaatctaacttagacattgaacgctaacattatctgttcttacaaaatttgcaaatgcttgtaggttttatgatacatggactgccagcatttcttgttatgtttctttccatcttttattctcctagggaaatagactagagatgacaagtgaatattagttctcaaggacacaaactctagattcagaatgtttatgcagtagattaaaaaggagtgttgattgggttacaatgcaaattgtagattctaaatttttaatatgtattactttgcaatttactaattatgtgtgct

SEQ ID NO: 1549 - DNA, 2426 bp, Glycine max var. Williams 82
ctcttcgtctcttgattgcattcttcctttttgttcttcgctgcaactctccctctttcacgaagaaactgagacgtttgctttccagtccgagatcaaccagctccttagtcttatcatcaacaccttctacagcaacaaggagattttccttagctttggacaaaattcaacttgagagtttgtcagacaagagcaagcttgacgctcagccagagttcttcatccacattattcctgacaagaccaacaacacattgtctatcattgacagcggtattgacattggctgatttggtgaataacctgggtacctttgcaaggtctgggaccaaggaattcatggaagccctggctgctggtgctgatgtcagcatgataggacagtttggtgttggtttctactcggcttatcttgtatctgataaggattttgttaccactagacagaatgatgatgagcagtatgtctgggagtcccatgctggtggctcattcactgtgacaagggacacatctgctgagaaccttggtaggaaaacaaagataactttgtttctcaaggaggatcaacttgagtatcttgaggaacaccgtctgaaggacttgatcaagaagcattctgaattcattagctatccaatttctctttggattgagaagactactgaaaacgagatttctgatgatgaggatgaggaagagcagaaagatgaggagggtaaagttgaagatgtagatgaagataaggacaagggggaggagaaaaagaagacaattaaggaggtatctcatgagtggtcattggtgaagaagcagaagcctatttggaggaggaaacctgaagagattacaaaagaagaatatgctgctttttataagagtcttaccaatgattgggaagagcatttggctgttaagcacttttctgttgagggtcagctggagcttaaggctatcctctttattcccaagagggcaccttttgatctctttgacacaaggaagaagcctaaaaacatcaaactgtatgtctgtcctgtcttcatcatggacaactgtgaggagttgatgccagaatatcttagctttgttaagggtattgtggattctgaagatcttcctctccacatttctagagaaatgctgcagcagaacaagatcctaaaagtcatcaggaagaacttggtcaagaagtacattgagatgttctttgaaattgctgagaacaaggactataataagttttatgaagccttctctaagaacaagtcaaagctagccgaattgctcaggtatcattccactaagagtggtgatgagatgaccagtctcaaggactatgctaccaggttgaaggaaggacagaatgacatctactacattactggcgaaagcaagaaagctgttgagaattcccctttccttgaaaagcttaagaagaaggggtatgaggtgctctacatggttgatgctattgatgaatatgctgttggtcagcttaaggaatttgagggaaagaagttgttctctgccaccaaggaaggcctgaaacttgatgagagtgaagatgagaagaaaaagaaggcagaattgaaggagaaatttgatggtctttgccatgtgatcaaggatgtgttgggtgacaaggtggaaaaagttgtagtgtctgatcatgttgattctccttgctgtctcgtgactggtgaatatgggtggacagccaataaggaaaggattatgaaagcacaggcattgagggaccgcagtatggctggatacatgtcgtgcaagaagacaatggagattaaccctgagaaccccatcatggaggagctgagtaagcgagcagatgctgacaagaatgacaaatctgtgaaggatctcgtgctattgctctttgagaaagctcttttaacttctggcttcagccttgattatcccaacacttttggtaacaggattcactggatgttgaagctcggactgagcattgatgaagatctggtgatgctgatgctgacacgccttctctggaggatgccgatgctgagggtagcaagatggaagaagttgattaagtgcatgtttggattaaagtttgcaaactcaaggtagacaaaattttactcaaacatatttttgggtctaaccaaacataattccgaattgattttattctcaaacatgacaattagggggctcccacctgaaatccaaatatacgataaatgagtattagaaacaggagaattggaaaacagtcttttacagtgtttatgttctttaattttgggaattttggaacgttagccggccaggtgccgtttatttctggatcaatgtattttagtttatggtaactttttgtgcatgctttgtggggatggtaaatgaatctgtgctttcttcgtataaacgtgaat

SEQ ID NO: 1550 - DNA, 1158 bp, Glycine max var. Williams 82
atggacgaggacgagcaactcgaacgattcgactcggagttcgcctccacgagttccatttcctccaccctcagcaccgacgatttccgcaacctcaccagctccggcgacatttcctccatcagcagcggctccggcgagattcctcccgtcgcggtcctcgcgcctccgtttctctaccgcgaggggtccaatgacgtcgagacggcgccggcgcccagggagaagtgcgtgggaaggagtaacaagggagtgagctgggggcacacttctgtgattgggagaaggaaagagatggaggacgccatcgccgttattccgggattcatgtctcgcacgtgcgatcgcgtcgggggttgtacggctcccggttctagatcctccggcgagatcgctccgcttcatttcttcggcgtttacgacggccacggtggctctcaggtggctaagttttgtgcgaagcggatgcacgatgttatagcagaggaatgggaccgagaaataggaggtgccgctgaatggcagagaagatgggaagctgtatttgctaacagttttgagaggactgataatgaaatcctctcagacgcagttgcaccagaaatggtaggatctactgcctctgtggtggttctatctggttgccaaattattacatccaactgcggcgactcaagggtagttctttgccgcaggacacaaactatccccttgacagtggatcagaagccggatagacaagatgaactcttgagaattgaaggaggaggaggaaaagtcataaactggaatggagctagggtatttggtgttcttgccatgtccagggccataggtgatcggtacttgagaccgtggattattccggtgccagagataactttcacagcaagaaccgatgaggatgagtgcttagttttggcaagtgatggactctgggatgtaatgaccaatgaagaggttggagaagtagcacgccgcattcttagaaggcgtcgcagatccttgtcaatggaggaaacatctcctgcacaagttgttgccgaaagcttgactgaaattgcatatggtcgaaatagtaaagataacatttcaatcatagttgttgatctgaaatcaaagagaaaacgtcagcaaaggcctcctttaatttcctaa

SEQ ID NO: 1551 - DNA, 993 bp, Glycine max var. Williams 82
atggagtaccaatcttttggaagagtccagagaccaaaaggggctaacataatgcaggcattgaaggtgatcctggttttggctgttggtgcatggctgttatatcaggtcaagcactcgagaaacgatacagagaactatagcgatcaaaccgagtttgatggagctatattgttggggcgtaaagggatgccatcacggttagatgaaatggattttcctgactcaggaaatgtagattctgcaggagaagctaatgagtcaagtaatggcagggatgatgggtctggtggagccaaggaagataaggctgaagaagagtttggacatatctatgagatattcagcagaggaaaagaagtggaacttgaaccagaaagtactcaacctgagttatcatccaaaattcaacacaaacatttgtccaaaacaaaatctgaaaaggttggtttagaatcaagaagtgagtcaggtcacaaagagcatggcaatgagaaatacccaaggataccaataataaatgattctaaaagtaatgacaaagaagaagaagtacaactcagggaacagctaaaggaagtgcaggttagaaagaatgctacatcagatttctcaaaaatggagaatgatggggatgagtggcccaaaattagagaaaaggaaaccaggatgcacaaaaatgtggccgataatgacaaaaatgctgaagtgacagaggaaataaatgaggttcaaagctttcatgatgaaaatggtgtcccacctaatgttaatgaaactgaaatagtgcatgaagaaaacatttcaaatgctggcaaaggaagttggtttagaaaacacatttatgaagtcacatatgtagaagataacactgttgaagtgaattgggaagcatcaaagaaccatgctgatgaagaaattaatacagtaagtattactcaagtcgacccttcaggcatcaaacgcaattcagaaattgatggagatagctag

SEQ ID NO: 1552 - DNA, 4002 bp, Glycine max var. Williams 82
atgaccaccgtaacggtcaccactcgagctcaaatcctccgccacaccgccgcattcacctcctccgtcctctcgcaatccgaactacgtcgccgcctcatcgccactctcctccgcgacactccattctccgaccaaaaacacctaaacctcgccgcagacactcttgagagcgcgatctcgttctcgagccccgccctccgcttctcgtccctctccctcgccgagaagctcctcctccctctccccgacttccccctctcctctcttctcctctctctcatccacgcactccgtaaccgccctaccgaatccgccgttagcctcctccgaatcttccactccaacgcttccctcgctcgatccgaaatcgctcccgcgctctacgaacgcctcttctctctccacctcttccccgtcttccgctggttcgatgatcagaggacgcggattctctcaacgagccgtaacgatagcgattattcggtaacttccgaggagtactccgtggtgctgccatgcgcgaaggtgttgtcgaagatgagcgaggagcaggcagcgaagctcagggaggtggagagagactacgaagaggtcctcaaccagaactgcatggttctcgccgagtatttcaaagaggttttggtcaacgaaaacggtgacgctgctgcgattagtccaccgtcgttggtactgaagagcgccgcagaagatggccgcggcggtgtggagaacagaaaggaggagatgatgaaaatgagcgtgttggagaacggacggtataatccaatatggtccgaaagggaagcatctattgaatttttgagccccagttccagcagcagatcttcccaagtgccattttatcctcaaagagtcttttccagaatcctcaaaccccaaaaagcttcaaaaacttggacaacaccagtctatttaaactcaaccaccgctgatactgatttttctttagatgagagtttgcttagttcgtcttcagattctgaggcagaaaatgatgaggaaaaggacaaaactgttgcattgttggagcctcgacaaagccaaattaaggagcgaatgctatccatcttcaaacaatcaagaggttccccagattatcctatggcagacttcgataccccgctgcatggaattgggaaacatgcacctcccaaggactttgtctgtccaataacaagtcacatatttgatgatccagtgactcttgagactggtcagacatatgaacgtaaagctatcgaggaatggtttaatagaggaaacataacctgtcccatcacacgccagaagcttcaaaacacccagctacccaaaacaaattacgtgctcaagcgactaattgcaagctggaaagatcgcaacccccatttggtcccaccgccgtgtgagagtccgtacgaagatactgatgaggcagttgtgataccaacaacattgccttcaacttctcctaatagtgttataacccaagccaccgttgatgggatgatgagtgagttacgctgtgcaatcaataacctttatatgtcagaggttctccaggaatcggaaatggccgtgcttcaaattgacaagttctggagaggagtgaatgtaggagtggatatacatagcatgctatcaaaacctgcgataatcaatggatttatggagatccttttcaattctgttgagccccaggtgcttcaagcttcagttttccttttggcggagatgggttccagagacaatgctgttattaagactctcacacgtgtggacactgacgtggaatgtatcaaggctcttttcaagaacgggttgactgaggctgttgtcttgttgtatctgctaaacccttccactatgagtcttgcagagatggcaatagtggagtctctaataacagttttcaataagaaagaggaagacttggttaagatgtgtttgaagcccaaaacagctgcagtgcttttacttgcacggattgttggaagcagtgaagagataattgcatcttcggttgtcaatacccttttctctgaaaaaacaattggaactattgtcggaagtttgggagctgacttggcaaaggagaggattgctgcagtggagatcttgttgagatgcatggaagaagatgggacttgcaggaataacattgctgataaagcagagttgtcacctattttggaaactttaatcggtgcaaccgatggagatcgatttaagattattcagtttttctttgagttagtcaaattaaataggcgtacattcattgaacaaatcctccacattataaaggaagaaggaccttttagtacaatgcatactcttcttatttatttgcagacagctcttcaagatcaatgtccagttatggctggcctcttactccaactcgatcttctggttgagccaagaaaaatgagcatataccgggaagaggcgatggatactcttatttcatgcctgagaaacacagatttccccgttacccaattagcagctgctgatacaattatttcactgcaagggagttttgacttctctggaaaccctcgaacaagagaagttcttcttaaacgagcaggtatcgaaaaaagttccagaagtcttgtacaggtggatcagatcaacaacttcagcccagaaattgatataactccagaagaagagaaggcagctgatgattgggaaagaagaattgcatctgttctagttagccatgagtttggcactctttttgaggctttagcagatggcatgaagagccgaaacccagaactacgatcagcatgctttatattagctacatggctcatttacatgttgaccattctaccagatacagggatacatgtagcagctcgtgcctgcttgctgaagcagttcatagctaaattaaattgtgctaaggatgtagaagacagaatcctttctatgcttgctctcaatagctttcttcatttctctgacggctttggtgatctaacttccttcactaaggatatcataaaagggttgagagagctaaagagatcctgtcctttagcaactaaaatgctaaaggttcttgttgaagaaaatgaatctaaagcggaaatttggatacataaagagctcataaaagaagactgcagcgagaatggagaggtgctgtctgtcatttgctttaagggtaaatttttttcaggacatacagatggcactatgaaggtctggacattaaaggataacttattctgtctgatgcaagagatccaagaacatactaaggctgtgacaaacttggtgatttccgaatctgatgacagattatacagtggttcacttgaccgaactgcaagggtctggtctattggaaaggcagcaatacattgtgtgcaggtgcatgatatgaaagaccagattcataatttagttgtaaccaatagcttatcttgtttcattccgcaggggactggtgtcaaggttcagtcattgaatggagaatcaaagttgttaaattctagtaaatatgtgaagtgcttggctcatgttcatgggaaattatactgtggatgccatgacagtagtgttcaggagatacatttggccactggaacagtcaacactattcaaagtggttataaaagattacttgggaaagcaaatcctattcatgcactgcaaattcatggtgaacttatatatgcagctggctcttccttggatggatccgctataaagatatggaacaattccaattacagtatagttggatcattgcaaactggatctgatgtgcgggccatggaagtgagctcagaattgatttatttggggtgcaaaggaggtactgtggaaatttgggataagaagaaacacaaaagagtcgacacgttgcaaatgggtacgaattgtagggttaattgcatggctctagacagcaatgaagaggttttggtaattggaacttcagatggacagattcaggcttggggaatgaattaa

SEQ ID NO: 1553 - DNA, 4447 bp, Glycine max var. Williams 82
caagggtcacattggtaaagtaaagtattttattttagtattttatgaaagtaaaacatggtaagaccaaaacaagggtcacattggtcatttcagaaactgccgtccgagacttctaattccggcaaattcaattgaaaccgttaactggtatttccgttaacgtcgtatccataatttcatatacccccccaacagaccaaacttgtactcactatcacaccaccatgaccaccgtaacggtcaccactcgagctcaaatcctccgccacaccgccgcattcacctcctccgtcctctcgcaatccgaactacgtcgccgcctcatcgccactctcctccgcgacactccattctccgaccaaaaacacctaaacctcgccgcagacactcttgagagcgcgatctcgttctcgagccccgccctccgcttctcgtccctctccctcgccgagaagctcctcctccctctccccgacttccccctctcctctcttctcctctctctcatccacgcactccgtaaccgccctaccgaatccgccgttagcctcctccgaatcttccactccaacgcttccctcgctcgatccgaaatcgctcccgcgctctacgaacgcctcttctctctccacctcttccccgtcttccgctggttcgatgatcagaggacgcggattctctcaacgagccgtaacgatagcgattattcggtaacttccgaggagtactccgtggtgctgccatgcgcgaaggtgttgtcgaagatgagcgaggagcaggcagcgaagctcagggaggtggagagagactacgaagaggtcctcaaccagaactgcatggttctcgccgagtatttcaaagaggttttggtcaacgaaaacggtgacgctgctgcgattagtccaccgtcgttggtactgaagagcgccgcagaagatggccgcggcggtgtggagaacagaaaggaggagatgatgaaaatgagcgtgttggagaacggacggtataatccaatatggtccgaaagggaagcatctattgaatttttgagccccagttccagcagcagatcttcccaagtgccattttatcctcaaagagtcttttccagaatcctcaaaccccaaaaagcttcaaaaacttggacaacaccagtctatttaaactcaaccaccgctgatactgatttttctttagatgagagtttgcttagttcgtcttcagattctgaggcagaaaatgatgaggaaaaggacaaaactgttgcattgttggagcctcgacaaagccaaattaaggagcgaatgctatccatcttcaaacaatcaagaggttccccagattatcctatggcagacttcgataccccgctgcatggaattgggaaacatgcacctcccaaggactttgtctgtccaataacaagtcacatatttgatgatccagtgactcttgagactggtcagacatatgaacgtaaagctatcgaggaatggtttaatagaggaaacataacctgtcccatcacacgccagaagcttcaaaacacccagctacccaaaacaaattacgtgctcaagcgactaattgcaagctggaaagatcgcaacccccatttggtcccaccgccgtgtgagagtccgtacgaagatactgatgaggcagttgtgataccaacaacattgccttcaacttctcctaatagtgttataacccaagccaccgttgatgggatgatgagtgagttacgctgtgcaatcaataacctttatatgtcagaggttctccaggaatcggaaatggccgtgcttcaaattgacaagttctggagaggagtgaatgtaggagtggatatacatagcatgctatcaaaacctgcgataatcaatggatttatggagatccttttcaattctgttgagccccaggtgcttcaagcttcagttttccttttggcggagatgggttccagagacaatgctgttattaagactctcacacgtgtggacactgacgtggaatgtatcaaggctcttttcaagaacgggttgactgaggctgttgtcttgttgtatctgctaaacccttccactatgagtcttgcagagatggcaatagtggagtctctaataacagttttcaataagaaagaggaagacttggttaagatgtgtttgaagcccaaaacagctgcagtgcttttacttgcacggattgttggaagcagtgaagagataattgcatcttcggttgtcaatacccttttctctgaaaaaacaattggaactattgtcggaagtttgggagctgacttggcaaaggagaggattgctgcagtggagatcttgttgagatgcatggaagaagatgggacttgcaggaataacattgctgataaagcagagttgtcacctattttggaaactttaatcggtgcaaccgatggagatcgatttaagattattcagtttttctttgagttagtcaaattaaataggcgtacattcattgaacaaatcctccacattataaaggaagaaggaccttttagtacaatgcatactcttcttatttatttgcagacagctcttcaagatcaatgtccagttatggctggcctcttactccaactcgatcttctggttgagccaagaaaaatgagcatataccgggaagaggcgatggatactcttatttcatgcctgagaaacacagatttccccgttacccaattagcagctgctgatacaattatttcactgcaagggagttttgacttctctggaaaccctcgaacaagagaagttcttcttaaacgagcaggtatcgaaaaaagttccagaagtcttgtacaggtggatcagatcaacaacttcagcccagaaattgatataactccagaagaagagaaggcagctgatgattgggaaagaagaattgcatctgttctagttagccatgagtttggcactctttttgaggctttagcagatggcatgaagagccgaaacccagaactacgatcagcatgctttatattagctacatggctcatttacatgttgaccattctaccagatacagggatacatgtagcagctcgtgcctgcttgctgaagcagttcatagctaaattaaattgtgctaaggatgtagaagacagaatcctttctatgcttgctctcaatagctttcttcatttctctgacggctttggtgatctaacttccttcactaaggatatcataaaagggttgagagagctaaagagatcctgtcctttagcaactaaaatgctaaaggttcttgttgaagaaaatgaatctaaagcggaaatttggatacataaagagctcataaaagaagactgcagcgagaatggagaggtgctgtctgtcatttgctttaagggtaaatttttttcaggacatacagatggcactatgaaggtctggacattaaaggataacttattctgtctgatgcaagagatccaagaacatactaaggctgtgacaaacttggtgatttccgaatctgatgacagattatacagtggttcacttgaccgaactgcaagggtctggtctattggaaaggcagcaatacattgtgtgcaggtgcatgatatgaaagaccagattcataatttagttgtaaccaatagcttatcttgtttcattccgcaggggactggtgtcaaggttcagtcattgaatggagaatcaaagttgttaaattctagtaaatatgtgaagtgcttggctcatgttcatgggaaattatactgtggatgccatgacagtagtgttcaggagatacatttggccactggaacagtcaacactattcaaagtggttataaaagattacttgggaaagcaaatcctattcatgcactgcaaattcatggtgaacttatatatgcagctggctcttccttggatggatccgctataaagatatggaacaattccaattacagtatagttggatcattgcaaactggatctgatgtgcgggccatggaagtgagctcagaattgatttatttggggtgcaaaggaggtactgtggaaatttgggataagaagaaacacaaaagagtcgacacgttgcaaatgggtacgaattgtagggttaattgcatggctctagacagcaatgaagaggttttggtaattggaacttcagatggacagattcaggcttggggaatgaattaaaaaaagacgctgaaggtgcagtggtacaggaagacatagatgaacttaccttgacatttgacagtattacattcattaaaccttaaaaaatactttcattttttaggttcctcgtgagctgtatatagctcaaagtttatacatccaagtgacttgtacatagattaattcatagatatattgctatatcatatgtatgagattgtctttttaatttt

SEQ ID NO: 1554 - DNA, 2477 bp, Glycine max var. Williams 82
ctaaactccaattggattttcttctgctaactatgtaacacaacttcactcctaactacgcacgcagaccataagcttctcaactgctaaactaaggatgaggcatctccgttattatgtgccggtataattaagccagcactccggctaggtcttgtagccagaatctgattctggctagaatagtagtttgctgaggctttcagaagcagtcaagaatcaagatagatttctgagaatcagatcaggtctactcattagtcatggatagcagcaagaagggagccctcatgagtaatgaaagcgcaaaagatttatcagtcatggttctgaaacagcatcagtacaagaagaaccaaccaaagttaagttctaccccgcaagagagacgtgatcaatcccactgccttatctgtaggggaaacaacagttgtcaaacagttcatgcaagaacaaaactgatgaatactttgattggaaaagggaagccacatgaagctcaggccgtcttcaacaacttaactgaagaagggcataagccaactctcataacatacacaactcttgtggctgctctaacccgccaaaagcgtttcaagtctattcctgcacttctttctaaagttgcagacaatgggatgaagcctgattcaatacttctcaatgctatgatcaatgccttttctgagtctggcaaggtagatgaggccatgaaaatctttcagaaaatgaaggagtatggatgtaaaccaacgactagtacttataatactctcatcaaaggatttgggattgctggaaggccttatgaatctatgaaattgctagagatgatgggtcaagatgaaaatgtgaaacccaatgatagaacatataatattctcatccaagcctggtgtaccaagaagaaactggaagaagcatggaatgttttgcataaaatggtggcttctggcattcagcctgatgttgtaacatacaacaccatggcaagggcatatgctcagaatggtgagacagagagggctgaaaggctaatattgaaaatgccgtacaacatagtgaaacctaatgaacgaacttgtggcatcataataagtggttattgcaaggaaggcaatatgccagaagccttgaggtttctatacagaatgaaggagcttggtgtggatccaaatccagtagttttcaactctcttatcaaaggatatctagacactacagacacaaatggagtagatgaggcactgacattgatggaagaatttgggatcaaaccagatgtagtaacctttagcaccatcatgaatgcatggagttcagcagggcttatggaaaattgtgaggagatattcaacgacatggtgaaggccggtatagaacctgacatccacgcatatagcatccttgcaaaaggctatgtgcgtgccggacagccacgaaaagccgaggctcttctgacttctatgagcaaatatggcgtacaaccaaacgtggtgatcttcactaccatcatcagtggatggtgtgccgcaggcaaaatggatcgtgcatttagactttgtgagaaaatgcatgaaatgggaacttccccaaatttgaaaacttatgaaactttaatatggggatatggagaagcaaaacaaccatggaaagcagaagagttacttactactatggaagagaggggtgttgtccctgaaatgtcgactatgcaactggtggctgatgcttggcgtgccattggtttattcaaagaagccaacagaattcttaatggttcagaagaagaatctgagctagatcaagaatttgatagtgacaagatacaagtgcaaagcttggagagtatttataagaaacagaaactcagtgcttctccctctaatctgcttcaaatacctgacgtagtggtgactcatccaacaagaacaactaatggaaacataagatgcagaatggtagtcaaactatctgacaacatgcggaatgttaccacttccatgttttttgttcgcacaagaagttcatatggagtgcaaccactgattgtaagtaggcagcagattcaaaatcaggttgttaggccattccttgactgttgcagagtagtgtcaatactttgttgaggtgacttaccattgtgatgaaacacaaatcctttctgaatagatttggttgtttccatgacagtacaccatgccaatgagttcaggtggaaaaactgtagataccattcatggacttcagaaatcagaacatacacttacaattttgacaaaatgctggtgtaatttcaatttgttgaactgctgctactcgtattcagtaatcacttgccaatgaaatgtgtatcctattacatcactataaaattcgttttgtattgttgtgtacactgagcattgttggaaaatcttacttttataaatagtacttataaggaaaacactgaaaagaatagaaccatatcaatc

SEQ ID NO: 1555 - DNA, 1894 bp, Glycine max var. Williams 82
aaatccctttaacttgctgtctattagtttctgtttatgccctgagactttgttgcttcctgctttctcatccattcaacaaaaccaaacttcttgtcagccttggcttattgaagcaaatcatacccttacataccattttgatttgatcttcagatcaatcagaccatactgtatctcatctgtttcaacttcactcaaagtactatcatggttttattttacgcaaagttttaaaaagcattccgccaccgaaattttggccacaatatcaaggtttctgggggtctgtgtgaccacaacttgaccataattgtggttgcatttattcactatatcaaggatggtcatgaaaccactactgtgattgcaatttaaaatcttgatttaatggtttcactttgtcatgaccttgtgcacctcttgaagctttttattcaggcttgaaattcttgaaattataactccttccccctttgatgcttaacatggagtacttgaaggaagtggaaggaaaaagtgtccatgattatgttgaggtaaagatgggtaaaatgacaaagccaataagtgtggcaggaccagtgatagtgggtgctggtccatcagggcttgctgcagcagcatgtcttaaacagaaaggcattccaagcttaatccttgaaagagctgattgcttagcttcaatgtggcagctcaagacttatgaccgcctgtgccttcatctccctaagcaattctgccaactccctctaatgccattcccacaaaactttccctcttatccaaccaaacaacaattcttggcctatctcaaagcctatgctgaccattttgatataaaaccagctttaagcaagacagtgatcagtgccaattttgatcatggatgtgggtactggagggtgaagactcaaggtttgaaaaaggaggagacagaatatgtttgtcagtggctgatagtagccactggagagaatgctgaagaggttgtgcctcaaattgaaggaatgagtgagtttgaagggcctatcttacacaccagctcatataaaagtggtagtatgtttggtgggaagaatgttttggttgttggatgtgggaattcaggtatggaagtttgcttagatttatgcaaccatgatgctcgcccatcccttgtggttagagatacggtgcatatcttgcctcagcagatgtttgggaaatcaacgtttggtttatctatgagcttgctcaagtggttccccatgcgtctcgtggacaaatttttacttctgatgtcacatctcattctcggggacacagctcaatttggacttaatcgtcccaaaattggccctctagagctcaagaacttgtgcggcaagaccccagttttggatgtaggcacacttgctcacataaaaagtggaaaaattaaggtttgccgcggaattaaacaactagcaaagcataaggtggaatttgtagatggaaaaacagagaatttcgatgtcatcattatggcaactggttacaaaagcaatgtacccacttggttgaagggcagcaacatgttttgtgagaaggatggattgcccaggaaagatttcccaaatggatggaaaggtgaaaatggactctatgccgtgggtttctctaaacgtggccttcttggtgcatctattcattcaaagaggacggcagaagatattgaacactgttggaaagctgctaataccacgcgtgtgtaggacttgatgcgttttaggatatacaacggaatcttttgtgcttgaattaagcaacggaatcttttgtgcttgaattaagcagtaattatatttagatcacgtttcattcaaacattacacttttttttttcagagaatataaatatactacaactcat

SEQ ID NO: 1556 - DNA, 2748 bp, Glycine max var. Williams 82
ctcttcaacaacaaacaactaacacgaagaagaagaaatttctctgcgcttggattcattcatttattctctgaagaaaaccctctcctttctcccaaggatggctaaagacttttacccctcctattgcttggtagcttataatctgggtgttttgttcaaaatctgtgcaatctgactggaggaacttgatttcagtttctggtgttcaaagcctttcttccagtgtgcaaagtactcctgaaaaaatggccattcagatgatgcttcaaaaagttcagaacttcttcagcagttcctaaaatgtggtccaaagaaggaacttcttcaaatgtgttttgacaaggacaataaaacatttcttcaaaaagcagaatgaccgaaaataagtcaaccagtaagatcactaagaaacaagagacaaaaaaagtttctagtttcagccatcagccccctagaaagcaacctcggaagggtgaaaaccctactagactcatacctcctcctgaccagtcttctgattttggccattcaaacacttggatttgtaaaaatgctgcttgtagggcggttttgtctatggatgacacattttgtagaagatgctcttgctgtatttgtcacctttttgatgataacaaggatcctagtctttggttggtatgcacatctgaatctgctcaagggggggactcctgtgggttgtcttgccatattgaatgtgcccttcagcatgaaaaggtgggagttattgatcatgggcaactgatgcaactagatggtggctattgttgtgcatcctgtggtaaagttacagggatacttggatgctggaagaagcagctaactatagctaaggatgcccggcgtgtagatgtactctgttacaggatatatttgagctacaggctccttgatggaacctcaaaattcaaagatttgcatcaaacagtacaagaggcaaaggctaaactggagacagaagttggtcctgtcaatggtgtttctgccaagatggctcgaggcattgtcagtagactccctattgccagtggtatacagaaactctgctctcttgctattgagaaagctgataggtggcttgccactgttccttatgtaaatccagattccacagagggttcacttcctgctgcttgcaagtttgtttttgaagaggtaacaacttcctcagccaaaatcattttaattgaaatgtcaaatatatgttctgaggaaattaagggatacaagctctggtattacaagagtcaggacgaatcacccactaaagatcctatttccatgtttcccaaatctcagaggaggattttggtatccaacctcaagccttgcacagaatatacttttcggattatatcttacactgatacacgtgacttgggtcattctgaggctaagtgtttcacccagagcatcgagatagttaaaaacaatccctcttcatctgttgctatgaataaagaaaaagagaaccttctaactaggggtaattcttcggtctctaagatagggcccaatgccacaacagaaggctacggattcaaggttcgagaccttgggaaatttttgcgtcttgcttgggctcaagaacaaggttacttggaagagttttgctgcgccaatgtgaaaaattgctgtggacaaagtgaaatggtggataagcctagaattccagaagcacagttgccttcactttcgcgagtccttgatttaaatgttgtttcagttcctgatttaaatgaagagctaacacctccttttgagtattctagggatgaagataatggttgctctttgctgcaagcagttgaggcagatgatgatgctgcttctcatgatctagagaaaaatggtttagtaagatcacatgggagtggggattcccagacctggacccatgggccaacaggagaagtgtctgctgttgattctcgcatagatatgtgcaggaaaaggatagcaagcacaaacgaagagactcatgattgtgacagcactttgataaatggttctcctttacgcatatctgatggttcatgttccttggatgagaactttgagtattgtgtgaaagtaattcgttggctagaatgtgaggctcacatcaaacaggaatttaggttgaaattgctaacatggtttagtttaagggcgacagagcaagaacgcagggtggttaataccttcattcaaactcttattgatgatccaagtagtttggcaggacaactggtagactctttttctgatattatatccaacaagaggctaagaagtggattctgtagtaaagctggggcatcaaattaatgaaacagtaacatatttttccctggaggaaggatttatggacatgaagtttcaggatgtaggaggcattatgccatttctaaattgctgcaatgatttttagtaatgaatttaattacggaagatattagaacccttttcttataacctttatttgaagaaggtacatgattcaatcgctgatttgatttatatttgtcattcttttgtaatcttcttgttcctcgtactgattagctggcaaatgaaaatgcttgcttcaaattgtggttaaagctgctgctgtttactatggttttctagactagcgtttcacatgatttctttggagatcttaagctagctggataaattaactttataaattaagacaatacatttgtgggttacgtcttatatctgactgcatgccaa

SEQ ID NO: 1557 - DNA, 2649 bp, Glycine max var. Williams 82
ctcttcaacaacaaacaactaacacgaagaagaagaaatttctctgcgcttggattcattcatttattctctgaagaaaaccctctcctttctcccaagtttctggtgttcaaagcctttcttccagtgtgcaaagtactcctgaaaaaatggccattcagatgatgcttcaaaaagttcagaacttcttcagcagttcctaaaatgtggtccaaagaaggaacttcttcaaatgtgttttgacaaggacaataaaacatttcttcaaaaagcagaatgaccgaaaataagtcaaccagtaagatcactaagaaacaagagacaaaaaaagtttctagtttcagccatcagccccctagaaagcaacctcggaagggtgaaaaccctactagactcatacctcctcctgaccagtcttctgattttggccattcaaacacttggatttgtaaaaatgctgcttgtagggcggttttgtctatggatgacacattttgtagaagatgctcttgctgtatttgtcacctttttgatgataacaaggatcctagtctttggttggtatgcacatctgaatctgctcaagggggggactcctgtgggttgtcttgccatattgaatgtgcccttcagcatgaaaaggtgggagttattgatcatgggcaactgatgcaactagatggtggctattgttgtgcatcctgtggtaaagttacagggatacttggatgctggaagaagcagctaactatagctaaggatgcccggcgtgtagatgtactctgttacaggatatatttgagctacaggctccttgatggaacctcaaaattcaaagatttgcatcaaacagtacaagaggcaaaggctaaactggagacagaagttggtcctgtcaatggtgtttctgccaagatggctcgaggcattgtcagtagactccctattgccagtggtatacagaaactctgctctcttgctattgagaaagctgataggtggcttgccactgttccttatgtaaatccagattccacagagggttcacttcctgctgcttgcaagtttgtttttgaagaggtaacaacttcctcagccaaaatcattttaattgaaatgtcaaatatatgttctgaggaaattaagggatacaagctctggtattacaagagtcaggacgaatcacccactaaagatcctatttccatgtttcccaaatctcagaggaggattttggtatccaacctcaagccttgcacagaatatacttttcggattatatcttacactgatacacgtgacttgggtcattctgaggctaagtgtttcacccagagcatcgagatagttaaaaacaatccctcttcatctgttgctatgaataaagaaaaagagaaccttctaactaggggtaattcttcggtctctaagatagggcccaatgccacaacagaaggctacggattcaaggttcgagaccttgggaaatttttgcgtcttgcttgggctcaagaacaaggttacttggaagagttttgctgcgccaatgtgaaaaattgctgtggacaaagtgaaatggtggataagcctagaattccagaagcacagttgccttcactttcgcgagtccttgatttaaatgttgtttcagttcctgatttaaatgaagagctaacacctccttttgagtattctagggatgaagataatggttgctctttgctgcaagcagttgaggcagatgatgatgctgcttctcatgatctagagaaaaatggtttagtaagatcacatgggagtggggattcccagacctggacccatgggccaacaggagaagtgtctgctgttgattctcgcatagatatgtgcaggaaaaggatagcaagcacaaacgaagagactcatgattgtgacagcactttgataaatggttctcctttacgcatatctgatggttcatgttccttggatgagaactttgagtattgtgtgaaagtaattcgttggctagaatgtgaggctcacatcaaacaggaatttaggttgaaattgctaacatggtttagtttaagggcgacagagcaagaacgcagggtggttaataccttcattcaaactcttattgatgatccaagtagtttggcaggacaactggtagactctttttctgatattatatccaacaagaggctaagaagtggattctgtagtaaagctggggcatcaaattaatgaaacagtaacatatttttccctggaggaaggatttatggacatgaagtttcaggatgtaggaggcattatgccatttctaaattgctgcaatgatttttagtaatgaatttaattacggaagatattagaacccttttcttataacctttatttgaagaaggtacatgattcaatcgctgatttgatttatatttgtcattcttttgtaatcttcttgttcctcgtactgattagctggcaaatgaaaatgcttgcttcaaattgtggttaaagctgctgctgtttactatggttttctagactagcgtttcacatgatttctttggagatcttaagctagctggataaattaactttataaattaagacaatacatttgtgggttacgtcttatatctgactgcatgccaa

SEQ ID NO: 1558 - DNA, 1191 bp, Glycine max var. Williams 82
atgagaaactatatgcagtttcttaatcctcagatcttgtgcttcctatttttcagtgctctattattatgtctagttgaaacaaagtccaccattgaaccatgcaattcctcaaactcgtgcccctctcttctctcttatctcttgccatgggactccaagctctccgaaatcgccactcgcttcaatgtaaacttttttgatatcttggcctcaaactctctcttccccataacaccatcaagtgcacaccaaatccttagtgccaaatcacaagtgaaaataccaatctcatgttcttgtgtggatggcatccgaaggtccatgtcaaccatttacactgttcatgcagctgatacacttgcttccatatcagaaggctatggtggattggttagtgctgaacaaatcaagattgtgaacgccatcaatgccaccaaccctttgacatatagaggcacccttgttattccactgccatgcacgtgttttgacaatgtgaataatgggggaaatgctatttatatgtcatatgtggtgcagagaagggagagcctggggagcatagcaaccaagtttggtacaactgtttcggacttggaaactgtaaatggctttggggaagctacggtagatccaggagacattctatctattcccattgcagcatgttcatcagcaaccttgaattggtacgatgagagtatgatagtcccaaatggctcatatacattaactgccaccaactgcatcaaatgcacttgtgaaccaacggatatcacgttgcaatgtgttccttctggactagacgtcccctgctataatttacgttgcaaaggatccaatcttattattggtgatcaatgtgtggatctttcacaaacagcttgcaatgtgagccaatgtgtttaccgtggccataggggtggcaaaattctgagtagtatgaagaaatcttcttacctcgagtgcccggatagtttgtgtcatagcggaccatcatgttggccttcctcatcaccatatcctgaagacccatttggtatgtctccaaagccatccccctccttgccactaccagtttctaaggctgctctgaggactcttgcctccagtggaaggcttggtccatttttattcaatgtgctgcaattattcttgttaaaatttatcatttattttcttatttga

SEQ ID NO: 1559 - DNA, 1116 bp, Glycine max var. Williams 82
atgagagacatgaaagacgcaggtgccctgggaggcaagacagcacgagcctgcgatagctgcgtaagcagaagggcaaggtggttctgtgcagcagatgatgctttcctctgccatgcttgcgacactttggttcattccgcgaaccagttagcaagcagacacgaaagggttcggcttcaaactgcatcctctaaggcaaccacaaccactacgcacgcatggcacagtggattcacacgcaaggcaagaaccccgcgtcacaacaacagcaagcactttgcgctgcaacagcgtctcaaacacgaagttctcttcaacaacaccagtgttcttcccctcgtgccggagctcggaggggaagaacaagaaccggtggttgtggacaacgatgaaacggaggaacagatgctgtgtcgcgtgcccgtgttcgacccttttgatgtgagaaccgatgacttggatagcttttctgacatggatttttctgaatttgctgctgatgttgaaggccggcttgacaaagaagacgatgaaataagtgcgtatgtgggaggaggagagggagttcaaggtgtattggccaaggttaagggcgaagaagaaattgatggtgatgtagcgtgttatctggagtcagtttttgacatgatcagtgatgatgcctttcattggaataatattgagtctgtggtgtcagatgcccgggaagagaaggggtgtgtggtgccatgtgatggtggggttagtgaacaaggaggaataaagagagacatatttttgagactaaactatgatgaggttattactgcttggtctagccaaggttcttccccatggacaacttcaaacccacctaagttcaactctgattatgacttctccttgggtttgagtggtgtagatggagaaggaagaagcttaaggggacacctagatggtggaagagaagcaagagtgtcgaggtatagagagaagagaaggactcgtttgtttgcaaagaagataagatatgaagtaaggaagttgaacgcagagaaaaggcctagaatgaaaggtcgttttgtgaagaggacatgctttgttggagccaatgcttttcctgcttaccactga

SEQ ID NO: 1560 - DNA, 939 bp, Glycine max var. Williams 82
atgtctacttcaaagagcgtcagcagttctagtgaagatgacaatgaacttagaagagggccttggactctggaagaggataacttgctctcccaatatatttttaatcatggggaagggcgatggaatttgctggctaaacgttcaggattaaagagaactgggaaaagttgcagattaaggtggctaaattatctaaagccagatgtaaaacggggaaatttaaccccacaagagcaacttataattcttgaactccactcaaagtggggaaacaggtggtcaaaaattgcacaacatttgccaggcagaacagacaatgaaatcaagaactattggagaactaggattcagaaacaagcaagacatttgaaaatttacactgacagcagagagtttcaagaacttgttaggcgtttctggatgcctagattgcttcagaaagcaaaagaatcatcttcttcaaacatgtcaattcaaaaccaggcaattcctatgccttttgattatgtttctcagcatttaactgttgggaccatacctccttggcagggaccttgtatgaatgaagctggtcccacttacatggaccaacatgagcagaactcagactcggaacacaacaatggttcatgcatctccttgtctgagtcagcaaatattccaaaagtgcctcagcattttggacacaccaccatcacccaatttcatgccttgaataccaatgactttggcaccttcacatatgaaggttataatgtaaacaacaatgtctatgagatggacaacttcaaaacgactactacatgggtggctgaggatgcgcaatacccaattggtgattgtcaaatggtaggaagcaattgggtaaacaacgattttgcatgtaacatgtggaacatggatgaactgtggcagtttagcaagttacaaaaataa

SEQ ID NO: 1561 - DNA, 1374 bp, Glycine max var. Williams 82
gcatatataggcatagtttaattttatagtttcagtgagtgagaatagccatgtctacttcaaagagcgtcagcagttctagtgaagatgacaatgaacttagaagagggccttggactctggaagaggataacttgctctcccaatatatttttaatcatggggaagggcgatggaatttgctggctaaacgttcaggattaaagagaactgggaaaagttgcagattaaggtggctaaattatctaaagccagatgtaaaacggggaaatttaaccccacaagagcaacttataattcttgaactccactcaaagtggggaaacaggtggtcaaaaattgcacaacatttgccaggcagaacagacaatgaaatcaagaactattggagaactaggattcagaaacaagcaagacatttgaaaatttacactgacagcagagagtttcaagaacttgttaggcgtttctggatgcctagattgcttcagaaagcaaaagaatcatcttcttcaaacatgtcaattcaaaaccaggcaattcctatgccttttgattatgtttctcagcatttaactgttgggaccatacctccttggcagggaccttgtatgaatgaagctggtcccacttacatggaccaacatgagcagaactcagactcggaacacaacaatggttcatgcatctccttgtctgagtcagcaaatattccaaaagtgcctcagcattttggacacaccaccatcacccaatttcatgccttgaataccaatgactttggcaccttcacatatgaaggttataatgtaaacaacaatgtctatgagatggacaacttcaaaacgactactacatgggtggctgaggatgcgcaatacccaattggtgattgtcaaatggtaggaagcaattgggtaaacaacgattttgcatgtaacatgtggaacatggatgaactgtggcagtttagcaagttacaaaaataagattttagggttttgttttttttggaataaccaaaagtccaaaactctttctttgatgacgttattattgttatcatgaactgtggattagctaccgaattaattaatacagatggcgattgttttctgtacatctgtcttgtattactctgttcagataagtacttttgtaatttgtattgattgagaaaagtcattaattagtcactagtacaaaacacaaacagttggaaattgagtgctaataaagaattcgtaaatatatagaagtaaacacttttagaaactttggtgcatttgtaggggaaatcggaatgccgaatgcagccactatgatatctaaatgaagagggcccgtgattgaatgaggatgcaattgaagcca

SEQ ID NO: 1562 - DNA, 1425 bp, Glycine max var. Williams 82
aaaatgttttataaaaatataagcccttctttacatcactgcaaatgaattggacactgtgttagcatttgacagaggaactatgggcaatgaagctgggtttgaagcttctgcaagaaagggcaaaagttggatcgttctggtggccatatataagtaatcttccagaaacatacaccgtgcctattttcttttccggggaggacataaagaacttgcactatgctcctattcttcatcaggtaaacaaaaggtgtcgatttcttcttgattttgagcgagaagtcaagcgtactttggtaagtcttacacaagataagcatccttttggtggtcaagaagtagatgcatcttctcttggatgggcaatgtcagcagtatcatctagagcgtttcgattgtatggtgaaaaggatcccaatgggatacgcattgacataccaatgatgctccccctaattgatatgtgcaatcatagtttcaatccgaatgctagaattgttcaagaacaagataccagtaactcaaggatgcaagtgaaggttgtggccgagacagcaatcaaagaagatgatcctctgttactttgctatggatgtttaaacaatgatcttttccttcttgattatggatttgtgatgcactcaaacccttatgattgtattgagctcaaatatgatggtgctcttttggatgctgcaagcacggcagctggagtttcttcaccaaacttctcagcacctgttccatggcaggaactgatcttatctcagctgaatctagctggagaaactgcagatctcaaggtgagcttaggtggtcaagaaacagtagaggcccgcttgttggctgcattgagggtacttctttcaagtaatgtggaaactgtgcagaagtatgacctcagcacactccagtctttagatgccgaggctcctctaggtgttgcaaatgagatagctgtgtttcgcaccctaattgctttgtgtgtcattgcactgggacactttcccaccaaaataatggatgatgaatcactgttgaagcagggtgcttcaggttcaaccgagttagctattcagtacagaatccaaaagaaatctgtgattatagacgtaatgagaaatatctcaaggaggttaaagcttctatcatcaaaggaaacagcaaccgcagaaggctaagttatagttaacaattagtaattatttgcttgctgtcatgaatctccttccttcgacattttattctccatcttactggagagtataattttgattgaaattacctgtgttttcaccatttggcaatcttctattgaactataaacagtgatatattttttttcagttggtcattatgaaaacttcataatttaacttgtataactcgtattattttcataatttattctcggaattttat

SEQ ID NO: 1563 - DNA, 2945 bp, Glycine max var. Williams 82
ttcgagtcaattttttttggagaaagaagtaaaaagaaaggagataatatatgtatatataacaaatactgtgattcgtaataataataaaaaaaagaaaaagaaaaataaagtgggttaggaattaggagttgggagtatcgttgttgtagcggcatgttgcagggttctgcagcggcggagggttgctgagttgaagaagaagaagaagaaatcaggcattggtattggtgagagagtgagagagaagatgctgaatggaagtagacgatacccttctttccttcaatcgcatgctccgaaagcaccctcccccacccattttcgtattcgacaagcttctgggagccattgtaaggatgggtcattaccccaccgccatttccctcttctcccaacttcactcaaagggaatcaccccttccatcgccactctcaccatcttgatcaattgctactgccaccaggctcacctctctttcgccttctctcttctgggaaccattctcaagatggggtttcagcccaacatggtcactttcaacactctcatcaacggtttctgcatcaatggtatggtctctaaagctatggcctttcgcctcgaccttatggcaaaagggtatcctttggatgagttctcatatggctctttgatcaatggcctgtgtaaaaatggacaaactagagatgcccttcaattgctgcaaaagatggaagaggatttggttcggcctaatctcattacctatagcacagtcattgatgggctgtgcaaagatagacttatagccgatgccctccgtttgttttctctggtcacttcaagggggattttggttgatgttgtcgcctacaattctctcatccatggctgttgtagtgtcggtcaatggcgagaagcaactcgattgctaactatgatggtgcgggggaacatcaacccagatgattatacctttaacatattggttgatgcgttgtgtaaagaaggaaggattgtggaagctcaaggcgtgttcgctgtgatgatgaaaagaggcgagaagcctgacattgttacttacaatgccttgatggaagggttttgtttaagcaataatgttagtgaggcaagagaactattcaacaggatggtcaaaagaggcttggaacctgatgtcttgaattataatgtcttgattaatggttattgcaagattgacatggtagatgaagccatggttctctttaaagagatacgttgtaaaaatttagtccctaatcttgctacttataattctcttattgatggcttatgcaaattggggagaatgtcatgtgtgcaggagcttgttgatgaaatgtgtgataggggccaatcccctgatatagtcacttacaacatttttttagatgctttttgcaaaagcaaaccttatgagaaggcaatctcattatttcgacaaattgtccaaggaatttggcctgatttttacatgtatgatgtgattgtagaaaatttctgcaaaggtgaaaaattaaagattgcagaagaagctcttcaacatcttttgatacatggctgttgtccaaatgtccgaacgtataccattatgatcaatgccctttgtaaagactgctcttttgatgaagctatgaccttgctttcaaaaatggatgacaatgattgcccccctgatgctgtcacttttgaaacaattattggtgctctccaagaaagaaatgagactgataaggcagagaaacttcgtctggaaatgattgaaagaggtcttgtaaacgatgaagcaagggttgtcaaaagcggtgctatagcagggtagtggcccctggctgctatatgcactgccaaagcttcccaaaatcctgagaatggcctccaatattagcattagagggccattttatggaggtaattttgggtaaaatagggtttcagcttgaggaaaaccctttcaaagttcataactatcatgtctcactcatctcctctcctaccttgtgaatactacactaatcctgtccgaccctccaacgaccattgtgtgaccctttggttggtgcatgaacagtgagggaatctgtgactcatccaattgcatacagcaagaagtgcaagtcaagatttgtatgtggtagtccagactgtgaatgctgtagcaatcaatttgtgctagaagaatgcagattttcaatatttctatgcaatacagttggttggtgttaacagcggtctacactgctcttttcttccctgccagtgctggcttttagtctgcttgacctttcctaccctgcatttttcctttcctataagccaattactttatttctggtccttggagattgtgaagaatcagtgcatagccttgtggaatttgccagatacatgtgagaagaaatcgttgttttaatatgcttgtcacaatgattgatggagcaatatcggtggaataaaaaaggactacttatggtattcattgatttggaaaaggtacaatagagtgccaagagaggtattgcaaaaagtgctaaataaggaagaagttcctactacctatatttgagaaatcaagaatatctacgatagggtggcaactagtttgagaacaagggaaggggagacgatagattttccaaattccatcaagggccatctatgaacccctatatatatatataaatttttttttacctcggtcttaatgtgcttgttatgtatatccaagtgttggtgtcacgatgcatgcagtatagatatataggcatgtgtcaataacaatagaagaagctccaattaagagagtagatcagatggaggatagtcctatcactaatccatcgattgttttaagtgtaaataggtagaaagaaaatagaaaaaatacgatggaaatattaatttttctatttgtttgagaagagtaacaagtgtttttttt

SEQ ID NO: 1564 - DNA, 1338 bp, Glycine max var. Williams 82
atgcgtgagattcttcacattcagggagggcaatgcgggaaccaaataggaacaaagttctgggaagtggtgtgtgatgagcatgggattgataccacagggcagtacgtaggcaactccgaacttcagcttgaaagagtgaatgtttattacaatgagggaagcaatggacgttacgtgccacgggcagtgctgatggaccttgagcctggcaccatggatgctgcccgcaccggcccttatggccagattttccggccggacaactttgttttcggtcagtcgggcgccggaaacaactttgcaaagggccattacactgagggtgctgagcttattgactccgtccttgatgttgttaggaaggaggttgagaattgtgactgcttgcaaggatttcaagtgtgccactccttgggtgggggaacgggttctggaatgggaactctgctgatttcgaagatcagagaggaataccctgatcgaatgatgctcacattctctgtgtttccatctccaaaggtgtcagacacggttgttgagccttataatgctacactttctgttcaccagttggtggagaatgctgatgagtgtatggtccttgataatgaagcgctatatgacatctgcttcaggaccctcaagctcgctacgcctagctttggagacttgaatcatttgatatcagcaacaatgagtggagttacttgttgcttaagattcccgggtcagctcaactcagacttaaggaagctagcagtgaacttgatcccatttccaagactccactttttcatggtgggttttgctcccctaacttctcgaggatcacagaactaccgcgcactttctgtcccggaactgacacaacagatgtgggatgccaagaacatgatgtgtgcagctgatccacgccacggtcgttacttgacagcctcagcagtgttcagaggcaaaatgagcacaaaagaggtggatgaacagatgttaagcgtgcagaacaagaactcttcctactttgttgagtggattcccaacaatgtcaagtctagcgtctgtgacatccctcccagaggcctttccatggcttcaacttttgtcggtaactcaacttctatacaggagatgttcagaagagtgagtgagcagttcacagccatgttcagaaggaaagccttcttgcactggtacacgggagaaggaatggatgagatggagtttactgaagcagagagtaacatgaatgatcttgtagctgagtatcaacagtaccaggatgcggcggctgatgaagatggtgattctgaagaagaagatgagggtgctgagagctga

SEQ ID NO: 1565 - DNA, 1569 bp, Glycine max var. Williams 82
tgcagtgacagttgaaaaaagagttaattttgcccctcatccaagccagaatatgcgtgagattcttcacattcagggagggcaatgcgggaaccaaataggaacaaagttctgggaagtggtgtgtgatgagcatgggattgataccacagggcagtacgtaggcaactccgaacttcagcttgaaagagtgaatgtttattacaatgagggaagcaatggacgttacgtgccacgggcagtgctgatggaccttgagcctggcaccatggatgctgcccgcaccggcccttatggccagattttccggccggacaactttgttttcggtcagtcgggcgccggaaacaactttgcaaagggccattacactgagggtgctgagcttattgactccgtccttgatgttgttaggaaggaggttgagaattgtgactgcttgcaaggatttcaagtgtgccactccttgggtgggggaacgggttctggaatgggaactctgctgatttcgaagatcagagaggaataccctgatcgaatgatgctcacattctctgtgtttccatctccaaaggtgtcagacacggttgttgagccttataatgctacactttctgttcaccagttggtggagaatgctgatgagtgtatggtccttgataatgaagcgctatatgacatctgcttcaggaccctcaagctcgctacgcctagctttggagacttgaatcatttgatatcagcaacaatgagtggagttacttgttgcttaagattcccgggtcagctcaactcagacttaaggaagctagcagtgaacttgatcccatttccaagactccactttttcatggtgggttttgctcccctaacttctcgaggatcacagaactaccgcgcactttctgtcccggaactgacacaacagatgtgggatgccaagaacatgatgtgtgcagctgatccacgccacggtcgttacttgacagcctcagcagtgttcagaggcaaaatgagcacaaaagaggtggatgaacagatgttaagcgtgcagaacaagaactcttcctactttgttgagtggattcccaacaatgtcaagtctagcgtctgtgacatccctcccagaggcctttccatggcttcaacttttgtcggtaactcaacttctatacaggagatgttcagaagagtgagtgagcagttcacagccatgttcagaaggaaagccttcttgcactggtacacgggagaaggaatggatgagatggagtttactgaagcagagagtaacatgaatgatcttgtagctgagtatcaacagtaccaggatgcggcggctgatgaagatggtgattctgaagaagaagatgagggtgctgagagctgaagatgttcgatcaaattgatgcttcgcatgttacaagcagtatctaatcgataatgttgagttctttggcttgctgaaggttatgtttagctgcagtggttgcagttctatgtttctttaacctttatagaagggtaccccttcaataacagtttcctttcttgatattttcatttaca

SEQ ID NO: 1566 - DNA, 1812 bp, Glycine max var. Williams 82
atgataacgttaaccgacttttaccatgtgatgaccgcaatggtgccactgtacgtggccatgatactcgcctacggctccgtgaaatggtggaaaatcttctccccggaccaatgctctggcatcaaccggttcgttgctctgtttgcggtccctctgctctcgttccacttcatagcctccaacaacccctacgaaatgaacttccggttcatcgccgccgacacgctccagaagatgatcgtgttggttgtcctgggcatctgggcgaacgtgagcaagagagggtgcttggagtggaccataacgctgttctccatctccaccctcccaaacacgcttgtgatgggaatccccttgctcaaaggcatgtacggcgagttctcggggagtctgatggtccaaattgtggtcctccagtgcatcatctggtacaccttgatgctcttcatgttcgagtacagaggcgccagattgttgatctctgagcagttcccagacactgccggtaccattgtctccatccatgtcgactctgatgtcatgtctcttgacggacgacagcaccctctggaaaccgatgcccaaatcaaagaggacggcaagctccacgtcactgtcagaaaatccaacgcttccagatccgacatcttttctagaaggtcccagggcttctcttccaccacccctcgcccttccaatctcaccaatgctgagatttactctcttcagtcctctcgaaaccctactccacgtggctccagtttcaaccacaccgatttctactccatgatggctgctggtcgtaattctaactttggtgccaacgatgtttatggcctttctgcttccagaggaccaactcccagaccttccaattacgacgaggatgcttctaataataacaatgggaagccgaggtaccactaccctgctgctggaacaggaacaggaacaggaacaggaacgggaacgggaacagggcactaccctgctcctaaccctggcatgttctctcccactgcttctaaaaacgtcgccaagaagccagacgatccaaataaggaccttcatatgttcgtttggagttcaagtgcttccccggtttcggatgtgtttggtggtggacatgaatatgatcataaagaactcaagttaactgtatctccaggaaaagtggagggtaatattaatagagacactcaagaggagtaccagccagagaaagatgaatttagttttggaaacagagggattgaggatgagcatgaaggtgagaaagttggaaacggaaatccaaaaacaatgcctccagcaagtgtaatgacgaggcttattttgatcatggtgtggaggaaacttatcagaaaccccaacacctactccagcctaatcggcctaacttggtcactcatttcattcaggtggaacgtaaaaatgccagccataattgccaagtctatttcgatattgtcagatgcagggcttgggatggccatgtttagtcttggtctgttcatggctttgcaaccgaggatcatagcatgtggaaattccacagcagctttttctatggccgtgagattccttacaggtccagctgtcatggcagctgcttccattgctgttggactcaaaggcgttctcttgcacgttgctattgttcaggcagctcttcctcaaggaattgtcccatttgtctttgccaaggaatacaatgtacatcctgatattctcagtacgggtgttatttttgggatgttgattgcattgcccattacgctcgtgtactacatcttgctggggttatga

SEQ ID NO: 1567 - DNA, 561 bp, Glycine max var. Williams 82
atggtagatccagctactgaattggtgccaccaccatcttcacccaccaattcatccatttcctcctctgatcttgacaccgagtctacgggatcctttttccatgacagaagcaccacactgggcactcttatgggtgtcagcttcccagctattaccttcagagcctccgacccccatccaaattccgccaccgccaccgccaccgctgctgccggaggccctcgtagggctgcgggctccaagaagaagagggcgatcgcggtggcggagaggcggaggaggtggtggtggctgtgcagggacggtgacgcgaggccggcttcgctcggtgagtttctcgaggtggaacggcgctgcggggacggcgccttttacggcacggcggcggaactcgaaggaatggtgatggacccgcagagtagccatggccgggctttgttttccgacgggagggttcttccgccggctggcgttgatgacgatgcgtcgacggcggggagtctttgtcgtagattcccggttttgctcaccgggatctgtagcggcggtgctggataa

SEQ ID NO: 1568 - DNA, 2385 bp, Glycine max var. Williams 82
atggcgaggccagaaaggacagcaggtagaaataaaagtttagagactctaatggactcggacaaaccaggaatcggaagaaatgtgaaccaacttaagattcagaagtccattccagggtatggccttgaattcagtaacctctcctatagtatcataaagaagcagaaaaaggatggagtttggatcaacaaagaatcatatcttcttcatgatatctctggccaggcaattaaaggtgaagttatggcaatcatgggacctagtggtgctggcaagtccacctttcttgatgcattggccggtcgaattgcaaaagggagtctagaaggatcagttagaattgatggaaaaccagttactacaagctacatgaaaatggtgtcatcatatgtgatgcaagatgaccagctcttccctatgctgacagtttttgagacatttatgtttgcagctgaagttaggcttcctccttccatttccaggagtgaaaagaagaagagggtctatgagctccttgaccaattgggcttacagagtgctacacatacctatattggtgacgaagggagaagaggagtgtcaggaggggaacgacgaagggtgtctattggcatagacatcattcataagccatcacttctgttccttgacgaacctacttcaggccttgattctacaagtgcttacagtgttgtagaaaaggttaaagacatagctcgaggaggaagcattgtccttatgaccatacaccagccttcatttagaattcaaatgctcctggaccagatcaccgtccttgcaaggggaagactgatatacatgggaaaggcagatgaagttcaggctcacatgtcaagatttggaaggcctgtacctgatggagaaaacagtattgagtatctcctagatgttatcagtgaatatgatcaagcaacggttgggcttgatccccttgtccaattccaacgtgatggcctcaaacctcacccggcagccatgacgccggttccaagaacaccttacaaaaggaacacacctgcatccaaacacatgattagcctacgcagccaaggatttactgccggaacacaacagcctgattctgcggacgacgaagacgacgacgatgctgaggattttgataactcccttgaaaggaaaagtgctccaacaccaaggaatatgactagtggtgttcaccaacgtttggcttctcagttctaccaagatttctcggccaaagatttctctgtctggctttaccatggggtagtaggaaccccacgtcgccaaccatcatggactccagcaagaactccaggatggacacctgggaaaacacccatgtcaggaccaacaagtgcagtttccaaccaatattctgcagctccttttgtggttggccagtctatggactactccgcaacttcatatgaaggatttgagattgaggaagtgcttgatgagccaaactttggatccaagtatgcaaacccatggttgcgtgaggttgcagtgctctcatggcgaacagcactcaatgtaattcgcaccccagaactcttcctctcccgtgagattgtgttagctgttatggcacttatcctgtccagcatttttggaaatctgagtcatccttttttcgaagacatcaataggctcctcaatttctacatctttgcagtgtgccttgttttcttttcttccaatgatgcagtcccatcttttatcatggagaggttcatcttcataagggagacttcacataatgcttaccgtgcttcttcatatgtcatttcttccctcattgtttacctcccattttttgccgttcaaggcttcacatttgctgtcataaccaaaaagatgctccacttgagaagcagcctattgtatttctggctaatactttatgcctcgcttattactaccaatgcatatgtgatgcttgttagtgcacttgtgcctagttacatcacagggtatgcagtagtcatagccacaacagcactcttctttttgacctgtggtttcttcctcaagcgaactcagatacccttttactggatgtggcttcactatatttctgcaatcaaatatccatttgaggcattgctcacaaatgaattcaataacctcaactgctacacaggaaatttagcagaattatcccatggaccattaggagacctgaagctcagcaaacaccataactccagtctgcccgctaactgtttattagggaaagatatcttgtcctcgatggatattacaatggataacatatggtatgacatcttaatcctgctagcttgggatgttctttacaggttcttcttctatttggttttgagattttactccaagaatgagaggaaatga

SEQ ID NO: 1569 - DNA, 2385 bp, Glycine max var. Williams 82; identical to SEQ ID NO: 1568

SEQ ID NO: 1570 - DNA, 915 bp, Glycine max var. Williams 82
atgaatgacctattctcaaactcattcaagaaatacagcaacctgaagcagcaggcacacctcgatgacgtagaggccgggaaagaaaccgtgaacctcgacaaattcttcgaggacgtggagaacgtgaaagaagaaatgagaacggtcgagaagctacacagaaaactgcaggaggcgaacgaagagagtaaagtggtgcacaatgcaaaaacaatgaaggagctccgggcgaggatggacaaggacgtggagcaggtccttaagcgcgtgaaagtaatcaaggggaaattagaggccttggagcgttccaacgccgccaacagaaacatccctggctgcggtccgggttcctcggcggacagaaccagaacctcggttgttagtggattggggaagaagctgaaggacatgatggacgatttccaaggtctgagaacaaggatgcagatggagtacaaggagaccgtggagcgaagatattttacgataaccggagagaagcccgataaggagactatagagaacttgatatggagtggggagagtgagagttttctgcagagggcgattcaggagcaggggaagggacaaataatggacacaatttcggagattcaggagcggcacgacgcggtgaaggagattgaaaagaatttgattgagttgcaccaagtgttcttggacatggcggctctggtggagtcgcaggggcagcagctaaataatatagagagccacgtggcgcatgcgagttccttcgtgagacgcggcacggatcagcttcaggatgctagagagtatcagaagagttcgaggaagtggacgtgctatgcaatcattcttggccttgtgcttcttcttgtgctcttgtttccaatcttgattaaccttttgcctcatttgttaaggtga

SEQ ID NO: 1571 - DNA, 1461 bp, Glycine max var. Williams 82
atggaccgacccgccgccatattttccgacaccgtcaacctcaacggcacggtgacgcagctgtctctgctcgccgacgggaggctgtggtggccggagggcggtcaacgcaatttgagcatcgagaaagaggttctcgggttcaccggcgacggtcccgatataaggctcaaaacaatcgtggaaaccgaagatggatgctgtggcggtgcaagcagagcaaaactagtccgaaacgacgtcgtttttcggccatcgtccgaggaaacgcataggctctggtgccagaagcttggcgaattcatcgattctctcggacgacccaagaggctttttgtttttgttaatccattcggggggacgaaatctgctgtcattgtttttcgtgatcaagtcaagcctctgcttgaagacgcacaagtgcagcttacagtccaagaaactaagcatcagctccacgcaaagcaagttgttcagtcattagatttttcaaagtacgatgggattgtttgtgttagtggagatgggatcttggtcgaggttgtaaatggactgcttcagaggcaggactgggacactgcaattaagatgccccttggagtagttcctgcaggtacgggaaatggcatggcaaagtctcttcttgattcagttggtgatccttgtacagtacccaatgctgttcttgccatcatacgaggccgtaagcgaaaacttgatgtggccaccatcacacaaggggagaccagatttttcagtgtgttgatgcttgcatggggtctggttgctgatattgatatcgagtctgaaaagtataggtggatgggaagtgctcgtattgatttttatgctctcactcgaatcttgcatttgaggcattacattggatgtctttattttgtgcctgcacctggatttgaagcttacggggaccccactagttaccctggaagttctaataacaaaggcagcaatagtgaactaattgatgaggaacctttgaagttacaaaggctaggctatcaaggacctgaaattgacctggagaatcagagttggagagttttaaatggaccatttatttctgtctggcttcacaatgtggcttggggtgctgaaaacaccaaggcagcaccagatgcaaagttctcagatggttatctggacttgatcattacgaagaattgcccaaagttaccattgctgtcgttgatgtcagatttgaataatggaggtcatgtaaaatcaccatatgtcatgtatttaaaggtgaaagttttggtcttggaacctggtccacgcttgggggaccaagagaaggaagggatcatagatgcagatggtgaggttctggcaagggggaaagggtcgtaccaatgtgagcagaaggctttgatggcctatgataaacttcaaataacagtagatcaaggtttagctactattttttctccaatataa

SEQ ID NO: 1572 - DNA, 468 bp, Glycine max var. Williams 82
atggcgttagggtttgagggttatagttatacaacaacacttggaaggaaaagggttgtgttattacacagtgaagcttcttctctcaactccaattcaccggtgaattcattgaagagaatgtgtagcaagaaattcacatttgactctgaaaggtctcgccttgaggcccttcctcttgatgttctgataagggtgttgtgtggtgtcgatcatgaagatttgaagcaacttgttcgagtctcaaaaactgttagagaagcggctgaggttgctaggaggatgcattttgagtatagcactccaaagaagaaaaattttgctattcctaaaccgtttgatatagagggtgctggtgggtttgaggaaattgatactccaaaagccccatcgaagaaagctaagtcaaagctgattggtaagaatctagcaagcatctcagtggcattgtttgcttcccctaattag

SEQ ID NO: 1573 - DNA, 1560 bp, Glycine max var. Williams 82
atgcctgcggtaggaggtattagcaacggagggggcaaggagtaccctggaagcctcactccttttgtgacggtaacatgtatagttgcagccatgggtgggttaatcttcggttacgatatcggaatttcaggtggggtgacatccatggatccgtttctgctcaagtttttcccgtcggtgttccggaagaagaattccgacaaaacggtgaaccagtactgtcaatacgacagccagacactgacgatgttcacgtcgtcgctgtatctcgccgcgttgctgtcgtcgttggttgcctccaccgtcacacgtaggttcggccgaaaactctccatgcttttcggaggcttgcttttcctcgtcggtgcccttatcaacggttttgcccaacacgtgtggatgctcatcgtgggtcggatcttgctcgggttcggtatcgggtttgccaatcagtctgtgccactctacctatctgaaatggctccatacaaatatagaggagcattgaacattggctttcaattgtcaatcacagttggtatcctcgtggccaatgtgttgaactacttctttgctaaaatccatggtggctggggatggagattgagtttgggaggtgctatggtccctgcccttataatcacaataggatcactagtccttccggacactcccaattccatgattgaaaggggtgatcgtgaaaaggccaaggctcagcttcggagagttcgcggcatcgacgatgtggaagaagagttcaatgaccttgttgcagctagtgaatcctccagaaaagtggagcacccgtggaggaacttgttgcaaagaaagtacagaccccacctcaccatggctgtgctgattccattcttccagcaactcactggaatcaatgtcatcatgttttacgcgccggtgttgttcagctccatcgggtttaaggatgattctgctctaatgtcagctgtgatcactggcgttgttaatgttgtggcaacttgcgtctcaatttatggtgttgacaagtggggtaggagagcccttttccttgaaggtggagttcaaatggtcatttgccaggctgtagttgcagctgctataggagcaaagtttggaattgatggaaaccctggtgatttgccaaaatggtatgcagttgttgtggttctcttcatttgcatttacgtatcagcatttgcctggtcatggggtcccctaggttggttggtgcctagtgagatctttcccttggagatccgttcggctgctcaaagtataaatgtgtcggtgaacatgtttttcactttcttgattgcacaagtcttcttgacaatgctttgccacatgaagttcggcttgttcatcttctttgcctttttcgtgttgatcatgacattcttcatctacttcttcttgcctgaaaccaagggcattcccattgaagaaatgaaccaggtttggaaggcacaccccttctggtccagattcgtggagaatgatgattatggcaatggtgttgagatggggaggggaactgctatcaaagaagtgtag

SEQ ID NO: 1574 - DNA, 441 bp, Glycine max var. Williams 82
atggcaaatgggggaagctgggagttgaagatagaggaagaagaagaagaggagggtggtgagtttggtggtgttctgaggatgtgggagggtgaagttcttgattgttttgatgatcatcgaatagctctcgaatccacatgttgtccttgctaccgatttgggaaaaacatgaagagagctgatttcggttcttgctacattcagggagcaatttattttcttcttgctattggtgcctttcttaacttcattgcctttgctgtcacgagacgtcactgttatctatacctgattgttgcctttggagcatatttaggattcttccggacacgtataagaaagaaattcaacatcataggaagtgatagctctatggacgattgcgtttaccatttcgcctgtccttgttgtacattatgtcagtcttcaagaacttga

SEQ ID NO: 1575 - DNA, 2733 bp, Glycine max var. Williams 82
atgcatgatgcatctacccgtaaggaaaagattcctaagtttaggcttggtcagataagagcagttaggcggctgcaatcttgttcttcatctttggtatttattactgactcacttttcatcatttttttcatttccaaaacacctcatctctgtaatctcaacaaggacacgggcatgaccaccaaacgccaacatgcaattcttctgctcctcttattcttctgttctcacactttgttctctcatgcagccgattccatcacagaggacacagtaatcagagacaacgatggtggtgacaatttggtgtccaaagacctcacctttgaaatgggtttcttcggtttggataataataactcttcaagatacgttgggatttggtaccacgagattccggtcaaaacattcatatgggttgcaaacagagaaaaacccatcaaaggaagagaaggttcgatcctaatacaaaaaagcaacggcaacttgattgttctcgatggagagaacaacgaggtgtggtcaacaaacatgtcagttccaaggaacaacacaaaggctgttcttcgtgacgatggaaacctcgttctctcagaacacgacaaggatgtttggcaaagctttgaggacccagttgatacatttgtgccgggtatggcacttccagtgagtgctggaacgaacatattcaggtcatggaaatcagaaacggatccttcaccgggaaactactcaatgaaggttgactctgaggggtcaacgaaacagattttgattttggagggagagaagagaagaaagtggagaagtggttattgggatggtagagttttcactggtgtctccgatgtgacaggaagctctctatttggctttacagtcatcacagacactaaaggagaggaatattttacatacaaatggaatagccctgaaaaagtgaggtttcagataacttgggatgggtttgagaagaagttcgtgttggatgcagatgggaaacaatggaataggacacagtttgagccttttgatgactgtgagaagtataacttttgtggtagttttgcagtgtgtgatacgggtaattctcctttttgtagttgcatggaagggtttgagccaatgcattgggaggagtggaataataggaattggacaagggggtgtgggaggaggactccactgaaggctgaggctgagagaagtgctaataatagttcttctggagctgatcgtgaggtgagtgttggagaagatggtttcttggagcaaaggtgtaccaagtttccggatttcgcacggttggagaattttgttggtgatgcggattgtcagaggtattgtctgcagaatacttcttgtactgcttattcatatactattggaatcgggtgcatgatttggtatggagagttagttgatgttcaacactctcaaaataatcttggaagtttactccacatccgtcttgccgatgctgatttaggcgatggggggaaaaagaccaaaatttggataatattagctgttgtggtagggctgatctgcattggaatcgttgtattgctggtatggaggtttaagagaaaacctaaagcagtttcctcagcttctggtttcaacaacaatagcgaaataccagcctttgatctaacgaggagtacagacttatcagaaatttcaggtgagttaggcttggaagggaatcaactaagtggagcagaacttccattgttccattttagctgcattctagcagcaacaaacaatttctcggacgaaaataagcttggacaagggggatttggtcctgtctacaaggggaaaattccagggggagaggaagtagctgtcaagaggctttcaagaaagtctagccaaggtttagaggagttcaagaatgaaatggtgctcatagccaaactgcaacatagaaatctggttagactattggggtgttgcattcaaggggaagaaaagatactggtatatgagtacttgccaaacaaaagcttggactgctttttatttgatccggtgaagcaaacacaactagattgggcaaaacgctttgaaataatcgagggcattgcaagagggctactttatctgcaccgggattctagacttagaataattcatcgtgatttaaaagcaagcaacattttgttggatgaaagcatgaatccaaaaatttcagactttggcttggccagaatatttgggggaaaccaaaatgaagccaacacaaacagagtggttggtacatatggttatatgtccccagaatatgcaatggaaggtctgttttcaatcaaatctgatgtctatagttttggtgtattgctacttgagattatgagtggccgcaagaacacaagctttcgtgacacagatgactcaagtctcattggatatgcctggcacctttggagtgagcagagagtaatggagcttgttgatccttcccttggtgattcaattcctaagactaaagcgttgaggttcatacaaatagggatgttatgcgtgcaagattcagcatctcgtagaccaaacatgtcatctgtgttgttgatgctgggaagtgaatcaacagctctacctttgcctaagcaacctttgctcactacttccatgaggatacttgatgatggagaatcttatagcgaaggccttgatgtgtcaaatgatttgacagtttcaatggtgacaacagggagatag

SEQ ID NO: 1576 - DNA, 3278 bp, Glycine max var. Williams 82
atgcatgatgcatctacccgtaaggaaaagattcctaagtttaggcttggtcagataagagcagttaggcggctgcaatcttgttcttcatctttggtatttattactgactcacttttcatcatttttttcatttccaaaacacctcatctctgtaatctcaacaaggacacgggcatgaccaccaaacgccaacatgcaattcttctgctcctcttattcttctgttctcacactttgttctctcatgcagccgattccatcacagaggacacagtaatcagagacaacgatggtggtgacaatttggtgtccaaagacctcacctttgaaatgggtttcttcggtttggataataataactcttcaagatacgttgggatttggtaccacgagattccggtcaaaacattcatatgggttgcaaacagagaaaaacccatcaaaggaagagaaggttcgatcctaatacaaaaaagcaacggcaacttgattgttctcgatggagagaacaacgaggtgtggtcaacaaacatgtcagttccaaggaacaacacaaaggctgttcttcgtgacgatggaaacctcgttctctcagaacacgacaaggatgtttggcaaagctttgaggacccagttgatacatttgtgccgggtatggcacttccagtgagtgctggaacgaacatattcaggtcatggaaatcagaaacggatccttcaccgggaaactactcaatgaaggttgactctgaggggtcaacgaaacagattttgattttggagggagagaagagaagaaagtggagaagtggttattgggatggtagagttttcactggtgtctccgatgtgacaggaagctctctatttggctttacagtcatcacagacactaaaggagaggaatattttacatacaaatggaatagccctgaaaaagtgaggtttcagataacttgggatgggtttgagaagaagttcgtgttggatgcagatgggaaacaatggaataggacacagtttgagccttttgatgactgtgagaagtataacttttgtggtagttttgcagtgtgtgatacgggtaattctcctttttgtagttgcatggaagggtttgagccaatgcattgggaggagtggaataataggaattggacaagggggtgtgggaggaggactccactgaaggctgaggctgagagaagtgctaataatagttcttctggagctgatcgtgaggtgagtgttggagaagatggtttcttggagcaaaggtgtaccaagtttccggatttcgcacggttggagaattttgttggtgatgcggattgtcagaggtattgtctgcagaatacttcttgtactgcttattcatatactattggaatcgggtgcatgatttggtatggagagttagttgatgttcaacactctcaaaataatcttggaagtttactccacatccgtcttgccgatgctgatttaggcgatggggggaaaaagaccaaaatttggataatattagctgttgtggtagggctgatctgcattggaatcgttgtattgctggtatggaggtttaagagaaaacctaaagcagtttcctcagcttctggtttcaacaacaatagcgaaataccagcctttgatctaacgaggagtacagacttatcagaaatttcaggtgagttaggcttggaagggaatcaactaagtggagcagaacttccattgttccattttagctgcattctagcagcaacaaacaatttctcggacgaaaataagcttggacaagggggatttggtcctgtctacaaggggaaaattccagggggagaggaagtagctgtcaagaggctttcaagaaagtctagccaaggtttagaggagttcaagaatgaaatggtgctcatagccaaactgcaacatagaaatctggttagactattggggtgttgcattcaaggggaagaaaagatactggtatatgagtacttgccaaacaaaagcttggactgctttttatttgatccggtgaagcaaacacaactagattgggcaaaacgctttgaaataatcgagggcattgcaagagggctactttatctgcaccgggattctagacttagaataattcatcgtgatttaaaagcaagcaacattttgttggatgaaagcatgaatccaaaaatttcagactttggcttggccagaatatttgggggaaaccaaaatgaagccaacacaaacagagtggttggtacatatggttatatgtccccagaatatgcaatggaaggtctgttttcaatcaaatctgatgtctatagttttggtgtattgctacttgagattatgagtggccgcaagaacacaagctttcgtgacacagatgactcaagtctcattggatatgcctggcacctttggagtgagcagagagtaatggagcttgttgatccttcccttggtgattcaattcctaagactaaagcgttgaggttcatacaaatagggatgttatgcgtgcaagattcagcatctcgtagaccaaacatgtcatctgtgttgttgatgctgggaagtgaatcaacagctctacctttgcctaagcaacctttgctcactacttccatgaggatacttgatgatggagaatcttatagcgaaggccttgatgtgtcaaatgatttgacagtttcaatggtgacaacagggagatagaagtgttaattacattttttggtttttcccattctgtttagctttgtttagactcttttcaatctacataagttcacagcaaaaagttttccttttaattttacctcccatttgaaacaagcctcttaatattgagtctattgtatatactataatttataaaccaaaatatcttttgagagtccaaaaaagtgccttgattcctggtcattgaaagaattcttctaggttgaaggttctcatgtgaggagatcattggaaaagtagcggaatctgtggttagcagttgcattttgattagttttttgaggcgtgattttgatatactatcatgtataaagttgtatattgttcacaattattatattcttgggagagcatcttcatttttaaatgtctctttgttgaactcttgtatgactagtttcgtacatgtctccaaatggcatttgtattttgatttttttattctttctagacatagttttgatatactaccatgtataaagttgtatattgttgacagattattatattgttggaaa

SEQ ID NO: 1577 - DNA, 774 bp, Glycine max var. Williams 82
atgtttgataattccataatccctaggatagtagttcagcaatctggtttctttcaagtattcacttgggataaccaaaagagtgaatggaaaaggtactggtctgaaccaacaaatcagtgtgataactatggaacctgtggatcaaacggtaactgtgactctttgaactttgaggactttaggtgcacttgtctacctggttttgagcctaaatttccacatgattggtatgagaacagagatggatcaggagggtgtgtgaggaagccaggagtatccctttgtgggaatggagaaggctttgccaaagttgaaggcttgaagattcctgatacctctgtggcaattcccacaaggggtttgagtttggaagagtgtgagaaggaatgcttgagaaattgttcttgccctgcatattcagttcttgaggtgaggaatggtgggagtgggtgcttggcatggcatgggaatttgatagacatacaaaaacttagtgatcaaggccaagatttatttgtccgtgttgatgttgttgaactagcccttgttctgaggtgcattcaaattggtctattgtgtgtgcaagaaaatgccatcaatagaccatccatgttagaagttgttttcatgctaggcaatgaaacaactcttcccccacccaaaaagccagcatttttattcaatgagaaccaagatttgcctgagtcatcaacatcaggaggaggatcttcaatcaatgaagtaacaactactatcatcagtgctcgctaa

SEQ ID NO: 1578 - DNA, 1848 bp, Glycine max var. Williams 82
atgtgtacgtgcagcgaaatgggtttccaaataaaaaggagtattgtgatcgagagattcttgtgtggcttgttactgggtgtcttaatggtaggtcacggtactgacactgatgtattctgtttaagttccattaaggaatccttggaagacccgcatgattacttttccagttggaagttcaacgacgtaaacatatgtgtatttgttggtgttgaatgctggcaacatggggagaataaagtgctaaatctcaacctcacaaacatgggtctgaagggtgagtttccacgaggccttaggggttgctcttcgttggtaggcttagacctttcacacaacgagctcacaggacccatcccatctgatatatccacattactcccttatgctacttccattgacctctcaaataacaagtttaatggggaaattccaccaagtttggctaactgcagttacctgaattctcttagacttgataacaacatgttaagcggtcatatcccacaagaacttgggcagcttcaaaggattagaaacatttcttttgccaacaataatttatcagggccgttgcctttgttccgggatggcgtgactagtgctgaagcttatgcgaataatacccaactttgtggagggcctttgccaccctgctcaagcgatgatttccctcaatcattcaaggatggccttgttgttggctatgctttttcgctgacttcttcaattttcctttatatgttcctctgtaaaccttggcatcagtcaaagcataaaagaaacaacaaccactggaataaggttaaagaaatcggcaaatatatttgttccatctcagggaggaagacaccttctgaagctgaccccacacaccaatttcaagctctgcagttgcaggataaagctatgaaagagatctctctagtaatggaaagaatgaagtccacgatgagtttgaccgaaatcaaagatgcaacagactgcttttcattagaaaatgccattgggatggggaaaattggaataatgtatgagggaaggctaactgatggttcgaaccttgccattaagaggctttttggttctaaacaatttaagaaggaatttcttttggaaataagaattctgggtaagtacaaacacaaaaatatagttcccctgcttggattctgtgtagaaagaaatgagaggattctggtataccaacacatgccaaatggaaggctttcaaaatggttgcatcctttagaaagtgaagttacaagattgaattggcctcagaggatcaaaatagctcttggggtagcaagaggcttatcctggctccattatacctgcaatttgcatgttgtgcatcgtaatataagttcggagtgtgtcttgctagacaagaattttgaacccaaaatatccaattttggaaaggccaagtttatgaatcccaacattgaggatggtgcaagcacgatattttatgcaagtgatgggaagaaggatgtctatgattttggtagtttgatttttgagctaatcacagggaaaacatttaacgagttgtcgcgttcatcatacaatgctactaacctgtctggcaacccatcgaatttttatgatgcaattgaggaatctctcattggggaaggttttgaaaatgaggtctacactctcatcaaagttgcatgtaagtgtgttaagcctttcccagatgaaagaccaacgatgcttgaagtttataactatatgatcgatatatggggagagcgacatagaataagtgatggttctgacacactcaacgtatctagttcttctactagtgtagatgaaattgttgagctataa

SEQ ID NO: 1579 - DNA, 2001 bp, Glycine max var. Williams 82
atggcttggtggcgcaatagtcttcaaaatccaactcttcttttctgttatgcaacaagaaccattttcatcctccaaataatccctcttgcaaactcactatcatttgattacccgaactttaagaatggtgatgtaaaatgggaaggtgatgcttctattctaaaaggagccatccaagtcacatccaacaccatggaccaaaataacaattacagtgttgggagagtcacaagttataagaaaatgctcctctgggatatgaacactggaaagcttgctgatttcactactaaattttcctttgttgttttttcagggaaaagttactatggagatggaatggcatttttccttgctgatcctaatctcccacttctgaagaatattagagaaggaggtggtcttggccttgtggatggcaaacaagtgctgaattcaactcaaccatttgtagcagtggagtttgacaccttccacaataaatgggaccctcaaggtggcactcatgtaggtctgaatttcaactctatgaggtctaacataactaagcaatggttgacagatattcaaatatggaatgtttataattgcagcattgagtacaactcaagcactcttaatttgagcgtttcgttcactacgtacaataatgttagtaaaccagttgaggaatacatatcttacaaggttgatttgagagattacttgccggggaaggttattcttggtttctcagccgcaactggaaaattgtatgaggtgcatacactgagatcatggtcatttaattcaagtctacagagtgatgagaacacaaatgagataaaaccagtagcagcaccaccaacttcaaatcctgattctgaaaatgaacacaagataggattgtgggtggggattggaattggtgtaggcttggttctgggtcttttagggctgatttgtgctttattgtggaaaaggagtagagagaaaaaaggagagttagtttttgatctcaatatggctgacgaattcccaaagggcactggacctaagagcttttgctataatgagctagtaagtgctacaaacaaatttgcagagaagctggggcaaggaggttttggtggtgtgtataaaggttacttgaaagacttaaagtcctatgttgctatcaagaggatatcaaaagagtctagacagggaatgaaggaatatgtgactgaagtgaaggtcataagccaattgagacatagaaatttagtacaactcattggttggtgtcataggaagaatgactttctcctcatatatgagttcatgccaaatggaagcttagattctcatctatacggtgtgaaaagcttcttaacatggacagtgaggtataacatagctttgggcttggcttcagcattgctttacctacaagaagagtgggagcagtgtgtgattcacagggatattaaatcaagcaacattatgttggattcatgtttcaatgctaaacttggtgattttggtttggctaggctggtggatcatgagaaagggtcgcaaaccacgcgtatagccgggacgaggggctatattgcgcctgaatatttcacttcaggaaaggctactaaggaatctgatatatacagctttggggttgtgttattggagatagccagtggaagaaaacctgttgaactagaagctgaggagggtcaaataactgtagttgagtgggtttggaagctctatggattgggaaggttccttgaagcagctgaccctaagttatgtggagaatttgatgaaaaccaaatggaacgtttagtgattgttggcctttggtgtgttcatccagattattcattcagaccatctataaggcaagtgattcaggtgcttaaatttgagtctgctttacctattctccctgaaatgatgcctgtgccaacctaccttcctccaacaataaaagcacttttttcttctgtttcatcttccttttggggtagaagttag

SEQ ID NO: 1580 - DNA, 2001 bp, Glycine max var. Williams 82; identical to SEQ ID NO: 1579

SEQ ID NO: 1581 - DNA, 375 bp, Glycine max var. Williams 82
atggcctcatgcaaatccttcatcacagctttctttcttcttgcaaccttctcatcaagcatgagtttgagcctagcatcatctcgtcacctcttgcaaacaaccacaacaccaaatttgcccggcatcactcccactttgcctaaccctacaggattgccacctttgccttcaaacccaacactgcctcagggcaatgttcctcctttgcccactatgccaactcttccatcacttccttccatttttccaacactcccttccctcaccctccctccatttccagcctcttcattccccaaaatgccctcaatcccaaacagtatcccgtccttccctttcttctccccaccaccttcaacatctagcccttaa

SEQ ID NO: 1582 - DNA, 411 bp, Glycine max var. Williams 82
atggcttgcaccaccgtcgtgttgacgctagtcgccgcattgttggtaacctccgtcgtggctcagtctccggcgtcctcaccagctctgtctccaaagcgcacccccgtcgccacacctcagaagtctccctcgccggcgatttctccctccgccgtgtcgccgtcgtcctctcctcccgctccggtggtgaacactccgtctccgtcaccaaactcagtcgactctccgccatctcctccgcagtctccgtccgtgtcaccagccggtgttccctccgtcactccttcagcaatctccgctcctcccactggagcaccggctccctctcaaaacggtgccgctttgaacagattcactgttgctggatctgctgctgttgtggttttcgctgcggctttgctcatgtag

SEQ ID NO: 1583 - DNA, 915 bp, Glycine max var. Williams 82
atgaccttaaattacaacattgccctcgccttctctgcggtgctcacgctgctcctctttcccctactgaccgtaggggagctcgtggaggagcagccactagtcctcaagtaccacaacggccagctcctgaagggccgcatcaccgtcaatctcatctggtacggcaccttcaccccgatccaacggtccataatcgtggacttcataaactcgttaagcagcgcgccaaacgcgcctctcccctcgaccgccacgtggtggaaaaccacggagaagtacaaggtgggaggaggatcccctgcgctcgtcgtagggatgcagttcctacacccggcttacacgctagggaaaaatctcaaaggaagagatctcctcgcactcgcgtcaaagttcaacgagattaactcgataacggtggttttaacggcgaaggacgttgccgttgagggcttctgcatgagccgctgtggcacccacggctctacccggaacgttaaaagtaatgcccgaaccgcatatatctgggttggaaactccgaaacacagtgccccgggcaatgcgcgtggccattccaccaaccgatttacgggccccagacgccgccgttagtttctcctaacggcgacgccggggttgacggaatggttattaacttggccacgcttctcgctggcacagttaccaaccctttcaacaacggttacttccagggtcccccaacggcgccgttagaggccgtttcggcttgcactggtgttttcggaagtgggtcgtacccgggttatccgggtcgggttctcgtggataaggcaaccggggcgagttacaatgcgcatggtgcgaatggaaggaggtatctcgtgccagcgatgtgggacccgcagacttcgacatgcaagaccctcgtctga

SEQ ID NO: 1584 - DNA, 867 bp, Glycine max var. Williams 82
atgacaacaacagtctctgcactctccaacaccttcttcatctctcagatttcccagctcgagatttcagcctctggctacccagttgaggaaaacaacctgctacaacatttttcttcaccttccattttcttacccacgtggttttcgtgttttgccattgttgctgggtaccctgcgtttccaacatcattggacatcaataagattcgtgacattctgccgcacaggtttccatttcttctagtggatagagtgattgaacacaatcctggagtttctgcagtggccataaagaatgtgacaataaatgacaacttttttcctgggcattttcctgaaagaccaatcatgcctggtgttctcctggttgaggcaatggcacaggttggtggcttggttatgttgcaacctgaaattggaggttctcgcaataatttcttctttgctggaatagacaaagtgcgatttaggaagccagtgattgcaggagacactttagttatgagaatgacacttatcaaactgcaaaagcgatttggaatagcaaagatggaagggaaggcatatgttggaggtgaagttgtgtgtgagggtgagtttctgatggcaactgggagcgaataattaagacaaacttctccaccaaaaaagaaagagctggttctgctgcatttagtttaaccctagattatttttttactgatgaacatgatcaccaccatttgagtcattcgatctcatgtacttctcaaactcagatttcttgcaaaataattatttatggcagtccaagctacctttgcatgtgtgtttttccatgttgcaactgggtatgataaagctaacagatattttgtgtgaaat

SEQ ID NO: 1585 - DNA, 777 bp, Glycine max var. Williams 82
atggcagctgcaacatctagtgctgtgttaaacgggtttggatctcacttcttgtgtggaggaaagaggagccatgcccttcttgctgctagcattggagggaaagttggtgcttctgttagtcctaaaagagttattgtggcagttgctgctgcaccaaagaagtcatggatccccgctgtaaaaggtggtgggagtttcatagacccagaatggcttgatggctcgctaccaggtgactatggttttgacccactaggactaggaaaggacccggcattcctgaaatggtatagagaagctgaactcattcatgggaggtgggcaatggctgcagttgtaggcatcttcattgggcaggcatggagtggagttccatggtttgaggctggagcagatcctaatgcaattgctcctttctcatttggctctctcttaggtacccagttgctcctaatggggtgggttgagagcaagagatgggtggacttcttcaacccagattctcagtcagtggagtgggccactccatggtcaaaaactgctgagaactttggcaactctactggtgaacaaggctaccctggaggaaaattctttgaccctttgggatttgctggagctatcaaggatggcgtttacattccggatgccgacaagctagagagactgaaattggctgagattaagcatgctaggattgctatgttggctatgctgattttctactttgaggctggccagggcaagacaccccttggtgctcttggcttgtaa

SEQ ID NO: 1586 - DNA, 1090 bp, Glycine max var. Williams 82
ataagaacagagtgtgttttttgcaaagaaaactccaaactcaagtaggctatactaaggtgaaaaaggagagatggcagctgcaacatctagtgctgtgttaaacgggtttggatctcacttcttgtgtggaggaaagaggagccatgcccttcttgctgctagcattggagggaaagttggtgcttctgttagtcctaaaagagttattgtggcagttgctgctgcaccaaagaagtcatggatccccgctgtaaaaggtggtgggagtttcatagacccagaatggcttgatggctcgctaccaggtgactatggttttgacccactaggactaggaaaggacccggcattcctgaaatggtatagagaagctgaactcattcatgggaggtgggcaatggctgcagttgtaggcatcttcattgggcaggcatggagtggagttccatggtttgaggctggagcagatcctaatgcaattgctcctttctcatttggctctctcttaggtacccagttgctcctaatggggtgggttgagagcaagagatgggtggacttcttcaacccagattctcagtcagtggagtgggccactccatggtcaaaaactgctgagaactttggcaactctactggtgaacaaggctaccctggaggaaaattctttgaccctttgggatttgctggagctatcaaggatggcgtttacattccggatgccgacaagctagagagactgaaattggctgagattaagcatgctaggattgctatgttggctatgctgattttctactttgaggctggccagggcaagacaccccttggtgctcttggcttgtaagcaaaataatgtacactagggagacaacttgaatcattgtcctgtacagccagatttctcccttgagaagtttcaaattttatgctctaatcttggatgcattcaccttgtatctgcattatacatttataatatcgacaactcgtataaatacttgcatctatatttcatttccaaaaccagatggagtgaaagggacagtgatagttgaaaattgcaagttgggccatgttaattgta

SEQ ID NO: 1587 - DNA, 1458 bp, Glycine max var. Williams 82
atggtaggaagtgttgatgttctagctcatgattccagcattaatggaacaatgaaacagtggcctgaagatttcagttccatgacgattatgagagatcatgtgacactcacaattggagagaatggcattggcaatggggttgttcagaatggtacagaaaatggagaaagaaagatagtgcttggaagaaatattcacaccacgtgccttgaagtcactgagcctgatatagatgatgaggttactggggaaagggaagcttatatggcaggcgtgttggctaaatacaaaaaatctctgactgaaaggaccaactatcatttaggatacccctataatttgaattttgactatgatgcactctctcagcttcagcatttttccatcaacaacctgggggatcccttcattgaaagcaattatggtgtccactctaggcagtttgaggttggtgttttggactggttcgcgcggttgtgggaactcgagaaagatgagtattggggctatataacaaactgtggcacagaaggcaatctccatggcatcctagtggggagagaggttttccctgatgggattttatatgcctcacaggaatcacattattctgttttcaaagctgctagaatgtacagaatggaatgtgtgaagattaacactctttggtctggtgagattgattgtgatgattttaaggccaagcttctttgtcacaaggacaagccagcaattgtgaatgtgaacataggtacaactgtgaagggagcagtggatgaccttgatctggtaataaagaaactagaagaggcaggattttcacaagacaggttctatatccattgtgatggggctttgtttggtctcatgctgccttttgtcaaacgtgctccaaaaatttcattcaagaaaccaattggtagtgtgagtgtctcaggccacaaattcgtggggtgccccatgccctgtggcgtgcagataacacggttggagcacgtcaacgctctttccagaaacgtcgaatacctggcttcaagggacgccacaatcatgggaagcaggaacgggcacgcccccatattcctctggtacagcctcaacatgaaaggctacagaggcttccagaaagaggtgcaaaagtgtttgaggaatgcacactacttcaaagatcgccttgtggatgctggcattggagcgatgctgaatgagctcagcagcaccgttgtgtttgagaggcctcacgatgaagggtttgtgcacaagtggcagcttgcgtgccaaggaaacgttgcacatgttgtggtgatgcctaatgtcaccattgagaaacttgatgattttctcaatgagcttgtgcagaagcgtgctgtgtggtttagagatgggaactgtcaaccctattgtatagcttctgatgtaggacaggaaaattgcctctgtgctctgcacaggtaa

SEQ ID NO: 1588 - DNA, 720 bp, Glycine max var. Williams 82
atggcgtcgtcgaaggttgtctcgacgaatccggatctgccacgaaactcttcttcgtcgtcgtcttcttcatcaacttctcctatatctcccctttcttctcttctctccgatctgcacccaatggacgacattctcaagtccatcagccccaagtcggtcgacgacgtctggaatgacatcgttaccggcgccaccgtccacgacgccgtctctgccaccactaccgacaatgccgacgccgccatgaccctcgaggatttcctcaccaaggccataagagaggaagacgtcagaggggctcctcctcctcctcctcctcctcctccttcttcctttctccccttccctgccgatggctcttcctcctccgttgagcctttcgccaatggcgttagtgccgcgccgtcgaattcggttcagaaagggaagagaagagccgtggaggaaccggttgacaaggcaacgcttcagaagcagaggaggatgatcaagaatagagagtctgctgctaggtccagggaacgcaagcaggcttacacatctgagcttgagtatctggttcaccagctagagcaagagaatgtgcagttattaaatgaagaggctgagatgagaaggcagaggaaaaagcagcttttcgagtgcatcattccaattgaggtgatgcctaaaccgaagaaaaaacttcgaagagtaaattcagcacaatcattgtga

SEQ ID NO: 1589 - DNA, 999 bp, Glycine max var. Williams 82
atgtcaaagttaagcattctcttcctcctagtcttatccttcagttctgtactctcagaactatgcaacccacaagacaaacaagccctactccaaatcaagaaagatcttggaaacccaaccactctctcctcatggcttctaaccactgattgctgcaacagaacatggctaggtgtttcatgcgacaccgacacccaaacataccgcgtcaacgacctcgacctctccgatcttaacctccccaaaccctactctattcctccctccatagccaaccttccctacttgaattttctttccattagcaggaccccaaccctaatcggtcaaatcccctcagccatcgctaaactcacccaactccgttatctttatatcacccacaccaatgtctccggccctataccagatttcttgtctcaaatcaaaaccttagtcaccctcgatttctcctacaacaccctctccggcaaactccccgcctcgctctcttcgctgcccaatctcgtcggaatcaccttcgacggcaaccaaatctccggcgccatcccggactcgtacggctcattctcgaagcttttcacgtcgatgacgatctcccgcaaccgcctcacagggaagattccggcgacgttcgcgaatctgaacctggcgttcgtggacttgtctcggaacatgctggagggtgatgcgtcggtgttgtttgggacggagaaaaacacgcagaagatacttctggcgaagaacatgcttgcttttgatctggggaaagtaggcttgtctaagaacttgaacggcttggatcttaggaacaaccgtatttatgggacgctacctcagggacttacggcgcttaagtttctgcacagttttaatgtgagcttcaatgatctttgtggtgagattccgcagggtgggaacatgcaacgttttgacgtatcttcttatgccaataacaagtgtttgtgtggctctcctcttccaccatgcacttaa

SEQ ID NO: 1590 - DNA, 432 bp, Glycine max var. Williams 82
atggctacacctttgaacgagacaagggaaccagaatggaagaaagcgtggacagctgggaacactttgctatctgcacctcctcttccactactcgccatagttggcatcgtggtgttcttgctatgggtttcatcacaattaaacaccaactactcatccatgcaaatagccacaaccaacgtgaacttgttcctcttgtttttgcttcttgtgttgaccctcatagcccaaggaacacgcctcgtgcttcctgcagcaccaagcgtgacaagtttgtatgatgcagatgtggagtcatcggagtcatcatcaatgccatggggatggattgtctctgccttgatgcttttggttctgatatccaaccgacttcaccctatctttgtaattgcaacagtggttgtttatgtgtattttttatcagcgtaa

SEQ ID NO: 1591 - DNA, 1854 bp, Glycine max var. Williams 82
atggagatacaaccagcagcagatttggatgaagaagatatttcagcagtttcatcacgactgctatcattatcatcaccatcatcattcctgttaccgtaccaaactgatgacagtaatcagaatttcacgcgcattgatcgtaaattatacgttgctgcgatgaaaggcgacttccaagaactctccaatgaacagaatttggagagtctgctcaccccaaacaaaaacaccgtccttcatatacacttgacttctacaacaagtcaaacagtttcagaagaatttgtgactaagattcttaaggagtgtggatgtctagttctactccctaacgccaagagagaaacagtccttcacatcgctgcaaggtatggacactccaatatcgctaaattattgcttgaacatgtcaaagcttttccaccttcagatattgagaaaggtattggagcagaaaagaagtttatgagggccacaaataatgagaaggacactgcattgcatgaggctgtgcgctatcatcacattgaagtagtgaagaccttgttagaaatggatcctgattactcctatgatgcaaataatgccgatgagactccgctttatctggcatcacaacgacaaaatcagcaagtggtggctgagatattaaacaaaatgaaatcaccggcatatggtggccccaataatagaacagcattgcatgctgctgtgattaaccaagatatagtaatggcaagagatcttgtgaagaataaacatgtgagaaaggctgtgaaacatgcggacaaggaaggttggattcctcttcattatgctgtgaaaacagggaatttaggtttgacgaagttgctgcttgcacaagatgggaacacagcatacatgcaagataatgagggcatgacagctcttcacatcgctgcttatgatggtgattggcttattatgaacatgataatagaatactatccagattgttctgagatagtggataaaaaaggcttgaatgttcttcattatgctgtcaatggggggagtggaactacagtggatataatcatggagaacctatcgctaagcaacctttacagtgagaaagactttgatggaaacacacccattcatcacctcaccaattccaaccttatgtgtgagagttttgtatttcaccgcagagttgacaagctggccgtcaacaaggaagctcaaacagctcttgatgttgcctattgtaagattgaagattcagatcaatcagattttagtagcatatcgataacagaggaccaaataaggttattaaaatcggctagatcaaaacaaagtcagcgactagatcaaaaatcaaagaacgggcaagaaaagactcaaagggtagtgttaactaaggaagcaaaggagactcatcttttagtggccacactcattgcaaccgtaagttttgcagctgggattactgtaccaggaggtaccatacaagatggtgaaaataaaggtagcccagttttggtgcaaagtagttttttcaaagcattcatggtatcaaacaccatatcaatggttctggccgctactgcagtttctatatatcttttcacgccagtgactagaaataaaaggaaggaaaatgctttctctaaaacagccctcgtattcactttgatcgccttagcagcaatgatcattgcattcattacaggcacgtatgtcgtattggaatcatcccgagtaattgctgttgcaattttccttattgggttatcctcttttatgttagcatactatgtagtggccttttggcatgggtatggcaagccacttccgccaacttgtggtatctatcttaagtag

SEQ ID NO: 1592 - DNA, 1584 bp, Glycine max var. Williams 82
atggtgtcaccaatctcacttattgtcctcttgttatcagtttctttagcagattcagcttcagttcaagaaagttttgtccaatgtctcaacttgaattcggacaaaacatttccattttactcatcaatctacactgcaagcaacccttcattcaccagcatccttgactcctccgcacagaacctaaggcttttggtgccttcagtgccaaaacccgagttcatattcacaccctctcgtgattcccatgttcaagcagcagtaatctgctccaagaaacttgggattcacattagagtgcgaagtggcggccatgactatgagggaatttcgtacgtctccgaaattgagagccccttcatagttgtggatttggtcaagctccgcggcatcgacgttgatgtaaaaagcaacactgcttgggttcaagctggtgccacaactggtgaagtttactacagaatatatgagaagagttcagttcatggtttccctgcaggcctttgcacaagcttaggcattggagggcatatcacaggaggagcatatggagccatgatgagaaaatatggccttggagttgataatgtcttagatgctaaaattgttgatgccaatggaagaattcttgatagagaagccatgggggaagacttattttgggctataagaggaggtggaggtggaagctttggaatccttctttggtggaagataaagcttgtttctgtgccaccaactgtgacagtttttacagttaccaaaacccttgagcaaggtgcaaccaagattcttcacaaatggcaagaagtggcaccttatattgatgaaaacctcttcatcagagtcatcattcagccatctagtgatgcaagaaacaagactcagagaaccatcgcaacttcttacaatgctctcttccttggtggggccagaacactcctccaagtcatgaagacaagttttcctgaattggggttgacaataaaggattgcttggaaactagttggatcaaatctgtgctctatattgcaggctttccaagtgacacccccccagaagttctgctcaaaggaaagtcaacattcaagaacttcttcaaggcaaaatcagattttgtgagggaaccgataccggaaaccgggctcgaggggttgtggcaaaggttgctggttgaagacagccccttgatgatttggaacccatatggtggaaggatgagccagttttcagaatctgagaccccatttcctcacagaaatggaacactatacaaaattcagtacttgtctttgtggcaagagggagacaagaatgctgcaaagcacatagattggattaggaagctttacaactacatgggtccttatgtttctagcttgccaagggaagcatatgtgaattaccgggatcttgatttggggataaacaccaagaacagcacaagttacattcaagcaagtgcttggggttataggtattacaagaacaactttgacaggttggtgaagattaagaccaaagtggatcctgaaaacgtgtttaggcacgagcagagtatcccaccacttccactctga

SEQ ID NO: 1593 - DNA, 1116 bp, Glycine max var. Williams 82
atgtctgttgaacctaaggaactttactaccaggaccttgtcctagaccacaatatcattaataatcagcatcagggcacagaagcaggatctaatactactatgtacgaaaagcacttttcctctaccttaattccttcagtttcagcagcatatgattcatcacaagcctttgatccctcttacatgagtttcactgactgtttgcaaggaagcatggactacaactcacttgcaacttcttttggcctttctccttcctcatctgaggttttttcttctgttgaagggaaccaaaagccagcagaaggaggaggagatggtggtggtggtggtggtggtagtggtggcagtgaaacccttgcgacccttaactcttctatctcttcttcatcttctgaagccggggctgaggaagattcaggaaagagcaaaaaagaaaggcaagtgaaaactgaagaaggaggagaaaactctaagaaagggaacaaggagaagaagaaaggagagaagaagcaaaaggagccaaggtttgccttcatgaccaagagtgaggttgatcaccttgaagatggatacagatggagaaaatatggacaaaaagctgtcaagaatagcccttacccaaggagctactacaggtgcactacacagaagtgcacagtgaagaaacgcgtggagaggtcatttcaggacccaaccactgtgataacaacgtatgaaggtcaacacaaccatccggtccccacttctctcagagggaatgcggccgcaggaatgttcacaccctcttctttgctagccacaccaactcatccactcgcagccgggtcaaacttcccgcaagatctcttccttcacatgcattaccctcgtcaccaccaccaatatcatcacattcacaacaacctcttcgccacacaatccatgacaaatgctactactgctactactacaaccaccactgctaccatcgctccgtcctcgttttactcttcctataacaacattaacaactctcttcttaacaaccagtttcttcctccagaatacggcctccttcaagacatagtcccttccatgttacacaacaagtcccatcataaccagaattaa

SEQ ID NO: 1594 - DNA, 792 bp, Glycine max var. Williams 82
atggcagcagcttcttccatggctctctcatccccatccttggctggcaaggccgtgaagctgggcccatcagccccagaagtgggaagggtgagcatgaggaagaccgtcaccaagcaggtctcctcaggaagcccatggtacggcccagaccgagtcaagtacttgggcccattctctggcgagcccccgtcctacctaaccggtgagttcccaggcgactacggctgggacactgctgggctttccgcagacccagaaaccttcgccaagaaccgtgaactcgaagtgatccactccaggtgggccatgctcggagccttgggctgcgtcttcccggagttgctgtcccgcaacggggtgaagttcggagaagccgtgtggttcaaggccgggtcccagatcttcagcgagggtgggctcgactacttgggcaacccaagcctgatccacgcccagagcatcctcgccatctgggccacacaagttatcctaatgggtgccgttgaaggttaccgtattgctggtggccccctcggtgaggtcactgacccaatctacccaggtggcagcttcgacccattgggccttgctgatgacccagaggcttttgctgagcttaaggtgaaggaactcaagaacggacgattggccatgttctctatgtttggcttctttgttcaggccattgtcaccggaaagggtccattggagaacctcgccgatcaccttgctgaccctgtcaacaacaacgcctgggcctatgccaccaacttcgtccccggaaagtga

SEQ ID NO: 1595 - DNA, 858 bp, Glycine max var. Williams 82
atggcttctgaaggcgaccatcaccaccaccaccaccaccatcaagatcacgatcatcatcatcatgatcatgatcaccatcatcatcacgatggagagggagagaccaactcatgggtaggtaaggatgggaaggtgtaccatagccacgatggtctggcgccgcattctcacgaacccatttactcccccggctacttcaccagaagagctccaccgcttctcaacagaaacttcaacgaaagagccttcaccgtcggaatcggtggacccgtcggtactggcaaaacagctctcatgttggccctttgtgaactcttgcgcgaaaactacagtctcgcagctgtgacaaatgatatattcactaaagaggatggtgagttcttggtgaagcacaaagcacttcctgaggaaaggatacgcgctgtagaaactgggggttgcccacatgctgctattcgggaggacatcagtattaatcttggaccgctggaggagctttctaacctcttcaaagcagatatacttctttgtgaatctgggggagataacctggctgccaatttcagcagggaattggctgactatattatttacataatagacgtgtctggcggtgataaaattcctcggaaaggtggtcctggaatcacgcaagctgatctccttgtgataaacaagactgaccttgctcctgcaattggggctgatttggcagtcatgcagcgggatgctctgcggatgagagatggagggccatttgtctttgcacaggtgaagcataagattggagtagaagaaattgggaatcttgtcttgcaggcatgggaagcagccacagggaataagcgtcattaa

SEQ ID NO: 1596 - DNA, 816 bp, Glycine max var. Williams 82
atgtcggttgcaggtcctcaagtcaagtgcattcataggattttgacctctttgtttcacaatttcaactcgcccatgacatgtcactgcatggcctatgaggaggaacatcactctagtagtcacaaaagcactaataacaaaatttacaaggtaaatcagcagaagacatctgatattgcagtacatggattgctcctgtgggcttcaaccgggtttttaatgcctcttggcatacttatcatcagaggatccattaaagcagaacctggatccagaaggagtatagttctcttctatctccatgttggttttcagatgctttcagtgcttcttgccacagttggagctgctatgtccctgaagaagtttgagaattcatttgataacagccatcaaaaactaggcctagcactttatggtgctatattggtgcaaggcttgattggatttttcagaccacacaggggaaagaaggagagaagttattggtacttactacattggatactagggacaatagtttctcttgtggggatcatcaatatttacactggattaaaagcctaccataagagaaccttaaaaagcacaacactttggactatccttttcactgtggaagtctctttcattggattagtttacctcttgcaagacaaattggaatatatgaaaaagcaaggagtgattattggaagtgagtcgtcaattgtgtcatctaaccaagatattcctcaaagccaaacccaaaaggagttgttgccagttgcatgtggaagaaagagaaatgcacttgagaatttgtttgattaa

SEQ ID NO: 1597 - DNA, 1543 bp, Glycine max var. Williams 82
agagacgctctcttatctccaatctgccattgtgtaatgcgctgtgtgcatttcaattcaatccataaaatcccaaaaacattgacagcaagaccaagtcaaccacctctcccagttgcagacttgagttccatatgatgggaaccgcatgtttcccaactaataacgttgttctcaaacctcaaaacttatctgggaatttctctaccctctgtgataacgttcggtgtctgaggttcctcactcccaaaccgccccacctgcgatcctctcactctaacttgggaaatagagcacagttgacatctttttcgatgtccaaggcaacccaattgaaggtttcgcaagatgcactctcatccacggaacaatcactgtcttcatctcctcgggtaataggagaacatgacttgctcattgtgggtcccggggttcttggtcgtttggttgctcagaaatggcgtcaggaaattccgggtagtcaagtttatggtcagacagtgagcactgatcatcacaatgagttgattcaaatgggtattaacccgtctaagaaatggacagaggctactcacacatttcccaatgtcatttattgtgctccaccttctcgtaccccagactatgctggcaatgtcaggctagctgcattaagctggaatggtgaaggttctttcttatttacatcaagcagtgctccatatgattgtaatgataatggaccatgtgatgaggattctccggttgtgcctatcgggaggagccccggagttgatgtccttctaaaagccgaaaatgtggtactggagtttggtggctgtgttctaagattggcaggactatataaagcagatagaggtgcacacaattactacttggaaaagcgtattgttgatagtcgtcctgatcacgtcctgaatcttatacattatgagtggtgcttatgatggggataaaattggtgctaattttggcatgcttccacaccaggatgcagcttccctctcagttgcaatcttgaagaaaaaattccgtgggcagattttcttgggttgtgataatcatcctttgtctaggcaagaaatgatggatctggttaataaaagtgggaaattcagtaaaaaatttgacgagtttactggaactgatggccctctaggaaagagattaaacaacacaaaaacctgccaggtagttgggtggaagcccaagtaccctagctttattcattttctagagagcagcatgtgacagactcctgactttatcttttgttgttcaatctaattaatttggaaaccacaatagtgaccatgcataggtgccttagggaattcttgctgtacatggagagttcatactcacctgaactcagcagtgtgtacattttcctatttcttcatatctgacattgtcaataaggatgatcagttattgaattgtcttaaaacactgttctgatacactttcatgtacacacttacgagagacttcagttctttttataaataaaatcaattctcttatgagagacttgtacttc

SEQ ID NO: 1598 - DNA, 1509 bp, Glycine max var. Williams 82
atggagatcctttccttcttgtcctactctctcctctacgtttttctctttctcctcttaaagcttcttctccaagccagaaagtttcaaaacctcccaccaggtccaccctctctccccataatcggcaacctccaccacctcaagcgccccctccaccgcaccttcagagccctctccgacaagtacggccacgtcatttccctatggtttggctcccgcctcgtcgtcgtcgtctcctcccaaaccttattccaagaatgcttcaccaaaaacgacgtcgtcctcgccaaccgcccccgcttcctctccggaaaacacatcttctacaactacacaaccttggggtcctccccctatggcgagcactggcgtaacctccgccgcatcaccgccctcgacgtcctctccacccaccgcctccactcttttgccgccatccggagggacgagactcaccgcctcgtccgaaaactcgccgaggctcaagggtcggagtcgtccctctccttcgccgaagtggaactgacgtctaagttttacgacatgacgttcaacaacatcatgaggatgatatccgggaagaggtactacggtgatgattgtgatatggccgatgtggaggaggccaagcagtttagggctatggtttcggagctgctgaagctggctggggcaaataacaagaacgatttcatgccggtgctgaggctgtttgattttgaaaacctggagaagaggctgaagaagattagcaataaaactgatacgttcttgagagggctgcttgaagaaatccgcgccaagaagcagcgtgcaaataccatgctggatcatctcctcagcttgcaggaatcgcagcctgagtactatactgatcagatcatcaaaggccttgctttgggtatgctcattgctgcaactgattcacaagctgtaactttagagtgggcattatcttgtgtgctgaaccatccagaggtgtttaagagggcgagggatgaattggaaacccatgtgggacaagaccatttgttggaggagtctgacctttcaaaactcccttaccttaaaaacattatctatgagacacttcggttgtacactcctgctccattgttgttaccacattcatcttcagaagagtgcattattgggggattcaaagttccaggagacaccatagtgttgatcaatgcttggtccattcatagggaccctaaagtgtggagtgaagccacaagtttcaagcctgaaaggtttgaaaaggaaggtgagttagacaagttgattgcatttgggttgggaagaagggcttgtccaggagaaggcttggctatgcgtgcactctgcttgagtttgggattgttgatccaatgctttgagtggaaacgggttggtgataaagagattgatatgagagaggaaagtggattcactttgtctaggttaatcccattaaaggccatgtgtaaagcacgcccagtcatcaacaggcttgggaaataa

SEQ ID NO: 1599 - DNA, 1557 bp, Glycine max var. Williams 82
atggagatcctttccttcttgtcctactctctcctctacgtttttctctttctcctcttaaagcttcttctccaagccagaaagtttcaaaacctcccaccaggtccaccctctctccccataatcggcaacctccaccacctcaagcgccccctccaccgcaccttcagagccctctccgacaagtacggccacgtcatttccctatggtttggctcccgcctcgtcgtcgtcgtctcctcccaaaccttattccaagaatgcttcaccaaaaacgacgtcgtcctcgccaaccgcccccgcttcctctccggaaaacacatcttctacaactacacaaccttggggtcctccccctatggcgagcactggcgtaacctccgccgcatcaccgccctcgacgtcctctccacccaccgcctccactcttttgccgccatccggagggacgagactcaccgcctcgtccgaaaactcgccgaggctcaagggtcggagtcgtccctctccttcgccgaagtggaactgacgtctaagttttacgacatgacgttcaacaacatcatgaggatgatatccgggaagaggtactacggtgatgattgtgatatggccgatgtggaggaggccaagcagtttagggctatggtttcggagctgctgaagctggctggggcaaataacaagaacgatttcatgccggtgctgaggctgtttgattttgaaaacctggagaagaggctgaagaagattagcaataaaactgatacgttcttgagagggctgcttgaagaaatccgcgccaagaagcagcgtgcaaataccatgctggatcatctcctcagcttgcaggaatcgcagcctgagtactatactgatcagatcatcaaaggccttgctttgggtatgctcattgctgcaactgattcacaagctgtaactttagagtgggcattatcttgtgtgctgaaccatccagaggtgtttaagagggcgagggatgaattggaaacccatgtgggacaagaccatttgttggaggagtctgacctttcaaaactcccttaccttaaaaacattatctatgagacacttcggttgtacactcctgctccattgttgttaccacattcatcttcagaagagtgcattattgggggattcaaagttccaggagacaccatagtgttgatcaatgcttggtccattcatagggaccctaaagtgtggagtgaagccacaagtttcaagcctgaaaggtttgaaaaggaaggtgagttagacaagttgattgcatttgggttgggaagaagggcttgtccaggagaaggcttggctatgcgtgcactctgcttgagtttgggattgttgatccaatgctttgagtggaaacgggttggtgataaagagattgatatgagagaggaaagtggattcactttgtctaggttaatcccattaaaggccatgtgtaaagcacgcccagtcatcaacaggcttgggaaataatttgttttagcttgcacaatagataaacttgtttcaattatatccagg

SEQ ID NO: 1600 - DNA, 3295 bp, Glycine max var. Williams 82
cggaatggtcttccccgtatgttccataaaccctaatagcattcattcattcattcttgttccttcaacactagcaaatgcaatgaagcccctcatgcactatcaacaccaatccccactatgaagaatccaaatccaatccaagttcttttcaccaaaacatgttgctttttgcgcgcaacatcggtggcagggcctcactccgagtaagctcctttcattcctcaccccttcaaaacccttttcctcttttcctcactccttcatccctctcctctcaaaattcaatttttgctcgccccgtgatttggttcaccagctttctgtgtgttataagatacccctttgtctcaaaaccttcttttgatgacattgcttccgaatcaatgcgtagtttcttgcagcaggacggtcctcacttgtctgattcagcattggcacccatttgggtgtctaaggctttggtgaagctgaaaggggaccctaaatcagccctgaagttcttcaaggaggcaggggctcgtgccgggtttcgccatgccgcggagtcttattgcgttttggctcacattttgttttgtggaatgttttatcttgatgccagaagtgtcatcaaagagtggattttgttggggagggagtttccgggttgtgatttctttgatatgttgtggtctactaggaatgtttgtaggcctggttttggagtgtttgatactttgtttaatgttttagtggatttggggatgcttgaggaggctaggcaatgcttttggaagatgaacaagttcagggttctaccaaaagtgaggtcttgtaatgagcttcttcacaggctttcaaaatcaagcaaagggggattggcattaagttttttcaaggatatggttgtggctggcctctcgccctcggtttttacatataatatggtgataggctgtctggccagagaaggggacttagaagctgctaggagtttatttgaagaaatgaaagctaagggtcttaggccagacattgtcacttataattctctcattgatgggtatggaaaggtagggatgctaactggagcagttagtgtatttgaggaaatgaaagatgcaggatgtgaaccagatgtgataacatacaattctcttattaattgcttctgtaaatttgaaagaattcctcaagcttttgagtatctgcatgggatgaagcaaagagggttgcaaccaaatgttgtaacttatagtacactaattgatgcattttgcaaggcaggcatgttactggaagcaaataaattttttgttgacatgatacgtgttggtcttcaacccaacgaatttacgtatacatctctgatcgatgcaaattgtaaaataggtgatctcaacgaagcatttaaactggaaagtgagatgcagcaggctggagttaacttaaatattgtcacctacactgcattactggatggtctttgtgaagatggaagaatgagagaggcagaagaattatttggggcattgttgaaagctggatggactcttaatcaacagatttatacttccctttttcatggatatatcaaggctaagatgatggagaaggccatggatattttagaggaaatgaacaagaaaaacttgaagccagacctgttgctgtatggaactaaaatatggggtctttgcagacaaaatgaaatagaagattctatggctgtaattcgggagatgatggattgtggtctgactgctaatagttacatatatacaacccttatagatgcatattttaaggttgggaaaaccacagaagctgttaatctattacaagagatgcaggatttgggtatcaagataacagtggtaacatatggtgtactaattgatggtttatgcaaaataggtttagttcaacaggctgttagatactttgaccacatgactagaaatggtttgcaacctaatattatgatttacactgctctgattgatggcctttgtaaaaatgattgtcttgaagaagccaagaacctgttcaatgagatgctggataagggaatcagtccagataaattggtttatacttctttgattgatgggaacatgaagcatggaaatcctggagaagctttgagtttgcgaaatagaatggttgaaataggtatggagctagacctgtgtgcttatacttcactgatttggggtttttctcgttatggccaagtacagctggcaaagtcgttgctagatgagatgctcaggaaaggcattattcctgatcaagttctctgtatttgtctattgagaaagtattatgaactaggagacatcaatgaggctctggcacttcatgatgatatggcgaggaggggcctaatttctgggactattgacataacagttccctctgtacacacttgagaggaaaacatgttatacatacttggtctcctgttccttattttggtggcctacaatctagtttacttcattttatgccaaagttcaatagcatcattgaaatgaatttgatgcatcattagataatgacatctggctgttccaattgatgctttctcattctcaaggcacttgaattttttatgatgtaaatcctgcagcttctgggatttgtacatcaataatcatgttctcatttgataatcaagacaaccataatgtgatgttttcctggcttgaaatcaacttggctaatattataactaggaagctcataattatagtgccttactgctgttaccaaattgcacaagctctgtgcttcacagtcaggaactgactttcacagaacagcaaatctttatttggcagatgtagaggagttcagccatagtgggatgcccttttcaccactgggacatgcaagttttattgcatggagattagaatttgatgtgagtttttcattgctaactcaataggcaggaggctgcttctagatgacatggatccaagaggtctagagctagaaatttgtgaatcattccaatgggtggaaagtttcaggcttatcttgttctctccctaatcttgtagctaacaaagacaaacagtctaaaagatcaggtgtatatttatttattgattgattgatttgggcaataaaatgtttaggggagagaagaggttgtctcatttcaaggttactagattcaaggatgatttactgttgtactagcaaaataacttactgatataagatcaccagcattctcaggtgttttgaccagcctttgtatcacaaagaataaacaactaaatgggacaatgtgccaaaa

SEQ ID NO: 1601 - DNA, 1482 bp, Glycine max var. Williams 82
atggtttttccaaaacccgcttctgagtctgatctctttcttcattccaactttgcttctcgttatgccagggactctcttcccaggttcagcatacccgaggactccatgccaaaggaggctgcgtatcagaacatacacgatgagttgcagcttgatgcaattccaaagctgaacttggcttcctttgtgacaacttccatggaagaagagtgcaacaagctcatcatggaatcgataaacaagaactatgtcgacatggacgaatatcctatcaccactgaccttcacaatcggtgcgtgaacatgatagcacgtttattccatgctgaaattggagaaaatgagattgcaactggagcaggaaccgttggatcatctgaggccataatgctggcagggcttgcattcaagaagaagtggcagaacaagcgcaaggaagagggaaagccttatgataagccaaatttggtgactggttccaacgtgcaggtatgttgggagaaatttgcgaggtattttgaagtggagttgagagaagtggaggtgagggaaggctactatgtgatggaccctgccaaagcagttgaaatggttgatgagaacactatttgtgtggctgcaatcttgggttcaacttacaatggagagttcgaagatgtcaagctcctaaatgacctattgctagaaaaaaacaagcaaactggatgggatacacctattcatgtggatgctgcaagtggtggctttattgctccattcctttatccagagttagaatgggattttagactcccattggtgaagagcataaatgttagtggccacaagtatgggcttgtttatgctggcattggttgggttatttggaggaccaaggatgacttaccagaagaccttgtcttccatattaattaccttggagctgaccaacccaccttcaccctcaatttctctaaaggttctagccagatcattgctcaatattatcagctaattcgtcttggccaagaggggtaccgaagcataatggagaactgcagagaaaatgcaatggtgctgaaggaagatttggagaaaagtggtcactttaacattctctcaaaagacgatggtgttcctgtggtggcattttctctcaaagacagaagccggtacgatgagttcaagatatcagagatgttgcgccgccacggttggatcgtgccggcgtatccaatgccacctgctgctcaacacatcaatgtgctccgtgtggtcatcagggctgagttttcacgcacccttgctgaacgccttgcgtttgacatacacaatgtgatggatgaacttgaaaagttgcatccccccatagtgaccaaaaacacaaaggaagagaacaaggccatggttgaaaatggggtgaagaacactgcattggatgcacacagggaaatcattgctcaagaatccaacaagcgtcagaaaatcatggcagcttag

SEQ ID NO: 1602 - DNA, 1071 bp, Glycine max var. Williams 82
atggaagtaacagctgctccagtgccttatgtccaagaaattgcaaaggaggcattgaccatagtgcctgagcgttatgttcgaccagttcatgaacgtcctatattatctaactctacacctttacctgaaattcctgtcattgacttgagcaaattgttgtctcaagaccacaaggagcatgaactcgacaggcttcactatgcatgcaaagaatggggtttctttcagctaattaatcacggagtggactcttcattggtggaaaaagtgaagagaggtgctcaaggattattcgatcttccaatggaagagaagaaaaagtttgggcagagagaaggagaagctgagggatatggtcaactcttcgtggtttcagaggaacagaagttagagtgggcagatttgtttttcatgttcactttgccaccaaacaagaggaaaccccacttattccccaaccttcccctgccattcaggggtgatttagacgcctattgtgaagaattaagaaaacttgcaatccagatccttgaccagatggccaattctcttgcaatagacccaatggaaataagagagttatttggtgaagcagaacaatcaatgaggatgaattattatccaccatgtccccaaccagagcttgtgatgggactcaatcctcattctgatggtggaggcctcaccatccttctccaagccaatgaagtggaaggtcttcaaataagaaaagatggactgtggattccagttaaaccccttcccaatgctttcatcataaaccttggtgacatgttggaggtgatgagtaatggaatctaccaaagcatagagcacagggcaacagttaactcagagaaagagagactttccatagccacattttatagcactgctatagatgcaattatatgtccagcaccaagccttgtaactccaaaaacaccagcaatgttcaaaccaatcagcgcgggagattacttcaaaggataccttgcacaagaacttcgcgggaaatctttccttgacaccataagaattcatgctgaaaatgagaatagctcttag

SEQ ID NO: 1603 - DNA, 1992 bp, Glycine max var. Williams 82
atggataatgataataatgttcatgtgaggttcttattctttacatcactattctttttcttaacagcatccattagtgctcaaaataacaacaccaaacacgaagagtgtagccagccatacagctgcggacagtattccatatactaccctttctggggagggatcagacccaattattgtgccagcaatgaccaattgaagctccaatgcgagggtaatcaaaacaccaccattcaacttggttcacaaagtttccaagtgcttcactttgatgatccagtgcattacaccttgaccatggttcgaacaggcctcatctatgatcattgttcttcctcggccttaaccaacacttccttcaactcgagtctctttcgttactcgcaaaatgttaccaacatcaccatcttctatggttgtcctagctccgtgtttgcgaataggaattactcttttccatgcaaggaagatcacaatatgagtgctttctatggggaccccgaaactgcaagagttcaagactgtgaaggacctaggattgaagtgcaagtatcaaaggaacctgtgcttggtgaaggaattgaagggctgaacaaagctttgagtgaagggttcagagtgcatcttatttcagaggctcaagttcaacagtgcttagaatgcgttgtaagtaatggaacatgtggggctaatgatgagtctcagtttacatgtttttgccaggatggaactgaaggtttagattgttctgatcatcatagtaataaatggaattgggaaaggaaggttggtataggcgtttctgctgctgtgctcggggcaattgtagtcagcattggcttttatatctgtagtcgtcagaagaagaagaaaaatcttcatgcagtatcatcatctgtacaatctaaagaaacctcttatagttcttctatagaagatactgagaagggatgcacatactttggagtccatttcttcacttatagtgaacttgaagaggccaccaacttctttgatcctgccagagaactaggagatggaggatttggaactgtgtattttggcaaacttcacgatggacgtgtagttgcagtgaagagaatgtacgagaacagttatagaagagtggagcaattcgtgaatgaagtagagatcctaacaggcctacaccaccaaaacctcgtgtcactgtacggatgcacatctcgacacagcagagaacttctgctcgtatacgaatacattccaaatggaaccgttgctgatcacctccacggccaaagagcgaaacctggcacacttgcttggcacacaagaatgaacattgccatagagactgctagtgcactggtgtatctccacgcctctgaaatcatccacagggacgtgaaaacgaataacattctcctcgacaatcacttcagtgtgaaagtagcggattttggcctctcgcgtctcttgccaacgcacgccacacacgtttccaccgcgccacaagggactccaggttatgtggatcctgagtacaatgagtattaccaactcactgataagagtgatgtttatagctttggagttgtgttgattgagctcatatcatcgatgcctgcggttgatatctcgaggcgtaggcatgagataaacctgtccaatatggccattaagaagatacaaagtggggcattgcatgagattgtggacactactcttgggtttgagacggatttcaaggtgaggaaaatgatcagtgctgtggctgagttggcctttcagtgcttgcagagttcaaaagatgtgaggccctctatggcagaagtgttggataggctagaggatattagaagtgatgggagtcataggagcaagcatgaggtgctagatatatcagaagatgatgctgctttgctcaagaatgtgcctcctccaccttcacctgattcacatttggtgaccatttctaattctacaccaccaaatgatagccagtga

SEQ ID NO: 1604 - DNA, 543 bp, Glycine max var. Williams 82
atgagcttcacattcaacctccatgttcccaaagctctgcctcctcttccctcttcatcacgtggaacaacttctctcttcttttcttcaaagcagaaatcataccacaacaacactagtccttgccaatcactacttataacatgcagaagccacaaaccaaattatgatgataccagcctaaagtatacaagtttggcactgcaagtaggagcactcttggccttgttgagtgtagcagtgactggagagaataaccggccagaactcatctgggttttgacccaatggggggttgttctctttggatatttccttgtcgtgccaccaataatcttttactggctttggaaaagatggtacagaagaaacttgctggagatgtatttacaattcatgtgtgtcttcattttcttcccagggaaattccctcgggacacttccttgcagtacccttggtctgtacctgaagatccttcaaaaattagaagttcatacgcaaagtacccatatgccgaacctgaagattatgataatctatga

SEQ ID NO: 1605 - DNA, 336 bp, Glycine max var. Williams 82
atgacgagtggaccaaagatagtgcacatcgaaacacggtacgtggaaaccgatgccataaacttcagagatgtggttcagcacctcacagggaagaactcgtcaacaacaaattgggacgtaggaaatggtgccttattctcatccctgccaggttcttcagattacaacaaaagaggaattgcaaatggtggtgtcagtgccaagccacacaccaccactaatggtaaaaagaatagtgttgcatcttccatgctactcatgaacgtgtccttcaaagactttgaggatttgttgtctgatatgcctcccatggaggagttgctcaagttgtag

SEQ ID NO: 1606 - DNA, 1713 bp, Glycine max var. Williams 82
atggaaggaggagtacctgacgccgatatctctgccttcagagaatgcctctccctctcatggaagaatccctatgtccttcgcctcgctttctcagctggaatcggtggccttctttttggctatgacaccggagtgatatctggagctcttttgtatataagggatgaattcccagctgtagataggaagacttggcttcaggaatctatagtgagtacagcaattgctggagcaataataggtgctgcagtgggtggatggatgaacgaccgatttggaagaagaaaatcaatccttgtagctgatgtcctctttatagttgggtcagcagtaatggctgcagcacctgtccctgctgttctcatcataggtcgagtttttgttggccttggtgttggaatggcttcaatggcatctcctctctacatttctgaggcttcccccaccaaagttcggggagcccttgtagctctcaacagtttcctcatcactggtggacaatttctctcctacctcatcaacttggctttcacaaaggcgccgggtacatggaggtggatgcttggagtggctgctgcacctgctataatacaagtggtgttaatgttcacgctcccagaatcaccacgttggctgttccgacggggaaaggaggaggaagcaaaagcaatattaaggaaaatttatcaagccaatgaagttgaggaagaaatccaagctttgcatgattcagttgctatggaactgaagcaagcagaatcctcagataacatgaacataatcaaactgtttaaaacgaaggctgtgaggagaggtttggtggcaggaatggggcttcaaatcttccagcaattcacgggcatcaacactgtcatgtactacagtcccacaattgttcagttagctggttatgcatccaaccagacggcattgctcctctccctcatcacttctgggcttaacgctttcggttcggtcgttagcatctacttcattgacaagactgggagaaagaaacttgctttgcttagtttgtgtggctgtgttgtagccttgacccttttaactttcactttccgccacaccgcaactcattctccaatgattagtgcgcttgagaccgttcatttcaacaacacctgccccggtttcggccacgctgtcaatgctaatcaatgggattgcatgatgtgtctcaaggcagaatgtggctattgtgcatccggtgtctctagcaagagcttaccaggggcatgtttgatttctaatgatgcaacaaagggtatgtgtcaaaaagaacatagagcatggtacacacagggatgtcctagcaaaattgggtggcttgcaatagtgggacttgcactgtacatcatattcttctcaccagggatgggaactgttccatgggttgtcaattctgaaatctatcctctgaggtaccgtggggtatgtggaggaattgcttctacaacttgttgggtttcaaacctcattgtttcccagtccttcttgactttgaccgtggctattgggacagcatggacattcatgttgtttggatttgttgctctcattggcatcttcttcgttctcattttcgtgccagaaaccaagggagttccaatggaagaagttgagcaaatgctggaggaaagagctgtgcacttgaagttttgggagaaggcgagtcctccccagaagggttga

SEQ ID NO: 1607 - DNA, 273 bp, Glycine max var. Williams 82
atggcaaattctcgcattgctaggttcttcatggaagtagcaccaccacagtatgttactgtgatgaggcacagaacatcgaagatgttggacactattactgaagatgagagggagattagtaccaatgattctgtcatgttacctcctaaaaccaaatcaacagtggcagttgcagcttcttcagcttcatctgctgcttctgttaccaatgttaaggggaggcattttcttaaggaagttcatagatccctttcaattttgaatcagtga

SEQ ID NO: 1608 - DNA, 900 bp, Glycine max var. Williams 82
atgggttctctggcccgaccaaactcactcttttttcgaaccaaaggacccggacgtgcccggaaagtaccaagtcaggttttggcttttcagcgttccaattcaaatggttcatttccctcatcagaacagctagaacttgaagcaagccagaagaacatggaagcacctgttgttgtagtcactggagcctccagaggcattggccgtgcaattgcactttccttgggtaaagccccatgcaaggtgttggtcaactatgccaggtcatccatgcaagctgaggaggtttccaacttgattgaggcgtttggtggacaagctcttaccttcgagggagatgtttcaaatgaggccgatgtggaatctatgattagaactgcagttgatgcttggggaactgttgatgtattggtaaacaatgcaggaattactcgagatggtttgttaatgagaatgaagaaatcacaatggcaggaagttattgatctgaatctcactggtgtttttctttgcatgcaggcagcagcaaagattatgacgatgaaaaagaagggaaggataatcaatattacatcagttattggtcaggttggcaatgttggacaagccaattatagtgctgcaaaggcaggggtaattggcctcacaaaaagtgctgccagggaatatgctagcagaaacatcactgttaatgcagtagcccctgggtttattgcatctgatatgactgccaatctacgaccaggcattgagaaaaaaagattggaattaatccccttaggaagacttggccaaccagaagaagttgctggacttgtggaattcttggctcttaatcctgctgccaattacatcactgggcaggtgttcaccattgatggaggtttggcaatgtga

SEQ ID NO: 1609 - DNA, 717 bp, Glycine max var. Williams 82
atgtctgctgctgtgtctgcaaccaaggatgttcccttcaatgctcatttggaggaagatatcaaaaacaaagaaatcaacaaggttgttaatgttggggaagcagaccagattccttacaatgatgatgctgaaggaactgattcagaggcagaggaagaccccaagttggaattggatcttggccctcagtgttccctcaaggaacagcttgagaaagataaagaggatgaaagtttgagaaaatggaaggagcaacttctgggaggtattgatgtgtctgctgttggagaaaacaaagagcccgaagtgaagatagtgagccttaccattatatgtccagggaggcctgacctcattctgccaattccatttacttctgatgctaagaagagtatcttcacccttaaggaaggaagtcaataccagttgaaattctctttcactgtctccaacaacattgtttctggcctcaaatacaccaatgttgtttggaaaactgggcttagagtggacaacacaaaaaaaatgttgggaacttatagcccaagccaggaactatatacatatgaattggaagaagaaactaccccttcagggttgtttgctaggggaacctattcagcaagaaccaagtttgtagatgatgatcggaaatgctacttggatactagttaccactttgaaattcagaagaattggcctacacccatctaa

SEQ ID NO: 1610 - DNA, 1713 bp, Glycine max var. Williams 82
atggatgaggatttcgagttcccaagtgctggcaacatggaaatgccagaggaggaagagattgagagtccgattctgaaggttggggaggagaaggagattgggaaaatggggctgaagaagaagttgctaaaggaaggtgaaggttgggacatccctgactgtggagaccaagttgaagtgcattatactggaaccttgcttgatggaaccaaatttgattctagccgtgataggggcacccctttcaagttcaggctaggccaagggcaagtgatcaagggatgggatgaaggtatcaaaaccatgaagaaaggtgagaatgcccttttcacaatacccccagaattggcttatggagagtcaggttctcctcccactattccccccaatgcaactctgcagtttgatgtggagttgctgtcatggacaagtgtgaaggacatttgcaaggatggaggaattttgaagaatataattactgaaggggagaaatgggataatcctaaggatctggatgaagtgtttgttaagtatgaagctaggcttgaagatgggatagtcatttcaaaatctgatggggtggaattcactgtggaagaggggtatttctgtcctgctttggccaaggctgtgaaaaccatgaagaagggagagaaagttctcttgaatgtgaagccacaatatgcatttggtgagagtggaaggccagcctcaggagatgaaggtgccgtacctccaaatgcttctcttcaagtggatcttgagttggtctcgtggaagactgtgtctgacattaccaacgatagaaaggttctcaagaagactttgaaggaaggggagggatatgaacgaccaaatgatggagctgtagttcaagtgaaactgattggcaagctgcaagatggaactgtcttcattaagaagggctacgatgatcaacagccattcgagttcaaaattgatgaagagcaagttactgatggacttgaccaagctgtgaagagcatgaagaaaggggaaattgcattgctgatcatacaacctgaatatgcttttggtccatctggatcctctcaggaattggctaatgttcctcctaattctactgtgtactatgaagttgagctgctttcttttataaaggaaaaggaatcgtgggatctgaatacgcaagagaagattgaggcagctgggaagaaaaaggaagaagggaatgctttatttaaggttggcaaatatgaaagagcttcaaagagatatgaaaaggccataaagtttgttgagtatgattcctccttcagtgatgaggagaaacagaagactaaggcattgaaaatcacatgcaatctcaacaatgcagcctgtaagttgaagctaaaggactacaaacaggcagagaagatgtgcacaaaggttttagagcttgatagtagaaatgtaaaagcactctatcggagggcacaagggtatctccatcttgtggacttggatctagctgagatggatattaagaaagcccttgagattgagccagacaacagggatgtaaagatggagtacaaaattttgaagcagaaagtgagagaatacaacaagaaggacgcacaattttacagcagcatatttgcaaaaatgaataaactagagcaagcaagaacagcaacagcaaagcaggagcctgtgccaatgactattgacagcgaagcttaa

SEQ ID NO: 1611 - DNA, 3442 bp, Glycine max var. Williams 82
atggcgccaaatttcgcagatctagcattagcgcgctcagaggccatggacaccgtcccaagttcccgtcagcggagccactcctctggtacactcactcgcgccagatcacagctctatcatcatcggaaccgctccggtcaactccgcttcgatcccgttccctcactggacgaaccctgcgcggaacttcttggctttcgccgaaccaattgcaagaaagcgaagcgcgacgacggcgaccttcctcgccgcctgaccaaggatcttcgcgccaggcgagtctattcgcctccgcaatccactaattccggtttgatcgaaagcgcgtttcccaagggaaacgccgaagcaatcgggagtcccgatttggggctttttttcgaggctcggggtttcgataggggaaatgctgatttgtttgaagagagcggtggagattgttcggagaaatttgatggtttggacggagcaacaactctacctgatgctgagatttgcggtggttcaaattccaaggttaacaaagatgtagagaaactggacgcagaggttcctgtcaaagatacaccttccactgggaatggttcttctctcaagagcaaatctgttctcagaccatgtttccaggggaagttgttcaaggccccgggttcagtcaattacagaaggttgtttccatttcaaaaggataccgtgagagatgattctgtagatacaccaaaattgggattttgccagaaagaccaggagggtagacagggattccaactgcctttgtcacctcaaagtgaagaagagtctaaacaagaacttaagacggatgccactgcagattatggtgttaaagatgctacaagtgatttgcccgatgatggcttgaagcaattgtctagccacatgaataatcttgattgtgttgaggctagtacctcacaggagtttggtgttttgaatgaagaatgtatacagacaactcctcctgatgctgatatatatgttaattcagaggtcaatgtcaaacccatggattttaccagaagcactcatgaaaatgcgggtcaagggttttgtctgaaagctgacaaggtgaaagattctcttaagagtaaatccgtgccgagacaacttttgcacaggaaactttttaaaaccccaggttctgtcagctataaaaggttgcttccatttctaatggatcttaccaaagatgactctgatagatccaaatttgatcatcagacacatcatcaagaagatgaggcaaagaggttccaacttcctttgtcatctgaaagtgaagaagcttctatagatgagcataagacaaacagcagtcccatgcatggcacagttgagtctaatggtttggaaaactatgtattagttaatccttctcatggcaaccagccaaaattgacaccttcccaagactttcctgaatttccaatgcaattggacgcaaaagaagtggttcgcggtgatttatctgcaccctctgtcaatgaacatacagagaactttgcaattgcttctaaggatgaatgcttgagtgcatcagagcttaatccatgttcagtaatggtggatggttttcactctgctaagaatgttgcgcataatgatggcgtcaaggaagtacaaaatacgatatccagacaacacgatagtgactcaccacccaaagatcagtatatgctttatctcaaaggtgatgtctctgggcttacatctgtgcatcgttcaagtaaagaaaaaggattcactattgcttatgatgaaagcaaacagtttgtgaatctgaaggagcgtgaatctgttagcagatttccccctgaatgtcagactctaagtcaattggatcttaatgtgctagatgctgaggagaatgtaacaagtttaaatcatgtccaggtttcaaatgatatacttggagctccatctgagaatattacctcagaaaaatctgacatggcagggcatagcggtgacaaagcaggaagtgtgcagaatgggatagttttatgttcaagaatgccttcaaaaggtagtgataacaaaaatgctagtggaataaaaaatggctctgaatccaagatcacttcggttcttaaacgctgtccacagtttaaattgttgaaacatgctggatctttaaactacaagagattgcttccatttatattggataccatgaaagatgattcttgtgcttcagtaaatgatcatcacccaaaacttgcgaaatccatggatcaaacacctctgccaatttcaacttcaaatttacatctaactcctgtaaatgattcaaatggttgtgttcccgtggaacattttgcaggcaattcttgtcctcagcaacaatcagggttgcaggcttgtgatttaaacaatgatagttcaagcccaaaatctcaaattcctgaatttcagtcatctcatgattcatgcaaagtgattcaactgcaagatgaacaggttgtattaaatggactctgcaagccagaaagctccactgatccatcaatttctgttcatggaatagacttaccaatcacaaccttggcacctatgattaatgaagttaccaccagagaggctacacctgactcgtccaagtcattatcagttttctctgaagtaaaaggaaacaattctttcctgatgtcttctaatgagaagctacctgaaacacacgaatgttctcagagcttgtctcaactgcaagttgtagaacaacttagagttcccgctgttggtttgaaaaaaggaattttaaaaagaaatccaagaggatgcagaggggtttgtgcatgtttgaactgtgcttcttttcggcttcatgcagaaagagcatttgagttttctaaaaatcaattgttagatgcggaagaggttgctcataatcttatgaaggaactatctcatctaagaaatatgttagaaagttctgctgatagtgtcaacaataatcccgtttttggtggaagccaggtgaaagaagcttgcaggaaagcatgtgcagctgaagaacttgcaaagaaccgtcttagtcagatgcacgatgatcttaatattcattgcagaataacgagcttgcagccaccaacggttacgtttgcggttcatgttgaaaaagaagtcattcaacctggcggataatcctgcaattgcggtctcaaagcagatatcctctcgtcttggaattgtttttaggagtgatataaaatatatctcagcttagccttggaaaactgaatatcagagaaatatgtttggccctttgaaacaggaagaaagtgagtagaagcggacaagaataaccttacagattttttttggaatttgttattgtaaatatttgctcagttatgaattttctaatttgctctatttttttaagattaatatgtttctgtttttctcaaatatctttttt

SEQ ID NO: 1612 - DNA, 1482 bp, Glycine max var. Williams 82
atgtgtgtgtgtgtggtagtgagaagaattgagaaaaagaatgtggtctccaaagtccaaccaatacaaatctctagctctccctccctctctcttgtatccctttatatgaatcttctcagacacgttttcgagagcccctttttccttatcatagcctcgcagcagctgatatctcatgttgttcttgttcctaacaaagtagcattaaaaaccatggcatcttcaccggacaccagcaaaaccataaagctgatgcgttacaacagctacctccgcagactcaacagcttcaaactccttaagacatccttcatcctcctcctcctcctctacaccctctccacccaccacctcctcctctcctccgccttccacggccccgcatgggagaatcaggtccgccactccgccctcccccgccgcccccacggcatgtcggtgctggtcaccggcgcggcgggcttcgttggctcccactgctccctctccctgaagaagcgcggcgacggcgtcctcgggctcgacaacttcaactcctactacgacccctccctaaaacgcgcacgccagcacctcctcgccaaacaccaaatcctcatcatcgaagccgacctaaacgacgccccgttgctcgccaagatcttcgacgtcgtttcgttctcccacgtcctccacctcgcagcacaagcgggcgtccgctacgccatgcagaacccccactcctacgtggcatccaacatcgccggattcgtaactcttctagaagcttccaaaaacgctaacccccagcccgccatcgtttgggcctcctcgagttccgtctatgggctcaatgacgaaagcccattctccgaactccaccgtacggaccagcctgcgagcctctacgcggcaactaaaaaagcaggcgaagcaatcgcgcacacctataatcatatctatggactctccctcaccggattgcgcttcttcactgtttatgggccctggggaaggcccgacatggcttactttttcttcactaagtccattctccagagaaagcccattgacgtgtaccagacgcatgacgagagagaagtcgcgcgtgacttcacttacatcgacgacgtcgtcaagggctgcctcggtgccctcgacacggcggagaagagcaccggcggcgtcgtagggaagaagcgcggccccgcgcagctgagagtttacaatctcggtaacacatcgccggtgccggtgggtaaacttgtttccgtgttggagacgttgctcggggtaaaggcgaagaagcacgtgatcaaaatgcctcgaaacggcgacgttccgttcacgcatgctaacgtgagcttggcgtggagggacttggggtacaagcccaccacggatctcgccgctggtctcagaaagttcgtgcagtggtacgtcgggtattatggtgttcgcttaggggtagaaaaggaaaaacacgcagacttggcttga

SEQ ID NO: 1613 - DNA, 2343 bp, Glycine max var. Williams 82
gtaacttgctcagtcttttgaaaacaatctatttgtctgcaacctaagtagaaaccagctattgtaattaaaagtttaacgctgcatgatttgagttctgttttgtcggcggggactagggacaaatatattttttgttagttaatttgtatatttattggtgatatgtctgaagttaagttaattggccatgcatgtgtgtgtgtgtggtagtgagaagaattgagaaaaagaatgtggtctccaaagtccaaccaatacaaatctctagctctccctccctctctcttgtatccctttatatgaatcttctcagacacgttttcgagagcccctttttccttatcatagcctcgcagcagctgatatctcatgttgttcttgttcctaacaaagtagcattaaaaaccatggcatcttcaccggacaccagcaaaaccataaagctgatgcgttacaacagctacctccgcagactcaacagcttcaaactccttaagacatccttcatcctcctcctcctcctctacaccctctccacccaccacctcctcctctcctccgccttccacggccccgcatgggagaatcaggtccgccactccgccctcccccgccgcccccacggcatgtcggtgctggtcaccggcgcggcgggcttcgttggctcccactgctccctctccctgaagaagcgcggcgacggcgtcctcgggctcgacaacttcaactcctactacgacccctccctaaaacgcgcacgccagcacctcctcgccaaacaccaaatcctcatcatcgaagccgacctaaacgacgccccgttgctcgccaagatcttcgacgtcgtttcgttctcccacgtcctccacctcgcagcacaagcgggcgtccgctacgccatgcagaacccccactcctacgtggcatccaacatcgccggattcgtaactcttctagaagcttccaaaaacgctaacccccagcccgccatcgtttgggcctcctcgagttccgtctatgggctcaatgacgaaagcccattctccgaactccaccgtacggaccagcctgcgagcctctacgcggcaactaaaaaagcaggcgaagcaatcgcgcacacctataatcatatctatggactctccctcaccggattgcgcttcttcactgtttatgggccctggggaaggcccgacatggcttactttttcttcactaagtccattctccagagaaagcccattgacgtgtaccagacgcatgacgagagagaagtcgcgcgtgacttcacttacatcgacgacgtcgtcaagggctgcctcggtgccctcgacacggcggagaagagcaccggcggcgtcgtagggaagaagcgcggccccgcgcagctgagagtttacaatctcggtaacacatcgccggtgccggtgggtaaacttgtttccgtgttggagacgttgctcggggtaaaggcgaagaagcacgtgatcaaaatgcctcgaaacggcgacgttccgttcacgcatgctaacgtgagcttggcgtggagggacttggggtacaagcccaccacggatctcgccgctggtctcagaaagttcgtgcagtggtacgtcgggtattatggtgttcgcttaggggtagaaaaggaaaaacacgcagacttggcttgattcatcctttccgtgcccctccattcatttattataattatatgtttttttgttgaaacttgtgaatggtgctggcggcccatgtgagaatgcataatcatgatttggtattttaataaaatgctagttgcatccagtattattatctgtgcacccaacacttaagatgaaatgacaaaaatatctttgatccgtaaatcatttaagttgatctataagagtcttatggatcaacttaatccgtattgtttcgtaaaaggtttacggatcatattgatccgtatcaaccttacggatcaacttgatttgtacgatttacggactatcctcacacacattcatcacaaatgcggaaaaagtgtagagataattttggtatttttataaacttgtgaatttcaacaagtctgcgtggtgtggcaccattcacaagtttcaacaagttttattaaacttgtgaatataaacgtggtatataggtccaaggtaataaaagcaaggacaagagcaagtgtatatatgtaatctatgtgtgaggtggtggagggggagctgagctgtattaatgatgggtgggctctactttaagcttttccaacttattattgtattttcaaaattaagttaaattgtgtatagacaataattatatgacatagacatgcaa

SEQ ID NO: 1614 - DNA, 528 bp, Glycine max var. Williams 82
atgagaaattgcataaggtgctgcatctcttgcatcttcccatgtggggctctcgacgtgatccgcatagtgcactccaatggcagagtagaagaaatcagcggcaccgtcaaggccagtgatgtcatgaaggcacaccccaaacatgtcctcaagaagccatgctcttcccccgccgatgccgccggcatcagcggcggggtccacaagatcgtggtggtgccacccgacgctgagctccaacgtggcaagatttacttcctcatgccactccctcctactcctcctacacaagagaagaagaaccggcagagaaagaagaagaggaaggaacatagagagagaactatgaacaacaccaacaacgcgtccatgattacgtctatgactagcttgcttgtctctgatcgctacttgaatgatatactctcagagaaggtgtcaagtcaaagagacagaagaagagggcgtgttgctgtgtggaggcctcacttggagagcatttatgagtcaccttctgatccgtaa

SEQ ID NO: 1615 - DNA, 1026 bp, Glycine max var. Williams 82
atgggtttccttgtgttgcttcttatctccctcttaggtctctcttctagttccagcatatcaactcatcgctccatattggaccttgacctatccaagtttaccacacagaaacaggtgtcttcactgttccaactatggaagagtgagcatggacgtgtctaccataaccacgaagaagaggcaaagagacttgagattttcaagaataacttgaactatatcagggacatgaatgcaaacagaaaatcaccccattctcatcgtttaggattgaacaagtttgctgacatcactcctcaagagttcagcaaaaagtacttacaagctcccaaggatgtgtcgcagcaaatcaaaatggccaacaagaaaatgaagaaggaacaacattcttgtgaccatccacctgcatcatgggattggagcctttctgaacaagaaatcacagattgtgtctataaagccaacagttgtaacggtggatatcactttcatgcatttgaatgggttatagaaaatcgtggaattgccactgaagttgactatccttacacagctgaagatcatggtacatgcaaagccaataagacacagaacagtgttacaattgacaattttggaggtctaataatatcagaacatagtacacaaccagagacagacaaagcactgttgagcgccacccttgagcaaccaattagtgtggccatggacgcaagagattttcatttctacactggcggaatttatgatggaggaaactgttcaagtccgtatgggatcaaccactttgttttaatagtgggttatggatcgttagatggtgtagattattggatagtaaaaaattcatttggaaaagattggggaatggatggatacatttggatccaaagaaatattgctaatccaattggagtatgtgcgattaattttttcgcttcttggccaatcaaagagaaatcagaaacactggtgtctgctcgcgttaaagctgatcaaagagtggattactctcctctttga

SEQ ID NO: 1616 - DNA, 300 bp, Glycine max var. Williams 82
atgctagctaaaaccaacgtgccccatgagaccttatctccacagaagattcatgtccaacatgttccaaagtgtgtgtcggataggttgctagagaagttctatgatgagtcagagttggatttcgattacgagcaaagtggattgtggtctcctccagttccacgcacggtattcttgagctcaccggggagaatattcactgagcaagaaatgcttgaaagactcagaagcaaaaatgcatcacgaagacgtggcaaaagattcagagtttgtttcagtgtgttatgttgtgcctga

SEQ ID NO: 1617 - DNA, 813 bp, Glycine max var. Williams 82
tttctgcatcattagcccctcataagatttgtctccatttcaaatgctacatcactcccaccctgtattttcaatatctcacatgcaccacattcgcgtgttatcaacaacaatatcattcaaatttttcttttagcatcataactcataaatcataattatatctcagagtgaaatgctagctaaaaccaacgtgccccatgagaccttatctccacagaagattcatgtccaacatgttccaaagtgtgtgtcggataggttgctagagaagttctatgatgagtcagagttggatttcgattacgagcaaagtggattgtggtctcctccagttccacgcacggtattcttgagctcaccggggagaatattcactgagcaagaaatgcttgaaagactcagaagcaaaaatgcatcacgaagacgtggcaaaagattcagagtttgtttcagtgtgttatgttgtgcctgacagtgaatgtaaacaaaagcgggaattgaaggtttttcagcaatgcttcttgtttagaatacaaatggaattaatccaaaaatttcctatgattgtattatcatattcacaggaatttacatgtatttctttttctttttgtctagccaaaagtgatgtatatgtgtgaattttatatataaatatatatatagagagagagtgtatcaatttcttatccattattttcagatgagattcctatatagtacctttgggtccctttgccatctctaatgtatgttgttcatgatattgattaagatgctaatagccagaggttgatataaggtagtagg

SEQ ID NO: 1618 - DNA, 687 bp, Glycine max var. Williams 82
atgggaagcgaagatgtgaagctgttgaacttttgggtgagtccatttggtaaaagggttgagtgggctttgaaactaaagggtgtggagtacgagtacattgaagaagatatctttaacaagagcaatctccttctggagttgaatccggttcacaagaaggttccggttcttgttcatgcccagaaacccatcgctgagtcattcatcatccttgaatacattgatgaaacatggaagaagtatccattgttacctcacaatccttatcaaagagcacttgctcgattttgggcaacctgtgttgaacaaaagcttgggaaggctggatgggtagcaatgtctaccagcggcgatgaacaagaagaggctatgaaagaagccaaagaaatgatggagaaaatagaagaagagattaagggaaagaatttttttggaggagacaatattgggtaccttgatattgcaattggatggattgcttacttggttcctgtttgggaggaagttggatcaatgcagataatagacccattgaaatttccagccacctttgcatggatgaccaattttctcagccaccctgtgatcaaggacagcttgcccccaagagataagatgcttgtttactaccacaatcgcaagaacaacttgccttccgtctttcgtaacttggtcaaggattag

SEQ ID NO: 1619 - DNA, 858 bp, Glycine max var. Williams 82
atgggaagcgaggaagtgaagctgttgagcttttttgcgagtccatttgggaaaagggttgaatgggccttgaaactgaagggtgtagagtatgagtacatagaacaagatatcttcaagaagagcaatctccttctggagttgaacccggttcacaagaaggtcccggttcttgtccatgcccagaaacccatcgctgagtcatttgtcatcgttgaatacgtagatgaaacatggaagcagtgtccactcttgcctcaagatccctatcaaagggcacttgctcgattttgggcttattcggcggagcaaaagcttatagatgcagcatggattgctatgtgtaccagcggggatgaccaacaaaacgctgtgaaagtaggcagagaactaatggagaaaatagaagaagagattaaggggaagaaattttttggaggggacaatattgggtaccttgacattgcactaggatggatctcttactggattcctgtttgggaggaagttggatcgatgctgataatagaaccattgaaatttccagccatcactgcatggatgaccaattttctcagccaccctgtgatcaaggacaacttgcccccaagagacaagatgcttgtttactacagcagtcgcagaaaggcactttcttcaacttctctgggctggttcaagcttatttcaactggtgtttatatcactcatccccgagcagctttggtgaccaccattcggtcattcatggataaagattggtgcttatccttccagcatactttgagggaaggaaactttgtagctgatggtttagcaaagaaaggggtccatgttactgcttcttttgctttttga

SEQ ID NO: 1620 - DNA, 561 bp, Glycine max var. Williams 82
atgccccctgaatccacaaccataattttgaatgatataatgacggctttgagacaaccaaatattggcatacttgggatgtatggatcgagtaatgcgaacacggaaaatgcagtggagaaagtcaccagaagagttgagagggacggattgtttaatgtggttgtgaagacatgcgtgatgaaaaagtcagatttgaaaaaaattcaaggagaacttgggaacgcattgggtctacaactccatcagaaaactctagtggaaagagctacccgtttgtgtgagaggattaagatggaggacaacatccttatcatccttcatgatcttcaagctcaaatcaacttggccaagattggaataccctttgggaatgaccacaagggttgtaaaatcttgttagtagctaagaataaagaggtgttgtcccacaaaatgaaaacccaaatagaatttgctgtggacgaggagccgtcaagttctggtctaacgaggagccatcaagttcaaactcgtggagtaattgtatggatcaaaaggtggtggtgtcctgtccagtga

SEQ ID NO: 1621 - DNA, 648 bp, Glycine max var. Williams 82
atgaacatcttcaggctcgccggtgacatgacccatcttttcagcattctcgtcctcctcctcaaaatctacgccaccaaatcatgttcagggatttctcgcaagactcaagagctgtacgcgattgtgttcgtggcacgctatttggatctgttcacggacttcatatccgtttacaacaccttcatgaaggtggtgttcattgcaagctccttagccattttttggtgcatgcgttttcatcccatggtcaggagaagctacgatagggacctagacacttttcgccactatttccttgttggggcaagctttgctttggcactcatcttgcatgaaaagttcactgttcaagagattttctgggcattttcaatatacttggaggcagttgcaatattacctcagttggttttgttgcaaagaagtggaaatgtggacaatttgactgtgcaatatgtattctttcttggtgcatatcgtgcattttacatcctgaactggatataccgctatatgactgagccacgttttactagatggatagcctgtgcctcaggtgttgttcagacagctttgtatgcagatttcttctactattatttcatcagctggaagaacaattcaaaactgaagttgcctgcctga

SEQ ID NO: 1622 - DNA, 816 bp, Glycine max var. Williams 82
atggctgattattcagcaggaactgaatcccaggaggtggtcgtaaatgtaaccaagaacacctccgaaacaatccaacgctcagactcccttgtctctgttcctttcttgcagaagttggtagctgaggcggtgggaacatatttcctgatatttgcagggtgtgcttcattggtggtgaacgagaactactacaacatgataacatttcctgggatagcaattgtttggggtctggttctgacggtgttggtttacactgtcggtcacatctctggtggccatttcaatcctgctgtcaccattgcttttgcctccaccagaagattccccttgatccaggtaccagcttatgtagtagctcaactcctaggaagcatacttgcaagtggaactctgagactattatttatggggaatcatgaccagttttcaggaacagtcccaaatgggactaacctgcaggcttttgtgtttgaattcataatgacctttttcctcatgttcgtcatatgcggggttgccaccgataacagagcggttggtgagttggctgggattgcaattgggtcgacattactgctgaatgtgattattggagggccagtgacaggagcatcaatgaacccagctagaagcctaggacctgcttttgtacacggtgaatacgaaggaatatggatatatttgttggcacctgttgtgggggccatagctggagcatgggtatacaacatcgttaggtacacagacaagccattgagtgagatcaccaagagtgcttctttcctcaaaggccgtgctgcctccaaataa

SEQ ID NO: 1623 - DNA, 825 bp, Glycine max var. Williams 82
atggatgagaattcagcaacaaatggaacccatgaggtgattttagatgtaaacaaggatgtctctagaacaactcaaccctcacgctcttgtgtcaatgtttctttcttacagaagttggtagctgaggtggtgggaacatatttcttgatatttgcagggtgtgcttcagtggtggtgaacaagaacaacaacaacgttgtaacacatcctgggatatcaattgtttggggactggttgtgatggtactggtttactctgttggtcacatctctggtgcccatttcaatcctgcagtcaccattgcttttgcctccaccagaaggtttcccttgaagcaggtaccggtttatgtagtagctcaggttgttggatccacacttgcaagtgcgactctcagactattatttagtggcaaggaaacccagttttcaggaacactcccatctgggtctaacctgcaagcttttgtgattgaattcttaatcacctttttccttatgtttgtcatatccggggttgccactgatgacagagcgatcggtgagttggccgggattgccgttgggtccactgtgctgttgaatgtgatgtttgcagggccaatcacaggagcatcaatgaacccagcaagaagcatagggccagccattttacacaatgaatacagaggaatatggatatatatagtgtctccaactcttggggccgtggctggaacatgggtatacaacaccattaggtacacggacaagccactgcgtgagatcaccaagagtacctctttccttaaaggagtagggcgtagtggtagctctaggtga

SEQ ID NO: 1624 - DNA, 1812 bp, Glycine max var. Williams 82
atggatactcatgttgttgatgggagtgtggagtggatgcaggaggagaaagcagaactggttgttgatggaaaagttgattggaaaggaagaagagctttgaaacacaaacatggggggatgaaagtttcattgctcatacttggcgcatttgctgtcgagaacatggcaactctatcactagcagtgaactttgtgtcatacttcactggaattatgcattatgaattagcagatgcagctaacatagtaaccgattacatgggtgttagttacatgctttccattgttgtggccgttgttgctgacacttggattggcagatacaaatccgttgttatttctggattcattgaatctttgggacttgcattgcttacggtacaggcacacatgggtagcctgacaccacccatttgcaacgtgtatgtgaaagatgcacattgtgcaaagcttagtgggaagcaagaagcatttttcttcattagcctctacttgttggcctttggcagtgcaggtttgaaggcttccttgccatcacatggtgctgatcaatttgatgaaagagaccccaaagaagcaatgcaaatgtcaagcttcttcaatggtctcttgttagcagtttgcattggtggtgcagtgagcttaacgtttaatgtatatatacaagaccgctatggatgggattggggctttggaatctccacttttgctattgttttgggaaccatactctttgcctttggattgccactataccgaattcatgttgcacatacaaaaaacggcatcattgagatcatacaggtctatgttgctgcaattcgcaacagaaacctttcccttcctgaagatcctatagaactatacgagattgaacaggacaaagaagctgcaatggaaatagagcatcaacctcatagggatattttcaggtttttggacaaagcagctatccaaagaaaatctgacgtgcaaccggagaaccaagagactccaaacccatggaaactatgcagagttacccaagtagaaaatgcaaaaatcattctaagcatgctccctatattctgttgctcaatcataatgaccctttgcttagcacaactccaaaccttttctgttcagcaaggctccaccatggacaccaggatcacaaaacattttaacatccctcctgcatccctcccaatcatcccagttggcttcttaatcattatagtccctttctatgatcgcatttgtgtgccttttcttcgtaaattcactggtattcccaccggcattacacacttgcagcgcataggagtaggcctaatactctcttgcatctccatggcaattgcagcaatcatagaggttaaaagaaaaggagttgcaagagaccacaacatgctagatgccttgccagtaaaacagccattgccattgagtatattctggcttgcttttcagtattttatatttggcatagctgacatgtttacctacgtggggcttcttgagtttttctattcagaagcaccaaaaggcctaaaatccacatcaacatgcttcctttggtgctctatggcccttggctattttctaagttccatattggtgaaaattgtgaacagtgcgaccaagaatatcacttcaagtggaggttggttagcagggaacaatattaacagaaaccatctgaacctgttctacttgttcctctcaatattgagcttgatcaacttctttgtctatttgttcgtttcaaagaggtacaagtacaggcctcaacaccctgcagttaccggtggcaattcagaggagtga

SEQ ID NO: 1625 - DNA, 1023 bp, Glycine max var. Williams 82
atgtcattgcctaccaccactagtggtcactcatctctttactctgcatttacattgccaagaaccactcaaattcacccaaccttgttttctcccaccaccaagttattttcttccagaagcccctcatattcaggtgtttcccattgtttctcaaacaccctttcgccaagaccgctgccttttgctgttaaggcttcatctggggttggctcagaagcatccaaacaggagaatgacaatagtgaagaagaagaagaggaaccgtatgaagagtatgaggtggaaattgagcagccttttggactcaaatttgcaaagggtagggatgggggaacttacattgatgctattgcaccaggaggatcagctgataaggctggagtcttcaatgttggggataaagtaattgccaccagcgcagtttttgggaccgaaatttggccagctgctgaatatggaaggacaatgtacacaattcgccaaagaattggcccattactcatgaaaatgcagaagagatatggaaagaacattgattctggtggtgagttaactgaaaaggagattatcagagctgagaggaactctgggtttatcagtaacagagtgagagaaattcaaatgctaaatgctttgaggaaaagggaacagaaagagcgcagggaaagggatttgagggaaggattacaactgtataagaatggaaaatacgatgaagcactagagaaatttgagtctattttgggatcaaagccagaacccgaggaagcagcagttgcaagttacaatgttgcttgctgttactctaagctaaaccagattcaagctgcactttcttcactggaagaagctctgaatgctggttttgaagacttcaagagaataagaactgatcctgacctggctaacgcaagggcatcagaggaatttgatcctttattgaaaagatttgatgaatctttcatcaatgagaatgccatcaatgccattaaatctctttttggatttggtaagaaataa

SEQ ID NO: 1626 - DNA, 1461 bp, Glycine max var. Williams 82
atggaggtgaccaaccttgtagtcttgccagcagttttggcattctttgtcctttgtctatatttcatcactaaagttgttagactcgggaaacatccaaaccttaatcttcctcctggaagattaggatggcctattgttggagaaacctttgactttatgcgtacaatgaatgagggaaacgtgttaaggttcatacaagagagagtggagaaatatgacgccagggtgttcaagacttcaatgtttggagatcctgttgttgtgttttgcgggccagctgggaacaagttcctatttagcaatgagaacaagaatgttcaagtgtggtggcctagttcggtaaggaagttgttaaggttgtctctggttaataaggttggtgacgaggcaaagatggtgagaagattgctcatgagctttcttaatgcagaaacactcagaaactacttgccaaaaatggatagcattgctcagcgccatatagacacctattgggaaggaaaggagcaggtgtttgtctatcccatagtacagctatacacgtttgaattggcttgttgcttatttttaagcattgaagactctgaccatatatcaaagctttccttaaaatttgatgaatttctgaaagggatgattggcttcccccttaacattcctggaacaaggtttcatcgggcaatgaaagctgcagatgcaataaggaaagaaattagaatgattctaaagaaaaggaaagtggatttggaggagaagagggcatcagctactcaggaccttctatcacacatgcttgtcacatctgaccccagtggaaggtttacgactgaaatggagattattgataacatacttcttctactttttgccggtcacgatacttctagatcagtgttatcattggtcatgaagtatcttggacaattgcctcatgtttttgaacatgtcttgaaagttatctttatgacagaacaacttgaaattagtcaagggaaagaggcagggcagttgttgcaattggaagatgttcagaaaatgaaatactcttggaatgttgcatctgaagtcatgaggctatccccacctgtgagtggtgcttacagagaagctaaagaggatttcacctatgctgattataacatccctaaagggtggaagctgcattggaacaccggttcatcacacaaggatccagcactcttctcgaatcccgaaacttttgatgcttcaaggtttgaaggagcagggcctacaccattttcatatgttccatttggtggtggcccccgaatgtgtttgggtcaagagtttgctagactagagatacttgtgttcatgcataatatcgtgaaacggttcaagtgggatttggtgattcctgatgagaagtttaagtatgaccccatgctagaaccagtagaaggacttgcaattcgactccatccttcccatttctag

SEQ ID NO: 1627 - DNA, 1870 bp, Glycine max var. Williams 82
ccgtgagtccgtgcttcataatcatagcttttaagttatataacttctctgattcagtcctattccaaagacaaagagctctttgtgtctttcatccatcttattacacctcagttttcctggctcccagaactttctttcatactctctgttgccttgtgccattcatcaatagttaaggtcttaaggacactaaatcttatggaggtgaccaaccttgtagtcttgccagcagttttggcattctttgtcctttgtctatatttcatcactaaagttgttagactcgggaaacatccaaaccttaatcttcctcctggaagattaggatggcctattgttggagaaacctttgactttatgcgtacaatgaatgagggaaacgtgttaaggttcatacaagagagagtggagaaatatgacgccagggtgttcaagacttcaatgtttggagatcctgttgttgtgttttgcgggccagctgggaacaagttcctatttagcaatgagaacaagaatgttcaagtgtggtggcctagttcggtaaggaagttgttaaggttgtctctggttaataaggttggtgacgaggcaaagatggtgagaagattgctcatgagctttcttaatgcagaaacactcagaaactacttgccaaaaatggatagcattgctcagcgccatatagacacctattgggaaggaaaggagcaggtgtttgtctatcccatagtacagctatacacgtttgaattggcttgttgcttatttttaagcattgaagactctgaccatatatcaaagctttccttaaaatttgatgaatttctgaaagggatgattggcttcccccttaacattcctggaacaaggtttcatcgggcaatgaaagctgcagatgcaataaggaaagaaattagaatgattctaaagaaaaggaaagtggatttggaggagaagagggcatcagctactcaggaccttctatcacacatgcttgtcacatctgaccccagtggaaggtttacgactgaaatggagattattgataacatacttcttctactttttgccggtcacgatacttctagatcagtgttatcattggtcatgaagtatcttggacaattgcctcatgtttttgaacatgtcttgaaagaacaacttgaaattagtcaagggaaagaggcagggcagttgttgcaattggaagatgttcagaaaatgaaatactcttggaatgttgcatctgaagtcatgaggctatccccacctgtgagtggtgcttacagagaagctaaagaggatttcacctatgctgattataacatccctaaagggtggaagctgcattggaacaccggttcatcacacaaggatccagcactcttctcgaatcccgaaacttttgatgcttcaaggtttgaaggagcagggcctacaccattttcatatgttccatttggtggtggcccccgaatgtgtttgggtcaagagtttgctagactagagatacttgtgttcatgcataatatcgtgaaacggttcaagtgggatttggtgattcctgatgagaagtttaagtatgaccccatgctagaaccagtagaaggacttgcaattcgactccatccttcccatttctagtttaataccatcattatacgcataatacattgattagaagctttctaagtagtcatcttatattgctatattagtattttaataaaactttttgctacatcggttagcagcttttttgtaactgctttcatgagttttatgatgtattcatttcaataaaactttgattattctgttatgtacaacatacatatatagttcatgtctatgcttccttgatgct

SEQ ID NO: 1628 - DNA, 2337 bp, Glycine max var. Williams 82
atggtgatctgttataaacagctgggagaatatcatttctttcttgttttgcttctcatttcagtccaatgcgttattgccgcaaataacattttgaagcccggagatacactgaatacgagaagccagctatgttcagaaaacaacatatactgcatggatttttccccattaaacacaaatcctattgtaaactacactcacttaagcatcagtgacaacagaaaggacgataattccgcagtgtgggttgctaatagaaatcaacccgttgacaagcattctgcagttctgatgctaaaccactctggtgtactcaaaattgaatcatccaaagatgccaaacccatcatccttttttcttcacctcaaccactgaacaacaacaacaccgaagccaagctgttggatacaggtaactttgtggtgcaacaacttcaccccaatggaacaaacactgtgttgtggcaaagttttgattaccctactgatactcttctccctgggatgaagttaggagttaatcacaaaactggtcataactggtcacttgtttcgtggttggctgtatccgaccccagaatcggggcattcaggttcgagtgggaacccataagaagagaattgatcatcaaggaacgaggaagattgtcctggacaagtggagaactcagaaacaacaatggatccattcacaacaccaagtacacgattgtctcaaacgacgacgaaagctacttcacaattacaacaacaagttcaaatgaacaagagcttataatgtgggaagtattggaaactgggcggttgatagataggaataaagaagctattgcaagggctgatatgtgttatggttacaacacagatggagggtgccaaaagtgggaggagatacccacatgtaggcatagcggtgatgcatttgaaaccagggaagtttacgtcagtatgaacatgctaaacaatctaggtaattcgagttatggcccaagtgattgccgggatatttgctgggaaaattgtgcttgtaatggatacagaaattactatgatggtggaactggttgtactttcttgcattggaattcaaccgaagaagctaattttgcaagtgggggcgaaacgtttcatatattggtcaacaacacccaccacaaaggtacaaaaaagtggatatggataactgtagcagtagttgttccatttgtgatatgtgctttcattctatttctggccttgaagaaaagaaaacatctgtttgaagagaagaaaagaaatagaatggagactgggatgttggattcggcaattaaagatcttgaagatgagttcaagaagagacaaaatctaaaagtatttaagtatacttcagtactgtcggcaaccaatgatttttcaccagaaaacaagttaggacaaggaggctttggaccagtttataagggaatcctaccaactgggcaagaagctgctattaaaagactttcaaaaacatctagacaaggggttgtggaattcaaaaatgagctaatgctcatatgtgaacttcaacacatgaatcttgtacaactacttggatgctgcattcatgaagaagagaggattctaatttatgagtatatgccaaacaaaagcttggatttctatctattcgattgcactcgaagcaagttactagattggaagaagcgtttcaacataatagaaggaatttctcaaggattactctatcttcacaagtactcgagactcaaagtcattcacagagacttaaaagctagtaacatacttcttgatgagaatatgaatccaaaaatttctgattttggattggcaagaatgtttgaggaacaagaatctacaacaactacgagtaggatcattgggacatatggttatatgtctcctgagtatgctatggaaggaattgtttctgtaaagtctgatgtttatagctttggagtgttggtccttgaaattattagtgggagaagaaatactagcttcaatgacgaccgcccgatgaatttgataggacatgcatgggagttatggaatcaaggtgtgcctctacaattaatggatccatcgcttaatgatttgtttgatctcaatgaagtgacaagatgcattcacattggtctcatatgcgtagaaaaatatgcaaatgatcgacccacaatgtctcaaataatttcaatgttaacaaatgaaagtgtagtagttcccttgcctcgaaaaccagcattctatgtggaaagagaaattttactcagaaaagcatcttccaaagagttatgtacaaactctactgatgaaattactattacctag

SEQ ID NO: 1629 - DNA, 3345 bp, Glycine max var. Williams 82
attcatgtatgtattactattactatactatactactattaaaagcgaatggattgttaccttaagaattggaaacgtcaaaatccacactttcacagcatccgagatagtttcagattctccatacgtacttgacctgttaattccgaaccaacctgctttaatatcagtgttgagttggctccactttacacttccacttcaagcttcagaaagaacaagctgcaaaatcagacacagcttttgtgtatttactcaactttcataaatattaaagttcaacaagtcttgcagttgaagatggactttacgtgctgctgaactgaacagtatttgtcaatcttgttcattcttggagggggctttggctttgcattccaaaacacaaatggaaaacatgcattggccacagcatatacatttagtggtactatttttcttgggaatggttctaataccttcctcgtgtcaaagtgatgcaactacaactgtgtacattgttactctgagacaagctcctgcttctcactatcatcaacatgagttgatcacagtgggcaacaactctagacatggttcatctgggagaagaagaactagagttcacaaaccaagacatcagaatgttacaaagccagataggaaacgtggttcatacttttcccgagttcacgactcgttgttgaataaagtgtttaatggggagaaatatctgaagctctatagctaccattatttgattaatggatttgctgtgctggttacccaacaacaggcagaaaaactgtcaaggagaagagaagtgtccaatgtggttttggatttttctgtgaggactgcaaccacacacactccacaatttttgggtctgccacagggagcttggtcgcaagcaggtgggtttgaaactgctggagaaggaatcaccattgggtttgttgacactggcattgatcctacacatcctagttttgctgacgataaatctgaacatccattccccgttcctgctcatttctctggcatctgcgaggttactccggattttccgtcccgttcttgcaataggaagcttgttggggctagacattttgctgcttctgctataaccagaggaatatttaactcatctcaggactatgcttctccctttgatggcgatggccacggcacgcatacagcttctgttgcagctggaaaccatggaattccagtggtcgttgctgggcaattttttggaaatgctagtgggatggctcctcattcacacattgccatttacaaggcactatacaagagatttggaggatttgcagcggatgttgttgcagctattgaccaggcagctcaggatagggttgacataatatgcttgtcaatcactcctaataggcgtccttctggtattgcaactttcttcaatccaatagatatggcattgctatcagctgcgaaagctggtatttttgtagtgcaagctgctggcaatactggaccatcacctatgagcatgtcctccttcagtccatggatctttactgttggtgccacctctcatgatcgagtttatatcaactccctatgtcttggaaataatgtgactatacctggtgttggacttgcacctggcacatacgagaacacattgtttaaattgattcatgcaagacatgctttgaacaaaaacacaacagttactgatgatatgtatattggtgagtgtcaagattcaagtaagttcagtcaggatttggtccagggcaacctcctgatctgtagctattcagtccaatttgtgcttgggctctccaccattcagcaggccttagaaacagccatgaatcttagtgcagttggtgttgttttctccatggatccttttgtgacttcttttcagcttaacccagttccaatgaaaatgcctggcataataattccatctgcaaatgattccaagatattactgcaatactacaattcttcactgcaaatagatggggattcaaataaaattgttaaatttggggctgttgctagtattggtggtggattagaagcgaactgcaataatgaggccccaatggttgtgtattactctgccagaggaccagatccagaggacagtcttcctcatgaagctgacattatgaaacccaatttggtagctcctggaaattttatatgggctgcttggagttctgttgccactgattctgttgaatttctaggtgagaattttgcaatgatgtctggcacaagcatggctgcacctcatgttgctggtcttgctgcactagttaagcaaaagtttcccaactttagtcctgcagccattggatctgcactttccactacagcttctctgtatgacaacaataggaggccgataatggctcagcgatcctatccctccatagaccttaacctatctccagcaactccctttgacatgggaagtggttttgtgaatgcaactgcagcattaaatccaggattgctttttgattctggttatgatgattacatgtcattcctatgtggtatcaacggttcaactcctacagtgctaaactacactggtcaaaattgctggacttataattcaacactatatggccctgatctgaacttgccctcaatcacaatagcaaggttgaaccaatctagagtagtacaaagaacaatccaaaacattgctggaaatgaaacttacaatgttggttggagtgctccatatggaacttctatgaaagtgtttcctaatcacttctctcttgccagtggggagagactagtcttgtctgtgatcttcaatgcaaccagcaacagttctgctgccagctatgggagaattgggctgtatggtaatcaaggtcatgttgtcaacattcctgtggcagtcatttttaaaatcttataaccagctaattaacaaggttagtgtctttaatttcttcttcagtaattcattttgattttgctttgttttcttaagctagtctttgttttattggcaatgtattaagctattttttcattcgttataattaatagtgtaaagctacttattaggtcgtatagtctggttgcataccggacacaaatgtataataataaattgtgctacactacttattaggtcgtgtagtctggttgcataccagacacaaatatgtgagatgggttatttttgtccggtatgcacttaaacgacacccaatccaagttgttaacaaggacactgcaagtgattagtgataattctgaattcttatatgctttgttaaataactgttgttccatctttatttacctttaaactgtagggatcatgcacctctagag

SEQ ID NO: 1630 - DNA, 777 bp, Glycine max var. Williams 82
atgagaaaatgcactgtgcaggcgttgggactcgctattgccttcttccttttactcatcctcctaaccccatccattcctcagcctcagcgataccatgacttcgctgacaagcgcgaattctttggcattcccaatgcacttaacgtgatatcaaatttcctattcatggttattggtctcattggccttgtgctttgccaccgtatgaactattttaacatcagtttgcaaggtgaactatggggttggacatgcttctatgttgctgtgacttcagttgcttttgggtcttcatactatcattttggcccaaatgatgcaggacttgtgtgggacaggttgccgatgtctgttgctttcgcgtctctgttggcaatccttgtcattgaaaggattgatgcaaagaagggaacaatttcaattgtctctctaattatggcgggcataatgagcaatgtgtattggaggttctttggtgacatccgtttatatgttctggcccaaggtgcatcatgcattgccatacctctcatggctactttattgcctccaatgtacacgcattcagcatattggctctgggcttcaggattttatgttctagctatgctgcaagaggccgccgatagagtgatttatttactgacgtttcacattgtcagtggtcacacacttaagcatttgtctgctgcaatggttcctatcatcctaacagtcatgcttgcaaagagaagtgtttactcggagaagcttttgcatgcaaagtctgcttaa

SEQ ID NO: 1631 - DNA, 1371 bp, Glycine max var. Williams 82
atagattaatgttgttgcaatggcgccattcaccaccgtcacaccgcccaccgtcacctgctacctctctcctacatgatgtctttcatttcactcacctctctcactctctaattcattctctttcttttctcccattttcatcaattctccaacaaaaatgagaaaatgcactgtgcaggcgttgggactcgctattgccttcttccttttactcatcctcctaaccccatccattcctcagcctcagcgataccatgacttcgctgacaagcgcgaattctttggcattcccaatgcacttaacgtgatatcaaatttcctattcatggttattggtctcattggccttgtgctttgccaccgtatgaactattttaacatcagtttgcaaggtgaactatggggttggacatgcttctatgttgctgtgacttcagttgcttttgggtcttcatactatcattttggcccaaatgatgcaggacttgtgtgggacaggttgccgatgtctgttgctttcgcgtctctgttggcaatccttgtcattgaaaggattgatgcaaagaagggaacaatttcaattgtctctctaattatggcgggcataatgagcaatgtgtattggaggttctttggtgacatccgtttatatgttctggcccaaggtgcatcatgcattgccatacctctcatggctactttattgcctccaatgtacacgcattcagcatattggctctgggcttcaggattttatgttctagctatgctgcaagaggccgccgatagagtgatttatttactgacgtttcacattgtcagtggtcacacacttaagcatttgtctgctgcaatggttcctatcatcctaacagtcatgcttgcaaagagaagtgtttactcggagaagcttttgcatgcaaagtctgcttaacacgtaaagcatttccctgattatgatcaaagaaggcatttgagttgtggaatgatctcagcaatgtcatcctttctctcccactgaagagaaaatagaaagcttaagctgcttagtggtgcatggagcataagtagtttgttaaatatttatgtttataaacttttgtgctttaagttgtactaaaaaaaaaaagaaggtacgtggatggaactaatcacaccctatcaattgttatacagtaacattcaccttaattagcttcttgtttatacagtcctgtcccgatcttcaatttatagccagtattaaaatagaagaggtagtccaagtagatgaagaatggaatcttgactcattcagtcactgttctctgatttgtatggaagaacctttctctgatttgtatggaagaacctttgtctggcaaatat

SEQ ID NO: 1632 - DNA, 1908 bp, Glycine max var. Williams 82
atgatgaagtgtttctcggtgtccttagcctctttatgggttctccttgctctcttttctctgagtgtgtcatctcaaaatatatctgagagtgggctacagcaagctagcctcccaccaagaggttggaattcctatgattccttttgctggacaatttctgaagacgaatttttacaaagtgctgaaatggtttctcaacgtctcaaggctcacggatatcagtttgtcgtggtggattacctctggtataggaagaaagtcaagggtgcttaccctgattctcttggatttgacgtgatcgatgaatggggaaggatgatccctgacccaggaaggtggccttcttccataggtgggaagggattcagtgaagtagctaataaagtacatagtttaggtttgaagtttgggattcacgttatgagagggataagcacgcaagctgtcaatgcaaacacccctatcctagatataacaaagggaggtgcttatcaagaatctggtcgagtgtggcatgcaaaagacatagcaatgccagaaagggcttgtgcatggatgcctcacggtttcatgagtgtaaatacgaagttgggagctgggagagcttttttgaaatccctttatgagcagtatgctgcatggggtgttgatctcgtgaaacatgactgtgtgtttggagatgacttggatttaaatgaaataagctatgtgtcggaggttctcagtgtgcttaatcgccctattgtgtattctctgtctcctggaaccagtgtgacaccagccatggccaaggatgtcagtggactagtcaacatgtatcgaataacaggagatgactgggataaatgggaggacgtcaaggctcattttgatgtaacaagggatttttctacagctaatatgataggagggaaaggtttgaagggaaattcctggcctgatttggacatgctaccatttggatggctaactgatccaggatcaaatgaaggtccacacagatttagtaaactcactctagaagaaaaaaggacacagatgactttgtggtctttggcaaagtctccccttatgtatgggggggatgtgcggaggatcgatccaaccacatacgaacttatcacaaatcctaccctgctagagattaattactttagctcaaacaatatggagtttccttacatcacaagctcaattaacttgaagcaccctggagggaaagaaagaagacttaagaaaggaatacattcattgggtttgactagctgcagtgaatcaaaggcgaggggttggtctattgaaagtcttaaccaagatcttgaaagaatctgttggaaaaagggtttagaaaacaagcatcaggcccctttctgcgtacacaaaagagaacttcaattcagattagacggggtgagtatgtatcaagaggactatcgagggaaacatcaattagttgcaactgacagaatgaaattttgcttggacgcttctccaagacgaaaggttacttctaaagagttcaagagaggtacattttctccatgcagatgggattcaaatcagatctgggaactgaactccaatgggaccatggtaaatagttactccggtctttgtgcaactgtagagtatattgaagctaatgttaattctggtgggattcgctcttggatcgcaacaggaagaacaggggaaatctatcttgctttcttcaatctaagcgaacagaagacggagatatatgcaaagacatcatatctggctaaggttcttcctgacaaaagcatcacttcatgcaagggcgaggaagtgtggagtggaacagatgtaataacaacgcaagggacgatatcaatgaacgtggaaattcatggatgtgcactatttgttctaaattgcaactag

SEQ ID NO: 1633 - DNA, 1988 bp, Glycine max var. Williams 82
tgacaggtcaacgaggttccttgaatcgtacttttctttgcttcaatggtcctccaagtttgccaatattaaggaggcagatttctcaatcacgtgtttggcacacattttggctgcctttgcaatgtaactacaccctactttcctagttgaatgattttaagttgcattgttgtcaacgatttgcaaagggacggttgtgtttgtataaactttgcatctcgttcaacggaaaagtaacaattttttccagttaagtttgctgcttaggaaagtgtgagaaataattgtcttagaaagtgtgaaataatgttcctaacattcaaaagtagtttgtttctacgctttaacattgttttgttttacaaacaagcacttggaaatgacgtagatatacacgtcataagcagacatgaaaatcagaaactgcagagaccttcaaatgtggctttcctggcttctattcatttaattagcgtctcagtttcttatatggaggaaacaatcagaaaagcttggatacaatggtgaaagctactcgcagttttactattaggaaaccgaatgaaagtatgaggcatatcctgttactttttgttggaggatttttcggcttaattgtaggagtatcacttccaccactgtcaatagcaaagttgaatctaccatacggcctgcttcatctctcttgtgtacaggaaaaatatatagatagcagcacctcatcccaagatcagtttccaagtgatgcaacaaagatatgggtttcaacaaatccaagaggtgcagaaagattacctcctgggattgtcaatgcagaatcagacttatttttgcgcagattgtggggtcttcccagtgaggatttaacctttaagccaaagtaccttgtgacttttactgttgggtatgagcagaaaaagaacattgatgcagctgtgaaaaagttttcaaaggacttcacaatccttctgtttcattatgatggccgaacaacagaatgggatgaatttgagtggtcaaaacaggccattcatgtcagtgttcacaaacaaaccaaatggtggtatgccaagaggtttctacatccagacattgtggcaccatatgactatattttcatgtgggatgaagacctgggggttgagaatttcaatgcagaagaatacctaaaactggtgaggaagcatggcttggagatatcacagcctgccttggaacctagtaaaagtaccaaagcggtgtgttggaatatgacaaggagaagagagcatagtgaagttcacaaagaagcagtggaaccaggaaagtgtaagtaccctcttctgcctccttgtgcagcgtttgttgagattatggctccagtgttttcacgaaatgcatggcgctgtgtgtggcatatgattcagaatgaatttgtccatggatggggtcttgattttgcttttagaaaatgtgttgagcctgcccatgagaagattggagttgttgatactcagtggattgtgcaccaaggtattccctcactagggaatcagggagaaacacaaacaactggaaaacctgcatggcgagcggtgaaggagaggtgtggcatggagtggaggatgttccagggtaggttgactaacgcggaaaagggttattacaagtccaagggaattgatttttctaatttgctcgttcataattaggggacagctccaaattcttacacatacatcgatcaccaccgttgtttttgttttcgagattattattttgatatacgattgttttaatcttgtaagatcaagtttggataaattattcaaggaacaaaaagaaaaaaaaataataactttaacttatctattacaaaatcttatgcgtaggttatctgaacttttctattgaattcgtgtagctacatttaaaccatcaactcatgatgtttatgtccggcgaaatttctagattcatttcccaattcccatgggtgctgtggg

SEQ ID NO: 1634 - DNA, 2259 bp, Glycine max var. Williams 82
atgctcatattggttatcatcagtgtcacccttcgtttctatcaggaatacagcagctcaaaagcagcaatgaagctttcagaatttgtaaaatgtccaataaaagttcaaagatgcgccggtagagttgttcagaaagaacttgtagttcaagttgatcagagagatgtagttccaggtgacattgtgatttttgaacctggtgacctctttccaggagatatcaggttgttatcttctaaacaacttgttgtaagccaggcatcactaacaggggaatcttggacaactgacaaaactgctgaaatcagagaagatcacagcactcctttattggatttgaagaacatctgctttatgggcacaagcgtggtatctggtactggaacaggcctagtgatttccactggatccaatacttacatgagcaccatgttttcaaaagttgggaagaagaagccaccagatgaatttgaaaaggttgcatctgccctcaatcctcagatgcttcccctcatcattaacacatgtcttgcaaaaggagcacttgctatggctaaagacagatgtatagtaaaaagtttaacatctatacgcgacatgggatcaatggatattctttgtattgataagacaggcacccttacaataaatcacgcaatcatggttaatcatcttgactgcaggggtttaccccaagaaaaagtcttacgctatgcctttttcaactcttactttaagagtgatcagaagtatcctctggatgatgcaattctggcatttgtatattcaaatggattcaggtttcagccatctaagtggaggaagatagatgagattccttttgacttcataagaagaagagtatctatcatcttagaaacagaagacaaacactcacaattctttggcaggttcctggtaacaaaaggagcactgttagaagtattgagagtttgttctttcattgagaatttcgataaagatgaaatttcgcccttctcttcagatgattatcagcggattttaaatctctcagaagatttgagcaatgaggggttaagggttatagcagtagctataaggaagctgaaaatgccgcaaaaatgcgaaacaagtaatggaagcaaaagagaagaggaggatattgaaagagacatgatgttccttggcctcataacatttttcgacccaccaaaggactcagcaaagcaagcactgcggcgtttgtctgagaagggagtgaaggcaaaggttttaactggtgactccctctccttgacaacaagggtatgcagggaagttggcataagcaccactcatgtaataacaggtcccgaactagagcaacttgaccaagacactttccatgaaacagttcaaagagccacagtactagcccgtctcaccccaattcagaaacaacgagtggtgcaatccttgcaaacaattgaaaaccacgttgttgggttcttaggagatggagtgaacgattcactagccttagatgctgccaatgtaagcatttcagtggactcaggtgtagccattgccaaagacatggctgatattatcttacttgagaaagacctcaacgtgcttgttgcaggagtggagcatggtagaatctcttttggcaacacaatgaagtatgtaaagatgtcagtgatagctaacttgggaagtgtcatttcactcctcattgcaacacttttattcaagtatgagctcttaacttctagacagcttcttactcagaatttcatctacagtgtgggacagattgccattgcttgggacaaaatggatgaagagtatgttaagacacctcacaagtcctcagagagaggcttgtccatgttcatattgtggaatgcaccagtgtgcaccctttgtgatgtggcaacacttttgcttcttcggttttattacaaggcttacaccgatgtgactcgaaagtttttccattctgcttggttcgttgaaggtcttctattgcagaccctcatcatccatttgataaggacagagaaaaatcctttcatacaggatgttgcatcttggcctgtgattttctccactgttgtgacatctgcaattggaattgcacttccattcacactcattgggaagatcttgggattctccgttatacctatctcatatttcggatttttggtgcttctttttctggggtattttgcagttggccaagtggttaagagactttacatattggtttataagagatggctttga

SEQ ID NO: 1635 - DNA, 939 bp, Glycine max var. Williams 82
atgaagagacttggcagttctgattctctgggtgctctcatgacgatttgtccaccaacagacgaacacagtccgaggaacaaccacgcgtatgggagggagtttcagtccatgctggaaggactcgacgaagaagggtgcgtggaagaaccagggcaccactctgagaagaaacgacgactaagcgtggatcaggtgaaggctttggagaagaacttcgaagtagagaacaaactcgaacctgaccgaaagttgaagctggcacaagaacttggcttgcaaccaagacaagttgcggtttggttccaaaaccgtcgtgccagatggaagacaaagcaattggaaagagattacggcgtcctcaaagccaattatgaatcacttaaacttaactacgacaccctccaacaagaccacgaagccttactcaaagagataaaggaattgaaatcgaggctggtgcaagaagagaacaacaacaacactgaaagcgatgtttcggtgaaggaagagatgctgaccaccacgctctgtgaaaccgccattcctggatcggacacgaaggagttgagttacgagtgttttaacaagagtgatgaggtgggagggggttcttctgtgttccatgtggatttcaaagatggctcttctgatagtgactcaagcgcgatcttgaacgaggagaacaacaaccacagccccaacaataacgcggcgatttcgtcgtgtggggttctgcaaagtcacgggcttttgttgtcgccttcttcgtcgtcgatgaacaactgtttccagttccagaaacagtaccagacgacgacgacgcagtacgtaaagatggaggagcacaattttcttagcgccgacgaggcctgcaatttcttctcggatgaacaagcaccaactctgcagtggtactgttcagaggaatggagttaa

SEQ ID NO: 1636 - DNA, 1712 bp, Glycine max var. Williams 82
tcatcaacatgagtatataaaccaagcatggctcaccatggcaatgcaagagccaagctcacaaagtgaggcctctcaaaaaacaaacaaaagtgacatcaaaatccccttctccttcctcttattctcttataccccacccccacttcttagcttcatccctctctctctctctccttctcaacaattacttgcaagtcttgagttttctcctccctgttctctggttttggaattgagacaggctttatttataattttaaaaacttgtttccctccctcccttatttttgggttttctcaacttgttcttgtcatcttgtaaaacatgggaactgctatagacatgtacaacagcagcaacatcgtagcggatttcctagatccgtatagtgaagagctgatgaaagcacttaagccttttatgaaaagtgattatttctctgcctcttcttcttcttcactcgaatcacagccttgttctttttcatctaattctctccccacttcgtatccctcttccaaccaaatcaagctcaaccaactcaccccagaccaaattgttcagattcaggcccaaatccacattcagcagcagcagcagcacgtggcccaaacccaaacccacctgggcccaaaacgcgtccccatgaagcacgctggcacggccgcgaaacccacgaagctctaccgcggggtgcggcaacggcattggggcaagtgggtcgctgaaatcagactcccaaagaaccgcacgcgcctctggctaggaacattcgacaccgcagaggaagcagcattagcgtacgacaacgcagcgtttaagctcagaggcgagttcgcgcgtctcaattttcctcatctaagacaccacggagccttcgttttcggcgagttcggagattacaagcctctaccttcttccgtggattccaaactgcaagctatttgcgaaagcttagcgaaacaagaggaaaagccgtgttgctccgtcgaagacgtgaagcccgtgatacacgctgctgagctggcagaggtcgagtctgacgtggcaaaatcgaacgctgaatatgtttatcccgagttcgaggattttaaggtcgagcacgagaacccaatgttttctggtgaatcttcttcgcctgaatccagtgttactttcttggatttctcggacttctcggattctaataatcagtgggatgaaatggagaattttgggttggagaagttcccttctgtggagattgattgggaagctatatgatgactcggtttatgtttcgctagtgtctttggctgcttctgcaatggattttttgacatttgcggatgttttgctgagacacgagggttgcaaattttaggcagtgaaatcagagggtcgtagtgatctttttgtggtctgctcgtgttttttgttacttgcatgaccttgggggcttctacttgtgtcttggctagctacttcttgttcaactgtaattaaagtgcccttccaatatatgaaaaatttacatgttcttgtaaagtatggaccatggagaagaactaaatggtgttaccgaattttgttttatgctaagtaactgtagtatgaaaattcgttaccgggagccaacttttactgatatatataagcaaacggtgtttgatctgttggccattgtgagtggtgtcaaattgttagtacaagctttgtttctcatcca

SEQ ID NO: 1637 - DNA, 1581 bp, Glycine max var. Williams 82
atgttcatcgagagtttcaaggttgagagtcctaacgtgaagtacacagagactgagattcagtccgtgtacaactatgaaaccactgaacttgttcacgagaacaataatggcacttatcagtgggttgtcaagcccaaaactgtcaaatatgaatttaaaaccaacacccatgtccctaaactaggggtaatgcttgtggggtgggggggaaacaatggctcaaccctcactggtggtgttattgctaaccgagagggtatttcatgggcaacaaaggacaagattcaacaagccaattactttgggtcgctgacccaggcatcagctatcagagtggggtctttccaaggggaagaaatatatgctccattcaagagcctgcttccaatggtgaaccctgatgatgttgtgtttgggggatgggatatcagtaacttgaacctggctgatgccatggccagggccaaggtgtttgatatcgacctgcagaaacagttgaggccgtacatggaatccatggttccactccccggaatctatgacccggatttcattgctgccaaccaaggagaccgtgccactaacgtaatcaggggcacaaagaaagaacaagttcaacaaatcatcaaagacattaaggagttcaaagaaagcactaaggttgacaaggtggttgtcctgtggacagccaacacagagaggtacagcaacgtagttgtgggactaaacgacaccatggaaaacctctttgcttccttggacaggaatgaggctgagatttccccttccaccttgtatgccattgcttgtgttatggaaaatgttcctttcatcaatggaagccctcagaacacctttgtcccaggactcattgatctggccatcaaaaggaatagtttgattggaggagatgactttaagagtggtcagaccaaaatgaaatcggtgttggtggatttcctagtaggggccggcatcaagccaacatctatagtgagttacaaccatttgggaaacaatgatggcatgaatctctcagcccctcaaaccttccgctcgaaggaaatttccaagagcaatgttgttgacgatatggtcaacagcaacgccatcctctatgagcctggtgaacatccggaccatgtggttgtcattaagtatgtaccttacgttggggacagcaagagggccatggatgagtactcttctgagatattcatgggcggaaagaacacaattgtgttgcacaacacttgtgaggattcactgttagctgctcctattatcttggacttggtccttcttgctgagcttagcactcgaatcgagtttaaagctgaaaatgagggaaagttccactcattccacccagttgcgaccatcctcagttacctgaccaaggcccctctggtaagtataatgtatctgattcataattgttcagtgaattttttcatcccccctttgattaattttctcaaattgtgtgaacaacaattattaaattacaggttccaccgagtacgccagtggttaatgcactgtcaaagcagcgagctatgctggaaaacatcctaa

SEQ ID NO: 1638 - DNA, 2141 bp, Glycine max var. Williams 82
gcacacaacaaccttcttcttcttctcttaaaagttattaagagcttttgcttttctttctgcgcgcttttcccaattaagtagttcttccttttctcaaagcaaaaaaaatgttcatcgagagtttcaaggttgagagtcctaacgtgaagtacacagagactgagattcagtccgtgtacaactatgaaaccactgaacttgttcacgagaacaataatggcacttatcagtgggttgtcaagcccaaaactgtcaaatatgaatttaaaaccaacacccatgtccctaaactaggggtaatgcttgtggggtgggggggaaacaatggctcaaccctcactggtggtgttattgctaaccgagagggtatttcatgggcaacaaaggacaagattcaacaagccaattactttgggtcgctgacccaggcatcagctatcagagtggggtctttccaaggggaagaaatatatgctccattcaagagcctgcttccaatggtgaaccctgatgatgttgtgtttgggggatgggatatcagtaacttgaacctggctgatgccatggccagggccaaggtgtttgatatcgacctgcagaaacagttgaggccgtacatggaatccatggttccactccccggaatctatgacccggatttcattgctgccaaccaaggagaccgtgccactaacgtaatcaggggcacaaagaaagaacaagttcaacaaatcatcaaagacattaaggagttcaaagaaagcactaaggttgacaaggtggttgtcctgtggacagccaacacagagaggtacagcaacgtagttgtgggactaaacgacaccatggaaaacctctttgcttccttggacaggaatgaggctgagatttccccttccaccttgtatgccattgcttgtgttatggaaaatgttcctttcatcaatggaagccctcagaacacctttgtcccaggactcattgatctggccatcaaaaggaatagtttgattggaggagatgactttaagagtggtcagaccaaaatgaaatcggtgttggtggatttcctagtaggggccggcatcaagccaacatctatagtgagttacaaccatttgggaaacaatgatggcatgaatctctcagcccctcaaaccttccgctcgaaggaaatttccaagagcaatgttgttgacgatatggtcaacagcaacgccatcctctatgagcctggtgaacatccggaccatgtggttgtcattaagtatgtaccttacgttggggacagcaagagggccatggatgagtactcttctgagatattcatgggcggaaagaacacaattgtgttgcacaacacttgtgaggattcactgttagctgctcctattatcttggacttggtccttcttgctgagcttagcactcgaatcgagtttaaagctgaaaatgagggaaagttccactcattccacccagttgcgaccatcctcagttacctgaccaaggcccctctggtaagtataatgtatctgattcataattgttcagtgaattttttcatcccccctttgattaattttctcaaattgtgtgaacaacaattattaaattacaggttccaccgagtacgccagtggttaatgcactgtcaaagcagcgagctatgctggaaaacatcctaagggcttgtgttggattagctcctgagaacaacatgatcctggagtacaagtgaagttcaaagtcttaagagtaatggtttgggatactgtagttgaatgagatcaaaacttaactcatatcccataccctcttttctgttatatatttatggcaaatgtgaaatttaaagatcgttggatctctctatctttgttcctgctgactaatttgagagcaggctatctatgctatgcatgcatgtaaaataatataaagttatcgaagtattttgtgcttaattcatgtttctcttcattccccctttttattttctgtatttagaagaattgacacaacgcctctcttggaaatgataatatagagcgtgttagctttaaataatggtaaggaccacattaaattataatgcattctattaatcaataagagttcttcacaaaatcaatggc

SEQ ID NO: 1639 - DNA, 2040 bp, Glycine max var. Williams 82
gcacacaacaaccttcttcttcttctcttaaaagttattaagagcttttgcttttctttctgcgcgcttttcccaattaagtagttcttccttttctcaaagcaaaaaaaatgttcatcgagagtttcaaggttgagagtcctaacgtgaagtacacagagactgagattcagtccgtgtacaactatgaaaccactgaacttgttcacgagaacaataatggcacttatcagtgggttgtcaagcccaaaactgtcaaatatgaatttaaaaccaacacccatgtccctaaactaggggtaatgcttgtggggtgggggggaaacaatggctcaaccctcactggtggtgttattgctaaccgagagggtatttcatgggcaacaaaggacaagattcaacaagccaattactttgggtcgctgacccaggcatcagctatcagagtggggtctttccaaggggaagaaatatatgctccattcaagagcctgcttccaatggtgaaccctgatgatgttgtgtttgggggatgggatatcagtaacttgaacctggctgatgccatggccagggccaaggtgtttgatatcgacctgcagaaacagttgaggccgtacatggaatccatggttccactccccggaatctatgacccggatttcattgctgccaaccaaggagaccgtgccactaacgtaatcaggggcacaaagaaagaacaagttcaacaaatcatcaaagacattaaggagttcaaagaaagcactaaggttgacaaggtggttgtcctgtggacagccaacacagagaggtacagcaacgtagttgtgggactaaacgacaccatggaaaacctctttgcttccttggacaggaatgaggctgagatttccccttccaccttgtatgccattgcttgtgttatggaaaatgttcctttcatcaatggaagccctcagaacacctttgtcccaggactcattgatctggccatcaaaaggaatagtttgattggaggagatgactttaagagtggtcagaccaaaatgaaatcggtgttggtggatttcctagtaggggccggcatcaagccaacatctatagtgagttacaaccatttgggaaacaatgatggcatgaatctctcagcccctcaaaccttccgctcgaaggaaatttccaagagcaatgttgttgacgatatggtcaacagcaacgccatcctctatgagcctggtgaacatccggaccatgtggttgtcattaagtatgtaccttacgttggggacagcaagagggccatggatgagtactcttctgagatattcatgggcggaaagaacacaattgtgttgcacaacacttgtgaggattcactgttagctgctcctattatcttggacttggtccttcttgctgagcttagcactcgaatcgagtttaaagctgaaaatgagggaaagttccactcattccacccagttgcgaccatcctcagttacctgaccaaggcccctctggttccaccgagtacgccagtggttaatgcactgtcaaagcagcgagctatgctggaaaacatcctaagggcttgtgttggattagctcctgagaacaacatgatcctggagtacaagtgaagttcaaagtcttaagagtaatggtttgggatactgtagttgaatgagatcaaaacttaactcatatcccataccctcttttctgttatatatttatggcaaatgtgaaatttaaagatcgttggatctctctatctttgttcctgctgactaatttgagagcaggctatctatgctatgcatgcatgtaaaataatataaagttatcgaagtattttgtgcttaattcatgtttctcttcattccccctttttattttctgtatttagaagaattgacacaacgcctctcttggaaatgataatatagagcgtgttagctttaaataatggtaaggaccacattaaattataatgcattctattaatcaataagagttcttcacaaaatcaatggc

SEQ ID NO: 1640 - DNA, 630 bp, Glycine max var. Williams 82
atggcactctcagtctcctcaccctcatgcgtacgcgttccttcatgtttttggaaaccaaatggcaagagttgcaaagagcgtactaaggtttcatgtgcagctcacaatgataataagaatccgttggttggaatcggtattggggttgtaacgtcttgtgtgatgggtttaactgcattggatgcggacgccacgagaatcgaatactacgcaacagtggcagagcctttgtgtgagtacaactatgttaagtctggcctcggctactgcgatattgctgagggcttcggtgacgaagctccactgggtgagcttatcaatgttcactatactgcgagattcgctgatgggatagtattcgatagcagctataaacgtgctagacctctcaccatgcgcattggtgtgggcaaggtaatcaagggactggatcaggggattttagggggtgaaggagtacctccaatgcggataggtgggaaacgcaaactgcagattcctccgcacttagcatatggccctgaacctgcagggtgcttctcaggtgactgcaatatacccgccaatgccactcttctgtatgatattaattttgttgaggtttattcggggaacagatcaaagtga

SEQ ID NO: 1641 - DNA, 6456 bp, Glycine max var. Williams 82
atggctacctcactcgcttggagacttgctgccaacaatggcaccacccttgccgcaaatgatctggaaagaaatggtgacgggaggactcaagattcagagcccccaactccacattctgttctgaagatgggattgagagagcgtaacagcagcatggaggatccagatgggacattagctagtgttgcccaatgcattgagcagctgcgtcagagctcatcttctgtgcaggagaaagagtattccttaaggcagttgttggagcttatagatctgcgtgaaaatgcttttagtgctgttggatctcactctcaggcagttccagtacttgtttcccttctccggtccggttcattgaatgtgaagatacaggcagcaactgtcttgggctccctttgtaaagaaaatgagctaagggtgaaggtcttgcttggaggatgcattcctccattgcttggtctactaaagtccagttctactgaaggccaaattgctgctgcaaagactatttatgctgtctctcaaggtggtgtaaaagatcatgttggttcaaaaattttttcaactgaaggagttgtaccagtgctctgggagcagctgaaaactggcctgaaggcaggaaatgtagttgaaggtttattgactggtgcattgaaaaatctctccagcaatactgagggattctggaatgcaacaatacgagctggagcagtggacatattagtgaagttactggcaacgggacagcctagcagtttagctaatgtgtgcaatttacttgcttctgtaatggtggaggatgcatctgtttgttcaaaggtgttgacagcggaggtgacaaaacaacttctgaaactattaggcccaggtaatgatgactctgttagagctgaagcagctggtgctctgaattctctttctgcccagtgcaaagaggcacggcgagagatagccaatgctaatggtattcctgctttgattaatgctaccatagctccttccaaagaatacatgcagggtgagtgtgctcaagcattacaggagaatgctatgtgtgctctagcaaacatctctgggggtttgtcttttgtcatatctagccttggccaaagtcttgaatcatgcacctcacctacccaaattgctgacacattaggagctttggcatcagctctcatgatatatgataacaaggcagaatcttccagagcatcagatcctttggttgtcgagcagacattactcaagcaatttaaacctcgcttgcccttccttgtacaggaacgaaccattgaagcacttgctagtttgtatggaaattccatactttcaaataaactcgcaaattctgatgcaaaacacctgcttgttggtttgataacaatggcagctaatgaagttcaagacgagcttataaaagctctgttgacactgtgcaaaagtgaaggcagtctatggcgtgcacttcagggccgtgaaggggttcagctattgatatcccttttggggctttcatcagaacagcagcaagagtgtgcagttgccctgctttgccttctatcatatgaaaatgatgaaagtaaatgggcaattactgctgctggtggcatacctccacttgttcaaattttggagacaggatctgcaaaagcaaaggaagattcagcaacaatccttaagaacctgtgcaatcatagcgaagatatacgtgcttgcgttgaaagtgctgatgctgttcctgcattgttgtggctattgaagaatggaagtccaaatgggaaggatattgcagcaaagactttaaatcatttaatacataaatctgacactacaaccattagtcagcttacagctttattgactagtgatcttcctgattctaaggtttatgtcttggatgctttgagaagtatgctttctgttgctccccttagtgaaattttacgtgaaggtagtgcttccagtgatgcatttgataccatgataatattattgagctctaccaaagaagaaactcaggaaaagtctgcatcagctctggcaggaatttttgaaacaaggaaagatgtgcgtgaaagtagcattgctgttaaaactcttttgtcagccatgaaattgcttaatgctgaatctgaaagtatcctgattgagtcctcacactgcctggctgcaatatttctttccatcaaagagaacagggatgtagctgctgttgctagagacacattatccaccctagttgcactagcaaactcttcagttttggaagttgcagagatggccacgtgtgctctggcaaacctcattttggatagtgaaattgcagagaaagctattgcagaagaagttatcttacctgctactagaatattatgtgaaggcacaatttctggaaaaacccatgctgcagcagcaattgctcgtctcctgcattctcgggatgttgattatgctgtaactgattgtgtgaatcgtgctggaactgttcttgcattagtttctttcttagattctgctgttaatggatctgttgccacatcagaggctctagaagcacttgccatcctgtccaggtcagaagagaccagtgcaaatattaaatctgcttgtgcagttttggctgaattccctaaaagcataagcccaatagtcttgtgtattgttgattcagagccaacattgcaagataaaacaattgagattttatctcgattgtgtaaggatcagcctgttgttttaggcgatactatcgtgtcagcacctggatgtatatcttcaatagctaagaggataattagttccacagatgtcaaggccaaaattgggggagcagcacttcttatttgtactgcgaaagccaatcatcagagactggtggaggatctccattcgtcaaacttgtgtgccgatcttattcggtctcttgttgatatgcttacttctgcacagccttctttgggttacctggatgatgacaacaaggaattcattagcatatgcaggtacacaagagaagaggccaatggttgtgaatccaacactagcactagcattatatgtggtgctgacttggcgatatggttactgtctattctggcttgtcatgatgaaaaaaataaaattgcaataatggaggctggagcaatcgatgttctcattgacaggatctcaaattgtttctcacaatattctcagattgaatacaaagaagatagcagcatgtggattcatgctttgttgttggcaatattatttcaaaatagagatatcatacgggcacatcccaccattaaatctgtaccagcacttaccagtttattgaagtcagaggaatcagcaaacaaatattttgctgcacaatcaatagctagccttgtctgtaatggtagcaggggaacacttttgtctgtggcaaattctggggcagcaggtggacttatctctttgcttggctgtgctgatactgatatacaggatcttctggaattgtcagaggaattttctttggtgcgttatcctgatcaagtggctcttgagaggttgtttagagttgatgatataagagtgggagccacttctcggaaggcaatacctgctctagttgatctgctcaaaccaattccagatcgtccaggagcaccatttttggcacttgggcttttgactcagcttggtaaagattgtccttcaaatatgagtgtaatggtggagtctggggccttagaggcacttacgaagtatctttcactgagtccacaagatgcaactgaagaagctgctacagatctgctaggaatcctgtttagcagtgctgaaatacgaaaacatgaatcagcatatggtgctgttgctcaacttgtagctgttctacgtttaggaggaagaggagcaaggtatagtgctgcaaaagccttggaaagtttgttttctgctgaccacattagaaatgcagagattgctcggcaagctgttcaaccattggtggagattctcagtaccggttcagaaaaggagcagcatgctgctattgctgcattggttgggttactgagtgaaaacccatcaagagcacttgctgttgctgatgttgagatgaatgcagtggaagttctttgtaggatcatttcatcaaattgttcaatagacttgaaaggggatgctgctgaattatgctgtgctctttttggaaatacgaggattcggtccacagcagctgctgcatgctgtgtcgaaccacttgtctctctccttgtgactcagttcagtcccgctcagctttcagttgtccgggcattggataggcttgttgatgatgagcaactggctgaattagttgctgcacatggtgcagttgttcctcttgttggtctactgtctggtaggaactatatacttcatgaggctatttccagagctctggtcaagttaggaaaagacaggcctgcttgtaaagtggaaatggtgaaagttggagttattgaaagcgtacttgacatcttacatgaaggacctgattatctatgtgcagcttttgctgaactgttgcgtatattgaccaataatgctagcatagctaaaggaccatctgctgctaaagtggttgaacccttgtttttgttgttgacaagacaggaatttgggcctgatggacagcacagtgcattgcaggttttggttaatatcttagaacatccacagtgtcgtgctgaccattcattgacttctcgccaagttattgaaccacttatccatttgcttgactctccaatttcagcagtgcaacagttggctgctgagcttctttcacatctacttgtagaagaacgccttcagaaggatccagtgacacagcaagccattggccctctcgttcgagttcttggttctggtatacacatattgcagcaaagagctgtaaaagccctagttagtattgcactaacatggcctaatgaaattgctaaagagggtggtgttattgaaatttccaaagtgatattgcaagctgacccttcccttcctcatgctttatgggaatctgctgcctcggttttgtcaagtattctgcagtttagctctgaattctacttggaagttcctattgctgtattggtaaggttgcttcgatcaggctcagatagcacagttgttggtgctttaaatgctcttttggtgttggaaaatgatgacggaactagtgcagaagctatggctgaaagtggtgctatagaggctctcttggagctcctacgatctcatcagtgtgaggaaattgctgcaagacttttagaagtattgctgaacaatgtgaagattcgagaaacgaaagtaacaaagtcagctatcgtaccattatcacagtatcttttggacccacaaactcaagcacagcaggcaaggttgttggcaactttggctcttggggatctgtttcagaatgaggctcttgctcgaacaagtgatgcagtttcagcttgtcgtgctttagtgaatgtgcttgaagagcaaccaacagaagaaatgaaagttgtagccatatgtgctttgcagaatcttgtgatgtacagtcgatcaaataggagagcagttgcagaggccggtggtgttcaggttgtattggatctgataggttcaagtgatccagaaacatcaattcaggcggcaatgtttgttaaacttctcttctcaaataatactattcaagagtacgcttctagtgaaacagtcagagcaattactgccgctattgagaaagatttatgggcttctggaactgtgaatgacgagtatctgaaagccttaaattctctatttaccaacttcccaagacttagagcaactgaaccagcaacccttagcattccccatctggttacagccttaaagacaggttcagaggcttgtcaggaagctgcattggatgcacttttcctgctcagacaagcttggtcagcatgcccagctgaagtttctagagctcagtcaattgcagctgcagatgcaattccattgctgcagtacttaatccagtctgggccacctcggtttcaggagaaagcagaatttttattgcagtgtttgccagggacattggtggtgatcatcaagcgtggtaacaatatgaagcagtctgttggaaacccaagtgtttactgcaagcttacacttggcaacactccaccaaggcaaacccaggtggtttcaactggccctaatccagagtggggtgagagcttttcatggacctttgaaagtcctccaaaaggccagaagcttcatatttcttgcaaaaataagagcaaagtgggaaagagtaaatttgggaaagttacaatccagattgatcgagtggtaatgcttggatcagtagctggagagtatgctttgttgcctcaaagtaaaagtggccccccacggaatctagaaatagaatttcagtggtctaacaagtga

SEQ ID NO: 1642 - DNA, 1524 bp, Glycine max var. Williams 82
ctcaattttaaagggttttgtttcttaacagaagttttctatatatgtgtatgcaccgaatcgccgcactgataagtccatagagcatggatgctacatcctcacagtttgtttcctcaagaagaatgggtgtatatgatcctatccaccaaattagcatgtgggaagaaactttcaaaagtaatgatactaataatttaactgtatccacatccataattggggaggtggagatgaagttagataatcaggttcatgtgcaatcagaggatgcttctcatggaatatttggaacatctgtgaagtacgaccaagatgccaacaggcttactgataagacacaaagacgtcttgcacaaaatcgagaggccgctcgcaagagtcgtttgaggaaaaaggcatacgtgcagcagttagaatcatgtcgtttgaagctcgtgcagctagagcaagaggtagatcatgcaaaacaacaggcaacaaaactgcagggattgtatattggcgacggattgggttctaataatttgggttttgctggctctgtaaattcaggaataacgcttttcaagatggagtatggaaactggctggaggagcaaaatagacaaattttagaactgagaactgctttaagttctcatataggtgacatacagctcgggacacttgtacagggcataatgaaccactacaccaaactctttagcatgaaatctgctgcagcaaaagcagatgttttctatgttatgtctggtatgtggaagacaacagctgaacgatttttcttgtggattggaggatttcgcccctctgaacttctaaaggttctggtccctctaagtgaacctttgacagagcaacaacggtttgatgcttatggccttgaaaaatcatgccagcaagcagaagatgctctttcacaaggtatggaaaaacttcagcaaatgctcgctgactctgtaggaccaggacaactagttgaaggaactcacattccccaaatggatactgcaatggagagactagaagcacttgtgagctttgtgaaccaggctgatcatctacgacaagaaacattgaggcaaatgtatcgaatacttaccacacgtcagactggtcgatttctgcttgatttgggtgaatattttcaacgcctgcgggctttgagcaaactttgggctaatcgtcctcaagaacttactaagtcagtcatcaaacattagttatagccaacaacaccttaaacttatcatcaagtgtctatatcattatcaaaaccatgttccggctgctcgcatttttccagcactgagaagttgtaaagttggttatcatgtagaatgtaaaatagtacatctacgtgttttgaaaactgcataatcctttttttttttctttgatagaaataatttgagagtaaagaaaactactaccaatagaagttaaattatctttagttagttcctgaaaggatatgtctattgccaatttaatatatttattgtcacccctaattaaaaa

SEQ ID NO: 1643 - DNA, 1428 bp, Glycine max var. Williams 82
atggcggcgatgcagaggccactcaagagaaccattgcaatcgccaagctacgcgcgtgcttttcctctctccgacccgccgccgccgccgacatcgtcgcgtctcctccgccgcagctcccgccgttcgatcaccagccgcacccttacaacggtcccttcgccgatgaagtcctcgccaagcgcaaaacgttcctcggtccttccgtcttccactactataagaaacctctgaatatcgtggaagggaagatgcaatatctgtatgatgatagtgggaggcgttaccttgatgcatttgcggggatagttactgtttcttgcggacattgccaccctgaaatcttgaatgccatcacggagcagagcaaacttctgcagcatgctacaaccatatatctacatcatacaataggtgattttgctgagtcattggcagcaaaaatgcctggaaaccttaaggttgtttattttgtaaattctggttcagaagcaaatgaattagcaatgatgatggcccgtttatatactggtagtcttggtatgatttctttgagaaatgcatatcatggggggagttctagtacacttggtttgactgctctgaacacgtggaaatacccaattccagagggccatgttcatcacgttatgaatccagatccatatcgtggagcctttggtgcagatgctgctagttatgcaaatgatgtccaagaccatattgactatggaacttctggaaaagttgctggatttatagctgaaacaatgcagggagttggaggagctgttgaactggcaccagggtatttgaaacttgtttatgacattatacataaggctggtggtgtctgcattgccgatgaagttcaaactgggtttggtcgaacaggaagccattattggggatttgagacacagggtgtcattcctgatatagttaccatggcaaagggtattggcaatggtctgccattaggagctgtagttacaactccagaaattgcaagtgtgttggcccaaaagattcaatttaatacctttggtgggaaccccgtttgctctgctggtggacttgcagtgcttagggttcttgataaggagaagcgtcaagctcactgtgccgatgttggatctcatttgcttgaacgattgagatttctcatggaaagacatgacatcataggaaatgtaaggggaaggggcctaatggtaggcatagagttggtcactgaccgagacaacaagacacccgcaaaggctgaaactgctgtcgtgtttgaaaaactcagagagcttggtgtgctagttgggaaaggaggacttcatggcaatgttttcaggatcaagccaccaatgtgtttctccaaagatgatgcagattttcttgtggatgccttggattattctctatcaaagttgtga

SEQ ID NO: 1644 - DNA, 1497 bp, Glycine max var. Williams 82
atgatttggatagcagcttttttagtttctcttgcttttctgtggttatggataagcaacaagaatgcaaagaaattaccacctggtcccatagggttgccaattttgggaagccttcacaagttgggtgcaaatcctcatcgtggcctgcaccaactagcccaaaaatatggacctatcatgcacttacgcttaggttttgtgcccaccatagttatttcttccccccaagctgctgaactgttcctcaagacccatgaccttgtctttgctagtagaccaccccatgaagctataaagtacattgcttgggagcagaggaacttgggatttgctgaatatggttcttactggcgcaacatgcgcaagatgtgcacattggaattgcttagccaaaccaaaattaactccttcagaatcgtgagagaagaagaacttgacctatccatcaagcttctaagagaggcatccaatgatggagctgctgctgttgatatcagtgccaaggttgcaagaatcagtgcagacgtggcttgtagaatggtcttgggaaagaagtacatggaccaggacttggatgagaaggggtttaaggctgtggtgcaagaggtaatgcacttactagcaactcctaacataggtgattacattccttacattggtaaacttgaccttcaagggctaatcaagcgtatgaaggcggttcgcaaaatctttgatgaattctttgacaaaattattgatgagcatattcaatcagacaagggacaagacaataaggtgaaggattttgtggatgtcatgttgggctttgttggtagcgaggaatatgaataccgtattgaacggcccaatatcaaagctatattgctggatatgctgttgggttcaatggatacttcggctacagtaattgagtggacactttcagagctcctaaagaatccacgggtgatgaagaaagtccaaatggagttggaaactgtggtgggtatgcagaggaaggtgaaggaatcagacttggacaagttggagtatttggatatggttataaaggaaaacatgaggctccatccagtggcaccgttactaataccacaccaatcgagggaagattgcatggttggagattttttcataccaagaaaatcaagagtggtaataaatgcatgggcaattatgagagactcaagtgtatggagtgaggcagagaagttctggccagagagatttgaaggaagcaacatagatgtgagagggcatgacttccagtttataccattcgggtctggcagaagggcctgtccaggaatgcaaatgggtctaacaatggttcgactaacagtggcacaacttgtgcattgttttcattggaaactgccgagtgacatgttgccagatcacttggacatgacagaagagttcggcctcactatgccaagggccaatcatctacttgccgttccaacttatcggcttcacactgcaagtgattag

SEQ ID NO: 1645 - DNA, 711 bp, Glycine max var. Williams 82
atgacagggacgaagagaaaccaaattacaacaagtcctgtgggaagtccaacatctggtaacatctcagacagctactcttcaaaagaacaagacagattcctcccaatagccaatgttagccgaatcatgaaaagggcactcccagccaatgcaaaaatctcaaaggaagcaaaagaaacagttcaagagtgtgtgtctgagttcataagcttcatcactggtgaggcctcagacaagtgccagagggaaaagaggaagacaatcaatggtgatgatcttctttgggccatgacaacactaggatttgagaactatgttggacccttgaagctctacctcaacaactacagggaaactgagggagaaaagagttctacttctatggcaaaacaagaagaacttcactctccaactcatcaacaccaaaccaatattgatggggtggttgaaatcaacaagttattgcctcattctgtggctgcagcaaccaaagcttcggacttcaacaacactactttcagtgctggtggcttctattctgtggggcctcatcaagtaactgctccaaagagcttcactgagatgggagggttgaatggttatagagagagttccattgctcaaagtgcgctcagtgctgatcaaattcaagatgcaagtggcaatagaatgatgccacccaacctacgttatagggttgaatggtag

SEQ ID NO: 1646 - DNA, 1134 bp, Glycine max var. Williams 82
atggagcttggtttgagcttaggagactcttcaaggcctttgcttggtttcatggaaaagcctcgtgaagccacctccaaccaactggggttaggcttcaacacaacgttatcaattggtccaatcatcactagacaaaaagatcatcaacaagatgaagatgaagaataccaagatgaagaaacaaagccaaataacaacaacaacactcacagaacagaagatcctaatgacctttgttccaaacccaacaacaacacagttctgcatcaacttgattttctccctcaacttgctctcccatggcaccctccttctgaaaacgggagtttatcatccgagttgggaggttcttcacgggggctggacgtgaacgtgcaacctccagcggcggaggacgaggcggcgcggtcgtcgtctccgaacagcgccgcctcgtcgtttcaaatggatctctgcatatacaacagcagaggagggagctctaataagagggactttgagggtgaggcctatgatcaaaggacttcttcaagagctagcgatgatgatgacaataatggtagtggtggtaacaccaggaagaaactcagactctcgaaggaacagtctgcgttccttgaagagagtttcaaggagcacaacactcttaatcccaaacaaaagcttgctcttgctaaacaactcaatcttcaacctcgccaagtagaagtttggttccaaaaccgaagagcaaggactaagttgaagcaaacagaagtggattgtgagtacttgaagagatgttgtgagacactaacggaagagaatagaagacttcacaaggagcttcaagaattgagggctttgaagacttcaaacccattctacatgcaattaccagccactactttgaccatgtgcccttcttgtgaacgcgtggccacaaattccacatccacttcctcatcaatgagtgccaccatcaatgctactaattcaggagccacggcctgtgtcaaaacaggtaataacaataacaacaatgactcaccctccaaacccattggattcccctttggcaaacccaggttccacccatttgttcacagtagccaacaacaactccatcagcaccaatcctcagcatcttga

SEQ ID NO: 1647 - DNA, 1332 bp, Glycine max var. Williams 82
ggcactgctgcaagtgcaactccaagaagcgcagtgccaagccaccatgtttcaacattcaacagaagcctttttccttccacttttctctttggaattggttcttctgcttaccaggcagaaggagcagcaagtgtagatgggagaggaccaagcatatgggacacctacactagacagcatactgaaaagatttgggatcatagcaccggtgacatgggagctgatttttatcatcgatacaagggtgacataaaaatagcgaaagaaattgggctggactctttcagattctctatctcatggtcaagaatattcccaaagggcaagggagcagttaacccccttggggttaaattctacaacaatgtcatcgatgagatcctagcaaatggtttaaaaccttttgtcactctttttcattgggactttccacaagctcttgaagatgagtatggaggattccgtagtcctaaagtagtggcggattttcgtggctacgcaaacttctgcttcaagacctttggagacagagtcaaatattgggtcactttgaatgaacccttatcatttagtctcaatggctacaatggtggcacctttgcaccaggacaaattgggatcactaatccaacacactactttttgccaaaatctcaaagtgctgcagattacaaggcagcaagtagagctctggacttcttctttggttggtattctgatccggttttctatggtgactatccggagagtatgaaatcttcagtaggttctaggctcccaaaattcacaaaagctgaatctgaaggtctaaaaaattccatagattttcttggtgtgaattactacaccacttattatgcggaacatgctgaacctgtcagtgccaaccgaaccttctacacagacatactagccagtctcagtagtaagtacttatggcaaaaccaaactgatttgaattggctctttatctttccaaagggaattcatcttcttatggcacacataaaggataaatacaagaatcttcctatttacatcactgaaaatggcatggctgaatcaaggaatgactcaataccagtcaatgaagcccgcaaggatagtataaggattagataccatgatggccatcttaaattccttcttcaagcgatcaaggaaggtgttaatttgaagggctattatgcatggtcattttcggacagttttgaatgggatgctggttacacagttcgattcgggctcatatatgtggattacaagaacaacttgaaaagataccccaagttctctgctttttggttgcaaaagttccttctcaagtga

SEQ ID NO: 1648 - DNA, 1077 bp, Glycine max var. Williams 82
atggcttggcactcgttcctcttattagcgacggccattctcgccgttgtgtgctccgccgtgagcggttgctcgccatcggatagggcggcgctgctggccttccggaaggcgctgagcgagccctaccttggcctcttcaactcgtggacgggctccaactgctgcctcgactggtacggcatcagctgcgacgccaccaccggccgctccgaagaccccatcttcgagaaagccggtcgctccggctacatgaccggaaaactctcagaggcgatctgcggcatcgacaccctcaccaccctcgtcgtcgctgattggaaagacattgccggggagatccccacctgcgtcaccgcgcttccctccctccgcatcctcgacctcatagggaacaagctctccggcgagatcccggccgacgtggggaaactctcacgtctaaccgtcctgaacctggccgacaacgccctaagcggcaaaattccagcgtccatcacccagctgggctcactcaaacacctggacctcagcaataatcagctctgcggcgagattccggaagacttcgggaatctgggcatgctgagccgcatgttgctgagccggaaccagctaaccggtaaaataccagtttctgtctccaagatttaccggcttgcggacttagacttatccgcaaaccggttatccggttctgtcccgttcgaactcgggacaatgccggttctatccacactgaatttggatagtaactctttagagggcttaattccttcgagtttgttgagtaatgggggtatgggcattttgaaccttagtcgaaacgggtttgaaggctccatacccgatgtgttcgggtcacactcgtatttcatggctttggatttgtctttcaataatttaaagggtcgggtaccctcttcgttggcttcggctaagtttatcgggcatttggatcttagccataaccatttgtgtggatccattcctctcggagcacccttcgatcacctcgaagcgtcgtcgtttactagcaatgattgcttgtgtgggaaccccttgaagacttgctag

SEQ ID NO: 1649 - DNA, 276 bp, Glycine max var. Williams 82
atggaggcatccattatgttacctcttgaaaggacttcgtcaattgaaagagagcccaggactcttaatatcaaccaaattcaatccgctagggagttagcaatatatatattgaacacaaagaccatagaagaagcgtccagaattttcacggaggggttgcagccggtggttagtgctgctccaaagatgggtttgggtgaagaagttgaagtgttggactccaaagtagcctccgtagcagcattcagggacatagcatctgcacctttctag

SEQ ID NO: 1650 - DNA, 652 bp, Glycine max var. Williams 82
acaactactccaccattagtgagagaagcttaatttctattttcatgtttttcggatttgcatcggggcaaaggaaaaaatggaggcatccattatgttacctcttgaaaggacttcgtcaattgaaagagagcccaggactcttaatatcaaccaaattcaatccgctagggagttagcaatatatatattgaacacaaagaccatagaagaagcgtccagaattttcacggaggggttgcagccggtggttagtgctgctccaaagatgggtttgggtgaagaagttgaagtgttggactccaaagtagcctccgtagcagcattcagggacatagcatctgcacctttctagctaacattgttgtgctgttgtgcaataattgcagaatatattactccacttattagttagcttgtacatatcatctgccatacacgttgaaattttgggttcccaactatatttcatttgattcgttatccccttttttggatgcttttccaataattaactgcctcattatacatcatgcatgttttggtacacgacaaggtattgtaaaataattggaactcaattactatatactactattcaaaatcatgggcggtttggtttagtggaacaatatataattaattaatttgt

SEQ ID NO: 1651 - DNA, 303 bp, Glycine max var. Williams 82
atgaactgtagagaaaccagtaatgccttagccgagattaaacatgctattgatgggatccaaaagctgtggctgtggaggatgttgctgcagctgttgttgctcttgttgttggtgctggtgatggtgctgctgctgctgcaagccagcatcggtggctaccgccaccgcactcgaaggagttcccttggcttcaacaaatctccacatgtaccacgaagcaacggaccggtaaggcctccacttgtcacacaactggtccatctgcgagggccggggcaagtcctcgaggttgtagagtga

SEQ ID NO: 1652 - DNA, 5715 bp, Glycine max var. Williams 82
atgggcgcgggacgaagttggttccaaaatccaaatattgggttgacgaaatggcggtggagaggaagaagaatgtcgaatccggatcagacagtattgaatcggcggccatcaagaagtgccgcgacgacgacgttttcgctggaggtgttcgacaacgacgtcgtgccctcctcactcgcctccatttctcccattctcagagtcgccaacgaaattgaaaccgagcgccccagggttgcttatctctgtaggttctatgccttcgaaaaagcgcacaggctagatcagagttctagcgggcgtggcgtcaggcagtttaagacgttgttactacagcgattggagagggacaatccaactagtcttgcctctcgggctaagaaaacagatgcgagagaaattcaatcttactatcagcaatattatgaacattatgtcagaactctcgaccaagtgaatcaggcagacagagcccagcttagcaaagcttaccagactgctggggttctattcgaagtgctttgtgccgtcaacaagactgagaaggtcgaagaagttgctcctgagattatcgcggctgctagagatgtccaggagaagacggagatttatacgccttacaatattcttcctctggatgctgctggtgcttctgtgcccattatgcaatttgaagagattaaggctgctgtttctgcgctttggaatactcgtggcttgaactggcctaattcatttgagcaacagaggcagaaaactggagatttagacatgcttgattggcttagagccatgtttggctttcagagggacaacgtcaggaatcagagagagcatctgattttgcttcttgctaattctcatataaggctacaccctagacccgagcctttcaacctgctcgatgatcgggctgttgattcagtgatgaaaaatctcttcaagaattacaaatcatggtgcaaattcttgggacgaaaacatagtttacgacttcctcaaggtcagcaagagatacagcagaggaagttgctttatatgggcttgtatcttcttatctggggcgaagcatccaatgttcgtttcatgccagagtgtctatgctacatatttcacaatatggcatatgaactccatggtttattggctggaaatgtcagcattgttactggtgaaaatatcaagccttcttatggtggtgatgatgaggcattcctgcgcaaggttataactcccctgtatcaagtaatacaaaaggaagcaaagaagagtggacatggaaaggctccgcactcagcatggtgcaactatgatgatctaaatgagtatttctggtcatctgattgcttttctctaggatggcccatgcgtaatgatggtgaatactttaaatcaacaagtgatttggcacagggaagaaatggtgctgctgcaagaaaatctggaaaaactggcaaatcaaattttgttgagacacgaacattctggcacatcttccgcagctttgaccgtctgtggacattttttatactgggtttgcaggtgatgttcattattgcttgggaagggatttcactgacggatatatttcagaaggatgtcttatataatctatctagtatattcatcacagcatccattctgcgcttgcttcaaagtatcttggacctgatcctgaactttccaggctatcatcgatggaaattcactgatgtgctaagaaatattcttaaagtctttgtcagtcttttttgggttatcattcttccactcttctatgttcattccttcaagggtgcacctcagggtctgaagcagttgctttcctttttcaaacaaataagaggcattccagcattttacatgctggcagttgcattatatttgcttccaaatttactagcagctgttctgtttcttttcccaatgttaaggcgttggattgaaaactcagactggcacatagtcagactcttcttatggtggtctcagccaagcatctatgttggaagaggaatgcatgatagtcaatttgctctcatgaagtacactatattctggttgttgcttttgacatgtaaatttttattcagcttttttgtccagataaaacctctagttaggccaacaaaggacataatgagcattcgacgtgttaattatggctggcatgcattttttcccaatgctcgaaataactatagtgcagtagttgcactctgggctcctgtacttttggtttatttcatggacactcaaatttggtatgcaatcttctcaactttgtacggtggtcttgttggagcctttgatcgtctaggagagatacgcactctgagcatgctaagatcacggtttcagtcattgcctggtgcattcaacacatgcttggttccttctgataagaagactaaactatgtttgcatgactccagggagatggatcttttgctagttccttactcattgggtcataatctgaaaataattcagtggccaccatttttgcttgcaagcaagattactgtagcactagatatggcaactcagtttcgagggagggactctgatctttggaagcgcatatgtgctgatgaatatatgaaatgtgctgtgattgaatgctatgaatcctttaaacatgttctacatgatttagtgataggagaaactgaaaaaagtataatttcctccatcatcaaagaagtcgagagcaacatctcaaagaatacacttcttacaaatttccgtatgggctttctaccctccctttgtaagaagttcgtggagcttgtggaaatcatgaaaaatggagatccatccaagcggggtacagtggtggtcttgctgcaagacatgttagaagtggtcactgatatgatggtgaatgaaatcagcgaattggcagaacttcatcaaagtagtaaggataccggacaacaagtttttgctggtacagaggcaaaacctgctatactattccctcctgtggttacagcacaatgggaggaacagattagacgtctttatctactcttgactgtcaaggaaactgccgttgaagttccaacaaacagtgaagtacgtagaagggtttcattctttaccaattcattgttcatggatatgccacgtgctcctcgagtacgtaaaatgctctcattcagtgtcctaactccatactacagtgaagagacagtatattctaagaatgacattgaggttgagaatgaagatgaggaatggaataacttcttggagcgacttgattgtaagaaagatagtgatatatgggagaaagaggagaatatattacagctacgtcactgggcctcattaaggggacaaacactttgtaggacagttaggggaatgatgtactaccgacgagcaataaagctccaggcatttcttgatatggcttctgaaaaagagatattcgatggttataaagctattgctgttccatctgaggaagaaaaaaagagtcatagatccttatatgcccgtttagaggctatggctgacttgaaattcacatacgttgcgacctgtcagcaatatgggaatcagaagcgctctggggaccgtcgtgcaacagatatcctgaatttgatggttaacaatccctcacttcgtgttgcatatattgatgaagttgaagaaagagaaggtggaaaagtacagaaagtttattattctgtattggtcaaagctgtggacaatcttgaccaagaaatatatcgaataaagcttccgggcccagcaaagttaggagaaggaaagccagaaaaccaaaatcatgccatcatttttactagaggggaagctcttcaggctatcgacatgaaccaggataattatttggaagaagctttgaaaatgcgtaaccttctggaagaatttaatgaggatcatggagtgcgcccccccaccatattaggtgttcgtgagcatattttcactggaagtgtctcttccttggcctggtttatgtcaaaccaagaaactagctttgtcactattggtcaaagagttcttgctagaccactaaaggttcgattccactatggtcatccggatgtttttgatagaattttccattttacccgtggaggaatcagcaaggcttcttgtggcatcaatctgagcgaggatatatttgctgcaatatttgatatttctacctttgcatcatatgcctttgcctatacaggattcaactcaacactaagacgtgggaatgttactcatcatgaatatatccaagttggaaagggtagagatgtagggctcaatcaaatctctctttttgaagcaaaagtggcctgtggtaatggagagcagatactaagcagggacatctacagactggggcatcgatttgactttttccgcatgctatcattttactttacaaccgttggattttatatcagctcaatgttagtggccatcacggtatatgctttcctctatggcagattttacctgtcattgagtggattggaggaggctataattaagatagccaggaaaaagggagatgatccattaaaggcagcaatggcttcccaatcccttgttcaaataggtcttctgatgactcttcccatggttatggaaattggactagagagaggattcagaactgcactaagtgacatcataataatgcagctgcagctagcacccgttttcttcactttctcactagggactaagatgcactattttgggcgcactctcctgcatggaggggcaaagtacagagcaactgggcgtggttttgtagttcgtcacgagaggtttgcagataactacaggatgtattctaggagtcactttgtaaaagggatagagatttctatactgcttatatgttatgggctttatggatcagcagctcctgattcaacagcatatgcccttctctcagtatcaatgtggtttttggcatgttcttggttgttcagtcctttcctttttaacccatcgggattcgagtggcagaagattgttgaggattgggatgattgggcaaaatggataagtagtcgaggtggtattggtgttccttcaattaagagctgggaatcatggtgggatgaggagcaggaacatctgcagtacactgggatttgggggaggatttgggaggtcattcttgccctgcgtttctttgtctatcagtatgggattgtgtatcatctacatgttgctagaggtgacaagagtatcggggtttatggtctgtcctggttagttgtagtggctgtcatagtcatcttgaagatagtgtccatggggagcaagacattcagtgcagatttccagctgatgtttcgtctcctcaaaatgtttctgtttattggaaccattgtcattctaattttgatgtttgtcctacttagtttcacagttggtgacatctttgcgagcctcctagcctttatgcccacaggttgggcatttatacagatagctcaagcatgtaagccattggtgaagggaattggaatgtgggggtctatcaaagcgttatcaagagggtatgaatacgtgatgggagtgattatctttgcaccagtggccataatggcttggttcccttttgtttccgaattccaaactagactgctatacaaccaagctttcagccgagggcttcaaatccagcgcattctggctggtggcaagaagaataaataa

SEQ ID NO: 1653 - DNA, 1383 bp, Glycine max var. Williams 82
atgtattcaattgcaatggaatcaccgcaaggcttcccacactatacaaaggaggacctccacatcatgaaaagcagaggcaagaagaagaatagagcaagagaaattggaatggaaggcagaggtggaggagaagtgagaaggcttcacatcatttacttccttagtcagataggtggtcgtgcagatcatcctcatctgattcgtgttcttcatcttgctcgaaatggggtttatctaagagatgtaaagagatggcttggggaattgagaggaaaagacttgccagatgctttttcttggtcctacaagaggaggtacaagagtggatatgtgtggcaagacttgttggatgacgacctcataacccccatctctgacaatgaatacgtcctcaaaggatcacaaatccaccctaccccatttgcaacaactccttcacttgatgaaaagaaaactactgtttgtgatatccatgctgagaagaaatgtagtcaagtacaaactatagaggacaaaaaccagcagccgcctctagcagaagaagaacctcgaattcaacgagacttggatttgaaaacggatactccgacaaaagggtcatcagaaatcagccaggactcatcattggtcttcagctcagacaggtcatctgtgacagatgatgactcttcaaaggtcgaagaagagaagcatttagaggcaacaggcaaagacggcttcaacgaaatcaaccaagacaagttagaggattgctcattgccttccttgtatcacaatctgttgagtaagaaggctagccacaaagatgacctgaataaaaccaactcacctgattcatcctcctccactatatcatcatcttcatctcaatcctcctttactaagatcaggagcaattctgccagagtttctaatgtgttccgcaattggatcacttgtggcactgtggaaacaaatgatgcagccctggtccaaatgaacctggctcaaaagaatttatctaaggaacctatcaacatacctgaaagaagggctgagatttgtaagggagacaaattgggaggatcagccaggtgttttgcgacttcttggggtcatcatcaccagaaacaacaatatggggcaagaaaaagctttgatggaaatgaaactagcaggagcaggaaaaagttaggggagttgctaaatcaaacttcttccaaaccatttggtggaccaacctgctcgcaatgcgggaagtcgtttaagcctgagaaaatgcacaaacacatgaagtcttgtaaaggaatgaaagccttgggaaagtcctccacaactgttgaggaggcacagcttcagggatcatcagcttcttatacagattactttttgaccaactaa

SEQ ID NO: 1654 - DNA, 1272 bp, Glycine max var. Williams 82
atggcacgcaagaagatcagagagtatgactccaagagattgttgaaggagcactttaagagactctctggccaggacttgcccatcaagtccgcacaagttacagaatccaccgatttcaatgagctaacagagaaggaaccctggcttttatcttcaaaattggttgtgaaacctgacatgctatttggtaagcgtggcaaaagtggtttggttgccttgaatctggatttggcagaagttgattcttttgtgaaagagcgtcttggcaaagaggttgagatgggtggatgcaaaggacctataacaactttcatagttgaaccttttatccctcacaatgaggagttttaccttaacattgtctcagagagactagggaatagtataagcttttctgaatgtggaggaattgaaattgaggagaattgggataaggtcaagactgtatttatgccaacaggagtgtctcttacatcagagagtattgccccacttgttgcaacccttcccttagagatcaagggagaaattgagggatttctaaaggtgattttcgctctatttcaagatctggattttactttcttggagatgaatcctttcactttggtcaatggaaagccttatcctctggacatgagaggcgagcttgatgatactgctgctttcaagaacttcaagaaatggggaaacattgaatttccattgccatttggaagggttatgagtactacagaggcttttgttcatggattagatgaaaagacaagtgcatctttgaaattcacagtattaaacccaatgggccgaatttggacaatggtagctgggggaggtgctagtgtcatctatgctgatacggtaggggatctcggttatgctcctgagcttggaaactatgcagaatatagtggtgcacccaaggaagatgaggtcttgcagtatgccagagttgtgattgattgtgcaacttcaaatcctgatggccaaaagcgagcccttgtgataggtgggggaatagctaactttactgatgttgctgctacgttcagtggcataattcgtgctctgaaggagaaggaacaaaagctaaaagaagcaaagatgcacatctacgtgaggagaggaggtcccaactaccagaagggtctagcaaaaatgagggcacttggagaggagattggcattcctatcgaggtttatggacctgaggcaacaatgactggtatatgcaaacaggcaatccaatgcatcactgctgctgcttaa

SEQ ID NO: 1655 - DNA, 1365 bp, Glycine max var. Williams 82
atgcatcattttgtgctaaccttattctttttagtttccactatgttggttgatgctagtaaaagcctaatgggctttagcatcgatctcattccacgtcactctccaatatccccattatataactcccaaatgacccaaaccgagttagttaaaagtgctgccttacgatctattactcgatcgaaacgagtaaattttattggtcaaatttcaccaccattatcaccgtcaccgtcaccatcatcatcaccaccatctccaccatcaccatcatcatcatcatcatcacctgctgaaagtatcataactcctatccctgaccatggagaatacctaatgagattctctttaggcactccgagtgttgaaaggcttgcaatttttgacacggggagtgatctctcttggctacaatgcaccccttgtaaaacatgttacccgcaagaagcaccattgtttgatccaacccaatcttcaacctacgtggatgtgccatgtgagtcacaaccatgcacactattcccccaaaaccaacgcgagtgtgggagctcaaagcaatgcatttaccttcaccaatatggtacggactcattcaccattgggagattgggctatgacaccattagttttagttcaactggtatgggccaaggtggtgccacatttcccaaatctgtgtttgggtgtgccttttatagcaatttcacgtttaagataagtaccaaggccaatggctttgtgggccttgggcctggcccattgtcactagcctcgcaactaggagaccaaattggccacaaattttcctattgcatggttccttttagttcaacctctacgggaaaattgaaatttggttccatggcaccaacaaatgaggttgtgtccacaccctttatgatcaatccttcttacccttcatattatgtcctcaacttagagggcatcacagttggacaaaaaaaggtgttgactggtcaaattggtggcaacataatcattgattcggtgcccatattgacacatcttgaacaaggaatttacaccgattttataagttcggtgaaggaagctattaatgtggaggttgcggaagatgctccaaccccatttgaatattgtgttagaaatccaactaacttgaatttccccgaatttgtgtttcattttacaggggctgatgtggtcttaggcccaaagaacatgtttattgccttggacaacaacttagtttgcatgacggtggtgccctccaaaggaatttccatctttggaaattgggcacaggttaattttcaagtagaatatgaccttggagagaaaaaggtttcttttgcccctaccaattgcagcaccatttaa

SEQ ID NO: 1656 - DNA, 702 bp, Glycine max var. Williams 82
atgtacaaggagtgtgcaataaaacaagatgttactgaactaattggaaacactccattgtgtgtggcttgcattgctgcaaagttggaatcaatggaaccctgctcaagtgtcaaagacaggatagcattaagtatgatcgaggatgctgaggacaatggcctgattacaccagggatgactgtacttgttgagactactggtggaaacactggaattggattgacattcattgcagcacttaaaggttacaggctaatcctagcgatgccggctttaatgagtctcgagaggagaattgtgctccgtgctttgggagctgagctgcatctcactgatcctgctatgggcttcagaagtagtcttcaaaaggctgaggagctactgagggagacatgtgatgcttttatgtctcatcaatttgaaaatcctgcaaacccaaagattcactatgaaaccactggccctgagatatggagagattctggagagaaagttgatgcccttgtagcaggtataggaactggcggtacaataacaggtgcagggaaattcctcaaggagagaaattcaaaaatcaaggtctatggagtggaaccagttgaaagtgcagtcttgagtggaggacagccaggagggcatctgattcagggaattggtgctggtattgttcctgctgtgctggatgttaaatctgcttga

SEQ ID NO: 1657 - DNA, 1323 bp, Glycine max var. Williams 82
atgcatgcttttgtattttgtttcttactcctatgttcacattctattgcatccttcgctgaagcctccaaaactctaagtggcttcagcatcaatcttattcaccgtgaatcaccattgtcacccttttacaacccttcactcaccccatcagagcgcatcaagaacactgtcttgcgctcctttgctcgctccaaacgtcgtcttcgcctatctcaaaacgatgatagatcacccggaaccattaccattccagacgaacccatcactgaatacctcatgaggttttacattggcacccctcctgtggaaaggtttgctattgcggacacaggaagtgatctaatttgggtgcaatgtgccccttgtgagaaatgtgtaccccaaaacgccccattatttgatccaagaaagtcttccacattcaagactgtgccatgtgactcacaaccttgcacactactccctccatcccaacgtgcctgtgttggaaagtcaggtcagtgctactaccaatatatatatggtgaccatacattagtctctggaatattgggttttgagtccattaattttggttccaagaacaatgctattaaatttcccaagcttacttttggatgcacattttccaataatgataccgtggacgagagcaagagaaacatgggtctagtgggtcttggagtagggccattgtcactaatttcacaactagggtatcaaattggtcgcaaattctcctattgtttccctcctttgagttcaaactccactagcaaaatgagattcgggaacgatgcaattgtaaaacaaataaaaggggttgtgtccactcccctcataatcaaatctattggaccaagctattactacctcaatcttgaaggcgtcagcattggaaacaagaaggtgaagacaagtgaaagtcaaacagatggcaacatattaatcgattcagggacctctttcacgattctcaagcaaagcttttacaataagtttgtggctttggtgaaggaagtgtatggtgttgaggcagtgaaaatccctccattggtatacaacttttgtttcgaaaataagggtaagaggaaacgtttccctgatgttgtgtttcttttcacgggtgctaaggttcgcgtggatgcttcaaacttgtttgaggccgaagacaacaacttgctttgcatggtcgcattacccacctctgatgaagatgattccatctttggaaatcatgcacaaattggttatcaagtggagtatgatcttcaaggggggatggtttcttttgctcctgctgattgtgccaaagactag

SEQ ID NO: 1658 - DNA, 1311 bp, Glycine max var. Williams 82
atgcatccactcgtgttcttgtctttagctttatacttactttctactgtatcatctagagaagtcagtgaaggccaaaggggcttcagcattgatcttattcaccgtgactcaccattgtcacccttttacaaaccttcactcaccccatcagatcgcatcataaacactgccttgcgctccatttatcaattaaatcgagcttcccactctgatctaaatgaaaaaaaaacactcgaacgtgttaggattccaaaccacggagaatatctcatgaggttctacatcggtacccctcctgtggaaagacttgctatcgcagacacagcgagtgatcttatttgggtacaatgttccccttgtgagacatgttttccccaagacaccccattgtttgaaccacacaagtcttccacgttcgcaaatttgtcatgtgactcacaaccttgcacatcatccaatatatattattgcccacttgtaggtaatttatgcttatacacaaacacttatggtgacggatcatccaccaaaggagtattgtgcactgaatccattcattttgggtctcaaaccgtcacatttcctaagactattttcggatgtggatcaaacaacgacttcatgcatcaaattagcaacaaagtcacaggaatagtgggtcttggagctgggccattgtcgctagtatcacaactaggtgaccaaatcggtcacaaattctcatattgtttacttcctttcacttcaacctctacaatcaagctgaaatttgggaacgatacaacaataactggaaatggggttgtctcaactcccctcataatcgacccacattatccttcctattacttcctccatcttgtaggcatcactattggacaaaagatgctgcaagtgcgtacaaccgatcatactaatggcaacataatcattgatttggggacagtgttgacatatcttgaagtgaacttttaccacaattttgtaactttgttgcgagaagcccttgggatttcagagacaaaggatgatattccatacccatttgacttttgctttccaaatcaagctaatataacttttcctaaaattgtgtttcaatttactggagctaaggtttttctgagccctaagaacctatttttcaggttcgatgacttgaacatgatttgcttggcggtactacccgacttctatgcaaagggattttctgtctttggaaatttggcgcaggttgattttcaagtggagtatgatcgcaaagggaaaaaagtgtcttttgctcctgccgactgctccaaaaactag

SEQ ID NO: 1659 - DNA, 1563 bp, Glycine max var. Williams 82
cctctatcctttactttgaatctgtatatcctcaaaatgcatccactcgtgttcttgtctttagctttatacttactttctactgtatcatctagagaagtcagtgaaggccaaaggggcttcagcattgatcttattcaccgtgactcaccattgtcacccttttacaaaccttcactcaccccatcagatcgcatcataaacactgccttgcgctccatttatcaattaaatcgagcttcccactctgatctaaatgaaaaaaaaacactcgaacgtgttaggattccaaaccacggagaatatctcatgaggttctacatcggtacccctcctgtggaaagacttgctatcgcagacacagcgagtgatcttatttgggtacaatgttccccttgtgagacatgttttccccaagacaccccattgtttgaaccacacaagtcttccacgttcgcaaatttgtcatgtgactcacaaccttgcacatcatccaatatatattattgcccacttgtaggtaatttatgcttatacacaaacacttatggtgacggatcatccaccaaaggagtattgtgcactgaatccattcattttgggtctcaaaccgtcacatttcctaagactattttcggatgtggatcaaacaacgacttcatgcatcaaattagcaacaaagtcacaggaatagtgggtcttggagctgggccattgtcgctagtatcacaactaggtgaccaaatcggtcacaaattctcatattgtttacttcctttcacttcaacctctacaatcaagctgaaatttgggaacgatacaacaataactggaaatggggttgtctcaactcccctcataatcgacccacattatccttcctattacttcctccatcttgtaggcatcactattggacaaaagatgctgcaagtgcgtacaaccgatcatactaatggcaacataatcattgatttggggacagtgttgacatatcttgaagtgaacttttaccacaattttgtaactttgttgcgagaagcccttgggatttcagagacaaaggatgatattccatacccatttgacttttgctttccaaatcaagctaatataacttttcctaaaattgtgtttcaatttactggagctaaggtttttctgagccctaagaacctatttttcaggttcgatgacttgaacatgatttgcttggcggtactacccgacttctatgcaaagggattttctgtctttggaaatttggcgcaggttgattttcaagtggagtatgatcgcaaagggaaaaaagtgtcttttgctcctgccgactgctccaaaaactagcaaataatgatgcttgacacctccatgttgtttaacatctagaaagagattgaggtaaaagagagataattaagaatagatatgatagacaatattatgattaatgataagaagatagagagaaatgattgacgttaaccaagtattgtaatggagaatatatatcatttttgaaaagtaatttatctatctacattacattaactattatattat

SEQ ID NO: 1660 - DNA, 306 bp, Glycine max var. Williams 82
atgcatccactcttgttcttgtctttagccttatactcactttcttctatatcctctggagaagccaatgaaagcctaaggggcttcagcatcgaccttattcatcgcgactcaccattgtcacccttttacaactcttcactcaccccatcagagcgcatcacaaacgctgccttgcgctccatttctcgattaaaccgagtatcaaactttttagatgaaaacagactacccgaatctcttctaatcctagacaaggttgaatacctgtttacactggaatttggtaaacaaccgctagtctaa

SEQ ID NO: 1661 - DNA, 662 bp, Glycine max var. Williams 82
gtgcattcaggttcttgtctttagcctttacttctttgaatttacatttcatcaacatgcatccactcttgttcttgtctttagccttatactcactttcttctatatcctctggagaagccaatgaaagcctaaggggcttcagcatcgaccttattcatcgcgactcaccattgtcacccttttacaactcttcactcaccccatcagagcgcatcacaaacgctgccttgcgctccatttctcgattaaaccgagtatcaaactttttagatgaaaacagactacccgaatctcttctaatcctagacaaggttgaatacctgtttacactggaatttggtaaacaaccgctagtctaagttaattgcttgcgagatcaactagtgaatctcaggagcatgtcacttgtgtattttgcgtttaaatgtaaagcttttgaatgttcatcgttgcagcaaacacttactggttcgaaatttgcagaaagtaaaattgtttaacagaaatcgaaaggctggaaataactaggcaaggaaaggaaaattgcagaatgtaaaggctcagcgagttcattcgatcgaatgaaccatttaaaatgcaggaattataaaacgaaacgtaaattgcattcgaaatgtaaagtttacagaaacttaaaa

SEQ ID NO: 1662 - DNA, 1516 bp, Glycine max var. Williams 82
ctttctctcactctattacagacgcttctttagaacaagcaaacacaactctgctaccctcttctctctctctcggatttcttgcgcggtttatcatgggggatagtcagtattcgttttctctcaccacatttagcccttctggaaagcttgttcagattgagcatgctttgacggctgtcgggtctggacaaacgtctttgggaattaaagctgcaaatggagttgtcattgctaccgagaagaaattgccatctatattggttgatgaagcatcagtccagaaaattcagttattaacaccaaatataggtgtcgtatatagtggcatgggtcctgattttcgagttttggttcggaaaagcaggaaacaagccgagcagtatcaccgtttatataaagaaccaattcctgtcactcaacttgtcagggaagttgccgccgtaatgcaggaatttactcaatctggtggtgttaggccttttggagtgtccctgctagttgctgggtttgatgataacgggccacaattatatcaggtggatccatcaggttcatatttttcttggaaagcttctgctatggggaaaaatgtttctaatgcaaagacgtttcttgagaagaggtacacagatgatatggagcttgatgatgcagtccacacagcaatattgactctgaaggaagggtttgagggacagatctcaggaaaaaacattgaaattggcataattggagctgataaaaagttcaggtgcatatccgtatacttaaaatatacctagtttgcttgacctggtttctgtcatcagtctaattgagttgatttttgggttgtccaatctgaaataataaataataaatttagagtatttcaaagtacaacagaatttcatcactaaaacgagactttcaagttatctgcatctaaattctaaaccaatctagacttcaaacttcaaagccatccttatatatttagattgtttaactgggtgatttaataatagcatgttaatgatgttgcagggtattgacaccagctgaaattgacgactatttggctgaagtagaataatctgcaatgaagaactcttgtgttcctgaagttgtttgtttcacagttgggtttaattggtagcttaattattgacattgtgatggcaatagtgaatttgcgagctactcgttgtgatgaccagcaagccttcagataaacccttttccaaagtcatcaacattttcaaacaaacctagtttgtttagacggtgcggaatgacttaatgactattgctaatttattattttcacccttttagaatctgattgttccttatctctgttatttttatatttccagttaagttcaatgcattattaattgcactgcgatctcaaattccttatcatgttcatttacttctgtagaaataggctttttttttccttgagattttgttaagtgaacaaggttcacgctagatagagagtatcaagtgatattgttataaattc

SEQ ID NO: 1663 - DNA, 234 bp, Glycine max var. Williams 82
atgaatcaccaacaacaatctcctgcagtgactgcatatccagcaggggctcagagcaacctagcagctccaccaccacctgtaggttatcccactaaggatgatcttccttcccaacaaaatgttcctgtcaaaaccactaccaggggtggtggcttctggagcggatgttgtacggcactccgctatggttgctgttgcatacactgtctgcaatgttgtttctcctcttga

SEQ ID NO: 1664 - DNA, 225 bp, Glycine max var. Williams 82
atgagtcgcttcaacaatcagcaagaagcccctgcagtatcatatcctccagctccatatgttagtgccccaccacctatgggttatccttccaaagatgatcctacagctgtagggtacccccaacaaagagttccagaggaaaccacaagcaggggtgatggattttggaaaggatgttgtgctgccttatgttgctgctgggtcctggattgttgcttctga

SEQ ID NO: 1665 - DNA, 231 bp, Glycine max var. Williams 82
atgaatcactctagcaacaatcagcaagaaacccctttatcatatctaccagaaggccaggccaattcttcagctccatatgtcactgccccaccacctatgggttatccttctaagaatggttctatagaacaaagggttccagaggaaaccacaagcaggggtgatggcttctggaagggatgttgtgctgctttatgttgctgctgtgtcctggattgtgtcttctaa

SEQ ID NO: 1666 - DNA, 270 bp, Glycine max var. Williams 82
atggcgaagagcaaggaagacataacctatgcaacatcacaagcaaggctttcagaagatgaagcagtgagagtggcctacgagcatggctcaccccttgaaggaggaaagattgctgactctcaaccagttgacttgttttcaagtgcacacaatatgccaaagagtggccaaacaacaatggattcaaacactagtgatcaatctcagatgcaacgtgatacacaagaagggggttctaaagaattcaccactggagctcctggatag

SEQ ID NO: 1667 - DNA, 909 bp, Glycine max var. Williams 82
atgagcaacataagcatggtagaggcaaagctgccaccaggattcaggtttcatccaagagatgaagagcttgtgtgtgattacttgatgaagaaggtgcaacacaatgattcccttctcttgatagatgttgaccttaacaagtgtgagccatgggatattcctgaaacagcatgcgttggagggaaggagtggtatttctacacacaaagagaccgtaagtatgcaacagggttacgcacaaatcgtgccactgcctcagggtattggaaggccacagggaaggacaggcctatcctccgcaagggcacccatgtagggatgaggaagactttggtgttctatcaaggaagggcacccaaagggagaaaaactgagtgggtcatgcatgagtttcgtatcgaaggacctcatggacctcctaaaatttcttcttccaaggaagattgggttttgtgtagggtgttctacaaaaacagtgaagttttagccaaacctagcatgggtagctgctatgaggacacgggatcttcaactcttcctgcgttaatggactcttacataagttttgaccaaactcaaacccatgcagatgagtttgagcaagtgccctgcttctccattttctctcagaaccaaacaaaccccattttcaaccacatgaccactatggagcctaagttccctctcaaccatgcaactacaacatatggaggagcaccaaatttgggttattgcttagaccctttatcttgtgacagaaaaatgttaaaagctgttttgaatcaaatcacaaagatggaaaggaatccacttaaccaaagtctaaaagggtcaccaagcttaggagaaggaagttcagagagttatttatctgaagtggggatgccccacgtgtggaattactga

SEQ ID NO: 1668 - DNA, 1116 bp, Glycine max var. Williams 82
atggagatcaccaatgtcagcgagtatgaagctattgcaaagcagaagttgccaaagatggtgtttgactactacgcatctggtgcagaggaccagtggactctgcaggagaacagaaatgccttttccagaattttgtttcggccacgtattcttattgatgtgagcaagatagacatcacaactactgtcctgggcttcaaaatatccatgccaatcatgcttgccccaacagccatgcagaaaatggctcatcctgagggagaatatgcaacagcaagagctgcatctgctgctggaacaatcatgactttgtcttcatgggctacttcaagtgttgaagaggtagcttcaacaggacctggcattcgctttttccagctatatgtgtacaaggacaggaatgtggttgctcagcttgtgagaagagctgaaagggctggattcaaagccattgcccttactgttgataccccaagactaggacgcagagaagctgatatcaagaacagattcacactgccaccatttttgacattgaagaactttgaaggattggaccttggaaagatggacaaagctgatgactctggacttgcttcatatgttgccggtcaaattgatcgtactcttagctggaaggatgtgaagtggcttcaaacaatcaccaaactgccaattctggtgaagggtgtgctgactgctgaggacacaaggatagctgtacaaagtggtgcagctggaattatagtgtccaatcacggagctagacaacttgattatgttccagccactatatcagccttagaagaggttgtcaaagctgctgaaggtcgtgttcctgtatttttggatggtggtgttcgccgcggaactgatgtcttcaaggcattggcactaggtgcctctggcatatttattggacgcccagtggtgttctccttggctgctgaaggagaggctggtgtaagaaatgtgctgcggatgctacgtgaggagtttgagctaaccatggctttgagtggttgcacctcactcaaggatatcactcgtgatcacattgtcactgattgggaccaaccacgcactatcccccgcgccttgccaagattatga

SEQ ID NO: 1669 - DNA, 1635 bp, Glycine max var. Williams 82
atggcttctttcaatctctcttattcttcctcaccagccctctcacgtccccgggcaagcaaacacttcaaattcttcaatgatgtgccttttgtccgaatgaattctaaatttccctcaagtgataatgcttttggtagaatcaaagctatgttgatctctggagggggtgaactactttcccatccaaatggcaatgacattgtgataggtacaaatctggttggagatgaatctgttcaaattgaggtacagcctaatggaacactggcagatgacacagggctaacaagcaatgttttctctatggacaacaatgaatttgattcggacagcccctcagcaggttttgcttccattcctgaggcaattgaagacattcgccagggaaagatggtagtggttgtggacgatgaagatcgagaaaatgaaggagacttgataatggcagcacagttggcaacacccgacgcaatggcttttattgtaaagcatggaactggtatagtttgtgtaagcatgaaagaggaagatctggatagattggaacttcctttgatggtgaacagtaaggacaatgatgagaaactctgtacggcattcactgtgacagtggatgctaaacatggtacaaccactggggtgtcagctcacgatagggcaacaacagtcttggcccttgcgtctagagattctactccaggcgatttcaatcgcccgggccatattttcccactaaaatacagggaaggtggtgtcttgaagagagccggacatacagaagcttctgttgatcttgctgtacttgctggtttggatccagtggcagttctgtgtgagattgtagatgatgatggttccatggctagactgccaaagcttcgccagtttgcagagcatgaaaatttgaaaattgtatctattgctgacttaataagatatagaagaaaaagggataagttagtggatcgctcttctgctgcacagatacctacaatgtggggaccattcacagcttactgttacagatcacttttagacgggattgagcatattgcaatggttaagggtgaaattggagatggacaagatgttcttgtgagagtacactcagagtgtctgacaggagacatatttggatctgccagatgtgactgcggaaatcagcttgcacttgcaatgcaacagattgaggctgctggtaggggtgtgctggtatatctccgtggacacgaaggaaggggtattggattgggccacaagcttcgtgcttataacctacaggatgatggacgagatactgttgaagccaatgaggaattgggattgccagttgactccagggagtatggcattggtgcacagatgttgagggacttgggtgtacgatctatgaagctgatgacaaacaatccggcaaaatatattgggctcaaaggttatggtttgacagtttcgggtaggatcccattgttaactcttatcacttcggagaacaagagatatttagagaccaaacgtgtgaaaatgggtcacatatatggcacggaatttaacggccgattgagcactcatgacagtggtaatggtaatgccaccaggattgaggactctaatgctgttactggcttataa

SEQ ID NO: 1670 - DNA, 1419 bp, Glycine max var. Williams 82
atggattcagttgcattaaatggcaaaagcaatgataagcctcttcacgttgccatgctcccatggctggccatgggtcacatatacccttacttcgaagtcgccaagattcttgctcaaaagggtcactttgttaccttcataaacagccccaaaaacattgaccgcatgcccaaaaccccgaaacacttagaaccattcatcaaactcgtgaagctacccttgccaaaaatagagcatctcccagaaggcgcagagagcacaatggacattccgtccaaaaaaaactgtttcctcaagaaagcttacgagggcctacaatacgccgtttccaagttgctgaaaacgtcaaaccctgactgggttttgtatgacttcgcagctgcttgggtcataccaatagccaagagctacaacattccttgtgctcactacaacattaccccagctttcaacaaagtctttttcgatccaccaaaggacaaaatgaaggattactcgctcgcaagcatatgtggtcctcccacgtggcttcctttcaccacaacgatccatatcaggccttacgagtttttgagagcatacgaaggtaccaaagacgaggagacaggtgaaagggcttcttttgatctcaacaaggcatattcaagctgtgacctttttcttctaagaacctccagagagcttgaaggagactggttggattatcttgctggtaattacaaggttcctgtggttccagttgggttgcttccaccatccatgcagataagggacgttgaagaggaagacaataaccctgattgggtcagaatcaaggattggttagacacacaagagtcgtcatccgtggtttatattgggtttgggagcgagttgaagctgagtcaggaggacctcactgagttggcacatggcattgagctttcaaatttgcctttcttttgggcattgaagaacctgaaagaaggtgtgcttgagttgccagaagggtttgaagaaagaaccaaggaacgtggcattgtttggaagacttgggcaccccagcttaagatcttggctcatggagcaattggagggtgcatgagtcactgtggctctggctctgtgattgagaaggttcattttgggcacgtgcttgtgactctgccttatttgcttgaccaatgtctgttttcgagggtgctggaggaaaagcaagtggctgttgaggttccaaggagcgagaaagatgggtcttttactagggtcgatgtggctaagacattgagatttgcgattgtggatgaggaagggagtgctctaagagagaatgccaaggagatgggcaaggttttcagttccgaagaacttcataataagtatattcaagatttcattgatgcgcttcagaagtataggattccttccgctagctaa

SEQ ID NO: 1671 - DNA, 573 bp, Glycine max var. Williams 82
atgggtgataacaatgtcaaccttccacccgggtttcgattttatcccacagatgaagagcttgtagtccatttccttcacagaaaggcatctcttttaccttgccacccagatgccatccctgatcttgaagtctacccatatgatccatgggaacttgatggtagagctttggcagagggaaaccaatggtactactacagcagaaggacacaaaatagggtcactggcaatgggtattggaaaccaacgggaatggaagaaccagtggtttcaagcacaagcaacaaaagggttggcatgaagaaatattttgtgttccatgtgggagaagcccctactgctggtatcaaaaccaattggataatgcaagaatatcgtctatcagattctgcttcctctaccagatcatccaaaagaaaaccacaaccaaaaatagaatacaataaatgggtgatatgtcgtgtttatgagcgcaatggagacgatgataatggaacagagctctcatgcttggatgaagtattcttgtcattggatgatgatcttgatgaaataagcttaccaaattaa

SEQ ID NO: 1672 - DNA, 654 bp, Glycine max var. Williams 82
atggcaaacaacaatattcaaccatgccatgacgaccttgatcctagagaagccaacaacccttcaaagatgttaaacttggacgtggaaggacagagagagggttttgactatgcaaagagggcacagtggcttagagctgctgttttgggtgccaatgatggtttgctctcaacagcatccctcatgatgggagttggagctgtgaggaaagatgttaagagtatgatgctgactggggttgcagggctggtggctggagcatgcagcatggccattggagagtttgtttctgtatactcacagtatgatattgagttggctcagatgaaaagagagggaaacatggatgagaagaaggataagttgccgaacccctattatgctgcttttgcctctgcccttgcgtttgctattggggcaggggtgccactacttggtgctgcctttgtcaatagctataaggcaaggttaggggtggtggcggctgttgtcacccttgctttgatcgtctttggagatttgggggcctttttagggaaagcacccagggttaagtccactctcagggttttgattggggggtggttggccatggctattacttttggtttaacaaagcttgtagatcatcttggacttggagtagcttga

SEQ ID NO: 1673 - DNA, 1029 bp, Glycine max var. Williams 82
atggaccaccaagctgacactaacagaactgatttgatgactatcacacgctttgttctgaatgaacagtcaaagtatcccgaatcacgtggcgatttcaccatccttctcagtcacattgttcttggctgcaaattcgtttgttctgctgttaacaaggcgggattggcgaaactcataggacttgctggagagaccaatgttcaaggtgaggagcaaaagaaattggatgtgctttcaaatgaagtatttgtgaaagccttaatcagcagtggacgcacatgccttcttgtttctgaagaggttgaagaggctatatttgtgccatcatcacatcgtggcaaatacattgttgtgtttgaccctctggatggatcctcaaacattgactgcggggtttctattggaactatctttggtatttacatggtgaagaatgaggctgaagtaagtcttgaagatgcattgcaacctgggaaccaaatgttagcagctggttactgcatgtatggaagctcttgcacgttcgtgcttagcacagaaaatggagtgaatggttttacacttgatcctagccttggggagttcatattgactcacccaaacatcaagataccaagtaaaggaaagatttattcggtgaatgaaggaaatgccagaaactgggatgaaccaaccactaaatatgtacaaatgtgcaagtttcctcaggatggttcaccaccaaagtctcttaggtacataggaagtatggttgctgatatccatcgaactttgctttatggtggtatcttcatgtacccagctgatgcaaagagtccaaacggaaagctacggcttctctatgaagtctttccaatgtcatacttgatggagcaagcaggaggtcaggctttcacaggaaaacaacgggctcttgatttgattccaaaaaaaatacatgaacgatcaccagtattccttggcagctacgatgacatcgagcaaatgaaagagctttatgctgcatccaaagaagatgatgcatga

SEQ ID NO: 1674 - DNA, 417 bp, Glycine max var. Williams 82
atggcgaccacagcggcgttgtgtggcactatgttgaacacctccttcctgaggaggcaggcttcagtgaacatcacaagcctcaaggctaacgctaacactgtgtttgggaggacgtggaggcgtgtgactgccatggcaagttacaaggtgaagctgataaccccagagggagagcaagaatttgaatgcccagatgatgtatgcattcttgaccaggcagaggagaaaggccttgagcttccctactcatgcagggctggttcttgttctgtctgtgctggcaaagtggaacagtcagatggtaacttccttgatgatgatcaaattgttgcaggatttgttctcacccgtgttgcttaccctacctcagacgttgtcgttgagactcactgggaggaggagctcactgcttaa

SEQ ID NO: 1675 - DNA, 417 bp, Glycine max var. Williams 82; identical to SEQ ID NO: 1674

SEQ ID NO: 1676 - DNA, 2601 bp, Glycine max var. Williams 82
atgtttccagttgtgtcgggtatctttaacaggggccagaagctaaaggggacagtggtgttgatgcgtaagaatgtgttggacatcaacgccctcacctctgctcaaagtgccactggtattatcggcggcgccatcggtgccgtcggtgatatcattggcaccggagttgacaccctcacctcctttctgggcagatcagtggccctcaagttgatcagtgccaccagtgctgattcaaccggaaagggaaaggttggaaagcaaacttttctggaaggtcttgttgcttccttaccaaccttgcgagctggagagtctgcattggatattcactttgaatgggacagtgacatgggaattcctggagcattctacatagagaatttcatgcaagttgaattcttccttgtgagtttgactcttgaagacgttcctaaccatggaaccatccactttgtttgcaactcatgggtttacaatgcaaaaatgtacaaaaacactcgtatcttttttaccaacaagacataccttccaagtgaaacaccgggtccactagtgaagtacagagaagaagaattgaagactttgagaggagatggaacaggacagcgcaaagaacatgaaaggatctatgattatgatgtctacaatgatttgggaacacccgaaaaggacaatttggctcgcccggttctcggggggtccaccttgccttaccctcgcagaggaagaactggtagaaacaaatctaaaaaagatcctaaaagcgagattcgcagcgactctgtttacattccgagggatgagtcatttggtcacttgaagtcatcagatttccttgcttatatactcaaatctgcatctcaaaatgtgatacctcaattacaatctgcacttagactacaattcaaccagcctgagtttactagctttgacgacgtgcgcggactctatgatggtgggattaagttgcctactgatgcacttagcaagcttagtcctataccattgttcactgaactcttcagaactgatggggaacaggtccttaagtttcccacacctaaagtaattcaagtgaatctgtctggatggatgactgatgaagagtttgcaagagagatgattgctggagtaaatccacacattattaagaaacttgaggagttcccaccaaagagcaagctagatagccaactttacggtgataataccagcacaataaccaaagaaaacttagagcctaacttgggtggactcactgtagaacaggctatccaaaacaacaaattgttcatactagaccatcatgacacactaattccatatttgaggagaataaacgcaactgagacaaaggcctatgctactagaaccatccttttcttgcaagataatggaactttaaagccattggccattgaactaagtaaaccacatcctcagggtgataattttggccctgttagtgatgtttaccttccagcagaacaaggtgttgaagcttctatttggctacttgccaaggcttatgtgatcgtaaatgactcttgctaccaccagcttgtcagccattggttaaacactcatgcagttgttgagccattcgtgatagcaacaaacaggcatcttagtgttgtgcaccctattcacaaacttcttcttccacactatcacgacacaatgaacatcaatgcccttgctaggaatgtcctggtgaatgctgagggtattatagaatcaacattcttctggggaaaatatgctttggaaatgtctgctgttgtatacaaggattgggttttccctgagcaggcactacctgctgatcttgttaagagaggtgtggctgttgaggattcatcttctccacatggtcttcgtcttttgatagaggactatccttatgctgctgatggattagagatatgggctactatcaagtcatgggtccaagaatatgtctctttctactacaagtcagatgctgctattgcacaagatgctgaactccaagccttttggaaagaactagtagaggttggccacggtgacaagaaaaatgagccatggtgggggaagatgaaaactcgccaagagttgattgaatcttgcaccacactcatttggactgcttcagcccttcatgcagctgttaattttggacaatatccttatggtggctatatccttaaccggccaactcttagcaggcgattcatgcctgagatagggtcccctgagtatgatgagcttgctaagaaccctcagaaggcatatttgaaaacaattacagggaagagtgatgcccttaaagaccttacaattatagaggtcttgtcaaggcatgcttccgatgagttgtaccttggacagagagatggtggtgaattttggacttttgacaaagagccattagaggccttcaagaggtttggaaagaagttggcagaaattgagcaaaagctcatccaaaggaacaatgatgagacactgaggaaccgatacggcccagtgcagatgccctacacattgctttatccttctagtgaagaagggttgacttgcagaggcattcctaacagcatctccatctaa

SEQ ID NO: 1677 - DNA, 4427 bp, Glycine max var. Williams 82
attgctggcatcagaggagggaaagggagagactgagagtctctctctttgtcctaaaaccctgtcctctctttctctctctaaacttttttttcttcttctctctcctttcgatttcattcacgattctctctcttcattttctttttgtctccttcctcgatctgcaaccagcaatacaacacgcgtagcgtctcactgctccctctcttctttcctttcccagtttttgctgcattgctaagttcgtttacgtttttcgacatgaacgggtccctcccgttcggtttaaggagaagaaattgaggacaaggggcagtttgatggttccaaagattttggtttccttgttggtgggtatgtgttaagtaagttaaatataactttaggttgagctgaattctggttaaatgacacgggggaggataagggcgaggctccggaggagccatctttacacatttggttgccttaagccttctaccactgaggaggcacctcatccacttaatggccccgggttctcgcgaactgtgtattgcaaccagcctctacttcatgacaagaagcctgtattgtactgcaaaaatgatatatccacgaccaagtacaatgttattacgtttttccccaaggcactctttgaacaatttcgtagggttgctaatatatacttccttttggctgcatgtctgtcagcctctcccatttcgcctttcagcccactgagcatgattgctcctttggcatttgttgtggggcttagtatggcaaaggaagcattggaagattcgcgcaggttccttcaggatgtcaaagttaatcgccggaaggttaatcgccataaaggagatggtttttttagtcccaggtcgtggcagaacattatggttggggatgtggtcaaagtgaacaaggatcaattttttccagctgatttgcttctcctgtcctcgagttatgaggatgggatttgctatgtggagactatgaatttagatggtgagaccaacttgaaggtgaaaagatcatcggagaccaccatgactctagataatgatgaagtttttaaagatttcactggaacgatacgttgtgaagacccaaaccccaatctttacacgtttgttggaaacttagagtacgagcgccagatttatcctcttgatcctagtcaaattcttctccgagattctaagctcaggaacactgattacatctatggggtggccattttcactggtcatgacagcaaagtcatgcagaattccacaaaatctccttcaaaaagaagcacaatagaaaagaagatggattatatcatatacaccctcttcactgtccttattttgatatctgttattagttccataggatttatcttcaagactaagtaccaagccccaaagtggtggtatttacggcccgacaatattgaatatcagtatgatcccaacaaagttggactggctggaatgagtcatctgattactgcacttattctttatggatatttgatacccatctcactttatgtttccattgaggttgtaaaggttttacaggcaaccttcatcaaccaagacattcaaatgtatgatgaagaaactgggactccagctgatgcgcggacatcaaatttgaatgaagagttgggtcaggtagatactatcctgtcagataaaactggaactttgacatgtaaccagatggactttttgaagtgctccattgccggtactgcatatggtgtgcgctccagtgaagttgaagttgctgcagcgaagcagatggcttctgatcatgaggaccaggattcagatctctccaatttccccatgcctaagagtaaagcacgcgtttcatgggatgatgttagaaaagctgaagaaattgaactggagactgttgttacttccaaaggagatgaggatcaaaagcatgccataaagggatttggttttgaagatgaccgcctcatgaattgtaattggttgaaagagcccaatgcggatgaccttttgatgttctttcgtatattagcagtttgccacactgccattcctgagctgaatgaggagactggtgtttatacatatgaagctgagtcacctgatgaaggggcttttcttgtagcagcaagagaatttggctttgcgttttgcagaaggactcagtcaagtattttcatacatgaaagattttctgcttccgggcaagtggttgaaagagagtacaaacttttgaatctgctggatttcactagtaaaagaaagcgtatgtcagtgattgtgcgtgatgaggagggcagttttcttcttctttgcaagggagctgacagtatcatatttgatcgattgtcaaagaatggaaaaaattatttggaggctactaccagacatctaaatgaatacggagaagctggtttgagaacactagccctggcttatagaaagcttgatgagcaagaatacactgcttggaacaatgaatttcagaaagccaaagcagctgttggggcagacagagattcaatgcttgagcgggtatcagatatgatggagaaagagttgattcttgttggggctactgctgtggaagacaaactgcagaaaggggttccccaatgtattgataatcttgctcaagctggtctcaagatctgggtgttgacaggggataagatggaaacggcaatcaacattggatttgcttgcagtttgcttcgacagggtatgaagcagatctgtataactactcctgttacagattcagtagccactgatgtcaaacaggctatcaaggacaacattttaaatcaaatcaccaatggttctcaaatgataaaactggagaaggatcctcatgctgcatttgctttaattattgatgggaaaactctgacatatgctctagaagatgatatgaagctcctatttttgggattggctgttgattgtgcatctgtcatctgctgtcgtgtgtctcccaagcaaaaggcattggtaaccaggttagtgaaacaaggttctgggaagactactctagcaataggtgatggtgcaaatgatgttggcatgattcaagaagcagatattggtgttggaattagtggggttgaaggcagtgatggctagtgactttgcgattgcccaatttcgatttttggagaggctcctggtagtccatggacattggtgttacaagagaattgcacaaatgatatgttatttcttctacaagaacattacatttggtctcaccatcttctattttgaggccttcactggcttctctggtcaatcggtttatgatgactggtacatgatattgttcaatgttgttctgacatcgttacccgtcatttcactcggtgtttttgaacaagatgttccgtcagaagtttgtttacagtttcctgcactatatcaacaaggacccaagaatttgttctttgactggtatagaatattggggtggatgggcaatggtctctatgcctccctcatcatcttcttcctcatcgtcaccatcttctatgaccaagcattccgtgcggatggccaggtagctgacatggctgctgttgggaccactatgttcacttgcatcatctggactgtcaactgtcagattgctcttacaatgagccactttacatggattcagcacctgtttgtatggggtagcatagccacttggtacatctttctctccttgtatggaatgctctctccagaatattccaagagtgcctaccaaatactggttgaatctcttggtcccgcacccatttactgggtaacaacccttttagttacagttacatgcaatctaccttattttgctcacatatccttccaaagatgtttcaatcccatggaccatcacattatccaagaaatcaagtactacaaaaaggatattgaggatcaacacatgtggacaagggaacgttctaaggccagacaggaaaccaagattgggttcactgcaagagtggaagcaaagatcaggcaactgaagggaagactgcagaagaagcaatctaccttggctatttcagccccatcgtgacactatacataagttaacagttttgggtatttttagggtttgcttatgttgtttgatttaagtgggggtgaattaaagtccccattcaacggaaaaagcatggaagctgctgtatgtaacatatttacgtagaagtgtcagtgtgtaattctcttaccacatggttgtgattcaattgcaattgaccttggaaaaatgaaagttaagttgtattactatttttcttttctttccttgggataggggttgttttatttggttagaacttctagttcccaatttttctcccaaaaaggatgaaacccattgtttattaattatactattcaaattctttgcatatttactct

SEQ ID NO: 1678 - DNA, 4383 bp, Glycine max var. Williams 82
atggtttggaatataaatctttgtattgagttgaggatctgtaatttatatggggtcagcataatagacattttaaagctacttttcatcgctgtcttctacacgtctttgcttgtttctttaatcagaagacattccgaatgtggtagcaacagaaagaactgggttttcctagttgtctcagtttgttgtgctctcattagcattgcacatttttgcaatggcttgaagttgtggaatcagaagagctggttagcttctactttcagagcatttgtgtggctttctctaacaatttcattacatgttcagagaaacaaatggatcaaatctctaaactctatctggtgggcatcttcctgtgtattggcttcagctctcaacattgaaattatgttcaaagagcacacagttgaacttttcgaaatggtacaatggcttgtacatttctcacttctcttttgcgccttccaaaatctcccttattttgccacatccgaaggtatccaagatactactagtttatctgagcctctgatagctccgagagttgaaactaaacaaacgcaactaggccatgctacccttctcagtaagttgactttctcttgggttaattctttactcagactgggttactcaaagccactagctcttgaagaaatcccatttcttcttcctgaagatgaagcaaactctgcctaccaagacttcgtgcatgcatgggaatcccttctaagtgagaacaacaataacaacaacaacaacaaaaacttggttctttggtctgtagtaagaactttctcaaaggagaacatattaatagcactttacgcattaataagaagtatttgcatgataatttctcctctaatactctatgcttttgtaaactactcgaatagcactgaggcagatctcaaagaaggtttttccatactgggttttatgattatcagcaaagtggttgaatctctgtgccagagacatttcggttttggctcgaggcggtcagggatgaaaattagatcagctctgatggtggcagtgtatcagaaactgcttaagctctccagctcagcaaggagaaggcactcaactggagaagttgtgaattacatcgcagttgatgcatatcgattgggagaatttccatggtggtttcacataacatggacttctgcagtgcaacttgttttgtccattgttctcctttttggtgttgtaggtgccggtgctcttccaggtttagtccctcttctcatctgtggagttctcaatgtaccatttgcaaagatgatacaaaattctcagtcacaattcatgatggcgcaagatgagcgtctcagagcaacttccgaaattctaaatagtatgaaaatcatcaagttacaatcctgggaggataaattcaagaacttagttttgtccctacgtgctaaagaattcatatggctgtctaaggcacagatcataaaagcttatgggtcatttctgtattggatgactcctaccatcgttccttctgttgttttcatggggtgttctcttttcgatagtgctccattgaatgctggaatcattttcacagttcttacgacattgaggataatgggagaacctgttcggttgatccccgaggctctatcgattatgatccaagttaaggtctcctttgatcgtctcaatacctttttgctcgatgaagagttagatagtattaatggttatggaagaaatataaagcaaagttcagttaatgcagtagaaatccaagctggcaatttcatttgggatcatgaatcagtgtctccaactttaagagatgtgaatttagaaatcaaatggggacagaaaattgcagtttgtggaccagttggagctggaaaatcatctcttttgtatgcagtacttggagagattcccaagatctcaggaactgtgaatgtaggtggcacaatagcctatgtttctcaaacttcttggatacaaagtgggacagttcgggataatatactcttcggaaagccaatggacaaaaccagatatgagaatgctactaaagtttgtgccttagatatggatatcaatgattttagccatggtgatcttaccgaaataggccagcgagggattaacatgagtggaggacagaggcaaaggattcaactagctcgagcagtttacaacgacgctgacatctatctccttgatgatccattcagtgcagttgatgcacacactgctgctattctgttcaatgactgtgtcatgactgctctaagagagaaaacagtcattctagtgactcatcaagtggagtttctcacagaagttgatacaatcctggtaatggagggtggaaaagttattcaatcaggtagttatgaagatctcctaacggccagaactgcctttgaacaacttgtgagtgcccataaagctacattaacaggagtggatcaaaaaaatgaaagtgaaattgattctgatattgaggttatggtacatccagaagagtctcaaagttttatctcactaaaatcaaagtggagccgggtgattctaccaagggtcaacttggggcacagctttacacaagacgaagaaaaagagattggtgatattgggtggaagccattctgggattatatttcattttccaagggatcattcttgctgtgtttaaccatgtcagcacagtttgcttttattgctttgcagactgcatcaacctattggcttgctctagccattgaaattccaaaagtcactagtggcattttgattggagttttctcattattttcattactgagtgctgtatttatatatataaggtctgtcctggcggctaatcttggattaaaagcttctatagccttcttctcaagtttcacttcggctatcttcaatgctcctatgtttttctttgactcaacccctgtaggaaggattttaacccgagcttcatcagatttgagcattttggaccttgatattccttatactctcactttagtagcatttgtagctgctgatgttctggtgacaatatgtgtaatggtttcagtcacatggcaagttcttattgttgctattcctgctaccgtggcatcaatatatattcagggatattatcaagcctcggcgagggaattgataaggatcaatggaaccacaaaagctccagtcatgaattttgctgctgagacatcacttggggtggttactgtaagagcattcaacacggtgaacagatttttcaacaactacctaaagcttgtggacatggatgcaacattgttctttcattctatcgtgaccatggaatggtcaattttaaggattgaagtacttcaaaatttgacagtcttcactgcagctttattacttattctacttcctaagggatatgtaccttcaggtcttgtgggattgtctctggcttatgcgttgacactgaaagaagcccaagtattttggagtcgaatgtttagcatgtcatcaaaccatatcatctctgttgaaagaataatgcaattcattgaaataccagcagagcctccagccattgtggaggataacagacctccatcttcatggccttccaagggtaggattgatcttcgagccctagagattagatatcatccaaatgctccattagtccttaagggtataaattgtacgtttaaagaagggaatagagttggagttgtaggaaggaccggaagtggaaaaactacacttataagtgctttgtttcgcatagttgaaccttcaagtggtgatattttaatagatgggattaacatatgctcaatagggttaaaggatttgagaatgaaacttagcatcatccctcaagaacctactcttttcaagggcagcattaggaccaacctggaccctctaggcctctatgacgatgatgaaatatggaaggctttagagaaatgtcagctaaaggaaacaatcagaaagctaccacgtctcttggattcttctgtgagtgatgaaggtggaaattggagcttgggacaacagcaactgttttgtcttggaagagtactacttaagaggaacagaatacttgttctagacgaagctactgcatcgattgactctgcaacagatgccattctacaacaagtgattagacgagaatttgcagaatgcacggttgtaaccgtggctcacagagttccaactgtaatagatagcgacatggtcatggtcctgtcctatgggaaactagtggaatatgatgacccttcaaaacttatggagaccaactcttggttctctagattggtcgctgaatattggtcgagctgcaggaagaactcctccccaaatattaacaggcagcaacattga

SEQ ID NO: 1679 - DNA, 4872 bp, Glycine max var. Williams 82
atggtttggaatataaatctttgtattgagttgaggatctgtaatttatatggggtcagcataatagacattttaaagctacttttcatcgctgtcttctacacgtctttgcttgtttctttaatcagaagacattccgaatgtggtagcaacagaaagaactgggttttcctagttgtctcagtttgttgtgctctcattagcattgcacatttttgcaatggcttgaagttgtggaatcagaagagctggttagcttctactttcagagcatttgtgtggctttctctaacaatttcattacatgttcagagaaacaaatggatcaaatctctaaactctatctggtgggcatcttcctgtgtattggcttcagctctcaacattgaaattatgttcaaagagcacacagttgaacttttcgaaatggtacaatggcttgtacatttctcacttctcttttgcgccttccaaaatctcccttattttgccacatccgaaggtatccaagatactactagtttatctgagcctctgatagctccgagagttgaaactaaacaaacgcaactaggccatgctacccttctcagtaagttgactttctcttgggttaattctttactcagactgggttactcaaagccactagctcttgaagaaatcccatttcttcttcctgaagatgaagcaaactctgcctaccaagacttcgtgcatgcatgggaatcccttctaagtgagaacaacaataacaacaacaacaacaaaaacttggttctttggtctgtagtaagaactttctcaaaggagaacatattaatagcactttacgcattaataagaagtatttgcatgataatttctcctctaatactctatgcttttgtaaactactcgaatagcactgaggcagatctcaaagaaggtttttccatactgggttttatgattatcagcaaagtggttgaatctctgtgccagagacatttcggttttggctcgaggcggtcagggatgaaaattagatcagctctgatggtggcagtgtatcagaaactgcttaagctctccagctcagcaaggagaaggcactcaactggagaagttgtgaattacatcgcagttgatgcatatcgattgggagaatttccatggtggtttcacataacatggacttctgcagtgcaacttgttttgtccattgttctcctttttggtgttgtaggtgccggtgctcttccaggtttagtccctcttctcatctgtggagttctcaatgtaccatttgcaaagatgatacaaaattctcagtcacaattcatgatggcgcaagatgagcgtctcagagcaacttccgaaattctaaatagtatgaaaatcatcaagttacaatcctgggaggataaattcaagaacttagttttgtccctacgtgctaaagaattcatatggctgtctaaggcacagatcataaaagcttatgggtcatttctgtattggatgactcctaccatcgttccttctgttgttttcatggggtgttctcttttcgatagtgctccattgaatgctggaatcattttcacagttcttacgacattgaggataatgggagaacctgttcggttgatccccgaggctctatcgattatgatccaagttaaggtctcctttgatcgtctcaatacctttttgctcgatgaagagttagatagtattaatggttatggaagaaatataaagcaaagttcagttaatgcagtagaaatccaagctggcaatttcatttgggatcatgaatcagtgtctccaactttaagagatgtgaatttagaaatcaaatggggacagaaaattgcagtttgtggaccagttggagctggaaaatcatctcttttgtatgcagtacttggagagattcccaagatctcaggaactgtgaatgtaggtggcacaatagcctatgtttctcaaacttcttggatacaaagtgggacagttcgggataatatactcttcggaaagccaatggacaaaaccagatatgagaatgctactaaagtttgtgccttagatatggatatcaatgattttagccatggtgatcttaccgaaataggccagcgagggattaacatgagtggaggacagaggcaaaggattcaactagctcgagcagtttacaacgacgctgacatctatctccttgatgatccattcagtgcagttgatgcacacactgctgctattctgttcaatgactgtgtcatgactgctctaagagagaaaacagtcattctagtgactcatcaagtggagtttctcacagaagttgatacaatcctggtaatggagggtggaaaagttattcaatcaggtagttatgaagatctcctaacggccagaactgcctttgaacaacttgtgagtgcccataaagctacattaacaggagtggatcaaaaaaatgaaagtgaaattgattctgatattgaggttatggtacatccagaagagtctcaaagttttatctcactaaaatcaaagtggagccgggtgattctaccaagggtcaacttggggcacagctttacacaagacgaagaaaaagagattggtgatattgggtggaagccattctgggattatatttcattttccaagggatcattcttgctgtgtttaaccatgtcagcacagtttgcttttattgctttgcagactgcatcaacctattggcttgctctagccattgaaattccaaaagtcactagtggcattttgattggagttttctcattattttcattactgagtgctgtatttatatatataaggtctgtcctggcggctaatcttggattaaaagcttctatagccttcttctcaagtttcacttcggctatcttcaatgctcctatgtttttctttgactcaacccctgtaggaaggattttaacccgagcttcatcagatttgagcattttggaccttgatattccttatactctcactttagtagcatttgtagctgctgatgttctggtgacaatatgtgtaatggtttcagtcacatggcaagttcttattgttgctattcctgctaccgtggcatcaatatatattcagggatattatcaagcctcggcgagggaattgataaggatcaatggaaccacaaaagctccagtcatgaattttgctgctgagacatcacttggggtggttactgtaagagcattcaacacggtgaacagatttttcaacaactacctaaagcttgtggacatggatgcaacattgttctttcattctatcgtgaccatggaatggtcaattttaaggattgaagtacttcaaaatttgacagtcttcactgcagctttattacttattctacttcctaagggatatgtaccttcaggtcttgtgggattgtctctggcttatgcgttgacactgaaagaagcccaagtattttggagtcgaatgtttagcatgtcatcaaaccatatcatctctgttgaaagaataatgcaattcattgaaataccagcagagcctccagccattgtggaggataacagacctccatcttcatggccttccaagggtaggattgatcttcgagccctagagattagatatcatccaaatgctccattagtccttaagggtataaattgtacgtttaaagaagggaatagagttggagttgtaggaaggaccggaagtggaaaaactacacttataagtgctttgtttcgcatagttgaaccttcaagtggtgatattttaatagatgggattaacatatgctcaatagggttaaaggatttgagaatgaaacttagcatcatccctcaagaacctactcttttcaagggcagcattaggaccaacctggaccctctaggcctctatgacgatgatgaaatatggaaggctttagagaaatgtcagctaaaggaaacaatcagaaagctaccacgtctcttggattcttctgtgagtgatgaaggtggaaattggagcttgggacaacagcaactgttttgtcttggaagagtactacttaagaggaacagaatacttgttctagacgaagctactgcatcgattgactctgcaacagatgccattctacaacaagtgattagacgagaatttgcagaatgcacggttgtaaccgtggctcacagagttccaactgtaatagatagcgacatggtcatggtcctgtcctatgggaaactagtggaatatgatgacccttcaaaacttatggagaccaactcttggttctctagattggtcgctgaatattggtcgagctgcaggaagaactcctccccaaatattaacaggcagcaacattgaacaagaaaagggagtacaaacaaactgaaggaaaactgaataaattgaattttagatgtgcctggatcctcttatttacccaaggggacatataatataatttacaaaatgttgttagacatcatattaagtgtatatgaacactcaattgcaagtctactttgagagaaaattggtgaagcttggaaaattcttccttccaaactatattagaatataacctatatattttccttctgtttattcattagtatctaagtaactccctaaatttatgtcattttttttgtttctctctatcaggcttcatcatatttgagtactttggaccttgatatttcttatactctccctttagtagcatttgtaacagctgaaattcaggtgataaattagacatctaaatgtatgggggagctacaaatgtaatgttattccttgaactgcattagtcagtccctggcaagacaagaagcataaaaagtaaat

SEQ ID NO: 1680 - DNA, 1725 bp, Glycine max var. Williams 82
atgtatcgattagctcgtagagtagcttcttccattgcttctccctctgctaagaacctcgtatatggtggagtattgtcaagcagaaattttgtgagcaaagatatcaactttggggtcggggctcgtgccgcaatcctccagggggtaactgaggttgctgatgctgtcaaagttaccatgggacccaagggtcacaatgtgataattgagagaagtcgtgggaatcccaggatcacgaaggacggtgtgactgtggccagaagtatcaaatttaaagacaaatccaaaaatgttggggcggatcttgtcaagcaggtggccaaggctaccaacactgctgctggagacggtacaacttgtgcaactgttttgactcaggcaatactcacagaaggatgtaaatcgattgctgctggcataaatgttatggacttacgtaatggaataaataaggcagttgatgctgtaattactgagttgaagagcagaacattgatgataagtacaccagaagagataacccaggttggaactatatctgcgaatggggagcgtgatattggagaattgatggctagggcaatggagaaagttgggaaggaaggagtcattactgttgttgatgggaacactttggataatgaattggaagtggtagaaggaatgaagttaaccagaggatacatatctccttattttattactgatcagaagacccggaaatgtgaattggagaacccctttattctcatccatgacaagaaaatttctgacatgaattcattgctgaaaatactggagctggcagtaacgaaaaaaagatcactcttagttgttgctgaagatgttgagagtgatgcgttggctatgctcatactcaacaagcatcacgcggggcttaaggtttgtgctgtaaaagctcctggttttggggataatagaagagcaagtctagacgatcttgcaattcttactggaggagaggtcatcactgatgagcgtggtttgtctcttgataaagtccaaccagaaatgcttggcactgcaaaaaaggttactatcaccattgatgacactattattctacatggtggtggggataagaaggtcattgaagagagatgtgaacagctgaggacagctatggaagagagttctgccacatttgataaagaaaaagcacaggaacgcctatcaaaactatctggtggtgtagctgttttcaaagttgggggggctagtgaggccgaagttggggaaaggaaagatagagtaacagatgctttaaatgccactagagctgctgtggaagagggaattgttccaggtggtggagttgctctcctatatgctaccaaagtcttggataaccttcaaactcaaaatgaagatgagaagagaggagtacaaattattcagaatgcactcaaggcacctacctctacaatagcttcaaatgctggttttgatggtgctttggtccacagcaaattgttggaacaagatgatcataatttaggttttgatgctgctaaaggtgtctatgttgatatggtaaaggctggaataatagatcctcttaaagttgttagaacagctttggtagatgctgccagtgtgtcattgctactgacaacaaccgaggcagctgtgttggataatccacatgacaaaaataaacctcctagtcgggtgccagatatggatgatttggatctctaa

SEQ ID NO: 1681 - DNA, 2532 bp, Glycine max var. Williams 82
atgagcttcaacaagctcaaagtgtggaatgtgccactactcttggtggtgtttgcatgttcactgcttggtcaagcttcagcttctgtgtcctatgaccataaggctatcatcatcaatggacagagaaggatacttctttctggctccattcactaccccagaagcacccctgagatgtggccagatcttattcagaaggcaaaggaaggaggtttggatgtcattcaaacttatgttttctggaatggacatgaaccttcacctggcaaatattattttggaggaaactatgatctggtgaggttcataaagctagtgcagcaagcaggcctctatgttaacctcagaattggtccttatgtttgtgctgaatggaacttcggaggattccctgtttggctcaagtacattccaggtatcagcttcagaacagacaatggaccatttaagtttcaaatggaaaagtttaccaagaagattgtggatatgatgaaagcagaaaggttatttgagtctcagggcggtccaataattctgtcccagattgaaaatgaatacggacctatggagtatgaaattggtgctcctggtagatcctacactcaatgggcagcacatatggctgtaggacttggcaccggggttccatggatcatgtgcaagcaagatgatgctcctgatcctattattaacacttgcaatggcttctattgtgattatttctctccaaataaggcttacaaaccaaagatgtggacagaggcttggactggctggtttactgagtttggaggtgcagttcctcacagacctgctgaggacttggcattttcaattgcaaggtttatacagaaagggggatcatttgtcaattattatatgtatcatggcggaacaaattttggtcgaactgctggtggcccctttattgctacgagctatgattacgatgcgccccttgatgaatatggattggccagacagccaaagtggggtcatctgaaggatttacatagagcaataaaactctgtgaacctgctttagtatctggagattctactgtacaacggcttggaaactatgaagaggctcatgtttttagatccaagtctggagcttgtgctgcattccttgcgaactataacccacaatcttatgcaacagtggcatttggaaatcagcattacaacttgcctccttggtctataagcattcttcctaactgcaagcacactgtttataacactgcaagggttggttctcagagcacaacaatgaagatgactcgtgttcctattcatggaggactatcttggaaagcgtttaatgaagaaacaaccactactgatgatagttcgttcactgtgactggcttgttggagcagataaatgcaaccagagatttatctgattacttgtggtactccacagatgttgtgatcaattccaatgaaggatttttgaggaatggaaagaatcctgttcttacagttttgtctgctgggcatgctttgcatgtttttatcaacaatcagctgtcaggaactgcatatggaagcttagaggcccccaaactaacctttagcgaaagtgtgaggctcagagctggtgttaacaaaatctctcttctaagtgttgcagttgggcttccgaatgttggtccacattttgaaagatggaatgctggtgttctaggcccaattacattaagtggtctcaatgagggtaggagggacttaacttggcagaagtggtcatacaaggttggtcttaaaggtgaagccttgaatcttcattctcttagtggaagttcctctgttgagtggcttcaggggtttttagtttccagaagacagccattgacttggtacaaaactacctttgatgccccagctggagttgcaccgttggctttagacatgggcagcatgggcaaaggtcaagtgtggataaatgggcaaagcctaggccgctactggcctgcttacaaagcatccggttcttgtggttactgtaactatgctggaacttacaatgagaagaaatgtggaagtaactgtggcgaggcttctcaacgatggtatcatgttcctcactcatggctgaagccaagtggaaatttattggttgtgtttgaggaattgggtggggatccgaacgggatctttttggttagaagggatatagatagtgtatgtgctgacatctatgagtggcagccaaatcttgtaagttatgagatgcaagcttctggcaaagtcagaagtcctgtgagaccaaaagcacatttgtcatgtggacctggacaaaaaatatcatcaatcaagtttgctagctttggcactccagtagggtcttgtggaagctaccgcgaaggaagttgtcatgctcacaagtcatatgatgctttcctaaagaattgtgttggccagagctggtgcacagtgacagtgtctcctgaaatttttggaggagatccttgtccaagagtcatgaagaaactctctgtggaggccatttgcacctga

SEQ ID NO: 1682 - DNA, 3448 bp, Glycine max var. Williams 82
caacacagaaccttcacataaagtatcttaaatttttaatcccccaaaaaggtcaaaacaaatcaaaagaaaaaaaagaaatatatatcactgtctctcactcttccaatctacaacctcccattttttttccttcctttcacacagtgttttctcttcaatcattctgctaaaagtaggagacttgagcaacagaacataagcatagaataaagtgtgcaaaggccactgctttagtgctttaccaagctgagaaacaacacaacacaacaagggtgttgtttagtattattattgattattattcattgtttgttgttgtcatgagcttcaacaagctcaaagtgtggaatgtgccactactcttggtggtgtttgcatgttcactgcttggtcaagcttcagcttctgtgtcctatgaccataaggctatcatcatcaatggacagagaaggatacttctttctggctccattcactaccccagaagcacccctgagatgtggccagatcttattcagaaggcaaaggaaggaggtttggatgtcattcaaacttatgttttctggaatggacatgaaccttcacctggcaaatattattttggaggaaactatgatctggtgaggttcataaagctagtgcagcaagcaggcctctatgttaacctcagaattggtccttatgtttgtgctgaatggaacttcggaggattccctgtttggctcaagtacattccaggtatcagcttcagaacagacaatggaccatttaagtttcaaatggaaaagtttaccaagaagattgtggatatgatgaaagcagaaaggttatttgagtctcagggcggtccaataattctgtcccagattgaaaatgaatacggacctatggagtatgaaattggtgctcctggtagatcctacactcaatgggcagcacatatggctgtaggacttggcaccggggttccatggatcatgtgcaagcaagatgatgctcctgatcctattattaacacttgcaatggcttctattgtgattatttctctccaaataaggcttacaaaccaaagatgtggacagaggcttggactggctggtttactgagtttggaggtgcagttcctcacagacctgctgaggacttggcattttcaattgcaaggtttatacagaaagggggatcatttgtcaattattatatgtatcatggcggaacaaattttggtcgaactgctggtggcccctttattgctacgagctatgattacgatgcgccccttgatgaatatggattggccagacagccaaagtggggtcatctgaaggatttacatagagcaataaaactctgtgaacctgctttagtatctggagattctactgtacaacggcttggaaactatgaagaggctcatgtttttagatccaagtctggagcttgtgctgcattccttgcgaactataacccacaatcttatgcaacagtggcatttggaaatcagcattacaacttgcctccttggtctataagcattcttcctaactgcaagcacactgtttataacactgcaagggttggttctcagagcacaacaatgaagatgactcgtgttcctattcatggaggactatcttggaaagcgtttaatgaagaaacaaccactactgatgatagttcgttcactgtgactggcttgttggagcagataaatgcaaccagagatttatctgattacttgtggtactccacagatgttgtgatcaattccaatgaaggatttttgaggaatggaaagaatcctgttcttacagttttgtctgctgggcatgctttgcatgtttttatcaacaatcagctgtcaggaactgcatatggaagcttagaggcccccaaactaacctttagcgaaagtgtgaggctcagagctggtgttaacaaaatctctcttctaagtgttgcagttgggcttccgaatgttggtccacattttgaaagatggaatgctggtgttctaggcccaattacattaagtggtctcaatgagggtaggagggacttaacttggcagaagtggtcatacaaggttggtcttaaaggtgaagccttgaatcttcattctcttagtggaagttcctctgttgagtggcttcaggggtttttagtttccagaagacagccattgacttggtacaaaactacctttgatgccccagctggagttgcaccgttggctttagacatgggcagcatgggcaaaggtcaagtgtggataaatgggcaaagcctaggccgctactggcctgcttacaaagcatccggttcttgtggttactgtaactatgctggaacttacaatgagaagaaatgtggaagtaactgtggcgaggcttctcaacgatggtatcatgttcctcactcatggctgaagccaagtggaaatttattggttgtgtttgaggaattgggtggggatccgaacgggatctttttggttagaagggatatagatagtgtatgtgctgacatctatgagtggcagccaaatcttgtaagttatgagatgcaagcttctggcaaagtcagaagtcctgtgagaccaaaagcacatttgtcatgtggacctggacaaaaaatatcatcaatcaagtttgctagctttggcactccagtagggtcttgtggaagctaccgcgaaggaagttgtcatgctcacaagtcatatgatgctttcctaaagaattgtgttggccagagctggtgcacagtgacagtgtctcctgaaatttttggaggagatccttgtccaagagtcatgaagaaactctctgtggaggccatttgcacctgatcattttcaacatctgaaaataagtggaataaagtttccatattgatttattctgcaattgaatacatggtgttttgggtcagctaagtttacacttgtagaccaccactggcattaatttggctttaccaaggtgaaattgcaaatgaatacacaccatgtggttgaaagcctgctgggatgattgttgtggttttatgtgtatatatattggtgttgtggttgttatactgaagtggaggagagggtgaaaaagttacctgatgcacattgagacgacatcgattgagtccatgtgcaaaattggtttttgtttgtgtggaagtctctagcttcctgtgatgtaatgttataatattaccttgtagttgtaaggagaaagcaatttggcgctttcttataagaaaacaacccaatgtaataacataaggtatattaattcaatcatgttttgcttttactttttcttgtttcgagaaagtgtcactaatacattttttctacccttagttgaagtttgattaaaatttacaaaatgattaagtctccattagaaagaagtgagacttaacattattttttaattcaataaa

SEQ ID NO: 1683 - DNA, 1425 bp, Glycine max var. Williams 82
atggacaacatttggattgtgtttgtgacagtgtttctcttatgcactgtgatcctctacaggaacaggcttagccttatgcttaaatcaaaacgtaagaagaataagcttccattaggcactcttggatggccttttatcggtgaaaccattgagtttgtttcttgtgcctactctgatcgccctgagagcttcatggacaagcgacgccgcatgtatggcaaggtgttcaagtcacacatatttggaagccctacaattgtttcaactgatgctagtgtgaataagtttatacttcaaagtgatgcaaaagtttttgttccttcttatcccaagtctcttactgagttgatgggagagtcttctattttgctcatcaatggaagccttcagaggagaatacatggactcattggagctttcttcaagtctcaacagctaaaggctcagatcaccagagatatgcaaaagtatgtcaaagaatccatggcaagttggagagaggactgccccatatacatacaagatgaaacaaaaaagattgcttttcatgtactagtcaaggcattgattagtttggatccaggagaagaaatggaacttctaaagaaacattttcaggaatttatctcaggcctcatgtctctaccaataaaactaccaggaactaaactctatcaatctttgcaggcaaaaaagaaaatggtgaaattagtgaagagaattatcctagctaagagaagtagtggcttctgcaaagttccaaaagatgtggtggatgtccttcttagtgatgctaatgaaaaattaacggatgatttaatagcagataatattattgatatgatgattccaggggaggactcagtgccacttcttatgactctggctacaaaatatctatcggaatgtcctgctgctttgcaacaattgacggaggaaaatatgaagcttaagaaaattcaagatcaggttggagaatccctgagttggagcgattacttatcactgccatttactcaaacagtcatcactgaaactttgaggatgggaaatattataattggagtcatgagaaaggccttaaaagatgttgaaataaaagggcacttaataccaaaagggtggtgtgtgtttgtaaattttagatcagttcatctagatgacaaaaactatgaatgtccatatcaattcaatccttggaggtggcaagacaaagatacgagcagttgcaatttcactccttttggagggggacaaaggctgtgccctggccttgacttggccaggctggaagcttccatcttcctacaccactttgtcactcaattcagatggcatgctgaaaaagatgcaatagtgaacttccctacagtaagaatgaaaaagaggatgcctgtgaaggtaaggagagtggaatcttaa

SEQ ID NO: 1684 - DNA, 789 bp, Glycine max var. Williams 82
atgtctggaattgtggttgttttcgactttgacaagaccatcgtcgatgtcgacagtgacaactgggtcgtcgatgatttgggtttcaccgatttgtttaaccagctccttcccaccatgccttggaactctctcatggataggatgatgatggagcttcattcaaatggtaaaaccatagaggacattgaagaggttttgcataggattcccttgcaccccagagttatacctgctattcaagcagctcatgctttagggtgtgatttgaggattgtgagtgatgcaaacgtgttttttattgagaccattctgaagcacttgggaataagggaatacttttcggagattaacaccaacccgggttatgttaatgaagaaggaaggttaaggattcaaccttgccatgacttcaacaaagcttctcatggctgcagtttatgccctccaaacatgtgcaagggtttgatcatagatagaatccaagattcaatttcacaagaaggtaacaagagaatgatctatcttggtgatggtagtggtgactattgcccaagcttgaggctcaaagagagaaactttatgatgccaaggaagaactttccagtgtgggacttgatttgcaaagaccctttgcttgttaaggctgaaatccatggctggagtgatggagaagagttggagcaagttttattgcatttaatcaacaaaatttcaatggaggaaaatgttcatgagcagttaattgcatctgattgcaagttacagactctgtctgtctctgcttaa

SEQ ID NO: 1685 - DNA, 1420 bp, Glycine max var. Williams 82
ttggaatcaaagattctttttttggggggttttaggtttaggcttaacccacattcactataaataccctcctcattctgggctacaaaatcaagtcaagaaccaatcttgagagcactacgagacacccaaattgagtctaattcttgagaaggaggtttcttcctctgggtcattgagattttctccattctccaaaaaaaaacaaaaaccatgtctggaattgtggttgttttcgactttgacaagaccatcgtcgatgtcgacagtgacaactgggtcgtcgatgatttgggtttcaccgatttgtttaaccagctccttcccaccatgccttggaactctctcatggataggatgatgatggagcttcattcaaatggtaaaaccatagaggacattgaagaggttttgcataggattcccttgcaccccagagttatacctgctattcaagcagctcatgctttagggtgtgatttgaggattgtgagtgatgcaaacgtgttttttattgagaccattctgaagcacttgggaataagggaatacttttcggagattaacaccaacccgggttatgttaatgaagaaggaaggttaaggattcaaccttgccatgacttcaacaaagcttctcatggctgcagtttatgccctccaaacatgtgcaagggtttgatcatagatagaatccaagattcaatttcacaagaaggtaacaagagaatgatctatcttggtgatggtagtggtgactattgcccaagcttgaggctcaaagagagaaactttatgatgccaaggaagaactttccagtgtgggacttgatttgcaaagaccctttgcttgttaaggctgaaatccatggctggagtgatggagaagagttggagcaagttttattgcatttaatcaacaaaatttcaatggaggaaaatgttcatgagcagttaattgcatctgattgcaagttacagactctgtctgtctctgcttaaagtcctccaagttcaaccataatttcttagtttatagtatctttcaaaatgtatcataactcaacggtttttttcttatttcgttgataagccatcatcaaatcttcaccaaaattgctaatgttggaagtgtccaaggtggacatctatcaaaaacaaatacataccgatttgccctataaatcttcaccaaactttggttttctatttgtacaattttttttgcgataaaaggagaaaaaatgttatataagatgaataatgtaatagaaagaaacaaaaaaaatattataaaaacattatactaataatataacttgctactttaaaaagttgtccatttatagttaataaggaattgccacaaaaggataaaggccccactaaacactccagagtctgcagacagcttattttc

SEQ ID NO: 1686 - DNA, 1296 bp, Glycine max var. Williams 82
atgagctccttcaaaacatggttcaatttgttcaccattttctatgtcttggctgcaactccaatcttctcattaacagattcctcaaaccaactctccacaaactttctagaaattgccaagaaacctgaagtttttgactggatggtgaaaatcagaaggaagattcatgagaatccagagttgggttatgaggaatttgagaccagtaaactcattagagaggaattggataaactgggtatcccatataaatacccagttgcagtcaccggtgttattggcttcattgggacaggaaagtcaccttttgttgcattaagagctgatatggatgcacttcccgtccaggaaatggtggagtgggagcacaagagtaaagtacctggaaagatgcacgcctgcggtcatgatgctcatgtcactatgcttcttggtgcagcaaatattctcaaacagcatgaaaaagagatacaggggactgttgttcttgttttccaaccagccgaggaaggaggtggaggggctaagaaaattttagatgctggagccttagaaaatgttactgctatctttggattacacgtggtgcctctcattccagtaggtacagcggcctctaggtccggtccattaacggctggaagtggtttctttgaagccaaaataagtggaaagggaggtcatgcagctattccccaactttctatagaccccatattggcggcttctaatgtcattattagccttcagcaccttgtttctcgcgaggctgatcctctagatccccgggttgtcacagtttcaaagattcaaggaggtgatgcattcaatgttattcctgattatgccacaattggtggcacctaccgtggttttactaataaaagcatggaccaacttaaattgcgaatcaagcaggttatcatcggtcaagctgctgtgcagagatgcaatgcaactgttaacttctttgaaaatgtgggaccagcgaatcctccaactgtgaataatggtgacttgcacaagcattttcaaaatgttgctgagaatgtgcttggcgtcaataatgttaatcttaacatgccaccattcatggtagctgaagactttgcattctatcaagaggtcatacctggctacttcttcacgcttggaatgaagtatgcttcacctaatgaaccgtttcagtcattacactcaccatatctcagaatcaatgaagatggacttccttatggggctgcacttcacgcatcattagctactagttatcttataaaacttcagcagtaa

SEQ ID NO: 1687 - DNA, 2688 bp, Glycine max var. Williams 82
atgatgggaatgttattgcagtttctttatgtattgtttggggtacttatttctgtggttctggttcaagcacaggatcaatcaggattcattagcattgattgtggtctacctgaatcctcaagctatactgagaagaccacaagcatattttacatttcagatgccaaatttatagatgctggtgtaagcaagagtatttcaccagcagagaagagtactcatctacaacagctagcatatgtgaggagttttcctagtggagagagaaactgttacagaataaatgtaaccagtggtactaaatatttgatcagagctactttcttttatggaaactatgatggcctcaatcagccaccacaatttgatcttcatcttggacctaatttatgggacacagtgagcttccccaatgcatcactcagcgaaatcagtgaaatcatttacaccccatcactagattacatacatccatgtcttgttaacaaaggtcaaggggctccattcatttcaaccatagaattgaggactttgaaaaatgcttcctatgtcacagcgtcagctgaatcattggcatactatcggcgatatgatttaggttccatcaccaacttagtatacaggtacaactatgatgtttatgaccgcatctgggtgccacatggattcaaccagtggacacaattaagcagcacacttaatcatgatatattccagaatgattacaaattaccagaagttgtcatgagcactgctgctacaccaataaatgctagtgctccatttcagttctattgggatccagataatgtgaatgagaaattctacatctacatgcactttaacgaggttaaaattctggcagaaaatgaaactagaacattcaatatcttcatgaatggcaagttattctatggacctctgactcctggatatctgacgaaaaatatcatatatagtacatcagctttgaccggagctacaaggtatctattttctcttgctaagacagggacttctacccttccacccatcatgaatgccatggagatttataaagtaatagattttgctcaatcagaaactgaacaagatgatgttgatgctatcacaaacatcaaaaacgcttatggggtggatagaaattggcaaggagatccatgtggcccagtagcatacatttgggaaggtctaaattgtagttatgataacaccccaagaatcacatccttgaatttgtcttcaagtggactgaccggacagatattatctttcatctccgagctcactatgttacagtatttggatttatcaaacaatagtttaagcgggtcagtacctgattttctgacacaactgcaatcacttaaagtcttaaacttggcgaaaaacaaccttactggtccagttcccggaggacttgttgaaagatcaaagcaaggttcactatcattgagcctggatcaaaatccaaatctatgtgaatctgatccatgcatccagcagacaaataacaagcagccagatggtgatcaacagaagaacaaaaataatatagttatcccggtagtagcatcagttgctggggttttggtgctcctaataattgtagcagcagctataatctgtggccttaaaaggaaaaaaccacaagcatctgatgtaaacatttatgttgagacgaacactccaaatggatcacaatttgcatccaagcaacggcaatatacattcaatgagcttgttaagatcaccaacaactttaccagaattcttggtagaggtggatttggaaaagtttatcatggatttattgatgacactcaagtagctgtaaagatgctttctccgtcagcagtacgaggatatgaacaattcctagcagaggttaaacttctgatgagagttcatcatagaaatctgacttctcttgttgggtattgcaatgaagaaaacaacatagggctcatctatgaatatatggcaaatggaaacttggatgaaattgtttcaggaaaaagtagtagggcaaagttcttgacatgggaagacagactccaaatagcattggatgcagcccaaggactggaatatctgcataacggttgtaagccaccaataatccacagagatgtgaaatgtgcaaatattttattaaatgaaaacttccaagcaaaattggctgattttgggctatccaaaagctttcccacagatgggggatcttatatgtccactgttgttgctggaactcccggttatttggatcccgagtacagcatatcaagcagattgacagagaaaagtgatgtttacagcttcggagttgttcttttggagatggtcacaggtcagccagctattgcaaaaacacctgataagactcacataagtcagtgggttaaatccatgctttccaatggggatataaaaaatattgctgactcaaggtttaaggaagattttgacactagctcagtctggagaattgttgaaatcggaatggcttctgtgtccattagtcctttcaaaaggccaagtatgagctatatagtgaacgagctaaaggagtgtttgacgacagaattagctcgaaaatatagtggtcgtgacactgaaaacagtgactcaattgagttggtcactctgaatttcacaactgaacttggtcccccagctaggtaa

SEQ ID NO: 1688 - DNA, 921 bp, Glycine max var. Williams 82
atgactatcctcattgagcaatctgatcactttggggctgaagtagaggcaaagactgaaccaataaatgagagagaactggtgttggatggtggatttctgataacacagaccaactcatttgggcacatgtttagggcttataatgatgctgaaagtgagaggcatgaaggagtggagaacttctacagaaaaaatcacacttaccaatcaattgatttcgtgaagaaaatgagagaggagtacgcaaaattgaacagggtagagatgagcatatgggaatgttgtgaactccttaatgaagtggtggatgagagtgaccctgacttggatgaacctcagattgaacacttgctccagacagccgaagctataaggagggactaccctgatgaagattggttgcacctaactggccttatccatgatcttggcaaggtgctgaatttgcctagttttggaggacttcctcaatgggctgtagtaggggacatattccctgttggttgcagatttgatgagtccattgttcaccacaagtattttaaggaaaatccagactacaacaatccagcatacaacactaaatatgggatttactcagagagatgtggacttaacaatgtgatgatgtcatggggacacgatgactacatgtatctagtggcaaaggagaatgatactacactgccctctgcggctttgttcattataagataccattcattctatgcattacataaggaaggagcctataagcacttgatgaatgatgaggattttgagaatctgaaatggctccatattttcaacaaatatgacctttacagcaagagcaaaattcgaattgatgttgaaagggtcagaccgtactatctgtccctcattgaaaagtacttccctgcaaagctgaagtggtga

SEQ ID NO: 1689 - DNA, 1686 bp, Glycine max var. Williams 82
atcattggtaagagtcaatttgaatctatattgatgtacctactactcacaacaaatccaaagtcgatcagcaaccaattaatcacactctttccatggaatgatgggagtgtgttgtcctcttttagattgctttttaacttggtggtaaatatagtagttattttatgttaaagggagggttaaagatggataaacatgatgttagtaccaaagatggaaaactagaaaatgatcaaatgaaaaagcaagattttcagggaaggacttggtatctcccaattctcaggcaaggacactccggccacttataaatagcaaagcaacctttccacaaccatgccaacccacctcaaaattcttctccttttgtgcttccaactcttttctttgttatattattctctttcactttctgccaacccttggagtcaacatgactatcctcattgagcaatctgatcactttggggctgaagtagaggcaaagactgaaccaataaatgagagagaactggtgttggatggtggatttctgataacacagaccaactcatttgggcacatgtttagggcttataatgatgctgaaagtgagaggcatgaaggagtggagaacttctacagaaaaaatcacacttaccaatcaattgatttcgtgaagaaaatgagagaggagtacgcaaaattgaacagggtagagatgagcatatgggaatgttgtgaactccttaatgaagtggtggatgagagtgaccctgacttggatgaacctcagattgaacacttgctccagacagccgaagctataaggagggactaccctgatgaagattggttgcacctaactggccttatccatgatcttggcaaggtgctgaatttgcctagttttggaggacttcctcaatgggctgtagtaggggacatattccctgttggttgcagatttgatgagtccattgttcaccacaagtattttaaggaaaatccagactacaacaatccagcatacaacactaaatatgggatttactcagagagatgtggacttaacaatgtgatgatgtcatggggacacgatgactacatgtatctagtggcaaaggagaatgatactacactgccctctgcggctttgttcattataagataccattcattctatgcattacataaggaaggagcctataagcacttgatgaatgatgaggattttgagaatctgaaatggctccatattttcaacaaatatgacctttacagcaagagcaaaattcgaattgatgttgaaagggtcagaccgtactatctgtccctcattgaaaagtacttccctgcaaagctgaagtggtgaagagttaattggagccatgaagtgccaataatttaccatgatagccaactagtttcgtatggagtagagggaataataagctataaagctgtagttgcattaattaatttatatgctttggtggtttaagatattcttgtaagttgtatgaaataatatttgtagctaaagtcctgcaaccagaggaaatgtttttccttttttgttttttctttcccttatctaaggaattctcacataatgtgaaactatacggtctcttgattctttaactgagggtgacaattaagtaaatcgtttcttaaagggacaatttcaagattagactc

SEQ ID NO: 1690 - DNA, 1098 bp, Glycine max var. Williams 82
atgcatatccaaaggaacaaaaatattattaagatgatcaacattattggagcacttgttctactctttgcatttctcttcctcagttgtgtgtatgcacaagacacaacaacccttgtgcctgcaatcataacttttggtgattctgctgtggatgtagggaacaatgactatcttcccacccttttcaaggctgattaccctccttatgggagggactttgttaaccaccaacctactgggaggttttgcaatggcaaattagctactgatttcactgctgacacattgggtttcaagacctatgctccagcatatcttagcccacatgcatcagggaaaaacctccttattggagcaaactttgcttcagctgcatctggttatgatgaaaatgctgctactttgaatcacgcgattccgttgtcccaacagttgagttatttcaaggaataccaaggcaagctggccaaggtagctggcagtaaaaaagcagcctcaatcatcaaggatgcgttgtatgtgctcagtgctggaagcagtgactttgtgcaaaattattatgtcaatccttggatcaacaaagtctacactcctgatcagtattcgtcctacttaattggttcattctcaagttttgttaaggacttgtatggattgggaggcaggagacttggagtgacttcactcccaccattgggttgcctacctgctgcaaggactatatttggtttccatgagaatggttgtgtctcaagaatcaacactgatgctcaaggatttaacaagaagctcaactcagctgcaacgagtcttcaaaagcaacttcctggtcttaagattgcggttttcgacatttacaagcctctctatgaccttgttcaatccccttcaaaatctggttttgtggaggcaaacagaggatgctgtggtaccgggactgtagagacaacatccttgttgtgtaatccaaaatcaccaggaacttgttctaatgccacacagtatgtgttttgggacagtgtccatccttcacaagctgctaaccaagttctagctgatgcattaattctacaaggcatatctcttgtcacataa

SEQ ID NO: 1691 - DNA, 942 bp, Glycine max var. Williams 82
atgtggcaaagaagccacaagtcatcagaggagagaaagctggagcttaggcttggtccacctggtgaagagtctctcaatgaaagcatcagaaaaagcaacagagaaagaaatgaatcacaattcactcttggttgcttctcaactcaaaatttttttacttctgacaagcaaggtccaggtgggactacgttgccctctgcatggccttccacatcctatcatcaccaacaccaggctaaagctaaagcttcatcatttcttcagctccaatcaagtccacaaaacatgatagtgatgggaaaggatgtgtcacaattctcttgtgtagagaagaaggtattctcaccctcttgtgcaaatccagcggtgtccaaaagaacttcttcaggtccagcagtgggttggcctccaattcgttccttcaggaagaacattgcaagtggaagcacttctaagttgccttctgggtcccaccagcaacatcaaaatgttgttccatacaaggttgctagccaaaaacctactgacaaatctggtaaaggcttgtttgtgaagatcaatatggatggtgtccccattgggagaaaagtggacatcaatgcttatgacagctatgaaaaactttcctctgctgttgatgagctctttaggggcctccttgcagagatgaagttatctcatattggctcttcccaatgctgttctggtcaaagagattcctgtgctggtggaattcaaaacaaggaacaggaagagaaatccaataagggtttattggttggaagtggggaatatactcttgtttatgaggataatgaaggagacaggatgcttgttggagatgtgccgtggcacatgtttgtatcgacggtgaagaggctgagggtgttgaagagttctgatcttcctgcttttacacttggtagtaagcaagactag

SEQ ID NO: 1692 - DNA, 312 bp, Glycine max var. Williams 82
atggcgaacacttgttgtcccattgagctggagcctaggacactgaatcaagtgcagttcactcaagcaagggaagtagctgcagaggtggttcaaaagttgcaaccacgtgaagcatcagctctgtttattgaggggctcatgcatccaatacaggaggtgatgcacatggatgaaaacggaaacctaactgagaagctcgttgattgcatgaagaaggctgagtctatccctgatgacaaagcttgccattgccagtgctcgtgcgctgctgtaaacccatttaaagaaccactttctgcaccgttttga

SEQ ID NO: 1693 - DNA, 510 bp, Glycine max var. Williams 82
atggcttccattgttgcaagcttgccgccaccattgctgctccctgctagaaaatatcatccgggcaacttcccaagttcccctttttctcttctttcagggagacggaatcatgtttcttttgttgtgaaggcttctggagaaagttctgaatcttcaactacccttactgtttttaagtctgttcagaatgtttgggatcaacctgaggaccgtctgggacttattggtttgggatttgcagccatagcagcattttgggcatcaacaaatttgattgcggccattgacaaattgccagttttcccaacagtactggaattaattggaatattttactctgtggtaagtgctgtgctgcataattggtgtgtgtttctattaatgccaattatgtttctattaacttttcctttcaatttcagtggtttacttatcgctatctcatattcaaacctgaccggtaagcatgttggtcccctttattcttatttccacaagtttgtttaa

SEQ ID NO: 1694 - DNA, 435 bp, Glycine max var. Williams 82
atggcttctcttgcaaccttagctgctgttcaaccagctgcgctcaatggccttgctggaagttccctctctggaactaagctctctttcaagccctctcgccacactgtcaaatccaagaacttcaggagtggtgccgtggtagcaaagtatggtgacaagagtgtgtactttgatttggaggatctgggcaacactacggggcagtgggacttgtatggctcagatgcaccttcaccctacaaccctcttcagagcaagttcttcgagacatttgctgctccattcacaaagaggggattgttactcaagtttctgatattgggaggtggttccacccttgcatacttcagtgcaacagcctcaggtgacattctaccaatcaagaagggaccacaacttccaccaaagcttggtcctcgtggcaagatctaa

SEQ ID NO: 1695 - DNA, 912 bp, Glycine max var. Williams 82
atggatttctggccagaatttcttgcaagcggttcgggaagagagtttgtagcaggtggctttggaggcattgctggtataatttcaggttatccacttgatactcttcgaatcagattacaaaactcgaaaaatggctctgcattcacaatccttagacaaatggtgtctagggaaggaccaacttctttgtaccgtggcatgggcgcaccattagcctccgttacttttcagaatgcaatggttttccaaacgtacgcagttctgtcaagggtatttgactcatctgtttttgctaaagaccctccttcctacaagggtgttgctttaggaggaacgggtgccggggttctccaaagtctattaatatcccctgtggagttgaccaaagttcaacttcagctgcaaaacggaggcaagatgacagaatctgtaaaaggttctttgacactcgccaaaaatatatggagaaaagaaggcctcagaggaatctatcgcggacttggtctcacagtgatgagggatggaccttctcatggtttatacttctggacatacgaatacatgagggaacagcttcacccaggttgcagaaaaagtggtgaagagagtttggataccatgttgatagcaggaggattagcaggggtgacgagttggattagttgctacccttttgatgttgtaaagacaagactacaggctcaaacaccctcttctataaagtacaaaggcattatagattgtttcaaaaagagtgttaacgcagaaggatacggtgtgctatggcggggtttaggaactacagttgccagagcgttcctcgtaaatgctgccgtattttctgcttatgagatttcactaagattattgtttaacaatgggagtattcaaatgcaggaaacactatag

SEQ ID NO: 1696 - DNA, 1768 bp, Glycine max var. Williams 82
aaacctgaatctttcaagcttttcaaaaaatcaagccccaacatgacacacaaagacaaagatttctacaacccacttgtgctgttccaacttccaaggttcaaggcttcatgtcacgagattttccagtagtggtagttgatagataaaattatcttcaccttgaactgaattccctcagtcattgttaatatctgtttctgtttatgtggggtgggggcaccaaaatcaattccaaaaagttgctgaacactaggctagaagcaacaacatcgggcacgattaaatttttccacgtgtaaatcatgtattggtaacgtacgtagattgattggtggggcctttttcttgcagtacaaaatagcaaaacaaaattgccaccggtgacatttgttttggcctatactcaaaagctgaggtcggagttctctgtttcttttccatctcacaagaaatgggaaggtgaaaaaaaggttcctatcattaacttgacacataaagatatcacatttcgggtttgccaaactatagatagaaacgccaaaggagggcgttttagctcaatagcttattacactagtggtatttgattcattgtgtaagcaaaaaaagcaacagagactagctatctgatataaagtttttaggaatgagagcagaagaaaatggatttctggccagaatttcttgcaagcggttcgggaagagagtttgtagcaggtggctttggaggcattgctggtataatttcaggttatccacttgatactcttcgaatcagattacaaaactcgaaaaatggctctgcattcacaatccttagacaaatggtgtctagggaaggaccaacttctttgtaccgtggcatgggcgcaccattagcctccgttacttttcagaatgcaatggttttccaaacgtacgcagttctgtcaagggtatttgactcatctgtttttgctaaagaccctccttcctacaagggtgttgctttaggaggaacgggtgccggggttctccaaagtctattaatatcccctgtggagttgaccaaagttcaacttcagctgcaaaacggaggcaagatgacagaatctgtaaaaggttctttgacactcgccaaaaatatatggagaaaagaaggcctcagaggaatctatcgcggacttggtctcacagtgatgagggatggaccttctcatggtttatacttctggacatacgaatacatgagggaacagcttcacccaggttgcagaaaaagtggtgaagagagtttggataccatgttgatagcaggaggattagcaggggtgacgagttggattagttgctacccttttgatgttgtaaagacaagactacaggctcaaacaccctcttctataaagtacaaaggcattatagattgtttcaaaaagagtgttaacgcagaaggatacggtgtgctatggcggggtttaggaactacagttgccagagcgttcctcgtaaatgctgccgtattttctgcttatgagatttcactaagattattgtttaacaatgggagtattcaaatgcaggaaacactataggagaaaattaaacaccattccaatagcagctggtgtgctgaaaacaatcaaaattccgctttgatattcaataaccattacaagatgtaattgccgtatattctatacgtaattaatattcattagatgatgtaattatcaatatttgtttttctattctttgactgtgaatcccgcgtttgcggaagcgt

SEQ ID NO: 1697 - DNA, 642 bp, Glycine max var. Williams 82
atggaaatgttgacatggacaatttttgcccttgtttctttgtatcccctcttcacttgtgatgtctctgctactatttccacacagttaatgtccaaccaaacacaagatgatttatcaaatatatgtggtttagtatattgtgggaaaggaacatgccgaccttcttcctctgaattgctcggttttacatgcgattgtgaatctggttggaagaagcctaaaattggttctgtcgaattaccgccatgcatttttcctaactgtactgttaatttaaattgtggtaatggatctccggcaaccccttctccacctacagaagtgaatgacccttgcttgttgaatttctgcggggatggaacctgtgtgagtcatggctttgattttaagtgtcaatgcaatgaaggctcagacaatctacttaatgatccaaagttgttttgctttcagaaatgcactttgggaggagattgcaatgggcttgatcttgggttcggctccgaaactccgccaccgccagcaacacatgggtctgcctctcctggaactgcaggttcaggtgaaacgctgagttgcacaagggagcttcatatgctagctatgacgatattagcattgatatttcaaatctggacttaa

SEQ ID NO: 1698 - DNA, 1089 bp, Glycine max var. Williams 82
atgtggagcaaccttcccttggacattttagccaacatcttctcatttctctccccagactcgttggctagagcaagatcagcttatcctatagccacaacaacctcttcatggttcttggctcttccaattcgcaaccatagaccatattgctacgctcataatccagtgatagataaatggcaccaactctctctaccaatcccatcaattcgaccaattggtccaatagggagcctcctcctcttaagggtcaccaattccacaaccctccaattgggtctttgcaaccccttcacgagagagtttaggcaccttccccggttgcatgttgcaagaaccaaccctgccgttggagtagttacaacctcggagtcatcgaatccaaaccgtgatgacgatgatgttcggtttccttcctttaaggtctacgtggctggtggcatgtccgaggcagcacaaggtggcggcgccacgtatgaaaccaaagtggagatgtatgactcgcggtttgacacgtggcggattgtggggtccacgcctgtcgagtttgccgttaggctcaccgtgtggacacccaatgagaacgtgtgcattggagaaacgttgtattgggtaacctcggccagagtctatagtgtcatgggatttgatgttggtagaaatagatggagggagttgggtgtgcctatggctgagaagctggaatttgccacgcttgttccgcggaatggggcattgggattggttggtggcacgtgtggtggaagtgcttgcatttgggagctaaatgaaggggacaaatggtgcttagtggataaggtgccacttgaattggggttgagattgttgggagagaagagaatttgggagagtgttaagtgtgtggggaatgaggatgctatttgtttgtatagggatattggatatgggatggtgatttgcaaaaaggtagtaggggaaataatgggtaggtgggaatgggtttgggttgatgggtgtggttacaccaaggggaaacaagtgcataattgtccaatcagaggggcacttgttcatccaagtcttgcctcctctcttatcttttaa

SEQ ID NO: 1699 - DNA, 642 bp, Glycine max var. Williams 82
atggaggagtcaggggaaaattggccttccgattcttatttagatgacttcgtcaacgatgatttaggttttgatgatgaagaatttggtagtgaagatgattcattttctgggatgggcgagaccgacagaaagaagagacagcgagaactcacagagaggttccttgcactttcagccaccataccaggcttcaaaaagacggacaagacttccatcctggccaatgctagcagctatgtgaaacaacttcagcaacgtgtgagagagctagagcaattgcaagaagttcaatccaacgttactagcaacgaaggcgccaccagctcttgcgaagtgaactcatcatccaatgattattactgtggtggaggaggaccaaatgaaattcttccagaggtcaaagtaagagtgttacagaaggaggttctcatcataatccactgtgagaaacacaagggcatcatgctcaaaatcctttcccagcttgaaaatgttaatctctctatagtcaatagcagcgtcttacgatttgggaaatccactctcgacatcaccattgttgctcagatgggtgagggatacaagatgacggtgggtgaactagtgaagaccctgagagtagcgatcttgactcattag

SEQ ID NO: 1700 - DNA, 987 bp, Glycine max var. Williams 82
atggaggagccatgggaaaattggcatcttcacatggaaatggattgcgggaacgatttctcagggaagtgtcacggcactcacgatgacgagttcctcagagacatccttcttcagcaaccacctgcggctttctcgtccgaaagcgaaagcgatcactccttccgccctgtcgtccaaaacactaccatcaccaacgacggcgccgtcaaaagcaacagctctcaaatctcttccaaacgacctcgtcctttgtccactcccaggacttacattctgtccttcgacaactcaaccatgcttccggcctcacccgaaccccgcctccgctcttccaacaataattccccttggcctccggaaagcccaggcccagaacctagaaggcccattactggaggagctaagaagaccagaacctcttctcagaccatcgatcacataatggcggagagacgaaggagacaggacctcactgagaggttcatagcactctcagccaccattcccggcttgagcaagacggacaaggcctctgtacttcgagcagcaatcgattatttgaaacaacttcaagaaagggtacaggaactggagaaacaagacaaaaaaaggagtaaggagtcagtgatattcaacaagaaacccgacccaaatggaaacaacaatgaagacaccaccacctccactgaaacgaactgtagcatccttcctgagatggaagtaagagtgttggggaaggaggtgctcattgagatccactgtgagaaggagaatggtgttgagctaaaaatattggaccaccttgagaatcttcatctcagtgtcaccggtagcagtgtcttgccatttggaaattcttctctctgcattaccatcacagctcagatgggtgacgggtaccaaatgacaatgaatgatctagtgaaaaaccttagacaagtgctctcaaaatcacatttgctaagcgacagtgatccgtactag

SEQ ID NO: 1701 - DNA, 678 bp, Glycine max var. Williams 82
atggaagatcaaaaacaccagcatgattccgttcctcgtgttttactagatctaagtctctcctccaacaaggattcaggtgatgataactcaaagcttaagccagaactcaacctcctcaattgtttccatacaaatttctctgaaaactcatcagaatctagtcagggaaatgaactggatcctcgtgttttctcatgcaactactgccaaagaaagttttatagttcccaggcactaggtggacaccagaatgcgcacaaacgtgagagaactttggcaagaagaggatacaaagctggtgctgccgattttggacacacatactccaacattcattttctgccttcacatggcttatacaacaaagcacttggaattcaggttcattctatgatcaacaaaccttcttatcaaacaccctttttcgggttgtgccgttccaataatgggtggcagaggcaacctttggattcacaaccagcaattgggaactttcgtgtgggggcagaaactgagtcatcatccttggctgatagtgttccaaagttaggcaagttttccacaaggttggtggcagaagggtttggaggttactgctttggtagcattactactcatttgaagtctaaacaacaagaggagttgcagaagcttgacttgtcccttaagctctaa

SEQ ID NO: 1702 - DNA, 1416 bp, Glycine max var. Williams 82
atggctgcaacttattatttactgccaacaagtccgaaaactttctcacctttcctcagaaacccaccttccattccttcaggtcatcatgtttcactgttgggttcattattggactatccattccattgttccagcagaagaggaaacaatagtgttgaggccaattgcaatgcaaaaaagaagaacccttggttagacccttttgatgatggggaggatcctgagatggagtatggttccttgtttgcagatgggaagcaggaggaggatcctaggccacctgatgaccctgacaacccttatggattcttgaagttcccttctggatattctgtggagatagcatccttggcattgaaagtgagaggggatgtgaggagatgctgctgtgtgatatctggtggtgtttatgagaacctcttgttctttccggctattcagctgatcaaggataggtaccctggtgttcagattgatgtggtggcatccgagagggggaagcagacctatgagttgaataagaatgtgaggtgggctaatgcttatgaccctgatgatgagtttccagagcctgctgagtatactgatatggttggagttctaaagaataggtactatgacatggtcttaagcaccaaattggcaggccttggccatgcagcatttttgtttatgacaactgcccgagatagagttagctatatctacccaaatgtgaatgccgcaggagcaggattacttctatctgaaacattcgtcccagatagtcaaaatctctcagacggaggatataatatgtaccatcagatggttgactggctaggaaaaccatttcgagaagttccaagacaaccagtgccaccacttagggtatcaatctcaaagaagttgaaggaggttgttgaggcaaaatacgaaaaagcaggtgcaaaaaaaggaaaatatgttgtcattcacggtataaaatcagattcaaaggcctccatgcagtctaggggtgatcctgatagcttgctacccattgaagtgtgggctgaaattgctgacgttataagggatgttacgccactttttgtcattccgcatgaaaaagaaagggaaaatgtggaggaaatattttcagaagatgcatctattgtcttcatcaccacccctggacagctagctgctcttattaatgactcagctggagtgatagctacaaatacaactgctgttcagcttgcaaatgcacgcgagaaaccttgtattgcactattttgctctgaagagaagggaaacaagtttgttccgcgggctgaagagaagaaatgtattataatatcatccaagacaggaaagttaatagatattgatgttgaggctgtaaaaaacgcagttcaaacattcaatttgtctccagctttagtatag

SEQ ID NO: 1703 - DNA, 1212 bp, Glycine max var. Williams 82
atgtctctaaaaatagcagcagaagtttatccaaaatcaccatcagagacagggatggagcctttggtgttagtaaaggaatatgaagaagatagacacaaggtggcagtagagaaacttgagaggctttgtgaagttgggcagagtggaaagccttctcttgtcactgacctcatgggagaccccatatgccgtatccgtcactttcaattgcatgccatgctagttgcagaatatggagaagaaggagaagttgttggggtgataagggggtgtgtaaaaacagttacaagagggaattcggtttatgtagaactagcctatatcttggggctcagagtctcccctcggcacaggagatttggcattggcacaaaactagttgaacatttagaagagtggtgcaagcaaaaagggtctaagtatgcatatatggcaactgattgtaccaatgaaccatccgtgaatttgttcacaaaaaaatgtggttactcaaagttcaggactctaaccatactagtgcaacctgtgcatgctcactacaagccaattagctccaatgttgctgtgcttcgccttccgccacgcctagccgggtccatgtataaccatatgtttgccaattcagaattttaccctaaggacatagagttaatcttgtcaaacaagctgaatttgggaactttcatggccatcccaaagaagtacttatcgaaatgtgatccaaaaaggggcattctgcctccaagctatgcaatattgagtgtgtggaacaccaaagatgtgttcaagttgcaagtgaagggtgtgtcaccatgggcacatgcttgttgcgtaggtacaaggttgttggatgaatggatgccatggctaaggctaccttcatttcctgatgtttttaggccatttggggtttattttctctatggactacacatggagggaaagtgtggtgcacaactaatgaagtccctgtgtggatttgtgcacaacatggctagagatgatggtggttgtggggccattgtggctgaactgggccaaagggacccagttagagacgcagtcccacattggagaaagttctcatgggcagaggacatgtggtgcattaagaatcttgaggacactaagaaggatatccaagaatctgattggttcacttctagatcctcttcgccagtgatatttgttgatcctcgagatttttga

SEQ ID NO: 1704 - DNA, 411 bp, Glycine max var. Williams 82
atgattgatatgtggaagagtgtattggtgttggtgttcttgtgtcttagtcttagtaatggtgatgatcaagagaagaagaaaccctgtttgtgggagtggaagagactgagtagcgcttactctgcctatcgggcactttttccttcaagtattggtcttgacatgcttaagaaccttgtcactcacacatatgcccgtttctttcctccaaatatagattttagaagagaggaggaagggcaagtcaaagagaatggagctggggaaaaggttagagaagcttttgcgaaaagcctaggaaatagcaaagctacgttggaggatgcagcaaaatcagcagcggaaaccgtgaggaccttctctgagtctgatgagaatagggaaacacaacatcaaaacgagctctga

SEQ ID NO: 1705 - DNA, 673 bp, Glycine max var. Williams 82
aactcaagtttcatgaatgattgatatgtggaagagtgtattggtgttggtgttcttgtgtcttagtcttagtaatggtgatgatcaagagaagaagaaaccctgtttgtgggagtggaagagactgagtagcgcttactctgcctatcgggcactttttccttcaagtattggtcttgacatgcttaagaaccttgtcactcacacatatgcccgtttctttcctccaaatatagattttagaagagaggaggaagggcaagtcaaagagaatggagctggggaaaaggttagagaagcttttgcgaaaagcctaggaaatagcaaagctacgttggaggatgcagcaaaatcagcagcggaaaccgtgaggaccttctctgagtctgatgagaatagggaaacacaacatcaaaacgagctctgagtgattatcctcttctcatctttaaccaacccaccctcacacgacacaaatttaaagttcttcatttcatttcttatttgttttcttttgctgctaataaatagtaacgagtcttttgcttaatgctgtgattgtaagtaaataaatgaagaagcgcgcagcgtttgtttgtgtgcagctgatatggcatggaaagctatagatagttctttttccggtaataaattcctcgttctgaaattcttt

SEQ ID NO: 1706 - DNA, 1281 bp, Glycine max var. Williams 82
atggagtttttgaaaatcaaaaagttcagaaaatctcagaaagcaaatggagaaaaggatttggcagacaaggcagtgcctgagcctgaggaaccaaagctgaacaccgatggtcctgatcagtgtaaatcagaaaacgcagactctgcaggtgaagcagaggatgacgatgattttattaccaatgaggttaagaggaggctaaaagaattgagaagaaacagttttatggtgttgattcctgaagaagattcctgccctgaggaaggggaggatgaagaggaagaggaagccggagagacatgctcaaatgaatggagggatgtggaggcagaaggtcagcaatggtggcgtggttttgatgctgtatttgaaaagtactgtgaaagaatgctgttctttgatcggatgagcactcaacagcttagtgaagttggcaaaggttcacagtatacttcaactccatctccaagatctgcttcaaagaagctggcttctccccttcgttgtctttccttgaaaaaatttgaagaacctgatgatgagactgaacatcttcaacagcctgagcatgacccctaccaggatattgaaacagcatatgtaggtcaaatttgcttgacttgggaggcgcttcattgtcagtactctcatatgagtcagaagatatcttggcaacatgataatcctacctgttacaaccatagtgcacaagagtttcaacagttccaggttctattacaaaggtttattgaaaatgaaccttttgagcagggccgtcgagctgaaatttatgctcgcactaggaacaatttgcctaaactgcttcaggttcctaatatacgaggttcagatcatgaattgactgatgattcagagatgagagttcttgctcctgatcttatcgggataattgaaagttctatccttacattccaccttttcatgaaaagggacaagaaaaagtcaagtggtgctaccaatcagaaccagcttgatactcctctacaacagattcagtcgactcttgaaaagaaagtggtgaagctgaaggaactgcgcagaaagaaaaaaaattggaagaagaattcttggccccaaaagcacgaggacattcaggttttgcttggccttattgacgtgaagatcctgtcaagggttctgaggatgacgaggatgactagagaacaactgttttggtgtgaagaaaagatgaaaaaactggatttatcaaatagtaggttagaaagggatccatgtcccatcctcttcccttgctag

SEQ ID NO: 1707 - DNA, 417 bp, Glycine max var. Williams 82
atgaaactggctacccctaaaataattagaaagatcccaagccctctgaagttggtatccagaagctcaagttcagcagcaaagaagccactattggtgtcaggatcaggacaaccgtcgtcgtcgtcggatggaagtagcaagcaacaggtggttcccaaagggtccctggctgtttacgtgggtcccgaccttcgaaggtttgtcattccagtaagcttcttggccatgccagacttcaaggttttgatggagtcggtggcagaggaatatggctgcgatcacgatggcgctattcaaatcccctgcgatgaagactattttcagcaaatcttgatgtcttgttcccaaagacaacggatcatatcccctaagaaactaattcctaacatcccactcatatgtactactcattaa

SEQ ID NO: 1708 - DNA, 3546 bp, Glycine max var. Williams 82
atggacccgaaaaccccatatgagaattcttccaattttgattctttcatgttcaactcgtcatcacctagaagtgacatgtccattcagtctaggagttctggcagggacaactccacccgtgaagtgagtttcggccacacaggatccaagcctgtgaggcatgggtcaaattctgaaggtctaagcatgtctcagaaggaaatcagtgatgaggatgcaaggttggtttatgttgatgatcctgagaagacaaatgaaaggctcaaattcgcggggaattcgattcgaaccgggaagtactccatcttcacctttcttccaaggaatttgtttgaacagtttcgtagagttgcttatatttacttccttgtaattgccattctcaatcagctccctcagttggctgtctttgggaggggtgtttccattatgccattgacctttgtccttgttgttactgctgtgaaggatgcatttgaggactggaggaagcacaggtcagacaaaattgagaacaacaggttagcattggttttggttaatggtcagtttcaagagaagaagtggaaggatgtcagggttggggaggtcattaaaataagtgcaaatgaaacaattccttgtgatattgtgttgctatcaactagtgaccctactggggttgcttatgtgcagactattaatctggatggagagtctaatttgaagactaggtacacgaaacaagagactcaatctatgtttcctgaaaaggagaggttgaatggattgattgtgtgtgagaaacccaataggaatatatatgggtttcagggttatatggaaattgatggaaagagattgtctcttggatcctccaacattgtcattagaggctgccagctcaagaatactaattgggcacttggcgttgccgtgtattgtggcagagagaccaaagctatgctcaacagctctggagctccatcgaaaaggagccttctcgagactcgcatgaactctgagatcattatgctttctttctttcttatagctttgtgcacagtcacctcagtttgtgttgctgtttggttaaagcgccacaaggatgagttgaatctctccccgtattataggaaaatggatgtttcagagggggaagaggatagctataaatattatggatgggtactggaaattgttttcactttcctcatgtcaattatagtgtttcagattatgatccccatatccttgtacatttccatggagcttgtccgtgttggtcaggcatacttcatgatccgagactcgagaatgtatgataaggcgacagattcaggatttcagtgcagggctttgaatattaatgaagatttgggccaaattaaatatgtcttttctgacaaaactggtacactgactgagaacaagatggagtttcaatgcgcgagcatcttggggtttgattacagttctgcaaaaatgggtcctgagaatgagcaagttgaatactctgttcaagaggatgggaaggtctttaagccaaagatgagggtgaaagttaaccaagagcttttgcaattatcaaaaagtggatttgcaaatagagaggggaaacagatttatgatttctttctagcattggcagcctgcaataccattgtgcctcttgttgttgacacatccgatcctatggtcaagctaatagattaccaaggggaatcaccagatgaacaagcgttggcttatgctgccgctgcctatggttttatgcttattgaacgaacctcaggtcacatagtcgttaatattcatggagaaaaacaaaggttcaatgtcttaggtttgcatgaatttgatagtgatcgaaaaaggatgacagttatattagggtacagtaacaattctgtgaaactttttgttaaaggggcagatacatccatgtttagtgtgatagacaaatcattgaactcagatatactacaagcaactgaaacccatcttcactcttattcctctgtgggtttgaggacacttgttattggcatgcgtgacttgaatgcttcagaatttgagcaatggcactctgcctttgaggcagcaagtactgctttgattggtagggcctctatgcttcgcaaggttgctatcaatgtagagaacaatctctgcatattgggtgcaactgctattgaagataaactgcagcaaggcgtaccagaatccattgagtctctaaggactgcaggtattaaagtatgggtcttgactggggacaaacagcaaactgccatatcaattggatgctcctcgaagctcctaacgagcaacatgactcaaattataattaataccaacaatagagagtcatgtagaagatgtttgcaagacgcccttgtcatgtctagaaaacacatgactgtgcctggggttactcacaattctgaaggaagatcagatgctgtttcaactccattagccttgattattgatggtaccagccttgtttatattcttgacagcgagcttgaagaagagctctttcaactagcaaatagatgttctgttgttctctgttgtcgagtggctccgctgcagaaggctgggattgtagcccttgtgaagaataggaccgatgacatgacactagccattggagatggtgctaatgacgtatcaatgatccaaatggctcatgttggagttggaatcagtggacaggagggtcggcaagctgtaatggcttcagattttgcaattgggcagtttaggcttttagttcctctcttattaatacatgggcattggaattaccaacgactgggttacatgataatatacaacttctacagaaatgctatctttgttcttgtcctattttggtatgtgctctttactgctttctctttgacaactgctataaatgaatggagcagcgtgttatattcaataatttactctgcagttccaactattgttgttggtgttcttgacaaggatcttagtaaaaggactctcctaaagcatcctcagctttatggggctgggctgagacaggaggcctacaacaaaaagttgttttggttgtcaatggccgatactttgtggcaaagcattgctgttttctttactcccctaatcgcatattggggaaccactgaagatgtagcaagcataggagatctttggactctttcagtggttattttggttaatttgcacttggccatggatgtcatcaggtggaattggattacgcatgcagcaatttggggctctatagttgcaactttcatttgtatcattattattgatgctataccagcctttcctggtttctgggctatctttcatgctgcaggcactggattgttctggctatgtttgctcggaactgtgatagccgcattacttcctcgattggttgtaaaatatatgaatcagtattattttcccagcgacattcagatttcgagagaagctgagaagtttgggaatccaagagacaatggagttggacagatagaaatgcttcctgtttcagatggttcaccaagataa

SEQ ID NO: 1709 - DNA, 459 bp, Glycine max var. Williams 82
atgtcgcttgttggtaaaattagtactgaaattggggttcatgcaactgctgcaaagtggttcaacctctttgcaacgcagctccatcatgttcaaaaccttactgatagagtgcatgaaaccaagctgcatcatggtgatgactggcatcacaacgagtcgatcaaacactggacttgtacaatagatggtaagattacaacatgtctggagagtattgaatccgttgatgaaccgaacaaaacaatcacctacaagctcttcggaggagatattggtcataagtataaagtctttaagctcatttttcaagctattgacaccgatcatgggggtgttattatcaaatggaccgttgaatatgagaagattgatgagaatgttgatcctccgtatggctacatcgaatacctgcacagtggcagtaaacagattgatggcaatcttctcaagccatag

SEQ ID NO: 1710 - DNA, 627 bp, Glycine max var. Williams 82
atgtcgatgaagctgttattagcttccctatccatttcggtgtggcttttcatggcaacattatcccttgcccaatccaacaaccgctacgtctttgacacacatggcgaccctcttgaaactgacgatgaatattacatcaggccggccataacagacaacggagggcgtttcacattgatcaacagaaacaggtcgtgccctttgtacgtcggtctcgaaaacaccgacacgccgcagggctacccgatgaaattcaccccttttgccaacaaggacgacgacgataacttgagggtgaacacggacttgaaagtgacactggtgcaagtttccacaacgtgtgtgcaatccaccgaatggaagttgggtgagaatgacacgaggagtggaaggaggctcatcgtcactgggcgagataatgggatacaaagtgcaggtaactattttagaattgtggaaacagaaagtgttggtatttataacatccggtggtgccctacggaagcatgccccacttgcagattcatttgtgggaccggtggtattctgcgtgagaatggaaggattttgtttgccttggatggtaccactctcccagttgtgttccagaaaaaagatgattaa

SEQ ID NO: 1711 - DNA, 1242 bp, Glycine max var. Williams 82
gtttcctgcatgctttcttttgcaccaaatagcactcctgtaacatatatcctataaatagcttcctcttgcaacatcaaaagcacgcacattgttactgaacacacaaaccctctcaccaaaccttcatcgatctctttgtttttttataaattataatattgatacgaagttgtttctgtaaatagcaattcagagaccttaaaggtagtgagtattttcctccttacttaatctattgtgtgatcaaagtcgttattattaaattagataattgataaccatgtcgatgaagctgttattagcttccctatccatttcggtgtggcttttcatggcaacattatcccttgcccaatccaacaaccgctacgtctttgacacacatggcgaccctcttgaaactgacgatgaatattacatcaggccggccataacagacaacggagggcgtttcacattgatcaacagaaacaggtcgtgccctttgtacgtcggtctcgaaaacaccgacacgccgcagggctacccgatgaaattcaccccttttgccaacaaggacgacgacgataacttgagggtgaacacggacttgaaagtgacactggtgcaagtttccacaacgtgtgtgcaatccaccgaatggaagttgggtgagaatgacacgaggagtggaaggaggctcatcgtcactgggcgagataatgggatacaaagtgcaggtaactattttagaattgtggaaacagaaagtgttggtatttataacatccggtggtgccctacggaagcatgccccacttgcagattcatttgtgggaccggtggtattctgcgtgagaatggaaggattttgtttgccttggatggtaccactctcccagttgtgttccagaaaaaagatgattaatttgaagccccaagtctgaagattgtgacggtttttggttatagggaataatatttatttttttatgcgtaagaatttaatacaccataatgggatttacaatacttagtataagaaataatatacgatggagctctcatccttttttatcggatgaaataaagatacatgcattcagtattctcttcttgatttgtagaaaaaagctcctaaattgatattatttgtatgtaattcatttactacatacttgattaaataaattattatataatttactttttctgatcttatttttactttcttatttatctttttatttttcatcaccc

SEQ ID NO: 1712 - DNA, 612 bp, Glycine max var. Williams 82
atgtcaatgaagttgtatgcttccctcacccttacggtgtggcttttcatggccacattttcgcgagcccaatacgttattgacacaaatggcgaacccgttgacaatgatgatgagtattacatcaggccagccataaccgacaacggagggcgtttcaccttgatcaaccgaaacgggtcgtgccctctctacgtgggtcttgaaaacaccgatacgccacttggttatccagtgaaatttacccattttgccctcaacgttcaagatgaggatataagggtgaacagcgacttgagaatcgaattcgtggaagtttccacaacgtgtgtgcaatccacggaatggagggtgggtgagaacgacacgaggagtggaaggaggctcatcatcactggcctagatgataattttggatccattggtaactattttagaattgtggaaacgcaaagtgttggtatctataacatcgagtggtgccctatggaaatatgctccgattgtggattcgtttgtagcactggtggtattttgcgtgaggatggaaggattttctttgccttggatggtactccacttccagttgtgtttcagaaaaaagatgattaa

SEQ ID NO: 1713 - DNA, 1025 bp, Glycine max var. Williams 82
gtattaaaaaaatatacttagtggggacagttatcccctaactgccattggagatccgtccctacatagtatcctataaatagcttcctcttgcaacctcaaaatcacacccattaattgtgacaaaacccataaatcctctcaccaaataaacctcaatttattgcattgcataataccatgtcaatgaagttgtatgcttccctcacccttacggtgtggcttttcatggccacattttcgcgagcccaatacgttattgacacaaatggcgaacccgttgacaatgatgatgagtattacatcaggccagccataaccgacaacggagggcgtttcaccttgatcaaccgaaacgggtcgtgccctctctacgtgggtcttgaaaacaccgatacgccacttggttatccagtgaaatttacccattttgccctcaacgttcaagatgaggatataagggtgaacagcgacttgagaatcgaattcgtggaagtttccacaacgtgtgtgcaatccacggaatggagggtgggtgagaacgacacgaggagtggaaggaggctcatcatcactggcctagatgataattttggatccattggtaactattttagaattgtggaaacgcaaagtgttggtatctataacatcgagtggtgccctatggaaatatgctccgattgtggattcgtttgtagcactggtggtattttgcgtgaggatggaaggattttctttgccttggatggtactccacttccagttgtgtttcagaaaaaagatgattaatttgaagcactaagtttgaagaatattgtggccgtttagtcatagttctttttatggtaaatagggattaatatatgatatatggagctatcatccatttattttaggaagaaataaagatacgtgtattcagtattctgttcttgatttgaataaagctcctaattgttatgagtttgtaattcatttgctactttggttattatatattatacttcttttatttcatcttt

SEQ ID NO: 1714 - DNA, 1602 bp, Glycine max var. Williams 82
atgcttatgtctggcacagaacaggtgaccatgggaggattaggactcaatttgactccaattactacatttgctatcattactgtgattgctacggtgctaatatggtggttttggaatgcactcaactgggtgtggctgagacccaagaggatagagaggcgtctcaaggagcagggtatccaaggaaattcctaccgccctttgattggagacatcagagatatggttaagatgattaaggaagccaaatccaaacctatggatcctcactctaatgacattgcaccccgtgtgttgccttacgttgttcacaccatcgctaaatacggtaagagttcatttatgtggcttggtccaacaccaagggtattcatcttggatcctgacaaattcaaagaaatggctactaaggtctatgattttcaaaagcccgacactagtccacttttcaagcttctagcatcagggtttgcaaattatgatggcgacaagtgggctaaacacagaaagatcgtgagtccagcattcaatgtagagaaaatgaagctcttggtaccgatattttgccagagttgcgatgatttgatcagcaaatgggagagtttgttatcttcgtctaatgggtcttgtgagttagatgtgtggccttttgtccaaaacgtgtcaagcgacgttcttgctcgtgcaggctttggaagtagctatcaagaagggaaaaaaatattcgaacttcaaagggaaatgattcagcttacaatgacgctctttaagtttgctttcattccaggttacaggtttctgccaacgcataccaacaggaggatgaaagcaattgacaaagaaatacgagaatcacttatggtaatcatcaaccgaagattaaaagcaatcaaagcaggggagcctactaacaatgacttgttaggcatactcttggaatcaaattacaaggaatctgaaaaaagtagtggtggaggaatgagtttaagggaagtagtggaagaagtgaagctattttacttggcagggcaggaagcaaatgcagaattgctggtctggacattgttgttattaagcaggcatccagattggcaagaaaaggctagggaggaggttttccaagtgttcgggaatgaaaagccagattatgaaaggattggtcaactgaaaattgtgtcgatgattctacaggagagtctcagattatacccaccagtggttatgttcgctcggtatcttcgtaaagatacaaaacttggagagcttacaattcccgcaggagtggagcttgttgtacctgtgtcaatgctacaccaggataaggagttttggggagatgatgccggggaattcaacccagaaagattctcggaaggagtatcaaaggcaacaaaaggcaagctttcctacttgccatttggatggggtcctcgactctgcataggacaaaactttggcttgttagaagcaaaagtagctgtgtcaatgatcctgcaacgtttctccctccatttttccccctcctatgctcatgccccctcctttattatcactcttcagcctgagcgtggggctcatctcattttacgcaaactctag

SEQ ID NO: 1715 - DNA, 1152 bp, Glycine max var. Williams 82
atgatgatgaatgttttagggttgagtctggtgttaacttcactggcagcagcaggaatattctctcccaatcccagaacagagaagcatggagccagcaccattgtcaaagaagggcatcgagttgtggtggttgaatacgaccaaggtggccatcagaaaaccaaaatctcaatatccccagagcaacccacgcatcaccatgatcatgatgatgatttgatcaaagaagctgcctcggttctccctaacttatgccaaggcatttcttcatcttcacaatattcacaccaaccgcagaatcacatggatcatgggcctttaaatctgcatgctcctaatcctaaagagctcatttgcgacgcctatggaaaatgcaaacacaaaatctccgacgccatggagaaggctcaagaggccatccataagaagaaggacaagatttgtaaaactaaagagactgtgtatgataaagcccatgacgtccatgaatacgcccaagacactgtagaagcagcaaaggaggatatggccagtaacgtttcaaacgccaaagatgcattgaagcttctaataggaggatctatggagagcctgaattctttgatgggggtggctaatctgctggggtttgccacggcttatgggatatgtgtgtgggttacgttcatctccagctatgtgcagtccaggactatgccaaggcaacaatttgcagtggtgcagagtaaaatataccctgtttatttcagggccatggcttatagcattgcactggctttcttagcccatttcttagcccatagaaacaccaactctgacatgttgcaatcatataatcttctggcctcccttgccacacttttcctcaattatctttacttggagcctcgggccaccaagttgatgttggagaggataaagatagaaaaagaggaaggaagaggcagatcacaagacatgatgagtagtagaacagtagatcctaaagagccagcagatcaggaggatgcactcagatcaaggataatcaagctcaatgacaagctcaagaaattcaattcctattcctcattcctcaatatcctcaatctcatgtctcttacttggcatctcgtttatttggctcaacgacttcaccatatttgctaa

SEQ ID NO: 1716 - DNA, 2157 bp, Glycine max var. Williams 82
atgtatcagtggattatcgtgagagttcacatgtggattagcaaaaagttgcgaccaaggaattcaattagcaatggagatagcagcagcgacacctttcacaacggtgccagtactgacaccgttgttgtggatgacaatccatttagcagcggggtggagtgttacgcctgcacgcaggtaggcgtgccggtgtttcactccaccagctgcgacagtgcctaccatcagctgcagtgggaggcttctgctggatcgtctctggttccaatccagagccggcccaaaaaggtcctcggcttccggaccgtgtctggtttgacacgggggccgttcgggcgggttctggatccgcggagcaagcgagtgcagaggtggaaccgcgcgctgctgctggcgcgtggggtggcgctggcgatcgacccgctgttcttctattcgctgtcgatagggagggaggggtcgccgtgtttgtacatggacggagggctggcggcgatggtgacggtggcgcggacgtgcgtggacgcggtgcacctcttgcacgtgtggctgcagttcaggctggcgtacgtgtcgcgggagtcgctggtggtggggtgcgggaaactcgtgtgggacgcgcgtgacatcgcgtctcattacctgagatcgttgaaggggttctggttcgacgcattcgtgattctcccagttccccaggttgtgttttggctgatagtgccaaaattgctacgagaagagaaaattaaaatcattatgacaataatgctattgatttttttgttccaatttctccccaaggtttaccatagcatctgcatgatgagacgaatgcaaaaagtcacaggctacatctttggcactatttggtggggctttggtctcaatctcatagcttattttattgcttctcatgttgctggagggtgctggtatgtccttgcaattcaacgtgttgcatcctgcctccggcagcagtgtgagagaactaatggatgcaatctttctgtgtcatgctcagaggagatatgctaccagtctttgttaccagctagcgcgatagcagattcatgtggtggaaactcaacagtggtaagaaagcctttgtgcttagatgttcaaggacctttcaaatatgggatctaccaatgggcacttcctgtcatatccagcaactctttggctgtaaagattctttatcccattttttggggtttgatgaccctcagcactttcggaaatgatcttgaacccacaagcaactggctagaagtgattttcagtatatgcatagtactcagtggactattgcttttcacattattgattggtaacattcaggtattcttacatgcagtcatggcaaagaagagaaagatgcagctgagatgtcgtgacatggaatggtggatgaggaggaggcagttgccatcgcgattaagacaaagagttcgccattttgaacgtcaaagatgggcagcgatgggaggagaagatgagatggaaatgatcaaagacttgccggaggggctgaggagggacatcaagcgccatctttgcctcgacctcattagaaaggttcctctattccacaacatggatgatcttattcttgacaacatctgtgacagggtgaagcccctagtcttctctaaagacgaaaagataatcagagaaggtgatcctgtaccaaggatggtgttcgttgtccgagggcgcataaaacgcaaccaaagccttagcaaaggcatggtagcctcaagcatccttgatcccggagggtttttgggtgacgagctactttcatggtgccttcgtcggccgtttatcgacagacttccggcctcctccgccacatttgtatgtcttgaatcagcagaagcctttggccttgatgccaataacttgaggtacatcactgatcacttccggtacaaatttgcaaatgagaggctgaaaagaacagcaagatattactcatccaattggagaacttgggctgctgtcaacattcaatttgcttggagacgttacaggcagaggactaaaggtcctgtgatccctgtaagggacactaatggaggcactgaacgcaggctcttgcaatatgctgcattgttcatgtcattaaggccacatgaccaccttgaatga

SEQ ID NO: 1717 - DNA, 1449 bp, Glycine max var. Williams 82
atggagcagttgtactacctcacccttgtgctactgtttgtgtccttcgtctctgtctcttttttcatcattttctacaggcatcgttctccgttcagcgtccccaacttgccgccggggaaggcggggtttccggtgatcggcgagagcctggagtttctgtcggcgggacggaaggggcttccggagaagttcttctccgatcgcatgacagagtactcttccaaagtgttcaagacctccatcttaggggagcctacagtgattttctgtggagccgcatgtaacaagttcttgttttctaacgagaacaaacacgtcatttcgtggtggcctgaaaatgtcaagaagttgttcccaacgaatattcaaacaaactctaaggaagaagccaagaagttgagaaacattctccctcagttcctcagcgccaaagccatccaacgttacgttggtattatggacactgttgcccaaagacactttgctctggagtgggagaacaacacccaagtcaccgtattgcccttggccaagaggtatacctttggggtggctagccgtgtgttcatgagcattgatgatttgaatcaagtggcgaaattggcagaacctttaaatcaggtgaatgcaggaattatatcaatgcccattaacttccccggaactgtgttcaaccgaggaatcaaggcctccaagttcattaggagggagctgttgaggattgtcaagcagaggaaggtggaactagctaatggaatgtccacaccaacacaagacattttgtctcacatgctaatatattgtgatgagaatggacaatatttggctgaacatgatattgtcaacaagatccttggcttgctgataggtagccatgaaaccacaagtactgtttgcactttcgttgtcaaataccttgccgagctccctcaaaatatttatgaaaatgtctatcaagaacaaatggcgattgcaaaatccaaagctccaggagagttgttgaattgggatgacatccagaagatgaaatattcatggaatgtagcttgtgaagtaataaggcttaaccctccagcccaaggagcttttagggaagccatcaatgactttatcttcgatggattctcaattccaaaaggctggaagttgtattggagtgcaaattcaactcacaaaaatccagagtacttccctgagccagagaaatttgatccaagcagatttgaaggaactggaccagctccttatacttatgtgccatttggtggagggccaagtatgtgccctggaaaagagtatgcgcgaatggaactattggtgttcatgcacaacttagtgaagaggttcaagtgtgaaactctttttcctaatggaaatgttacttataaccctacgcctattcctgccaagggccttcctgttcgtcttattcctcaccgatcatga

SEQ ID NO: 1718 - DNA, 1344 bp, Glycine max var. Williams 82
atggccacccctcactttcttcttataccatatccagttctaggccatgtgaatccccttatccagttgtctcagattctaatcaaacatggttgcaacatcacttttctcaacacagagttcagccacaaaaggttgaacaacaacactggtgctgctggccttgacaacctcaggagatcagggataaagttcgtggcactccctgatggcttaggcccagaagatgatagaagtgaccagaagaaagttgttctctcaatcaaaaccaacatgccctctatgcttcccaagctcatacaagatgtcaatgcttcagatgttagcaataagatcacttgtattgttgccacattgagcatgacttgggccttgaaagttggccacaatttgggaatcaaaggggctcttctatggccagcatcagcaacttctttggccttgtgtgatttcatcccaaggctgattcatgatggggttatagattcacgtggggtccccatcagaagacaacaaatccaattctcctcaaatatgcctttgatggacacacagaactttccatggcgtggacatgataagttgcactttgaccatcttgtgcaagagatgcaaactatgaggttaggagagtggtggctttgcaacactacgtataaccttgagccagcaattttttccatatcagcgaggctcctaccaattggtccattgatggggagtgacagcaacaagagttcattctgggaagaagacacaacttgtttggagtggttagatcagcaactggctcaatctgttgtatatgtttcctttggaagtatggcagtgatggaccccaaccaatttaatgaattagctcttggacttgatcttcttgacaagccttttatttgggttgtacgtccaagtaatgacagcaaggtaagtattaatgaatacccacatgaattccatggaagtagaggcaaagttgtgggttgggcaccacaaaagaagatattgaaccatcctgcattggcttgcttcattagtcactgtggttggaattctactgtggaaggtgtgtgtggtggcatacctttcttgtgctggccatttgccaaggatcaacttgttaacaaatcttatgtttgtgatgtgtggaagattggacttggattagataaggatgaaaatggaataatttctaagggagagataaggaagaaggtggatcaactacttcttgatgaagacataaaagaaagatcgttgaaaatgaaggaattgactatgaataacataggcaaatttggtcagtcttcaaaaaatcttgaaaagtttatcaactgggcaaagtaa

SEQ ID NO: 1719 - DNA, 1332 bp, Glycine max var. Williams 82
atgggtatccctcactttctttgtataccatttccagttcaaggacatgtgaaccctcttatgcaattttctctgcttttggttaaacatggttgcaaggtcacttttgtacacactgagttcagcctcaaacgaacaaagacttctggtgctgacaacctcgagcattcacaagtaaagttggtgactcttcctgatggtttggaggctgaagatgacagaagtgatgtgacaaaacttcttttgtctatcaaaagcaacatgcctgctttgcttccaaagctcatagaagatatcaatgccttggatgctgacaataagatcacctgtattattgttacatttaatatgggttggcctttggaagttggccacaaactgggaatcaaaggagctcttctctgtccagcatctgcaacttccttggcttctgctgcttgcatcccaaagctgattcatgatggcattattgattctcaaggacttcccaccaaaacacaagaaattcaactctctccaaacatgcctctgatagacacagaaaactttccatggcgtggctttaataagatcttctttgaccatcttgtgcaagagatgaaaactttggagttaggagagtggtggctttgcaacactacttatgatcttgagcctggagcattttccgtatcaccaaagttcctacccattggcccattgatggaaagtgacaacagcaaaagtgcattttgggaagaagatacaacttgcttagagtggttagatcaacaaccacctcaatctgtcatatatgtttcctttggcagtttggcagtaatggatccaaaccaatttaaagaattagctcttgcacttgatctccttgacaagcctttcatttgggttgtacgtccatgtaatgacaacaaggaaaatgttaatgcatacgcacatgatttccatggaagcaaaggtaaaatagttggttgggcaccccagaagaagatattgaaccaccctgcattggctagcttcattagtcactgtggttggaattctaccctagaaggtatatgtgccggtgtacctttcttgtgttggccatgcgccactgatcaatatcttgacaagtcatatatatgtgatgtgtggaagattgggcttggactagacaaggatgaaaatggaataatttctagggaagagataaggaagaaggtggatcaactgcttgttgatgaagacatcaaagctaggtcattgaaattgaaagacatgaccataaataacatactagaaggtggtcagtcatcaaagaatctcaacttctttatggattgggcgaagtaa

SEQ ID NO: 1720 - DNA, 1959 bp, Glycine max var. Williams 82
atgtcttcttttcttttccctcaaacacaatccacagtcctctcagacccttcaacctatttctcctcaaacctcctttcatctccactccccacaaactctttcttccaaaacttcgttattccaaacgggtcccaagctgagtacattcacccttacctcatcaaaacctcaaactcttcactatcagcttcataccctcttctgatcctcttcaccactgcagtgttgtaccagacttttgtggcagatatcaccatctcttcaactcaaacaacctcacaaaaccatgtaatctcatcatacagtgaccttggtgtcactttggacattccctcctccaacctaaggttctttctctcaaggggaagcccttttctaaccgtttctgtgacatctccaacatctctttccatcacaacagtgcataccatagtctctttgtcttccaatgatgacaacaacaccaaatacacccttaagcttaacaacactcaaacatggctcatatacacttcctcaccaatctatttcacccataataatgcttcagaggttacatccaagccattttctggcatcattcgtgtggcagtgttgcctaaccacaactacgtaacaattcttgacaagttcagcacttgttaccctttgtcgggtaatgcaacactcgtagagcctttccgtgtggtgtatgaatggcaaaaggaaggttctggggacttgctcatgctagctcaccctcttcatgttaagcttctatcaaataattataatggtctagttactgtgctgaacgattttaagtatagaagcattgatggtgatcttgttggtgttgttggagactcatgggtgttggaaaccaatcctattcctgtgacatggtattccaacaaaggtatggaaaaagattcttatgatgagattgtctcggcacttgttaaggatgtgcaagagctgaattcttcatcaataggaacaagttcatcttatttttatggaaagcgtgttggaagggctgcaaggttggcgttgatagcggaagaagtttctttttctaacgtggttcccacgattaagaagtttcttaaggagtctattgagccttggttggatggaactttacaagggaatggatttctatacgaaaataaatggggtggacttgtcaccaaactggggtcaacggattcaacagctgattttgggtttggagtgtacaatgatcaccattatcatttgggatacttcctttatggaattgcggtccttgcaaagattgatcctgagtggggacaaaaatacaatccacaagtttattcacttgtcacagattttatgaacttgggccaaaaatataactctcgttatccacgtctaaggtgttttgacctttacaacttacactcttgggcttcaggagtgactgaattcgcagatggaaggaatcaagaaagtacaagtgaggctgtgaatgcgtactattcagcggcattggtaggtttagcatatggtgactcaaatcttgttgccattggatcaacactactggctttggaaattcttgctgcacaaacttggtggcacgtgaaagcagaaggcaacttgtacgaagaagaatttgcaaaagagaacaaaatagtgggtgttctgtgggctaacaagagagatagtgccctatggtggggccctgctacgtgtagagagtgtaggcttggaattcaagtgctaccattgtctcctgttactgagactttgttctctgatgctgattatgtgaaggagcttgtggaatggacaatgccctctttgactagtgaagggtggaagggaatgacctatgccttgcaaggaatttatgataaggaaacagcattggaaaatattagaaagttgaaaggttttgatgatgggaactcgttgagtaatctcttgtggtggattcacagcagatga

SEQ ID NO: 1721 - DNA, 1287 bp, Glycine max var. Williams 82
atggacttgaaagaaaattgtacttatgtcatgcacaattttaaagtgctaaaaaacaatggtcagtacagagtgtgtgatcatcaatttaaattggtgtttattggggttactgttgtgagggagtgtgttctaggggacatcccttttagaaaatacaggtttactggatttgcagatgttgtggctggccagtttgaacgtggactattggttgatattattggtgtggtggaggaggttgtctttcagcaagtttcaggaaaaggtagaagggtagtcttcaaactaaagaacttgagccagcaattgctatcttgcactttgtgggatgattattgcttgcagtttttgaagttcttagatgattatgaaggatcttatcccgcatcgatcaacaattctttcaaggcttcaaagttaattattaaccagcccatgatggagattcaagaattcaatgaacggcttgcagagttgggcattgaggcccggtcaggttttaaatcccatggtgaagggagtacacaactttcaggttctatccaattatcatcaaaagaatcattctttggcaaggctgaggaaattgtttgtgtcactgttggcacaattactaggattgttctggacaatcattcatggtgttatacagcttgcattcagtgccataaaaaaagtgatgcagagatggcgccctttacatgtgcatgcggcaaatacaataaggaagttgtgcttaggtataggcttgagctgatgatcaaccagggaaatgaaagcacaaaattcctgctttgggactgtgaatgcagtgaattaattggtcaatcagctgatgcagttaatcagcttgaaattgaagatggtgatgttgatttgaatgcttcacccgaaacacttgataagctgctgggtcatgaacttgctttcaagataaaggtgcaacccaagttcaggaattctgctgttttgaagtgttcaactgacttgagcttaataaatgctgtgatggatatgctagctgatgttgagacatcttcaagaatggatatcccggtttctaattccaatcattctgctcaacatgaatcacaatccctctctgtgacagcagatcatgatcccctgcttggactccccttgacgcctacaaagcggcaaacatttcaagattgtgatgatgaagcagggacctctcaaatttcacctgcacagctttcatccaacaaattaaaaaaaacatggcacaatttagtgcatttggttgtttccaagttgtgttga

SEQ ID NO: 1722 - DNA, 1401 bp, Glycine max var. Williams 82
atgacgattggtagtctagcacctaaggcagagaagaagaaatcaaggaagaacaagactgttgttgttaatgagaatgcacccttgttgccaaaaagtcatgttcaggagagtgatgctggttttgatgatttcaatggagcttcattttctggggctgtttttaacttatccaccacaattattggtgctggtatcatggccttgcctgcaaccttgaaacagttgggaatgatacctggtcttcttgccatcatcatcatggctttgttgacagagaagtcaattgagcttttgattcggtttacccgggctgggaagtctgcttcttatgctggtctcatgggggattcctttgggaattatggaaaagctctggtgcagatatgtgttataatcaataacatcggtgttctgattgtttacatgattataattggtgatgtgctctctggaacatcttcaagtggagatcatcactatggtatccttgaaggatggtttggtgtgcaatggtggacaggccggacatttgttgtactttttactacacttgccatatttgtacctcttgcgagctttaagcgaattgattcattgagattcacgtccgccctttcagtcgcacttgcagttgtttttctagtcattgccgtgggaattgctgttgtcaagatatttagtggaggcattgtgatgcccagactcttccctgtcacgactgatgtggcatcattcttcagactattcactgtagttcctgtgtttgtgactgcgtatatctgccactacaatgttcacagcatagacaatgaacttgaggactcctcacagatgcaaggggttgtacaaaccgcccttgttctatgctcttcagtgtatgtaatgataagcttctttgggttcctcctatttggcgaaggaactcttgatgatgtactggccaatttcgataccgatcttggaattcctttcggttctgtgctcaatgatgctgttcgtataagctatgctgcgcacctgatgcttgtatttccagttgtcttctttccgttgcgtcttaacatagatggtctcctcttctcaaaatcaaggcctctggttctggataacgtcagatttgcatcactcactgttgcccttattggtgttatcttcctgggagcaaatttcatacctagcatttgggatgccttccagtttactggagcaactgccgcagtctgtataggattcatttttccagctgccatcactcttaaggaccgctacaacattgctactaaatcagacaagattttgtctgtcattatgatagtccttgcagtcttctcaaacgttgtggctatatacagtgatgcatatgccttgatcaagcagaacaaaacttcacgcgaatga

SEQ ID NO: 1723 - DNA, 918 bp, Glycine max var. Williams 82
atggcctcaacagctgaaccacttccttatagctcaagaagaagagatgagtcagagttcaatttgagagaatgggcagtgaaagctagaatccgccgagagaacaccaactctagaaggtactcaggatcttacatgagaagctttagagaagacacaaggtcatttagatcaaacataaccatttctagcactgcttcttcacccggataccccttaaaagatgatatagacccttcaacatattctttcacaactgctcttaaagcattgcaagcaagggcaggctataacaggtggggatgcttatctccagatggttttgctttaaattccaagtggaatgaagcagaaaggtatatatgcaaccctctctcaggggaggtaccattggagtgtttatctgcaaaaactcttagtggaagatcttttagaaactcaataaacagaattgccatgtctgctcctctagtttattcctcaaagcacattccaacaaagccagcaacttacatacaagaagaagtggctcttcaatttcccaatccagaaaagaagaaagagggaatcacaagagatgttggtactcaaagcacacccccttatcttagttcaaccagtcccagccctgcttcaactccatccatcacagagagatcaaaacctcgaatttctgactcccttaacttaaatgcaaaaacaacaaattccgacgaagaggtggaagagaaagatgaagaaacatgggagacaagagaaacaaaaagagaaaagaaggtgtggaggaagaaagaggagcaactttgcaaacaaagtgggtgcttttcgtggatgagaaaaaaaaagggagaaagagaaaaagaaagacaaagaaggaataacatctttctcactcacttcaaagctggcaaaagataa

SEQ ID NO: 1724 - DNA, 894 bp, Glycine max var. Williams 82
atgggagatgtggcgaaggaccttgcagctgggactgttggaggggcagcacagttgatatgtggacacccatttgacaccatcaaggtcaagctccaaagccagcctgcaccactccctggtcagcttcccaagtactcaggtgcatttgatgctgttaagcagacaatagcagctgaaggagcaaggggtttatacaaaggtatgggtgctccgcttgctacggtagcagccttcaatgctgtcctgtttacagtgaggggacaaatggaaacattagtgaggtccaatcctggttcccccctcacagtggatcagcagtttgtttgtggagctggagccggagttgctgtttccattcttgcctgcccaactgaattgatcaaatgcaggttacaagcacaaagtgcgcttgccggctccgaaacagctaccgtggctgttaagtatggaggacctatggatgtggccaggcatgttcttaggtcagaagggggcgtgagaggtcttttcaagggcttggttcccactatgggacgtgagatacctggaaatgctataatgtttggtgtatatgaagcattaaagcaaaagtttgcaggaggtactgatacttctggcctaagtagaggttctctgattgttgctggaggcttggctggagcttccttctggttcttggtttacccaactgatgttattaagagtgtgattcaagtagatgatcacagaaacccgaaattttctggttcatttgatgcattcagaaagattcgagctacagaaggattcaaaggcttgtataagggttttggtcctgcaatggcccgtagtgttcctgcaaatgcagcatgcttcttggcatatgagatgacaagatcagctctgggatga

SEQ ID NO: 1725 - DNA, 1746 bp, Glycine max var. Williams 82
atggtttcgggatggagaaggacgtttcgcacatccaataccattccccaaaacacgcaagaaccagaaaattgtaattattgttacgacaacaacaacatcaattcaagtcccaaaatcacttccaccaatttctcatcatcaattcccaccctccattcccgaaccaattcaccactttccaaacacaataataataatgcaagaactccctctcccaccaaacgcaatacccccgtgtcgtttcatcaatccactccctcttccccaaactcaccctcaaccttctctcttctcaaatccaccttacgcttatccaaaggctcatgcgaaatctgcatgcggagtgtgaaaaccggcgaaggaaaagcgattttcactgcggagtgttctcacgtctttcacttcccatgcctagcaggtcacgtgaaaaaacaccgaatggtcacgtgccctgtgtgcaacgctaactggaaacaactgcagcaaaacgcagacgaaaacaaaggaaacgcagaactcaaaacgacgagttccgagacgtacgttgcggtgttgaatgtgaagtctcagccgcgtaacgcggcggcgaatcggccgccggcggatctcgtcgcggtgatcgacgtcggagggagtgtttccggcgaagagtatcggatgctgaagcgctcgatgcaggttgttatctcgtcgctcggctccgctgatcgtctctctgtcgtcgcattctccggcggatcgaaacggctgtttcccctgcggaggatgaccggccgcggccagatggcggcgcggcgagtagtcgacgcgctttccaccgttgagctccgccgcgatggaacggcggcgaggaacaacgcgctgaagaaagccgcgagggttctggaagatcggcggcagaagaacaccgtcgcgaaaatcattctcctcacaaacagccacgaggatcagcgattatcctccacgcgcttcgacattcattcactgagatactcttacgatggcgcgtgtaaccacgcgcaacacgaccacgagttagcgaagcgcgtgggcaatttgttgagcgtggcggcacaggacttcaaactcgagttaaaactcacgtctcgctcggctccggcggagatctccgccgtgtattctctggccaagggttgcaccgacgctctctcgccggaatccgtcgcgctcggcgatctctacgcggcggaggggagagaaattctagtggagttgaaagtgccagctggcacagcttcgcgtgggtcccaccaacgtgttatatccgtacggtgttcccatcgtgaccccttcactcgagagcttgttatttccaaggatcgtgagttaaacgttccgcgaccccgcacggttcgatcatgcgaccccagaatcgaacggttgagacgttgccaggtcagcgctcgcgccgtagccgagtcgagaaggttgatggctcgtaacgacgtgtctggcgcgcttgagttgctatcctcggctcgagcatctgtgagccgcgaacagggtgatgagtgcttgcgctggctcgaatccgaacaagccgagctgaggagccaaaagttaagaagtagttgtaataataattgcttcgatgaaaagggggagccacttacgccgatgtcggcttggagagtagctgagagactggctaaagtggctattatgagaaagtctatgaacagagtcagtgacttgcatggcttcgaggatgccagattttaa

SEQ ID NO: 1726 - DNA, 402 bp, Glycine max var. Williams 82
atgatggagaaccagaatctttctttgccaccccacgtggacgcatctcgaccgtcccttgggttccctttgggcactgtccttctcttgatcatcatcttcaccttcagtggcgtcctctcttgctgctaccattgggatagggtccgttccttccgtcgttctttctctcattccgacccccaaatgccttcctcacccaccaattctaagcattccaaggaatcgaaggaaaacagggggcaaagcttgccagtgttgatgccaggggatgaggtgccaaagttcatagccatgccgtgtccgtgccagccttcaagaccagaaaacatcgttgtcaccgtcgaaatggagaagcaggcgcccaagcccccgcaactacctgtccctttctatttgtaa

SEQ ID NO: 1727 - DNA, 771 bp, Glycine max var. Williams 82
atggttctgtccaactcaaagccctttttcttgcttctggttcaattcctaatgctacatcgaaactgggacgacacatctttcaacttccccaacttttcagggccatatccaaacaccgttttaaccttccaaggcgatgcccgtataataaggggtgtaatagatccaacaaatttcgtaaaaaatgctgaaattgtgccaagtgcgggaagagccacctatgctctccccgtgcgtctttgggattcaaaatctggtaaagtcgcaagtttcactactaccttctctttcaaaatatcgaatggtccaaacaccggagacggaatcgctttcttccttgcaccgttcggatccaacatgccccgagattcggctggcggatacctcggactcttcagtcgcgacactgccctaagaaatacgaacaaaaaccatatagttgccgttgaatttgacatgcaccagaatgaatgggacccagctgctactccccacataggaattgatgttaactccatctcttcggtagcaactgtgcgatgggaaattgaagagctcggggttccaacagtatctgccaccgtttcctatgactccaaaacccaaatttttggcatggctttaaatgacggaactgttgttgcctatgaaattgatttgaggaccgttctgccagaatttgtcagcgttggcttctccggtgccacgggagtgctgattgaagatcatgagattctatcttggactttcagttctagcttcgattag

SEQ ID NO: 1728 - DNA, 846 bp, Glycine max var. Williams 82
atggctaaaagtaaaacacaaactccattccctactctcttggttttcctctgttatgtgttgctactcaacaatgtgaagaagtccaattcactttcattcaacttttccaatttcgtgtcgggaccaaacttcgacattggtttccttggcgatgcgcgtccattagacggtgcaatacaattgacaagaagagacaataacggaccttatggcactgccaatattcgccagcacagtgttggtcgtgcagtttatattccaccagtgcgcctttgggacaaaaccacaggcaaactcgcagacttcgaaacagacttctccttcgtcgtagattattattccgctggttcgcaaatccacgctgatggcctgtcctttttcatcatacctttcggtgctgaccccagaatccccaagaactcatctgggggataccttggactattcagccccgaaactgctttcaatgcttacaaaaaccaaatcgtggctgttgagtttgacagcttcagaaatgaatgggatcccgagcctgtcccggttgctcctcatatcggaattgacatcaactctcttgaatcggtggaaactacagattggcctatcaattctgtgcctcaaggtgctgttggaaaagctatcattagctatgattctaatgctaaaaaactgtatgtcgccgttggctatgatacccaacctcctactattgttgccctctcacaaaccattgatttgagggttgttctaccggaatgggtaagaattggtttctcgggtgccactggtgatatggttgaaacacatgacattctttcttggtctttcacttcacacatctag

SEQ ID NO: 1729 - DNA, 2103 bp, Glycine max var. Williams 82
atgcatatagttcgctattctttggcttctccaccaccatcactcttcttctctttctcctctgccatggctttcttcacctatgcttcaaactctaaccaatgcccaaaacaaaccttgttgttcatattcaccatcttcaccttgttccatacactctttaccactgtagagtgcctttccttcaacttttcaaccttccaaccaaactcaaataatctaatagactttaaaggtgatgctttttcctcacgcggtgttcttcagctcacaaagaaccaaattgatgacaaaatcacattcagcgttggtcgagcctcgtataaccaacaagtgaggctttgggatagaagaactaagaaactcactgatttcacaacccatttctcttttgtcatgaaagctgttgaccctaaacggtttggggatgggctagccttcttcattgcaccctttgattctgttattcccaacaattcagctggtgggtaccttggcctattcagcaatgaatccgcattcaacatgaagaaaaatcagttagttgcggttgagttcgacagcttcgaaaacgaatgggatccgagctctgatcatgttgggatcgatgtcaactccattcaatccgttacaaatgtctcttggaagagcagcattaagaacggatcggtcgctaatgcttggatatggtacaactctacaaccaaaaatctctctgtgttccttacttatgctgataatccaacttttaatggcaattctagtctttcttatgtcattgatttgagggacgtgttgccagagcttgttagaataggcttttctgctgccacgggttcgtggattgaagtgcacaacattttgtcttggtcattcagttcaaacttggatggggataataggaaaaaggttaaggttggtttagtggttggtttaagtgttggtttgggttgttgtttagtttgtgttgtaggcctattatggtttaccttttggagaagaaaaaataaaggaaaggaggaaaacttaggtgttgatgcttctatagatgatgagtttgagagaggaactggtccaaagaggttcacctatcgcgaactaagcaatgcaaccaacaactttgcagaagaaggaaagctaggagaaggaggatttggaggtgtttacaaaggcttagttgtgaactcaaaccttgaagtggcagtgaagagggtttcaaaagggtcaaaacaagggaaaaaggaatatgtatcagaagtgagagtaatcagcaggctaaggcatagaaacttggttcaactcatagggtggtgccatgaacaaggtgagctccttcttgtttatgaatacatgcctaatggaagccttgattctcatatatttggaaatagagtcatgctttcatgggtggtgagacacaaggtggctttaggtttggcatctgctcttctttatcttcatgaagagtgggaacaatgtgtggtgcatagagacattaagtcaagtaatgtcatgttggatgcaaatttcaatgctaaacttggtgacttcggtcttgcaaggctagtagaccatgaacttggttctcaaaccactgttttggcaggcacaatgggatacctagccccggaatgtgtcaccacagggaaatctagcaaagagagtgatgtgtacagctttggtgttgttgcacttgaaatcacatgtggtagaaaaccagtggaagttagagaagagcctagtaaagtaaggcttgtggagtgggtgtggagcctctatggaaaagggaaactacttgaagcagctgataagaaactgaattgggaatttgaagaacagcaaatggaatgtttgatgattgtggggttgtggtgttgccatcctgatcataccatgaggccatccattaggcaagtgattagtgtccttaaccttgaagcccctttgccaagtcttccatccaagttgcctgtgccaatgtattatgcacctccaatggatatgtgcaaattctcctacacttcatctggtgttacaagcacaaccaaagaatcttctccatactcttcaatgtcagctgggtccggaaaatctctattgtag

SEQ ID NO: 1730 - DNA, 393 bp, Glycine max var. Williams 82
atgtttccatggctagcctttggtcacatgatcccaaaccttgagctggccaaactcattgctcaaaagggtcaccaccgtcttccaaaaccgtcactaaacacacttgatatcaatttcgtgaaccttccactgcctaaagtccaaaaccttccagaaaacgcagaagccaacactgacatcccctacgacgtctttgaacacctcaaagaagcctacgacgttctccaagaaccgctgaaactcttctacgacttcgctcccttttgggtgggttcaatggcttcgaagcttggcatcaaagcgcttttttcagcatttgcactccacccttctcgggtaaatatttattttaaaaatatacatataaagaaaaatataaaaattggataa

SEQ ID NO: 1731 - DNA, 945 bp, Glycine max var. Williams 82
atgggtgtcaaaggtttcgtcgaaggaggcattgcttctgtgatcgcagggtgttccacacaccctcttgatctcatcaaggtaagaatgcagcttcaaggagagacccagcaaccctcgaatctccgacccgcactcgccttccaccctagctccgtccacgcgccgccgcagccggcggccaaggagggtcccattgccgtcggagttaagttagtccaacaagaaggcgtggccgcgcttttctccggcgtctccgccaccgtcctccgccagcttctctactccaccactcgcatgggactctacgaggtgctcaagaagaaatggtccgatcccaattctgccggaggcaccttgtcgctatctcgtaagataacggcagggttaatttctggtggaatcggcgcagtcgttggaaatcccgccgatgtagccatggtccgcatgcaggccgacggaagacttccgccgatccgacaacggaattataaatccgtccttgacgccatcgcaaggatgacaaaagacgagggcatcactagcttatggcgtggttcatcgttaacagtgaaccgcgccatgttagtgacggcctcgcagctcgcttcttacgaccagttcaaggagatgattttggaaaagggtgtaatgcgtgatggtcttgggacccatgtaacgtcgagtttcgcagcggggtttgtggcggcggttacgtcgaaccccgttgacgtgatcaagactagggtgatgaacatgaaggtggaacctggggcggcgccgccgtattccggcgcactggattgcgccttgaagacggtacgcaaagagggccccatggctctttacaaaggctttattcccacgatttcgagacaaggacccttcactgttgttttgttcgtcacgttagaacaggttcgaaagttgcttaaggatttctaa

SEQ ID NO: 1732 - DNA, 1605 bp, Glycine max var. Williams 82
atgcatgttcttttttctgcgaagagagtagcgttctctgagtcctttctgccacacagaagaaggcttttcacttggttcagtttaagtactttagcttctcttgttctgttgtccctcttccttctcagtaactccctcagggttcctaaagttttagtctttgttccaaaatttggcgctgttggtgcaaactcttctgttggtccttgtcccttgtttcctttcaacaccagccactctttttccaatgagaatgacacttttgacacttcaaagtcaaatgggtcagagagttctgtgaagagaattgaagagggaagtgttgttgaaaatcttcatgtagtgaataatgtgtcagatgaaaacattaagagtgttgcagaagggaggggtttggagaattctagtttttcttctattttgttgtcagagagtaaccatgggaagcaaccaaagcatgaggggggttttgttggggaaaagagtttaaagaatgtaactgttactcataatgagaaaatgcatgttggtttatatgacgagaaatgtgacatttttgatggaaagtgggtaagagatggttcaaagccatattatcctttaggatcttgtcgcctaattgatagagattttaattgtcaccgtaatggaaggcctgatgctgaatatgttaaatggaggtggcagccaaatgggtgcataattccaagtttgaatgcaactgattttctggagaggttgcgtgggcagaggctagtttttgttggggattcactgaacaggaacatgtgggagtcacttgtatgcattctccgtcaaagcatcaataaaaagaaacgggtttttgaaatttctggaagaagggaatttaagaagaaaggtgtctatgcttttagatttgaggactataattgttcggtggattttgttgtttcaccattcattgttcaagagtcaactttcaagggcaaaaatggttcgtttgagacattaagattggatttgatggaccgtactacggccaggtattgggatgctaatatcatagtcttcaacacaggacattggtggacccatgataaaacatcaaaaggagaagattattatcaagaaggaaatcatgtataccaaagacttgaggttctagatgcatatacgagagccttgaccacttgggctaaatgggttgataaaaaaattaatgccaatcaaactcaggttttcttcagaggattctcacttacccatttctggggtgggcaatggaactcaggaggacagtgccacaaagaaactgagccaatattcaatgaagcttacttacaaagatatccttcaaaaatgttggctctagaacatgtcatccaacaaatgaaaaccccagtagtatatatgaacataagtaggcttacagattacagaaaagatggacatccttcggtatacagaacggggtataaggcgtcgatgaagcagaacactgctgcactattcgaagattgcagccattggtgcttgcctggggtaccagatacttggaatgaattgctatatgtttctctcttaaaatatggaaaaggtacttggaaaaaaactaattaa

SEQ ID NO: 1733 - DNA, 1027 bp, Glycine max var. Williams 82
cttttcaaggctctctctattgtttaggttccaaagtcaatatacaatttctgatctctgcatctcaatccaatagatcaaatatgccttcaaacgatggtatagttatcgtggtcatgggtgtcagcggtgctggaaaaaccacaataggtcagatgctggaaaaagagttgaaatacaagtatcttgatgctgatgattttcacttagaatcaaacaaagaaaagatgcgaatgggaatccccctaaccgatgaagaccggatgccatggcttgaatcgctatgctacgccataaaagaatacttgaataacaaaaagggtctggttcttggttgttctgctttgaagaaggaatatagagaaattcttagatcaggtgatactagttataattgggggacttatgcaagtgctgtcaacttcattctcttggatgctcctgctgaagtgctaagtgttcgagtgaataagagagctgcagaaggaaaacattatatgcctgcatcgcttttgcaatctcagttagatttgcttaagattgatgagcctgagggagtacttagagttgatgctactttgagaccccaagacattgtaaacaccattctaaacatggatcagtttcagggctgtttcaatcatgattttgttgaatctctttgatagatttggataattattttaggtttcaaatataggttgtacaaataaaaggaagaataggattatgcttgagagaaatggagaagggaatggttcagagcaggataaccaatagaaaaaataggggcaagctgcaaatatgaatttttagcattccctggattgattcatgccattcaatttctttttcaccatatggtgtctatatatagaacattgcatgtctaaatagaccattgttttgtaactgaattttttcttacaatcatttaattaaactttaatgattcgacttagaacaggatagtgtattgtccaatctaaaacaccaagtaatttgaatcacaattcagtttgttttg

SEQ ID NO: 1734 - DNA, 1083 bp, Glycine max var. Williams 82
atgaatgcggaacctccgctgccgccggcgctcctcatgtcggtttcctgcctctccgactacgacctcctctgtggcgaggacacctccggagtcctctccggagagtcgccggagtgctcctcatccgacatcggctcctcaccacttccgccgtcacctccgccgtcgccgacgatgacggaggattgttattccatcgcgagcttcatcgagcacgagcgcaacttcgtccccggattcgagtacctgtcgaggttccaatctcgctccctcgacgccaacgccagagaagaatccgttgcatggattctcaaggtacacgcgtattatggctttcagcctttgacggcgtacctcgccgtcaactatatggatcggtttttggattctagccagttgccggaaacaaatgggtggcctctgcaacttctatctgttgcatgcttgtctttggcagcaaaaatggaggaacctcttgttccatctctcttggaccttcagatagaaggtgccaagtacatatttgaaccgagaacaattcgtaggatggagctacttgttctgggtgtcttggattggaggctaagatcagtaaccccactttgcttcctcgttttctttgcgtgcaaagcagattcaactggaacttttacccggttcctcatttcccgggctacagaaatcatcgtatctaatatccaagaggctagctttcttgcttacaggccatcatgcattgctgctgcagccatactcactgcagctaatgaaattcctaattggtctgtggttaagcccgagcaagctgagtcctggtgtcagggaataagaaaagaaaaagtaatagggtgctaccagttgatgcaagaacttgtgattaacaataaccaaaggaaactccctactaaagtgttgccgcagctgcgagtaacaactcggacccgaatgaggtcaagtactgtctcatcattctcatcaacatcatcatcatcctcttcaacctccttctccttgtcttgtaagaggaggaaattaaataatcgtttgtgggtagatgatgagaaaggaaactccgagtaa

SEQ ID NO: 1735 - DNA, 366 bp, Glycine max var. Williams 82
atggccatggcatatgttgctaggtcatcagagtcatctcaagtgcttactttccattccactgctaaatggaatgctcactttgatgccttgaaacaaactaacaaactgatggtggttgatttcactgcatcatggtgtggaccttgcaaactcatggatccagttatccaagagtttgctacaaaatacagagatgttgagtttgtcaagattgatgtggatgagttaatggaggtatctcaacattaccaagtacagggaatgccaactttcatgctgcttaagaaaggcaaagtggctaataaagtggtgggagtgagaaaggaggagctacaaaggttgattgaacaacacagaaaataa

SEQ ID NO: 1736 - DNA, 1224 bp, Glycine max var. Williams 82
atggagcttgcacctgtgaagtctgaactaagtccaaggagccataggttgctcatgatagatggtagtgaggttattggcactaagtgtgtcaaaaggcggcgaagagattcatctacggccgtgttaggtggcaatggacaacaaggtgaacagttagaagaacagaagcaacttggtggccaatcaactgccaccactgtgaagagaagctcaaggttcaggggtgttagcagacacaggtggactggaaggtttgaagcacatctatgggataaagggacctggaatcccactcagaagaagaaaggaaagcaagtatatttgggagcttataatgatgaagaagctgcagctagagcttatgatttggctgcactcaagtactggggaatatcaactttcacaaattttcctgtatctgattatgagaaagaaattgagataatgaaaactgtaaccaaagaagaatatcttgcttcattgagaaggaggagcagtggtttttccagaggtgtatcgaagtatagaggagtagcaaggcatcatcacaatggaagatgggaagcaaggattgggagagtgttcggtaacaagtacctctaccttgggacttacagtacacaagaagaagcagctcgcgcatatgacattgcagcaattgaatacagaggcataaatgcagtgacaaactttgacttgagcacctacataagatggctaagaccgggaacacatcctactgcttctcatgatcaaaagcctagcactgatgctcaaccttttgcaacctctaactccatgcaagcaagagggaacattgaggtatccaactccaacaagaattcattcccctcaggtaaattggacagtaccaagaagcgagacttttccaagtacatgaaccctttgagtccatgcaacaagccatcttccccaacagcattaggacttctcctaaaatcctcagtgtttagagaactgatgcagagaaatctgaactcttctagtgaagaagctgaagaagttgaattgaaatatccacatgagggcaatgatggagttggagggatttatgataatgaaaacaccaataactcttacttttgctcttctaatatcagcagattacctaacttggagtcatcagaagagagtccattgcctatgtatcatggaactgtgcaatcactatggaatagtgctttcaacatgtctaactga

SEQ ID NO: 1737 - DNA, 1473 bp, Glycine max var. Williams 82
ccaggtaaattacattgttgtctgctgaaataaaaaacagaagagtgaaatggagcttgcacctgtgaagtctgaactaagtccaaggagccataggttgctcatgatagatggtagtgaggttattggcactaagtgtgtcaaaaggcggcgaagagattcatctacggccgtgttaggtggcaatggacaacaaggtgaacagttagaagaacagaagcaacttggtggccaatcaactgccaccactgtgaagagaagctcaaggttcaggggtgttagcagacacaggtggactggaaggtttgaagcacatctatgggataaagggacctggaatcccactcagaagaagaaaggaaagcaagtatatttgggagcttataatgatgaagaagctgcagctagagcttatgatttggctgcactcaagtactggggaatatcaactttcacaaattttcctgtatctgattatgagaaagaaattgagataatgaaaactgtaaccaaagaagaatatcttgcttcattgagaaggaggagcagtggtttttccagaggtgtatcgaagtatagaggagtagcaaggcatcatcacaatggaagatgggaagcaaggattgggagagtgttcggtaacaagtacctctaccttgggacttacagtacacaagaagaagcagctcgcgcatatgacattgcagcaattgaatacagaggcataaatgcagtgacaaactttgacttgagcacctacataagatggctaagaccgggaacacatcctactgcttctcatgatcaaaagcctagcactgatgctcaaccttttgcaacctctaactccatgcaagcaagagggaacattgaggtatccaactccaacaagaattcattcccctcaggtaaattggacagtaccaagaagcgagacttttccaagtacatgaaccctttgagtccatgcaacaagccatcttccccaacagcattaggacttctcctaaaatcctcagtgtttagagaactgatgcagagaaatctgaactcttctagtgaagaagctgaagaagttgaattgaaatatccacatgagggcaatgatggagttggagggatttatgataatgaaaacaccaataactcttacttttgctcttctaatatcagcagattacctaacttggagtcatcagaagagagtccattgcctatgtatcatggaactgtgcaatcactatggaatagtgctttcaacatgtctaactgattgcttttgttattttattttatttttctgttaagaaaacttgagagaaactctctccctccttagcatactagtggatgtcaaataattgccaagatgtgcatattgtcacttcgaccttgactgttcataaatcaacaatgtcaaataaacattgctgtattgacttcaattttgaagcaaaatgtgtaaaacttttt

SEQ ID NO: 1738 - DNA, 738 bp, Glycine max var. Williams 82
atggcactgaaatcagcaatctcagtcacattcttgtgcttagtcttgttagcactaggaaatgaatggcaactaggcacgctggacgaggcttgtgccacagggaactatgactatgtgatcatagcctttttgccaacccttggcgatggccaaactcctatgattaaccttgcaggccattgtgatccatacagtaaaggatgcactggcttaagctcggacattgagtcctgccaagccaaaggcatcaaggtgttgctctctttaggaggaggtgcaggaagctactcaattgcatcaactcaagatgcaagccaattgtcttctcgtcctcttggccccgccattctagatgacatcgactttgacattgaggatggatcaaaccagcactggggtgatcttgccaagttccttaaagggtatggcatggccaagcaaggcaagcaagcgttcataactgcagcacctcagtgcccatttcctgatgcttggattggaaatgccctcacaacaggcctttttgacattgtttgtgtccaattctacaacaaccctccttgccaatacaattctggggcaattactggaagtggtttcattccttctgctgatcttatttccaaggtgcttccagccattaagggttctgctaaatatggaggtgttatgatgtggtctaggtattatgatgctcaaagtggatatagctcctccatcaggagccatgtgtaa

SEQ ID NO: 1739 - DNA, 1206 bp, Glycine max var. Williams 82
atggattatttcaatgcaccaggaagaaaccatctctttgttccagggccggttaacattccggaccagatcatccgggccatgaacagaaacaatgaggactaccgttctccagcaattccagctatgacaaaaactttgcttgaggatgtcaagaagattttcaagaccactactggaaccccatttctcatccctacaactggtactggtgcttgggagagtgctctcacaaacacactgtctcctggggatcgaattgtatcgttcctgattggccaattcagcttgctttggattgatcagcagcaacgcctgaagttcaatgttgatgttgttgagagtgaatggggccatggtgctaagcttgatgttctggaatcaaagattgcttcagatacttcacacactataaaggcaatttgcattgttcacaatgagactgcaactggggtcaccaatgacttggccaaagtgagacaaattcttgattcctaccagcatccagccctccttattgttgatggagtgtcttccatttgtgctcttgatttccgcatggatgaatggggagttgatgtggcaataactggctcccagaaggccctttcccttcccactgggataggtattgtggttgcaggccctaaagctattgaggcctcaaaacatgctaaatcacttagagttttctttgactggaaagactacctcaaattctaccagctaggaacctattggccatacactccttccatacatttgctgtatggtctgagagctgctcttgatctgatttttgaggaaggactcgaaaatgtgatcgcaaggcacagtcgtttaggcaaagcaaccagacttgctgtagaggcatggggtttgaagaattgcacccaaaaggaagagtggtacagtgacactgtgactgctgttcttgttcctgcttacattgatagtactgaaatagttaggagggcatggaagagatacaatttgagcttaggtcttggactgaacaaagttgctgggaaggttttcagaattggacatcttggccacttgaatgagttgcaactgttgggatgtctagctggtgtagagatgatactcaaagatgtgggttatcctgtaaagcttggaagtggagttgctgctgccagtgcatacttacagaacactattcctatgatcccttccaggatttga

SEQ ID NO: 1740 - DNA, 486 bp, Glycine max var. Williams 82
atgtacaggaacatgaagggaggtacgattctcacatcaatgcaacaggaaatggaagaaaatgtgcatgttaaggatcatcacccaatctgctccaactgttcatcccaaagcataatcttcagatcacaaggaactaaatttaaattaaaggcatcaaaatatgatacggggattgtcaatcaagaaattcacccgctagaaaataaaggactttcgcagaccagtgaaactgattatgatctaaatcaggaacccgagtcaagtgcatgcttatttagtgaatcgtcaaatgaagaaaagagtaggacaatgaaatttcttgatctctcactctctttcggctcttcaccaattccaacaatggacggtgatcaagagagaatgcgtttttcttcaccaaatacagcagataatcatgttatcgattctaattctgtacaatctcatgggagcaattatataaatttagacctaacaatatga

SEQ ID NO: 1741 - DNA, 1191 bp, Glycine max var. Williams 82
atgtctggtgttcttctttgggtgagttgtggacccaaggagaaccctatctccattgttggtcttggcgggagaggtggcagaagccagaggaggtttggactgtgcaatgggatcagttttgcaagcttttcaccagcagtggcagacccttcaagatcctcagaggagagggtatatgaagtggtgttgaaacaagcagcactggtcaaggagcaggacaagggtacaaagagagcactgaatttggacaaaccaacaattgaaggtgatttaaccaatggggatctgttgagtgatgcttatgataggtgtggtgaagtctgtgctgaatatgccaagacattttatctaggcacacaattgatgacccaagagcgcagaaaagccatctgggccatatatgtgtggtgcagaagaacagatgaactagtggatggacctaatgcttctcacatcacaccaaaggccttggacaggtgggagcaaagattatctgatgttttcgaaggccggccttatgatatgtatgatgctgccctctcagatacagtctcaaagtacccagttgatatacagccatttaaggacatgattgaagggatgaggcttgatctgagaaagtcaagatacaatagctttgatgaactctacctttactgctactatgtagcagggacagtgggccttatgagtgttccagtaatggggatagcaccagaatcaaaggctacaacagagagcgtttataatgctgcattggcacttggcatagctaatcaacttaccaacattctcagagacgttggagaagatgcaagaagaggaagagtatatcttccacaagatgaattggcacaagctggcctaacagatgatgacatttttagagggaaagttaccgacaagtggcgcaatttcatgaagggccaaatacagagagcaaggatgttttttgatgaggcagagaagggagtttcggagctcaactctgcaagcaggtggcctgtatgggcatctttgttgttgtatgggcaaatcttagattctattgaagctaatgactacaataacttcactaaaagagcttatgtaggaaaagttaagaagctcttatcactacctgctgcttatggaagagcacttctaggcccccaaaagttaaccaagatggttacaagaagtatgtaa

SEQ ID NO: 1742 - DNA, 2361 bp, Glycine max var. Williams 82
atgtcttcagctatctttcttcctttcatactttcactttcactttcactttcacttctgaatggcttagatgtcatacaattaaacacaaacatcactgccggttcaaattctacctggaagtcaccctcgggcgattttgaattcggattctatgatcttcgcactggtctctttcttgtgggaatatggtttggaaaaatcccagacagaactttggcatggtacttccagagtccccctgtggaagcaaattcccaaatccaattcacttctgcaggaaaccttgtggttgcatacccgaaccagactattgctcaaaccatatacagtggtggtgctgcaacttcttcctacatgcaagatgacggaaattttgtcatgaaggactccaactcggaatctgtctggcagagtttcaattctccttccaacacaatgttaccgggacaaacgttgcagagtaccaaagttctctattccaaggagagaggagattcaaactactcattgggaaaattcatgttacaaatgcaagacgatggaaacttggtgctaaaagcgtaccaatggtctggccctgcatactggtacaattcaaccaacacccccaatgtgaatttggagtttaatgctaccagtgctctcatgcactttgttagcggctctaggagcatctacaccttaacaaaaagcacttcaacccccgtggaagattactatcaccgcgctacaatagatgagaatggaaattttcagcaatatgcatatcccagacgaaacgagaatgacaccactgggtggaggagggtttggagagctgtggaagatccctgcagagtgaatcttgtttgtggtgtttatggtttgtgcacttctcctgacaatgaatcagtcaagtgtgagtgtattccgggttatatcccattggatcatcaagatgtgtccaaagggtgtcacccaccagatacaatcaattactgtgcagagaagaagttcaaggtagaggtgtttggggacactgatttccaattcgataataattttgttcgcgtatatgatgttgatttggaaggttgtaagaagtctttaatggatgattgtaatgtcattgctgcaacttataacacctccacccgcacatgtgccaagaagaggttgcctttgctgaatgctagaaatagctcttcttcgaagggacagaaagcactgcttaaagttcctaacagtgttgatgatgggagatctaataaagctaccaacaaaaagagctttaatgtaagaatatttttgaaggttatgcttgcagttactgccactcttgcatgtttctttggtgcccttgttgtctactatcaccctttcactcagagactagcaagaagaaagcggtatttgaatgcaagcgctattggaatcaacttcagagaattcaccttccaggagctgcatgaagcaacagatggattcactaggattcttggaaggggttcttcgggtaaagtctatcacggaactttaataatagacgatgcagtgattggtattgcagtaaagaaactggaaaagaaaattgagaaaagtgagagtgaattcatgactgagctcaaaattattggccgtacccatcacagaaatttggtgaggcttttgggcttttgcattgagagtagccatcgagttcttgtgtatgagttgatgacgaacggagcattgtcaagctttttgtttggagagggagaaaggcctcaatggggtcagaggatcgaaatggctcttggagtcgcacgaggcttactatacctgcacgaagagtgccacacccaaatcatacattgtgatatcaagccccaaaatgtgttacttgattccaatcacacagcaaagatagcagattttgggctttccaagcttttgctcaaagatcaaactagaacaagcaccaatttaagagggacaataggttatatggcacctgaatggctaaagagcgcaccaataactgccaaagttgatatatacagttttggggttatgttattggagattatttgttgcaggaggcacttcgagtctcctcacgatgcaaacgacagcgaagatgatgatttggttctttcaaatttggttttaaggagtgtggtgtctaggaagctagaggtagtggtgagacacgactcagaagtgctgaatgatttcaagaggtttgaagaaatggcattggttggactatggtgtgttcatccgaatccggctcttagaccttcaatgaagcatgtgatgcagatgctaaatggaactgtggaagttgggattcctcctttggtttatgatcagatgatggaagatcagggcttgtag

SEQ ID NO: 1743 - DNA, 2352 bp, Glycine max var. Williams 82
atggttacaaaaccccttgttctctttgtttctttctttctatgttccagtgttctaagaaatgctaactcaattgaactaggttccagcattgtggctggcaccaataattcatcttggagatcatcaaatggtgattatgcctttggcttctaccaccttcttagtggccactatcttgttggaatttggtttgacaaggttccaaacaaaacactggtttggtcagcaaatcgcgacaatccggttgaaattggatcaaccatcaatctcacatcaagtggcgaatttctgctccaacctgtcaaaggggctacatttcaaatctacaaaggaacaaacactcctgctgcaactgcaaaaatggaggataatgggaatttggtgttgaggaattcactttctgaatttatatggcagagctttgattctcccacggatactcttctattaggccaaactttgaagatgggtcagaagctctattccaatgccaatggatcagtggactactcaaaagggcaatacagtttggagatccaacaatctgatggaaacattgttctcaaagcttttcggttcaccgatgctggttattggtccagtggaactaaccaaaacacagatgtgagaattgttttcaacagcacaacagcttttctttacgcggtcaatggaaccaaccaaaccatccataacatgacagtcgatcctttaacgggcgcgatcgaagactattatcatcgcgtgctgatcgatgatcggggaaacttgcagaagttgattcacccaaaagaaaatggaagcgattggacatctgtctggaacgccatagaactgccctgcagagtgaccgcgctttgtggggtgtatggcttttgcaattcatctgacaaccaatcatatagctgtgaatgcttgcctggctatacacatttggatccaaatgtaccttccaaagggtgttatcttagtacggaggccaatggcttgtgtgctgcaaattcctctaaggttgaagtgaaagcaattcaagatgctgatataccaaataatgattatttttattttgatctacaagttataaacaacatggatctggaaagttgcaagagggaactgatggatgactgtctctgcatggctgctgttttttatggctcagattgccacaagaaaacgtggccagttataaacgccataaaaatcttccctgacactagcaatcgggtgatgctgattaaagttcctcttcttgacaatgatatggaaaatgaaaaggattcacaatctttggttgttttgatagtggctcttgtctcttgttccctacttgctgtattgtttgctgctacttttatttatcatcaccccatcatttgtcaacatctcatacacaaaggggagccaccaaagccaaagcctatggatatcaacctaaaggcattctcattccaacagctgagagaagcaacaaatggattcaaggacaaactcggtcgaggtgcctatggtacagtgtatagcggggttctaaacttggagggtcaacaggttgaggttgcggtcaaacaactggagcaagtagaagagcaaggtgagaaagaatttgttacagaagttcaagttattgctcatactcatcatagaaatctcgttgggctattgggctattgcaatgaacaaaatcacaggcttttggtttatgagaaaatggaaaatgggacactctccaactttctttttggagaagggaatcatagacccagttgggagagtagagtaagaattgtgattgagattgcaagaggcttattgtatctgcatgaggagtgtgaccaacaaatcattcattgcgacataaagcctcagaatgttcttctcgactcgagttacaccgcaaagatttcagattttggactggcaaagcttctaatgaaagacaagactcgaacaagcaccaatgctagaggaacagtgggttatatggcaccagaatggctaaaaaatgcacctgttactacaaaggttgatatctacagctttggcgttgtgttgttggaaaccatattttgcagaaggcacatcgagttacaccgaatcaatgacgaaacaacgggtggtgatgacatgatactcatagattgggttctgtatctggcaaaagaaaacagtttaagagcagctgtggttgatgatcttgaagttgaaagtgatttcaaacggtttgaaagaatggtaatggttggattgtggtgcgtatatccgaattcaactcttcgaccatctatgaaagtggtggcacagatgttggaaggaaatatagaagtgggtgttcccccactcaactaa

SEQ ID NO: 1744 - DNA, 1674 bp, Glycine max var. Williams 82
atggttttgagggtttctctgattctggttctccttgtgttacactgttcctgcactgtggaatccatttgggggcatcacaatgatctcaacaagaatggatcttctcttgctgcagtcaagtttcctgatcatgcacacttcaatgctgtttcttcttccacagaaactgggtgtagtttctccaagtcagagaaatttgagccttcagttgctaccatggcatcaaatgaagacactgatggtaaagagggagaggcttttgtggcagcaaaacagcacaagcaatctgtgaaactcaatttgagacaccactcagtgagcaaagattcggagcctaaaaaatctgtggttgattccacagggagagacttgaagagaattcagacccttcacagaagggtcatagagaagaagaaccaaaacacaatttcaaggttggagaaagcacaggagcactcaaagaagtcctataagccaccgacagtggctgcggcggccccgccggagtatttatccggtcagcttatggcaaccttggagtcaggggtcagtcttggctctggtgagtacttcatggatgtgtttgttggcacaccccctaagcatttttctctaattcttgatactggtagtgaccttaattggattcaatgtgttccttgttatgcttgttttgagcaaaatggaccatattatgatcccaaagattctagttcttttaagaatataacttgccgtgatccaaggtgccaattggtgtcatccccagaccctcctcagccttgcaaaggtgagactcaaagctgtccatatttctattggtatggagatagttccaacacaacgggtgattttgcacttgaaacattcactgtgaatctcaccacacctgagggaaagcctgaactcaagattgttgagaatgttatgtttggttgtggtcattggaatagaggactttttcatggtgctgctggattgctagggttggggagaggcccattgtcatttgctactcagcttcaatctctctatggtcactccttttcctattgccttgtggataggaacagcaattcaagtgttagtagcaagttgatatttggtgaggacaaggagcttctcagccaccccaatttgaatttcacttcttttgttggtggcaaagagaaccctgttgacacattttactatgtccagataaagtccatcatggttggtggtgaggtgctgaagattccagaggagacttggcatttgtcagcacaaggtggtggtgggggtacaatcattgattctggcaccactttgacctactttgctgaacctgcttatgagattatcaaggaggcattcatgaggaaaattaaaggttttccactagtggaaacctttccccctctaaagccatgctataatgtgtctggtgttgagaaaatggagcttcctgagtttgcaatcttgtttgctgatggagctgtgtggaattttcctgtggagaattacttcatccagattgaacctgaagatgttgtttgcttggctgttttggggactcctatgtctgcactttcaataattggaaactaccagcagcagaattttcacatcttgtatgatgtgaagaaatcaaggattggatatgcaccgatgaattgtgctgatgtttaa

SEQ ID NO: 1745 - DNA, 1398 bp, Glycine max var. Williams 82
atggctaccataaaagcttctcacactgtggttccaaatcaaccaacaccaaaaggtcgattgtggctatccaacagtgacaattccacacgtaaagcacattcaccagttatttacatctacaaagcaaaacacaacattgaatacaacattgagaggatgaaagagtctcttagcaaaactctagtgtacttctatccagttgctggcagattgagcttatcagaaagtggtagaatggaagtggattgcaacgcaaagggagtgacattgatcgaagccgaaaccgcgaaaacattggctgattttggagacttttcaccctctgattccatcaaggaagaacttgttccagcaattgattatcactctcaacctatacaagagattcctttgctatttgttcaactaacaagattcaaaggtgaccaacaacaacaacatggccttgccattggaatggcttactcacatcctgtggctgatgggcttgcttggactcgctttgtcaacacatgggcaatggtcaatagaggagactcattagatgttaatgaaatgccatttctagatcgaactatactcaaatttccaacatggtcatcgtcattgtcgttactgtcaccaccaccactatcacactctgatcacccagagctgaagcctcttccactcatactaggcagatctgacagcactgaagagcaaaacaagaagacaacagcatctgtgttgaaactcacatcaaagcaagtggagatgctgaagaagaaggccaatgatcaagggtcaacaccttgtaccagatttgaagctgtggccgcacatatatggagatgtgcatgcaaggctcgcggacaacatcacaagcaaccaactatagttcggttcaatggtgatattcgcaacagattaatccctcctctccccaggaactactttgggaatgcattggtagcaacagtgacaccagaatgttatgttggagaaatcacatcaagaccattgagttatgcagcaagaaaattgagagaagcaatagcgttgctcagagatgagtacatcaggtcacagttagaagctgtgtttggtgaggagcaattgaagtgcataagggctttcttcttgggacaaggtgaaggtagaagtgaaccgtttggagggaatccaaatcttcaaatcacaagctggatcaacttcccggtggatagtacagattttgggtggggaaagcctgtgtattttggtctaggatatgtgtgtgcacttgatagggggattattgttcgagatccacaagatgatggttctttgattgtgatcatgcatttccagatagcacatatgcaactctttaagaaactcttctacgaggatatattcacttcaaggctgtaa

SEQ ID NO: 1746 - DNA, 2322 bp, Glycine max var. Williams 82
atgagcacctttgaatcatcaacaacaagatcctttgtttctgtagaatcaacaacaccaattgaaggaacggaagctgacaatgtgaatagggactcattgttccgagggtgtgtattggaagggagatgggacttcattcttacggcatataaaaacgatagtcactatcacaaaattaaaataaacgaaagcagaggcacagcactacacgtggcagtgaatgatggcaaagtggaacttgttaacactctcgttggtgcaatcttaaaccatgaagggatggatgtgctgagggatgatagtgcattgaaaacaaccaatgagagaggggacactcctttgcaccttgcagcatcaagagggttcaatgctatgtgcaagtgcatcataggggagtctgaggaaaggaaggatttgattagggttaggaacaataagggtgaaacacctctcttccgggctgtgctcacatgccatacaaagacctttgtgtacttccatcatgtttccaaagatattccacttaggaactatgatggggataccatccttcaccatgccatttggagagaattcttggatttggcaattataataactcattgctatcctgaacttgttgacatgcgaaacaaagatggagccactcctctcaaagttcttgcctctaagccttcagccttcaagagtggaagcaatctcccatggtggaagcaaattctatattatggtatactcgtagaacaactagacgcagaaaaggcaataaaatcctatatggataaagttgacaaatttgaggccgacattgaactcaaagtgaatatacattcagaaagtagtgaagccaacaaagcacaaaaatttgtggaaaaacagtatgctacttctgttcggtttgtaaagagtgctgttcgattagcattcaaagtccttagcctctcgggattgggtgtcactgcacaggacttgaaagcaataaagaagataaggcagaagcacagatggagtcgtcaactcttgaatatttttatggaaagaccttatgagtcgtacattggaattactgggggtcgaccatttttgagagaagacagagacttagggcaacccgttattacccaacaacagttacaaatggtgggtggtgcagctagctcagggcaacaagaaaacaatagagtggaatccgcagcaaaaaatgaggaaaaggagacatttgtggcagtggcaaaagccggcatagttgaacttgtgaatgagcttcacaacaaagtaccaagtaccttccatgacactaactctcctgagaaggaaaacttactgattgtggcaatgaagaacatcaaatacaaaataggagaacaccatgttgacaaaaaggagactgcatttttggcagcggctaaatacggcattgtggagattgtatttgcacttcaatccaaaataccaagtgccgtgcatgaaaccaactccaacaatgaaaacgtgttgcttgtggctgtgaagaatagacaaaccaaagttgttgaggtgttaaggaaacatatggataaggaactctttgatagcttgattttagaagtggataacagggagaacactgtgttgcacttggcagctggaactggaactacaagcaacagtgaaaggacctggcagattgctggtgctgccatgcaaatgatgtgggatatcaagtggtatcagtacattagagccctagtgccggagcacttcgttttcagaaccaacaaagacgataaaaccgcaggcgaaatcttcaaacaaaaacacaaagacctggtgaaagaaagctccgagtggctaaaggaaacctccaactcctgctccgtcgtcgccgccctaatcgcgggcgtctccttcgccacatcgagctccgtccccggtggcaccgagaagggcaagcccgaacttgaaggccagccagccttcgacgtcttcgccatcgcatcgctcatcggcctctgcttctccgtcaccgccctcatcatgttccttgccattctcacttcgcgaaaacaggccccagacttccgcaagagcttgcccttgaagcttctctttggcttaagctctctcttcgtgtccattggctcaatgcttgtttcgttttgcgctgcgcatttctttgtgctcaaggacaagtacaagaacattttgttccccgtttatattgctacttgtttgcctgtgaccttctatgcggtggtgcagtttccgttgtatgctgatcttcttaaagccattttcaagaaggtgccacaacccagtattaccagcagccaattttag

SEQ ID NO: 1747 - DNA, 681 bp, Glycine max var. Williams 82
atggcatcagctctaccaaatgtaggtttccatgcccgcacttcatctagtagaatgaacaaattttccaatgtcaaattgctaccattgacaagcaaaaggaatagaactttctgcagcaatgtaaaggctatggcaggaggtgaaacgagtttgcagaagtcaaagcagcaagtgcaaccaaagatgaaggtgccacaagcttcacctaaagtgctgttgaaccagtttccagtagcaaggactgtgcagcaaatgatggacacaatggagaggatggtggaggatcccttggtttatggtagcacttcacctttgatagttgtgggagacgatgaatacagtaaggggaagattccttgggcaataaaggaaggccagaaagattacaaaatgagattcaacatgccaggaatgaacaagaatgatgtcaaggtatgggtagaacagaacatgctggtggtgaaggcagagaaggcactccaggagaaccatgaaggtcaagcagacggcaacgaagactggcctgccaatagctatggtagatataaccacaggatagccctcccagaaaatattgagtttgataaaattaaggcacaggtcaaagatgggattctttatgtaacaattcccaaagccagcacttcttcaaaagtaattggcatagatgtacagtaa

SEQ ID NO: 1748 - DNA, 510 bp, Glycine max var. Williams 82
atgtgtggtgtgccagatgatccgaaaaagataaaccacttggttagcctcgatggtgctaaggagaggctgcacctctacaaggcgaatcttctcgaagaaggttcctttgactctgtctttcaaggttgccatgctgtgtttcacactgcttctcccttttatcacgatgtcaaggacccccaggctgaattgttagacccagctttgaaggggactctcaatgttctgaagtcgtgtgtgaacttgccaacgctggaacgtgtcgttttaacctcttctgttgctgcagttgcgtacaacggaaagcctcgtactcccgatgtagtggttgatgagacatggttttctgacccggatttctgtagggaatcacagatgtggtatacactttcaaagactttggccgaagatgcctactctattgtaaatacaataattttatcgtccattgttaggtcttttctctttgtaaacataaaaaagtgcaaggcaacaggtttcctttag

SEQ ID NO: 1749 - DNA, 1533 bp, Glycine max var. Williams 82
atggctctactattcctcttctttgtagctcttatttcctttctcttcacgatccttatagtacaaaaactaggaaagaaatccaagaaaactgatgacacaacttgtgacatgcatatgccccacgggcctagaaagctacctattataggaaatatatacaatcttatatgctctcaaccccatagaaaattaagagacttggccataaaatatggacccgtgatgcatcttcaacttggagaggtttcaactattgtcatttcatcccctgactgtgctaaggaagtgatgacaacccatgatattaactttgccacaagacctcaaatcctagctactgaaataatgtcatacaattccacaagtatagctttttctccttatggaaattactggaggcagctacgaaaaatttgcatattggagcttttaagcctaaaacgtgttaactcataccagccagttagagaagaagagctcttcaatcttgtcaaatggattgcttcagagaaaggatcccccatcaacctcactcaagcagtactttcatctgtttatacaatttcttcgagggctacctttggcaagaaatgcaaagaccaagaaaagtttatatcagtgctaacaaaatcaataaaagtttcagcaggttttaacatgggagatttgtttccatcttctacttggcttcaacatctcactggcttgaggcctaagcttgagaggttgcatcaacaagctgatcagatattggaaaacatcatcaatgatcataaagaggcaaagtcaaaagccaagggtgacgatagtgaagcacaagatctggttgatgtcctcatacaatatgaggatggaagcaagcaggatttttccttaactaaaaacaacatcaaggccataattcaggacatttttgctgctggaggtgagacatcagctacaacaatagattgggcaatggctgaaatgattaaggatccaagagtgatgaagaaagcacaagctgaggtgagagaggtattcggtatgaacggaagggttgatgaaaattgcatcaatgaacttcaatatttgaaactaattgtgaaagagaccttgaggttgcaccctccagctcctcttttgcttccaagagaatgtggtcaaacatgtgagatacatggttatcacataccagccaaaaccaaggtcatagtcaatgcctgggcaattggaagagatccaaagtattggactgaatcagagaggttttatcctgagaggttcattgatagcactattgactacaaagggaatagttttgagttcattccttttggtgctggaagaagaatatgcccaggaagcacatctgctttgagaactattgatctagcccttgcaatgttgttgtatcactttgattggaatctgccaaatggaatgagaagtggagaactggacatgagtgaggagtttggagtcacagtaagaagaaaagatgatttaattttggttccttttccatatcatcctttgcctgtcacatga

SEQ ID NO: 1750 - DNA, 1787 bp, Glycine max var. Williams 82
atccatggctctactattcctcttctttgtagctcttatttcctttctcttcacgatccttatagtacaaaaactaggaaagaaatccaagaaaactgatgacacaacttgtgacatgcatatgccccacgggcctagaaagctacctattataggaaatatatacaatcttatatgctctcaaccccatagaaaattaagagacttggccataaaatatggacccgtgatgcatcttcaacttggagaggtttcaactattgtcatttcatcccctgactgtgctaaggaagtgatgacaacccatgatattaactttgccacaagacctcaaatcctagctactgaaataatgtcatacaattccacaagtatagctttttctccttatggaaattactggaggcagctacgaaaaatttgcatattggagcttttaagcctaaaacgtgttaactcataccagccagttagagaagaagagctcttcaatcttgtcaaatggattgcttcagagaaaggatcccccatcaacctcactcaagcagtactttcatctgtttatacaatttcttcgagggctacctttggcaagaaatgcaaagaccaagaaaagtttatatcagtgctaacaaaatcaataaaagtttcagcaggttttaacatgggagatttgtttccatcttctacttggcttcaacatctcactggcttgaggcctaagcttgagaggttgcatcaacaagctgatcagatattggaaaacatcatcaatgatcataaagaggcaaagtcaaaagccaagggtgacgatagtgaagcacaagatctggttgatgtcctcatacaatatgaggatggaagcaagcaggatttttccttaactaaaaacaacatcaaggccataattcaggacatttttgctgctggaggtgagacatcagctacaacaatagattgggcaatggctgaaatgattaaggatccaagagtgatgaagaaagcacaagctgaggtgagagaggtattcggtatgaacggaagggttgatgaaaattgcatcaatgaacttcaatatttgaaactaattgtgaaagagaccttgaggttgcaccctccagctcctcttttgcttccaagagaatgtggtcaaacatgtgagatacatggttatcacataccagccaaaaccaaggtcatagtcaatgcctgggcaattggaagagatccaaagtattggactgaatcagagaggttttatcctgagaggttcattgatagcactattgactacaaagggaatagttttgagttcattccttttggtgctggaagaagaatatgcccaggaagcacatctgctttgagaactattgatctagcccttgcaatgttgttgtatcactttgattggaatctgccaaatggaatgagaagtggagaactggacatgagtgaggagtttggagtcacagtaagaagaaaagatgatttaattttggttccttttccatatcatcctttgcctgtcacatgaactcacaatgagaaactgaaacctttggtgatgcttgtcacatgtatttcagaataaagatgtactgtcaattgaaataagactttgttcggctatcaggttatgtttggctgtgaaagagaatgaaaattgtgtgactaatgcatagtaaaatagctctttatcctcacttgacattattgtaacaagatgttaataaactttgataccgtgtcatttgctaccattttcttaaattattcttcaactc

SEQ ID NO: 1751 - DNA, 1539 bp, Glycine max var. Williams 82
atggctctactattcctctacttttcagcacttatctcctttatcttcttaacccttatagtacaaaaaataggaaggaaacccaagaaaactgatgacacaacttttaaaatacccgatggtcctagaaagctacctattataggaaatatatacaatctgttatcctctcaaccccatagaaaattaagagacatggccttaaaatatggacccttgatgtatcttcaacttggagaggtttctactattgtgatttcatcccctgagtgtgctaaggaagtaatgaaaacccatgacattaactttgccacaaggcctaaagtcctagctattgatataatgtcttacaattcaacaaatatagcttttgctccttatggcaattattggaggcagctaagaaaaatttgcacattggagcttttaagcctaaaacgtgtcaactcataccagccaatcagagaagaagagctgtccaatcttgtcaaatggattgattcacataaaggatcctccatcaacctcactcaagcagtactttcatcaatttatacaattgcttcaagggctgcctttggcaagaaatgcaaagaccaagaaaaatttatatcagtggttaaaaaaacatcaaaacttgctgcaggttttggcattgaagatttgtttccttctgttacttggcttcaacatgtcactggtgtgaggcctaagattgagaggttgcatcaacaagctgatcagataatggaaaacatcattaatgagcataaagaggcaaagtcaaaagccaaaggtaaccaaagtgaagcagaagatcttgtggatgttctcatacaatatgaggatggtagcaagccggatttttccttaactcgaaacaacatcaaggccataattctggacatttttggtgctggaggtgagacatcagcaacaaccatagattgggcaatggctgaaatggtgaagaattcaggagtaatgaagaaagcacaagctgaggtgagagaggtattcaatatgaagggaagggttgatgaaaattgcatcaatgaactcaaatatttgaaacaagttgtcaaagagaccttgaggttacaccctccaattcctcttttgcttccaagagaatgtggtcatacatgtgagatacaagggtacaaaataccagccaaaagcaaggtcgtaatcaatgcttgggcaattggaagagatccaaactattggactgaaccagagaggttttatcctgagagattcattgatagcactattgaatacaaagggaatgattttgagtacattccttttggtgctggaagaagaatatgcccgggcagcacgtttgcttcgagaattattgaactggctcttgcaatgttgttgtatcactttgattggaagcttccaagtggaattatatgtgaagaattggacatgagtgaagagtttggagtcgcagttagaagaaaagatgatctattcttggttccttttccttatcatcctttgcctttcatattaacttcacaatga

SEQ ID NO: 1752 - DNA, 1539 bp, Glycine max var. Williams 82; identical to SEQ ID NO: 1751

SEQ ID NO: 1753 - DNA, 252 bp, Glycine max var. Williams 82
atgtggaggtttcacaatgttgcttggaatcatgtgctgagagatgctcacaaaccatctttgatgttaatgttacgattttataaaaatcgccttggtatgtttacagcttactacggttttcttttaaccatggccattgaaattttggtatttaaatggcgactttatccttgggtcatacctccttcattccttcactccgccgcaaccttcactccaccgcaaccttgcctgtgtaagtctccatag

SEQ ID NO: 1754 - DNA, 1248 bp, Glycine max var. Williams 82
atgcagctcctccggccactgctcgcggcggcgctgctcctcctcgccaccctctccgacgcgcacaacatcaccagcatcctcgcaaagcaccccgagctctccaccttcaaccactacctcaccctcacccacctcgcccccgaaatcaacggcaaaaccaccatcaccgtctgcgccgtcgacaacgccgccatgtcggaccttctctcgaagcacccctccatctacaccgtcaagaacgtcctctccctccacgtcctcctcgactacttcggcgccaagaagctccaccagatcaccaacggcaccgccctcgccgccacaatgtaccaagccaccggcaccgcccccggatccgccggcttcgtcaacatcaccgacctccacggcggaaaagtcgcattcgcccctgaaaacaacgacggcacactctcctcaacgttcgtcaaatcggtggaagaaatcccttacaacatctccgtaattcagatcagtaaggttctcccctctgccgcagcggaagcccctgcacccgcacccacccaacaaaacctcaccaacattatgtcaaaacacggttgcaaagtcttcgccgacactctctctgctcaacccgacgctctcaacaccttcaatgacaacctcgacggtggcttaaccgtcttttgccccctcgacgacgcgtttaaagcctttctccccaaattcaaaaacctaacaaaatctggtaaggccgcgcttcttgaattccacgctgttccggtttaccagtccaaagctactctcaaatccaataacggacttcagaacactctcgccactgatggcgccaacaagtttgacttcaccgttcaaaacgacggtgaagatgttactctgaagacgaagcttacaactgccaagatcaccgacactttgattgatgaacagccgcttgcgatttttgctattaataaggtgcttcagcctaaggagttatttaagggtgaggcggaggctccggcgccggcgccggagccttctgccgccgacgctcctgcgccggcgaagaaggggaagaagaagaagaaggcggctgatgcgccggcggatgattctgatgctcctgctgattctcccgatgacgctgccgatgtgaccgccgatgatagtaacgacgccgttagacgtaacggcgggaggtacggtggtggtgttgttgccttggttttgagtttggtttttgggttaccgttaatgctttga

SEQ ID NO: 1755 - DNA, 450 bp, Glycine max var. Williams 82
atggaaaaacaaatgtttccaacaaagtttcttctagttcttaccaccatatggtttgcactatccaattttgcctttaaagcttcagcagatgatgtcactcaaaccccaataacatgtctgaattgttccaaatgtgaatacccttgtcaacaacaaccctcacccccacttccttatgttgctccaccaccaccacaatcccctacaccttatggttactctatatatggagcaccaccaccaccaaaagagaaagagaaagaccctagcaagtgccctcctgctgcaggtgttcagtgctgcacccctccagatccttatgttttttctcctccaaatccttacactcctgtgccctatggtgaaggccaacgctcggcttcaatgcttcttcaagttgtagttccactcatgatgctttgctcttcctttattttcctcttctga

SEQ ID NO: 1756 - DNA, 984 bp, Glycine max var. Williams 82
atgagagcaatccaaaaatcaaactgttcccaagacaatgggaatgaagaaacatgtggatttggggatggatatttcatgtttatttttggtgcaatgcaagttcttctctcacagatacccaacttccataatatccaatggttgtcaattcttgcagcaattatgtcctttgcttatgctttcataggaatggggctttccatcgggcaagtcaaagaaaatggacatgctgagggtagcattgaaggaatccctacttccagtggaatggaaaaattatggctgattgctcaagcacttggtgacatagcattctcctatcctttctcagtaattcttatagaaatacaggatactttgaagtcgcctccaccagaaaacgtaaccatgaagagggcctcaacaatatcagtcattatcacaacatttttctacctctgctgtgggtgttttggatatgcagcctttggtaatgatacaccaggaaaccttttagcagggtttgcacactataataaacattggcttgtagacttttccaatgcttgtatagtaattcacctagttggtgcatatcaggtgtatagccagccactttttgccaatgttgagaattggcttcgtttcaagttcccggacagtgaatttgcaaatcgcacgtactacttgaaactccctttgctgccggctttcccgctaaattttctcaggctgactttcagaactgcatatgttgcatcaacaactgggattgcaatgatctttccctacttcaatcagattttgggagttttggctggcataatctattatccattatctatatattttccagtggaaatgtacttgagtaagggcaatattgaagaatggacagctaagtggacaatgcttaggacttccagcattgttggttttttggtgggattgttcactctaattggatccattgaagggatagtatctgcaaaattaagctga

SEQ ID NO: 1757 - DNA, 2211 bp, Glycine max var. Williams 82
gacctaccaaaaccttttcgggatcgaaccagccaaatgtattcgttctttcttcaacgaagcaaaacgcttcatgtagctgatggaatcttggttaatagcttcaaagagattgaagcagggccaataagagcattgagagaggaaggaaggtgtgaatgtttaaggtggttggagaaacaggtacctaattctgttctttatgttagctttggaagtggagggacactttcacaagaccaattcaatgaactagctttggggttggagctaagtggtaagaaattcttgtgggttgtgagagcaccaagtgaatcacaaaattctgttcaccttggttgtgaaagtgataaccctttacggttcttacccgaacggttcattgagaggaccaagggcaaggaacacggtttggtggctccttcatgggcacctcaagttcaagttctttctcataatgtaactggtgggtttttaactcactttggatggaactctacccttgagagtattgtgaatggtgtgcctctaatagcgtggcctttgtatgctgagcagggaatgaatgcggttatgttaactaatgacctaaaagtggcactaaggccgaaggataatgaaaagggtttggtggaaagagagcaagttgctaaggttataaggagactaatggaggatcaagaaggaagggaaatcggtgagagaatgcaaaattcgaaaaatgctgctgctgaaacccagcaagaagaaggatcatctacaaaaactttgattcagttgggagtttatttgttggtgatgatactgattccaatggagaagccaacccacatagtgattgttccaagtcctggcttcagccatttactttcactcattgaattttccaaaaggctaatccaccactccaatggcttgcaagtcacatgcatgattcccacacttgactcaccctctgaaccctcccaagccatacttcaaactctcccttcaaccattcactccatttttcttccctcaatccacttcaacaaagagacacagactccaatagcagtccaagttcaactcgcagtgactcactctcttccctttatccgtgaggctttgaaaaccataagtttaagctcaaggctagttgccatgtttgctgatatgttcgcaagtgatgctcttatttgtgctaaggaactcaacttgttgtcatttgtttactttccatcatcggccatgacactctctttctgtttttatctaccgaagttggatcaaacatttccttctgaattcaaagaccttacagaacccatagaaattcctggctgtgttccaatatatgggaaggatttaccaaaaccggttcaggatcgaaccggccaaatgtacgagttctttcttaaacgatgcaaacaactccatgaaaccgatggggtcttggttaacagcttcaaaggcattgaagaagggcctataagagcattggtagaggaaggaaatggttacccaaatgtttatccgattggacccattatgcaaacaggattaggtaatttaagaaatgggtctgaaagtttaaggtggttggagaatcaggtaccaaattctgttctttatgttagctttggaagtggagggacactttcaaaagaccaactcaatgagctagcttttgggttggagctaagtggtgagaaattcttgtgggttgtgagagcaccgagtgagtcagccaattcttcttaccttaattctcaaagtgatgactctttacgattcttaccagaagggttcattgagaggaccaaagaagaacaaggtttggtggttccttcatgggcacctcaagttcaagttcttgctcataaagcaactggtgggtttttaactcactgtggatggaattccacacttgagagtataatgaatggtgtaccactcatagtgtggccactgtttgctgagcaaagaatgaatgcagttacgctaactgatgacctaaaagtggcactaaggccaaaagctaacgaaaatggtttggtgggaagagaggaagttgctaaggttgtaagaaaactaattaagggtgaagaaggcagagaaattggtggaagaatgcagaaattgaagaatgctgctgctgaagcacttgaagaagaaggttcatctacaaagactctaattcagtttgcagataatttgattggcaactag

SEQ ID NO: 1758 - DNA, 1104 bp, Glycine max var. Williams 82
atggcaggagggaggtattgtgagaaggaagtgcttccattcaccgcaatggttgctgttgagtgcaccaacgttggtgtcaacgttctattcaaagcagcaactgagaagggtttaagttactatgccttcatcgcttattcatttgcagtctccacccttttcctccttttgcctctgcccttcgtctttcgatggtcaagggggcttcctccactcaatctgtctctcatcttcagaattttcctccttggagtaattggacttacagcgcagctttgtggatataaaggacttaaatacacttcgcccactcttgcttctgctcttagcaaccttataccggctttcaccttcatactagcaatcattttcagaatggaaaaggtagctttgagaagcccaagcactatggccaaaatcttgggttcgttagtatccatatcaggtgcactcatagttgttctttataaagggcccataatcttatcaacttcttctccacaaccttcaccaacaactgattctccaatggattctacatctcaaacaaactgggttcttggtggatctctacttgccattgagtttcttttggttccaatctggtacattgttcagaccaatattatgaaacaatacccagcagagtttattgtggtcttcttatacaacttgactgggactctcatatctacaccaatttgcttgctattagaagccaatctgagctcttggaagataaattgtgatataacattgatcgccattatatattcgggtttcttttccacgggcctaagtagtttggttcacacatggggcctccatcttaaaggcccagtttatatatcaatctttaagcctttgtcgatagtcgttgccgctgctttgagtgttatattcctcggtgatgcattatattttggaaccgttgttggagcagtgatactctcatttgggttttatgctgtcttatgggggaaagcaaaagaagaagaattgactgtagtggactttgatgatatacgtcctccttcaaatactaagagtcctttgttgcagagctacaaagtgaaagatgaagataaccaaaatatttaa

SEQ ID NO: 1759 - DNA, 642 bp, Glycine max var. Williams 82
atgaagaatactatcttctctgctctctttctactttgtgccttcaccacctcatacctaccttcaaccaccgcggtggtcgataccgacggtgatattcttcagaatcctggcacatactttatcttgtccgtttttcgacccggcggcggagtagaattcgccgccactggaaacgaaacttgccctctcactgtcgtgcagactctcttcgggaggggctttccagcaatattatcgtcccggttacgaatccctttcatcggcgaaggacaactcttcagcatcctgttccgtattgtgccatggtgcgccaccactccttctaagtggaccattgtggagggtttaccagaatcacccgcggttaaactcactgggtacgacaacacagtgcctggtgagtttaaaattgagaaagctaaccctttccataacgactatacccttttgttctgtccagctggcgaagaaagcaaatgtgggcatattgggattcatttcgatgatgatggaaacaggcgtttggtggtgtctgaggagaatatattaagggttcagtttcagaaatttggatcatcagcaccggatgaggcatcactggcccttaaaaaacatcatgtgctctctgtcagtgagtga

SEQ ID NO: 1760 - DNA, 975 bp, Glycine max var. Williams 82
attcaaactgaacaagaaagataaagcattccatagcctcccataaaaatgaagaatactatcttctctgctctctttctactttgtgccttcaccacctcatacctaccttcaaccaccgcggtggtcgataccgacggtgatattcttcagaatcctggcacatactttatcttgtccgtttttcgacccggcggcggagtagaattcgccgccactggaaacgaaacttgccctctcactgtcgtgcagactctcttcgggaggggctttccagcaatattatcgtcccggttacgaatccctttcatcggcgaaggacaactcttcagcatcctgttccgtattgtgccatggtgcgccaccactccttctaagtggaccattgtggagggtttaccagaatcacccgcggttaaactcactgggtacgacaacacagtgcctggtgagtttaaaattgagaaagctaaccctttccataacgactatacccttttgttctgtccagctggcgaagaaagcaaatgtgggcatattgggattcatttcgatgatgatggaaacaggcgtttggtggtgtctgaggagaatatattaagggttcagtttcagaaatttggatcatcagcaccggatgaggcatcactggcccttaaaaaacatcatgtgctctctgtcagtgagtgagtgagagacaagtgtaagactaaatgaatggtttggttgtaataaataaatttttaattgccagactaaatagaacaaacaaaccttattcctttttatgccagattatgtatgggttgcatctcttacatagagttcttagtttctttttcttcttctgttctgtttgttttctttgctgtttgttgctttccttttctagctgatgtatccagagaaagctcattccttccattgcaaataatttaatttctgagcaatgctatataaatatttttatatatt

SEQ ID NO: 1761 - DNA, 423 bp, Glycine max var. Williams 82
atgaattgcacgcgaagctgctgccacgtagagtgtgaaatggcattcggtattctctcctttcgttataaaaaggcaacatatagtgaacactctcgaagcatatttgagactaactcggagagaaagagagagagagagagaaaaatggctgatacaagtggaggagatgcagtgagaccggtggtaatatgtgataacaagtgtggctgcacagttccatgcactggtggttccacttgcagtgtttcacatgcatgcaggtgcacaagtgtcggcatgacaactggaggcggtgatcacgtgacatgctcgtgcggagagtactgtgggtgcaatccatgctcatgtcccaagactgcggcttctggaactggttgcagatgtggcacagattgctcatgtgcctcttgccgcacttaa

SEQ ID NO: 1762 - DNA, 1446 bp, Glycine max var. Williams 82
atggaagacttagaagcaaagatatcagattcaaaaccagatgactcaagtcctctaaaactctacttgctcccttttcttgctccgggacacatgatcccacaaattaaccttgctcaagtttttgcctttcgtggccaccatgttactattcttaccactccttccaatgctaaactcatcccaaaacatctcaatgtccacatcttgaacttcccctccgaggaagtgggtctcccttcaggccttgagaatatctccttggccaaagacaacaacactgcctacaagatatggaaggcctcaaagcttctcaaacccgaaatcgaaaacttcttaaatcataaccctcctcacgctttgatcatagacatcatgtatacatggagatccacacttaacaatagcatccccacgtttgtttacagccccatgcccgtcttcgctctttgcgttgttgaagccatcaatcgccatcctcaaactttggcttctgattcttcacttccttatgttgtccctggtggtctcccccacaatgtcacgcttaattttaacccctcatcaactagctttgataatatggctcgtactttgctacacgccaaggaaaataacaaacatggtgttattgtgaacacatttccagagctcgaagatgggtacactcagtactacgagaaactcacccgtgttaaagtctggcaccttggcatgctctcacttatggtggattatttcgacaaaagaggcaagccacaagaggatcaggtcgacgacgagtgcctcaaatggcttaacaccaaggagtccaactcagtggtgtacatatgctttgggagcttggcccgtctcaacaaggagcaaaattttgagatagcacgtggaatcgaggcctctgggcacaaattcctttgggtgttgcccaagaacacgaaagatgacgacgtgaaagaagaagaattgttgctgccacatggttttgaagaaaggatgagggaaaagaagagaggaatggtagtgagagggtgggtcccgcaaggtctaatattgaagcatgatgccattggagggttcttaacgcattgtggtgctaattcggtggtggaggcgatttgtgaaggggtgcctttgatcaccatgcctaggtttggtgaccattttttgtgtgagaagcaagcgactgaggtgcttgggcttggggtggagttgggtgtgtctgagtggagcatgtctccttatgatgcgaggaaggaggtggtgggttgggaacgaattgagaatgctgtgaggaaggtgatgaaggatgaaggaggcttactcaacaaacgagtcaaggaaatgaaggagaaagcacatgaagttgttcaagagggtggaaactcttacgacaatgttactacccttgttcaatcactcagacggatgatgaatgttcatggttga

SEQ ID NO: 1763 - DNA, 1542 bp, Glycine max var. Williams 82
atgctagacatcaaaggctacctcgtactcttcttcctatggttcatatcaaccattctgatacgttccatcttcaagaaaccacagcgtctaagactcccaccgggtcctccaatttcaatacccttgctgggacacgcgccatatctccgttcactgctccaccaagcattgtacaagctatcactgcgctatggacccttgatccacgtcatgatcggttcgaagcacgtggtggtggcgtcgtcggcggagacggccaagcagatcctcaaaacctcggaggaggcattctgcaaccgtcccttaatgatagcgagcgagagcctaacctacggcgcggcggactacttcttcatcccctacggcacatactggcggttcctgaagaagctctgcatgacggagcttctgagcgggaagaccctggagcatttcgtgagaatccgcgagagcgaggtggaggcgttcctcaagagaatgatggagatttcaggcaatggaaattacgaggtggtgatgaggaaggagctcataacgcacacgaataacatcatcacgaggatgataatggggaagaagagtaatgcggaaaacgatgaggtggccaggttgaggaaggtggtgagggaggtcggggagttgcttggggcgtttaacttgggggatgttattgggttcatgaggcctttggatctgcaagggtttgggaagaagaacatggaaactcaccacaaggtggatgcgatgatggagaaggtgttgagggagcatgaggaggctagggctaaggaagatgctgactctgataggaagaaggatctttttgatattttgttgaacctcattgaagctgatggtgctgacaataagctcactagagagagtgccaaagcctttgctctggacatgttcatcgccggcacaaacggccccgcaagcgtcctagagtggtcactggcggagctggtgagaaacccccacgttttcaagaaggcaagagaagagattgagtcagtggtaggcaaagaaaggctggtcaaagaatcagacattcccaacctaccatacctacaagcagtgctgaaggaaaccctaaggctgcacccgccaaccccaatattcgcaagagaagccatgcgaacatgccaggttgaaggctacgacattccggaaaattccactattttgatcagcacatgggccattggtagggatccaaattactgggatgacgcactcgagtacaagccggagaggttcttgttctccgacgacccgggcaagagcaagattgacgtgagggggcagtactatcagctcctgccctttgggagcgggagaagaagctgccccggagcctcgctagcgttgcttgtcatgcaagcaacgctagcgagtttgatccagtgcttcgactggatcgttaatgatggtaaaaaccatcatgttgacatgtctgaggaagggagggtgactgtgtttttggccaagccactcaagtgcaagcctgttccgcgtttcactccgttcgctgcctga

SEQ ID NO: 1764 - DNA, 1428 bp, Glycine max var. Williams 82
acaccatcacaatccatcaaggaccctgaaactctaaggtccaaagatggtaaattcactttggggttcttcacccctcaaaactccacaaaccgctatgtcggaatttggtggatgtctcagtctacaatcatctgggttgctgacagaaaccaaccactgaatgattcttctggaaaagttacaatatccgaagatggaaatcttgtggtgctgaatggaacgaaacaagtcatttggtcatcaaacatgtccaacataacatccaatatacaagctcagagttttcagatttttcatccttcaaatacgttattgcctggcctggaacttacaacaaatataagagcaggtctgaaagtagaacttacatcatggaaaagcccttctaatccttccatttggagcttctcttccaatattgttcaacgcataaatttaattgaactgctaatttggaatggaactcgaccatactggcgcagtggtccatggaatggtaggctctttacatggataccgaacacggactctgcgtatcttaatggctttcaagaagaaacaaggtgggatgatgagaagaaagacacggaagtttcatggactagtccagaatccgattgtgatgtttatagtatatgtgggtcattttcaatctgcaatgcacagagctcacaaatatgcaactgtttgaaagggtttgagccaaggatcaaaggggaatgggatagacaaaactggagtagtggatgcgttaggagcacaggcttgcagtgtgaaacgactggttgtatgtcttggactggaaatctacttgacatacaacaattctcaagtgcagaacttgttctatatgttcgtgtagcgtatgctgaacttgaacatgcaaggaaaaggaacaacaaagcatccctactgtttaataatgatgaaacatcagaacatccaagccaaaaagtaattgaagaactgtcacaagttacactaccggagctgttacaattagatttcgaaatggttgcaatagccacaaacaacttccacctgcccaacaaacttgggcagggtggttttggtcctgtgtacaaggggaaactgcaagatggacaggaaatagcagttaaaagactatctagagcatctggacaaggtctagaagaattcatgaatgaagtagtggtgatttcaaagcttcaacaccgtaatcttgtcaaactttttggctgttgcattgaaggtgatgaaaagatgttgatatatgaatacatgccaaataaaagcttggatgtgttaatctttgatccatcaaaaagtaaactcctggattggaggaagcgctatagtataatagaaggaatagctcgaggattgttgtatatgcacagagactccagactaagaatcatacacagatttgaagacaagtaa

SEQ ID NO: 1765 - DNA, 2391 bp, Glycine max var. Williams 82
atggctttctctatctcactctttttattagtcctgcttttttctttccaatcttcttcatcttccctattgtcattgaacaaggggtcctccctctcagtggagaaacacgcagaagacgttattgtctccccaaatcaaatgttctgtgctggcttctttcaagttggtgaaaatgccttctcctttgccatatggttcaacgaccctcacactcacaacaacaaccacaccgtggtttggatggcaaaccgtgaaacacccgttaatggaaggctatcaaagctttccctcttaaacagtggtaacatggtcttggttggtgcaggtcaaatcactacatggtcatcaaacacagcatcagatgctccagtaaagttgcatctccaagatgatggcaatcttgtgttacttgatctccaaggaaccattttgtggcaaagttttgataccccaactgatactctccttcccggtcaattacttaccagatacacacaactagtgtcttcaagaagccagactaaccattctcctggtttctataagatgctatttgatgatgacaacgttcttcgtcttatttatgatggtcctgatgtctcaagcacatattggccaccaccatggctactcagttggcaagctggaaggtttaattacaacagcagcagagttgcagtgttaaattctattggaaatttcacttcatcggataattatgatttttccacggatgatcatggcacggtgatgccaagaagattaaaactggattcagatggaaacgctcgtgtgtacagtagaaatgaggctttaaagaaatggtatgtttcatggcaattcatatttgatgcatgcaccagtcatgggatttgtggtgctaacagcacttgcagttatgatcctaaaaggggacggagatgctcgtgtttaccaggatacagagtgaagaaccatagtgattggtcttacgggtgtgaacccatgtttgatcttacttgcagcagaaatgagtctatctttttggagatacagggcgttgagttatatggttatgatcacaattttgtccaaaacagtacatacataaactgtgtgaatttgtgtttgcaagattgtaactgcaaagggtttcagtacagatatgatggtaaccaaatatttagctgctttacaaagtcacagttgttgaatggaaggcgttcaccaagttttaacggagcaatttacttgaggctgccaatcaccaataacttctccaaggaagaatctgtgagtgcagatgatcatgtttgttctgtgaagcttcacaaagactatgttagaaagccagaaaatcgtttggtgagattttttctgtggcttgctactgcagttggggctttagaagtgattttctttttcctgatttggggtttcttgatttggaacctcaaaacgtctagtgcagatcagcaaggctaccatcttgcagcggtgggattcagaaaatatagttatttggagttgaagaaggcaacaaaggggttcagccaagagattggaagaggtgcaggagggattgtgtacaaaggcattttatcagatcaaagacatgttgcaattaagagactctatgatgctaagcaaggagaaggagaattccttgctgaagtgagcatcattggaaggctcaaccacatgaatttgattgaaatgtggggatattgtgctgagggaaagcataggttgttggtgtatgagtacatggagaatggttctttggcacaaaatctctcatccaacacacttgattggagtaagagatatagcattgctcttggaacggcaagggttctggcatatcttcatgaagaatgcttggagtggattttgcactgtgacataaagccccagaacatacttcttgatgctagttatcagcccaaggtagcagattttggcctgtccaagctactaaatagaaacaacctcaacaattcaagtttttcaatgatcagaggaaccagagggtatatggcacctgagtgggttctgaacttagcaatcacctcaaaggttgatgtttacagttatggaattgttctattggagatgataactgggaagagcccaacaacaaccggtgttcaaaacattgatggagaagagccatacaatggaaggctggtaacatgggtgagagagaaaaggagtgccacatcttggttagagcacatcattgatcctgcaattaagacaaattatgatgaatgtaagatgaaccttttggctacagttgctttggactgtgtggaggaagacaaagatgtaaggcccaccatgagccatgtggtagaaatgctacaaagccatgaaagtgatcctcgtaatatcatcaatgcttga

SEQ ID NO: 1766 - DNA, 852 bp, Glycine max var. Williams 82
atgcagattcttcaatggctctttagaagggcacatgaacaagaaagaaagagtagcaacaacttcaataatctccctcccaaaagggaagatatcagtgggaaagaggtaaatctggtaaagcgtgatagatcatacaaaagaacaagaaacaaatggagcaatcctggttgcaagaactttaagatattcacttttctatatagaaaagacattccaaaagctttcttttacagcaccctcaacttgaagagattagggagctttaatagaaaacaatttttgcacttcatgaagatgaagagagaagaaccatcatcccgagatgtaggaagtgttaacaaggctgattcaggtggccaacatgttggaaacaaggttttgcctataactgaggcaccattgtcatcctcagctgaaagaaatgaccaatgtgattccacagaaactaaagatcaaaccaaaggggacaagaaaaagccaatgtcgagaatgaaagagctacttagatgggctgcttctgccaagacagagaaaggagggaaattcaatggaagaaaggttttaatgttcagaaggcgtggaaccctgaaagcagttccagatgatgaccaaggttgcactgactcacccaagatcagtttcagatgggatgtggaaagttgctccaccacttcctctgtctactctgctatctcaatagcttcctcatcaaaaaatggacaaaaccaaattgcaacttccactatatctatccctcctgaacacaccactggtcatcacaacaacactagtagaaaaaaaggaaactggatcacaacagactctgaatttgtggtgctggaactatga

SEQ ID NO: 1767 - DNA, 1356 bp, Glycine max var. Williams 82
atgaagctgctctctccaaaattgttcactctcgccattctgctcgcggcggcgctggttttagcttccgccgacgcagtcagtgacaatgagatgcagaaacatgaagccacggaatcaagggacgtggttgaagagaagttgcgagtgcagagcttgaagaattcgtcaatggcagaaaggtcagggggtgctttaaatgaacatgcagttgataatccagaggagattgcttccatggttgatgagagcatacgcaattacacagctcgaaggaacctgaacttcttctcatgcgggaccgggaacccaatcgacgactgctggcggtgcgacaagcggtggtacgcccgccgcaagcgcctagccaactgcggcatcggcttcggccgcaacgccatcggtggccgcgacgggcggtactacgtggtgtcggaccctaacgacgacgacccagtaaaccccaaacccggtaccctccgccacgccgtgatccaggaccgccccctctggatcgtgttcaagcgcgacatggtcataaccctaaagcaagaactcatcatgaacagcttcaagaccatcgacggccgtggcgtgaacgtccacatcgcttacggtgcgtgcatcaccatacagttcgtcaccaacgtgatcatccacgggttgcatattcacgactgcaaggtaactggtaacgcaatggttcggagctctccctcgcattatgggtggaggactcttgctgatggcgatgggatctccatctttggctcgagtcacatttggattgatcataactcgctgtcgagttgcgctgatgggcttgtggatgctgttatggggtccactgctattactatttccaacaactacttcactcaccacaacgaggttatgctactgggtcacagtgactcttatgtccgtgacaagcaaatgcaagtaaccattgcttacaaccattttggggagggtcttatccaaagaatgcccaggtgcagacatgggtatttccacgtggttaacaatgactatacccactgggtaatgtatgcaattggaggcagtgctaatcccacaattaacagccagggtaacagatacctcgctcctctgaacccttttgctaaagaggtgacaaagagagtggatacagggtcatccgtatggaaaagttggaattggagatctgaaggagaccttttgctcaatggagccttttttacttcatcaggagcaggagctgcagcaagctatgccagagcctcaagtttgggggctaaatcatcttctttggttggtaccatcacatctggagctggtgttcttaaatgccgcaggggtgtcatgtgttaa

SEQ ID NO: 1768 - DNA, 3462 bp, Glycine max var. Williams 82
atgcttgtggttaagtttttgagggaattgccaatgtcaatgccgaggcaagtcttgagcaaccaaaaccacaaccatatgtcgaggcaagctttcatcacaaaccatcaccatcacgaccaccatcaccttctccatattcttctctttacactccttgttcctctttcttttgctgcaaatgatgaagttagtgcattggtttcatggatgcatagctcctccaatacagttccttcagctttttctagctggaaccctttggactcaaatccttgcaattggtcctacatcaaatgctcctcagcaagccttgtcactgagatagccattcaaaatgttgagttagcgcttcatttcccttcaaaaatctcatcctttcctttccttcaaaggctagtgatttctggggctaacctcactggggctatctcacctgacattggaaactgccctgagcttatagtccttgaccttagctcaaatagtcttgtggggggaattccttcaagtattggtaggctaaaatatcttcaaaacttgagcttgaactctaaccatcttactggaccaatcccaagtgagattggtgattgtgtcaatctcaagacccttgatatctttgataacaaccttagtgggggtcttcctgtggaactaggaaagctgacaaatctggaggttataagagcaggagggaacagtggcattgtggggaagattccagatgaacttggagattgcaggaatttgtcagtgttaggtcttgctgacactaaaatttctggttcattgcctgcttcactgggtaagttaagcatgcttcagaccttgtctatttatagtactatgctctctggtgagattcctcctgaaataggaaactgttcagagcttgtgaacttgtttttgtatgagaatggtctctctggcttcctgccaagagagattggtaagcttcagaagcttgaaaagatgcttctgtggcaaaacagttttggtgggggcattcctgaggaaattggcaactgtagaagcttgaagattcttgatgtctccttgaattctctctctggtggaatacctcagagtttggggcagctctcaaatcttgaggagcttatgctgagtaacaataacatatctggttcaattccaaaagctctctccaatctcacaaacctcatacagttgcagttggatacaaatcagctatcaggttcaattccacctgagcttggaagcttgacaaagctaacagtgttttttgcttggcagaacaaacttgaaggtggcattccatcaacattgggaggttgtaaatgcctagaggctttggatttgtcatacaatgcactcactgatagcttacccccaggtctgtttaagcttcaaaatttgacaaagcttctgctaatctctaatgatatttctggccccatccctcctgagattggcaactgcagttccctcattcgcctcaggctcgtagacaacagaatcagtggggagataccgaaagaaatcggcttcctcaatagcctcaatttccttgatctgtctgagaatcaccttactggatcagtaccacttgagattggaaactgtaaagaattgcaaatgctgaatctaagtaataactccctttctggtgctttgcctagttatttgtcttctctcacaaggctagaggtgttggatgtttctatgaataagttttctggtgaggttccaatgagtattggccaactcatttcacttcttagagtcatcctgagcaaaaactctttctctggtccaattccctcctctcttgggcaatgttcaggtcttcaactgctagaccttagcagcaacaacttctcagggagcatcccaccagaactgcttcaaattggagcacttgatatttctctaaatttgagtcataatgcattatctggagtggtcccaccagagatttcttctctgaacaagctgtcagttctagacctttcacacaacaaccttgaaggtgacttgatggcattttcagggctcgaaaatcttgtttctctaaacatttcctacaacaagttcactggttatctgccagacagcaagttattccatcaactatcagcaacagatttggctggaaaccaaggtttgtgtcctgatggtcatgattcatgttttgttagcaatgctgcaatgacaaaaatgctgaatggcactaataattctaagaggtcagagataatcaaactggccattggattgctcagtgctttggttgttgcaatggcaatctttggagttgttacggtctttagagcaaggaaaatgattcaagcagacaatgattctgaggtgggaggggattcatggccttggcagttcaccccattccaaaaggtgagtttttctgtggagcaagtcttgaagtgtttggtggattccaatgtgattggaaaggggtgttcagggattgtttatcgtgccgaaatggaaaatggggatgtcattgctgtgaaaaggctatggccaacaacattggcggcaagatatgatagtaaaagtgacaagttagcagttaatggaggggtacgcgattccttttcggccgaggtaaaaactcttggttctattcgccacaagaacatagtcagattcttggggtgctgttggaacagaaacaccagattgcttatgtatgattacatgccgaatgggagtctaggaggtctgcttcatgaaagaagtggcaactgcttggaatgggatatcaggtttcggataatactaggagcagctcaaggtgtggcttatttgcaccatgactgtgctcctccaattgttcacagggacattaaagccaacaacatcctcataggcactgaatttgaaccatacattgctgatttcgggctcgcaaaacttgttgatgatagagattttgctcgatcttctagcacactagctggttcctatggttacattgctcctgagtatggatacatgatgaagataacagagaaaagtgatgtttatagctatggtattgttgtattagaagtactaaccgggaagcaaccgattgatccaacaatacctgatggactccacattgttgattgggtaagacagaaaagaggtggagttgaagtgctagacgaaagcttgcgagctcggccggaatccgaaattgaggagatgctgcagaccttaggtgtggctttgctgtgtgtgaattcaagcccagatgacagaccaaccatgaaagatgtggtagcaatgatgaaggaaattaggcaggagagagaggaatgtgtgaaagttgacatgcttcttgatgcatcttctgcaaatgatcaacaagaaagaaatcattccattgaagaaccaatgtcaatgataagcaccagcagcacaaatctgcatctgcattactctccccatcgccctcaaacaccaaagtaa

SEQ ID NO: 1769 - DNA, 2727 bp, Glycine max var. Williams 82
atggccaccatggagcgccggaaaacgatgaccatgaactgggatggcctcggcgacgacgatgacgacgaccacttcttcgagacctacaacctcctctccgccgccgtgccgcaggacctcgccgacgacgataacgatttcgaagacagccgcctctccttcgcctccaccatctcctccaccctctccatcaagccccgaacctcacacttctccgcaaacttcaccggaaaaccaaactacgaaatctggatggccgctccgggatccatctccgaacgcagaagaaggttgctcggcagcatgggcctcgacgagaacaaggagctcctccaagccaccagcgccgccatcgcccgtgccatcacgaaaaaattcgaaaacaacaatggcatcatcaacaacgataacaacaacaacaacaacaacaacaacagcagttacgctatcaattccaccgccgttgatgttgggaaacagaaaccgtcgaactcgccggtatacgtcctcgtccggtcgcggtccgagggcgacatcggctccttctcaatggagaaatcgaggaaggaggagataataggaaaggtatcaaagcagcggttgacgagaaccgctacggaggttgctcagcggcggcacgccggcgctgagaacaaccgaatggtggtgaaagacgtgcctgctgctggggattcacctgtgcatcaggtgaaccgccaggtggtgacggcggccatgggaatgggcgacctgggggcgttttttctaataaagaacctggacacgggaaaagagtttatagtaaacgaatacggagaagacggcacgtggaacaggctgagcgatttgcagactggaaaacagttaacgatggaggagttcgagaaaacggtggggcattccgcggttgtgaaagaggttatgaggcgcgccaacgtgtcgcgccacagcgataagaagctttcttcaaactcctacatttcgaggagtttgagattaagcaagaggcgtggagcttctttgttgaggaacataaagggcgttgcgagtggattcgtcggggagcgtgaggcgtcggtggcggcgcctcaagcggcggtggggaagaacgagtgggtgcgcgtgaggcagagcgggaagtcgcagaaggagctatcggcgctgcacctgtgccaggagttccaggctcacgaagggtgcgtgtggacgataaagttcagtttggatggtaggtatttggcaagtgctggggaggacaaggttatacacgtctgggaggtgcaggagtgtgaggttatgtccttgaaacccgacttgaagaagaaaggtaagaaagggggtgcttctgccattcccgaatatgttcatgttcccgaaactgtttttactctatccgagaagccttattgttctttcactggccatttggatgaggtcttggatttgtcttggtccagatctcagttacttctctcgtcttccatggataaaacagtgaggttgtgggatttggaaaccaagtcatgcttaaaattctttgcacataatgactatgtgacctgcgtgcagttcaaccccatggatgaagactatttccttactggctcccttgatgccaaggtcagaatgtggaacatccctgcacgtctcgttgtggattggattgatatccatgaaatggttactgctgtttcttacacccctgatggccagggtgttctagttggtacacaaaaaggaaattgtcgaacttacagcttagaggattacaagttaactcaatctggcacagttgagcttcgaaacaaaaagaaatctcagctgaaaaaggttaccggtttccagtttgccccaaataatccatcagaagtgcttgttacttcagctgattccaggataagaattgtggatggttcccaagttgttcaaaagtttaaaggttttcgaaatgcaagcagccaaatggcagcttcatttactacaagtggaaggtacatcataagtgcaagtgaagactcacaagtgtatgtttggaagaacgaagaggctcgcactccaagctccggaaaagcaaggagtctgattgttaaccaatctcacgagcacttcccatgtaaagatgtttcagttgcaataccttggccttgtaccataaggggtgatccaccatcagtgccaatgcaaaaccccaaaaagaactcaaaacgttcacaagaggacactccagcgaacagcaagagaatgttgccacctcttccaaagaaaagcaacaaccacgccacagaaagtgcaccaggctccccagaacatgaccctgcagcgatttcgcgcacagaatccggaattggagactcatttgggaacagcaagagaatgttgccaccccttcctaagaaaagtaacaaccatgcaacagaaagtggtgactcccctatagatgaagaacttgaagcaatttctaggacagacacgggattaggtgattcatttgcttcaagctatggtgatccagcttctatatctgcttcaggtactccatcaaatgcatcttggtcttccaattactcatcatatgatggttgcaatggtgcctcatcaatacacccttcagcatggggcttggtgattgtgacagcagggtttggaggtgaaattaggtgttatcagaattttggtctgcctcggaggatgagacaggccaatatctttttgggacctacataa

SEQ ID NO: 1770 - DNA, 1680 bp, Glycine max var. Williams 82
atgaagtgcgttgttccctctactgtgttgtttcatttgatcttgttcatcttccccctagtactctctgttcacttactttcagctttatctccaactgggtcctccaaacatcccataaagtttatcctaggggaagacaatttgggtccatggaagaatgaagtcacacaagtagctcaagcagcacgtcctagaactaagggtactcttgtcctagcagcaaacagaaccaatagacctgacattctacagggatttcgacgttaccatggtggttgggacattgcaaatcgacattactgggcctcagttggattcactggtgtggctggtttcacccttgctgtcctgtggtttatctcatttggcttggcacttgtgattcatctatgctgtggatggggaattaacatcaaggataaaggttcaaatcgtttgcaaagaatttggcttgtgttgctgttgttattcacctgtgttgtaacgactggatgcatcgtcctttctttcgggcaggataaattccatggtgaggcagtggataccctccattatgttgtcaatcagtcagactacacagtgcagactctaagaaatgtgacagagtatcttgcgcttaccaaaactatcgtggtggcagagatgtttcttccatctaatatcatggatgatattgacaaattgaatgcagatctagattctgcagcagatacactttccaagcagacaaatgaaaattcatttaaaatacgaaaagtattcaatgctgcgcgtctagctttgattatgatggcagcagtgatgattctactggctgtaatcgggttaatcctgtctatccttggatatcaacacgcaatcctcatatttgttatcactggatggctattggttgcaaccacattcattttttgtggagttttcacaatccttaataatgcaatttgtgacacctgcatggccatgggagaatgggtggagaatccgcatgctgaatctgctcttagccatattcttccatgtgttgatcagagaaccacaaacaagacactttttcagagtaaacaagttgttaccaatattgttagtattgtcaatcggttcatctatgacactgcagatgcaagtccatcacaaggtagtatgaattattacaatcaatctggacctgcaatgccacctttgtgctatccctttgactctcagtttcgagaacaccagtgtacacctcaagaagtgtccttggccaatgcttcactggtttggaagaggtatgaatgcaagacatctgaatatggtgtttgcaccactgttggaagggtgaccccagagatttacttggagttagtacaagtagttaacgaaagttatgcattggaacattatactccacttttacttagccttcagaattgcaattttgtgaggcatgcattcaaagaaattacttcacgttactgtcttccattgaaccattatcttaaggttatcaatgtaggattgggcctaatttcaattggtgtcttgctttgtctcgttctctggatactctatgcaaaccgcccccaaagggaggaagcgtttgttaggctctacatagctaaaaaactgaagaacaaatttagcaagaaccccaacagaaattcatctttgtcaatagcaatgagtgaagtatag

SEQ ID NO: 1771 - DNA, 267 bp, Glycine max var. Williams 82
atggctattacaacgaaccctcttgttgttggacgtgtaataggagatgttctggagccatttgcaagttctatccctttgagagttgtttacaacaataacaaagaagtcatcaacagtggagagctcaaaccctcccaaataatcaaccctccacgagttgaggttggtggtgatgacctcaggaccctctacactctggtcatggtggaccctgatgcacccagcccaagtgacccaaatatgagggaatatctgcactggtaa

SEQ ID NO: 1772 - DNA, 2844 bp, Glycine max var. Williams 82
atgaatgattcctcggtgaagaatttggctatcacggagaagaaggtgcagcagcataagcctggtggttgtgttggcattttctttcagctcattgattggaagaggaaactctccaagaagaagctcttctccaagaagcttcttcctcctgctcgtgcaaaaaagtttaagggagatgaaaaaatgccgaattccaagcttcacttgattgctaatgagaatagtggaggttttcctagtgctaaaaaaggtgggaatcatggtgtagatggagagcaaaagagtgacttgcgagttccgagtctggtagctaggttgatgggtctagaatctattccggctgctcagcgagataagtccaagaaagccgtgttggctgatgtttgtgctgatgggaagaaggagtcttcggctgatcatggtgagttggataggcaaggtgtcgatttggaaatgggagttgtaaaacatgattcaagacctcagaagcttcagaaaaccggggtgtatgagagaagggcagtgactaggtttggagctgaggcactgcaaattaagagtgttttgtcgcgagcaagaaaatataatcatcatcatccaaagcttgcttcttctttgaaaagtccgagagttccttctggaaaaagtgcttctcgaagcgctaggttaataggagcagctacaaaaattttggaacctggactgcaaagcagaagtagagctaaaaattctctcacatatcctgcttccttgtatcctcataagactggcattgtgtcaaatggtgtggaagatgggtcagcgattatgcaaaatcaatcttgttataaaaccagcccatgcaaacaattgatggggcagacctcttgcaaaaactgtggtaatttgctagatgttgttgactgcaagcttgaggttgggggacagcctttggttcctccgcccattgtttcagatgtgatcacagctacatctatggagaagaagggaaagtcattccctcctcatggacatgaaagagatgtagttcttccgataagtcaggaaaagctcatatctcttgttactgaagcaaagggtaaaaataatgcacatcaatcatggagtgaacccactgccagaagaatgccaatgccccatgacggtccagctaaatggaattcatcttgcctatcatcaaggaccctagaggatgatgcatcttcttttgccttaaaacacaaaactcaaacacaagaacagatgttaagcagtgaaagatattcatctggatctacaacaagtgatatgcaagtaaaaagggtattgtcatctatgagtgctgtgaatggaactaaagactttgttgctatgaatagaagtctaagtggccgatcaaggatgaggtcacctaccaaagcggatagttccaaatttgacctagagaaaaaaccttacaatcgacagcagagttccttgtctcatggaaggacattagagagaaaaagaaggatccctaatgtcacacaactggaaggcgcgggttctgtttattcagttgatgcaaaacagagaaatctccattctggtggaatgggtggcaaaataagggacttcaatgcttcctccctgaacaattctattgtaaaaaataaacaagttggtcaaggagaaagatttattaaggttaatgacaataagatcaatgtagtgtcatttaatccccccttgaagcaaaagataggaatccatggcaagagggaagagacaagcagtgataatgagagtatgaggtatttccgaaggccttcgcctctgagagttgatgctttaggtgcctttctagaacaaaaattgaaggaattaacctctcaaagagatgaggagttggctacaggtgctccacctaaaaaatcgagtgccatgattcttcaagagctgatatctgctctaagttccgagaatctgatctgtcatgatgatcatcacatgtttaatgaaaatgttggtttccattatggggcaaaacaagaaaggttattaggaacctcttgcaatggtaatcatctgagtcctggatctgttttggaagcttctttttcttccagtagtcttgatgaaagctcagggcatggttttcaccctgattccatgaattactcatattatggtcaactggaacatgatactgaactttcagattctgcaacatcctttaaaaaaggaagcacaggtgagatgctgagtgatcttatcaaccaaattcccagggcattagaaagtttgctcactttggggacagaattgacaagaagcaagcttggccatatgaaggatattctcttgcatgctgagttagtgcttggaattgcaactgatcgcagagaggatgaagggccacaacttctaatttatcggtttcttggtgatgatcttgacagtatggcgagtgatgctatgtggactgatgctaatggcgttgttgtgggttgtgaggattctaaacagagaaaggagctaaaggggtttctccttgattgtgttatagaatatctagaatcaaattgctgccaatattttaactctggatccaaggcatggacaaagctgcccttatgcatgaaagctgagatgttggctcaagaggtgaagagggagatcaatgagtggttatctatggttgggatggtacctgatgaaattatagaatgggaaatgagccactccttggggaaatggactgactttgatattgaagcatttgaggctggtgttgatatagatggggatatacttcaaattttggttgatgaagttgttcaagatcttgcaggttgcaagcaaggcaccatttccttctaa

SEQ ID NO: 1773 - DNA, 2463 bp, Glycine max var. Williams 82
atgttgttagagagcaccaagatggcctcttcaacttttcttcgttcctattttctgcttcttcttctaattattctcccctttctcccatctgtgtttagtgctacttcttcaaactgtaatgtagacttaaattcctctctggtcaccaatggcacatggaattcaccttctggtcactttgcctttggtttccaaagtgttttattcgacaacaaggagttcatgtccgtgcttgcagtttggtttgccaaagaccccaacagaaccatagtatggtatgcaaaacaaaaacaaagtcctgcttttccttccggttccacagtaaacctaacaaacaaaggaattgtagtcaacgatccaaagggtcatgagatgtggcatcgtccagaaaataacactactattgccttagtatcatgtgcttctatgttagacaatggaagttttgtgcttcttgatgaaagtgggaagcaggtttgggagagttttgaagagcctacagataccattttgcctggtcagaatctggctaagcctaaaaccttcagagcacgtgaatctgacacaagtttttataatgggggttttgaactcagttggcagaacgatagcaacttggttctttactattcaccacaatcaagcgatgatcaagcctctcaatctcctacaggtgaagcttactgggccactggaactttcaaaactgaatcacaactattctttgatgagtccggacgcatgtacataaaaaatgacacgggtacagtgatcagtgaaatcacatacagtggaccagaagagttcttctacatggctagaattgaccctgatggggttttcagattatatcggcatccgaaaggtgagaacacagttgctgatagttgcagttcggggtggtggagtgtggtgcaacagtatccccaagatatttgtctttccttcacaaaacaaactgggaatgtaatctgtggttataacagctactgcattaccatcaatgggaagcctgagtgtgagtgcccggatcattattcttcttttgaacatgacaatctcacaggttgtaggccagattttcccctgccgagctgcaacaaagacgggtgggagcagaataaggatcttgtagatttcaaagagtatacaaatttggactggcctctctctgattatgacaagttggttgcaactgctatggacaaggatatgtgtaaacaaaagtgccttgaggattgcttttgtgctgtagccatatatggtgagggacaatgttggaagaagaagtatcctttcagtaatggaaggaagcaccctaatgttactagaatagctcttgtcaaggtacctaaaagagatttggacaggggtgggagagaacagactacacttgtgcttgtcatatcaatattgcttgggagctcagtgtttctcaatgtgcttctatttgttgccttgtttgttgcttttttcattttctaccacaagaggcttttgaataatccaaaattgtcagctgcaaccataagatcttttacatacaaggagcttgaagaagcaaccacggggttcaaacaaatgttgggtcgtggtgcttttggaacagtctataaaggggtgttaacatcagatacaagcaggtatgttgctgtgaagaggctagataaggtggtgcaagaaggcgagaaggagttcaaaacagaagtgagtgtgattggacaaacccaccacaggaacttggttcgtttacttggttattgtgacgaaggggagcatcgtcttctggtgtatgagcacatgagcaatggctccttggctagctttctctttgggatatcaaggccccattggaaccaaagagtgcaaattgctttggggattgcaagaggtctcacatatttgcatgaagagtgcagcactcagatcattcattgtgacataaagcctcagaatatactcttagacgagttgttcacgccaaggattgctgattttgggttggcaaagttgttgttggctgaacaatcaaaagctgctaagacgggtttgagagggacaattggttactttgcacctgagtggtttaggaaagcttcaatcaccactaaaatagacgtatatagttttggggtggtgttgttagagatcatatgttgcaagtcaagcgttgcctttgcgatggctaatgatgaagaggcacttatagattgggcatatcggtgttatagccaagggaaggtggctaaattggtagaaaatgatgaggaggcaaagaatgatataaagagagtggaaaagcatgtcatggtagcaatttggtgcattcaagaggatccttcgttgagaccctccatgaagaaggttacccaaatgcttgagggcgtgacaacagtttctgtgccacctcgcccttccatattcagttcatcatcgtttgaaatttcatttacttcgtaa

SEQ ID NO: 1774 - DNA, 1413 bp, Glycine max var. Williams 82
atggctctcgccgtttccactacttcttcctcttcagcagctgctgcagcttctagctccttcttctctcgtctcggatcttcctccgacgcaaaagctcctcaaatcggttcgtttcggtttccggagaggtcgcttgtttcgtctgttgttgtcaatgtaactcaacgacgctccttggtgaggccactcaacgccgaaccgcaacggaacgattctattgttcctcttgcagcaactatcgttgctcctgaggttgagaaggaagaggaagattttgagcaaatagcgaaagaccttgaaaatgcatctcctcttgaaattatggatagggccctcgagaaatttgggaacgacatcgctattgcatttagtggtgctgaagatgttgctttgattgagtatgcacatttgacgggtcgaccctacagagtgtttagtcttgacactgggagactgaatccagaaacctacaaattttttgatgcggttgagaagcattatggaattcacattgagtacatgttccctgatgcggttgaggttcaggcattagtaagaactaaagggctcttctcattttacgaggatgggcatcaagagtgctgccgagtaaggaaggtgaggcccttgaggagagcccttaagggtctcaaagcatggatcactggacagagaaaagatcagtctcctggtactaggtctgaaatccctgttgtccaggttgatcctgtttttgagggactggatggtggaattggcagcctggtgaagtggaacccggttgcaaatgttaatggtctagacatatggagcttccttaggaccatggatgttcctgtaaattcattgcattcccaaggatatgtttcgattggctgtgagccgtgcacaaggccagttttaccgggtcaacatgaaagagaaggaaggtggtggtgggaggatgccaaagccaaggagtgtggtcttcacaaaggtaatataaaacatgaagatgctgcccagcttaatggaaatggggcctcccaagcaaatggatctgccactgtcgctgacattttcaactcccaggatgtggtcagcttgagcaggtctgggattgagaatttggcaaaattggagaaccgaaaagaaccctggcttgttgtgctctatgcaccatggtgccgcttctgtcaggctatggaggaatcatatgttgatttggcagaaaagttagctgggtcaggagtgaaggttgcaaaattcagagcggatggagaccagaaggaatatgcaaagactgaactgcagttgggaagcttccccacaatactactcttccccaaacactcttctcaaccaattaagtacccttcggaaaagagagatgttgattcattgacggcattcgtgaatgctttacggtga

SEQ ID NO: 1775 - DNA, 1275 bp, Glycine max var. Williams 82
atggcatccttacaaatttcatctttgctttctaacaccttttgttcaacatcaccatcaagaataaaatcctctatccacatcccagaaaaactccctatacctttttccatagctccaaactcaaaaccaagtagaaagctgtttgaggaattaaacggtttctcgcacacaatccaaatactccaagacaactcatgcagcagcagcaacaacaacaacaacataacctcaaaagctaccattcaactttatgcaattctagaagccgtagacgatagagtggagatgcatcacaacataggcgagcaacgtgacaactggaacacccttctcttaaactcaatcaacatgctcactctcaccgcaaccgccatggcaggtgtcgccgccaccatcgccaccggtgacgcgccacttctggctctaaaactatcctccatgctcttattctccgcctccacggggatgctgatggtgatgaacaaaatccagccctcacaactggccgaggaacaaagaaacgctaggaggttgttcaagcaaattaagtcccacatcgaaacaacactagccattggaaaccctaccgaggaagatgtcaaggacgcaatggagaaggttttagcacttgacaaagcctacccacttcctttgttaggagccatgattgaaaaattccctaaaaaatttgagccagcagtttggtggccttcaaagagaaacaattccaaatatcatgaaacaaatcagcaacaacaacatggtaagaacaatgggtggaatgaagggttagaaatggaaattagagatgttttgaaagtggtgaaggaaaaggacatgaaggactatgagaggttagggaacttagttttgaagatcaacaagagtttggccattgcagggcctttactcactggcgttgcggctgtgggatctgcatgtttgagccaagattcatcatggggagcaatagtgtcggttttgggaggggcattagcgaccgctgttaatgcttttgagcatggtggacaagtggggatggtgtccgaaatgtacagaaactgtggtggattcttccaaatgttagagaattcgatccaagagactatggaggaagatgaagaacaaagggaaaatggagagttgtttgaaatgaagttggcgttgaaattgggaagaagtttgtcacaactcagagatcttgcaagaaaatcggcttattctcgggtagagggaataaccaccgatgaatttgctagcaagctcttctaa

SEQ ID NO: 1776 - DNA, 1626 bp, Glycine max var. Williams 82
atggacaaaggatgggtttcctctcaatctcttcttcctcccacacccgacaatactatgtttcctctcctcggattccccgtcaaactcagccgccccaccatggaactccaccatgataaccgcaaacttgtcgctgaagtcgacttcttctctcatactccgccacccaacatcgtcaagaaggaacttgatcaaacacctcttcacattaatactggtttacaactccttactgctaacaccaggagtgaccaatctaccgtggatgacgggctttcatcggatgcagaagataagcgagccaaaaccaccgagcttgcacagttgcaagtggagcttcaacgcatgaacgctgagaacaagaagctgaaagagatgctcagccatgtcaccggtaactacaccgccttgcagatgcatcttgtgacactaatgcaacagaaccagcagcgaacagaaagcacggaaaatggggttgctcagggaaaggttgaggataaaaaccatggtgttggtggaggaaaggtaccaaggcaattccttgatataggtcccagtggcacagcagaagtagatgatcaagtatctgattcttcttctgatgaaagaacacgatcgagcacgcctcaggacaataacactgaagctggaacaagagatggagcgagaaataacaatggtaataaaagcgagttgggtagggaagagagtccagactcagaatcacaaggttggggtcccaataagcttcagaaagtgaacccttccaatcctatggatcaatccactgcagaagccacaatgagaaaagctcgtgtctcagttcgtgcccgatcagaagctcccatgattagtgatgggtgccaatggagaaaatatggacaaaaaatggctaaggggaatccatgccctcgagcatactacagatgcactatggcagttggttgcccagttcgcaaacaagttcaacgttgtgctgatgatagaacaattttggtgacaacatatgaaggcacacataaccatccactgccacctgctgctatggccatggcatcaaccactgcagctgctgctaccatgttgctgtctggatcaatgtccagtgcagatggagtaatgaaccccaatttgctagccagagcaattcttccttgctctacaagcatggcaacactttcagcttcagcaccattccccactgtgactttggacctcacacacaacccaaacccattgcaatttcaaaggcctggtgccccattccaagtacccttcctccaagcacagcctcagaattttgggtccggagccaccccaattgcacaagcactttataatcaatcaaaattctctggtcttcagttgtctcaggatgtaggatcttctcaattagcaccacaagctcccagaccacccttgcagccaagccaacatccctcactggctgacacggtcagcgccgccgcctctgccatcacttccgatccaaacttcaccgccgtgctcgctgccgccatctcctccatcattgggggagctcacaattcaaacaacaacaacaataacaacagcaacaacaacacgagcaggactactattagcagcttttcaggaaactga

SEQ ID NO: 1777 - DNA, 1134 bp, Glycine max var. Williams 82
atggcagggtcatgtttccacgggcttaggctaaggatgtctaagagtaaagctttagcggagccttcatcttcttccaagacccagttggagagtgacgcggagaacgtggaaaggaagagatttgatagcatggaatcgtggtcattgatattcgactcaatggagacatgggagacttcaaaggaggaccagaaaggggagcaagaggaatgggctgcagacctgtcacagctttttataggtagcaagtttgcttctggagctcacagccgaatttaccgtggagtctacaagcagagagctgttgctgtgaaaatggtgaagattccaactcaggatgaggagaaaaaggccttactggaggagcaatttaactttgaagtggctttgctttcacgtctcattcatcataacatagtgcagtttattgcagcatgtaaaaaaccgcccgtatactgtatcataacagaatacatgtcacaagggactctgaggatgtatctaaacaagaaagagccgtactcactctcaattgaaacaatactaaggttagctctagatatatcaaggggtatggagtaccttcattcacaaggtgtgattcacagagacctcaagtcaagtaatttgcttctcgacgatgacatgagagttaaggtggcggattttggcacatcttgtcttgaaacaagatgccggaaaggcaaaggaaactcgggaacatatcgttggatggcaccggagatggttaaggaaaaaccttatactcggaaggttgatgtgtacagttttggtattgtgctttgggagctcacaacttctctgcttcccttccaaggaatgacaccagtgcaagctgcttttgctgtggctgagaagaatgaaaggcctcctctgccagctagttgtcaaccagcactagcacatctgataaagcgttgctggtcagcaaacccctcaaaaaggccagatttcagtgatattgtgtctactttggagaagtacgatgagtgtgtgaaagagggcctgccactgagtcataatcattcagggctagtcagcagaaatgtaattattgaacgcctaaaaggttgtgtatcaatgagctcctccatacctgtacatgcttga

SEQ ID NO: 1778 - DNA, 1011 bp, Glycine max var. Williams 82
atgttcattaagaaattaattaaatttttgaaagtggtgtggtgcatattgcataataatactcttatagatatggcaaggattccagtgaggtttcagagagtggcagcggcgtttgacgctgacgtggcacgcgtgaggctctgcgagagcagcgggagcgagcactcgccggagagtttgaccgatttgtcggatctcgtgaagtcctttatggagaagaacgagacaacaaccaccggggaaaaagaagaagaagaagaagaaggtggtggtgttcatgaagaagagttagaaaaaactgagtggtctgattcggagaagagggaaatgctgcagagtttcttgtatgggaaagaagatgagactgatgaggatgaaagggacgccaaagaaaaaattaggagagaggttgaagttgcatttggacttgttgggaacaattacaaacgcaggttgatctctctgttaagggagaaaggttttgatgctggtctttgcaaatccaagtgggagaaaaatggaagattaacagctggtgattatgagtacattgatgtcaattttaagggaaaacgctacatagttgaaatttcccttgctggcgagttcgaaatagctcgtcccacagatcaatattcttccttgctagatgtgttcccattgatatttgtgggtaaagtggaagagatgaagcaggttgtgaggctgatgtgcactgctatcaagggctccatgaaaagaatgaaactgcacataccaccatggaggagaaatgtgtacatgcaagccaagtggttcggtgcttacaaacgaacaaccaatgcagttgcaactaaaagggtatcattgcctttgtcttctgatgagtctttgtttcctaaaaggtccattggatttgaagtgagacctgtgaaagcacacaagtgcagggatgtttatgccactaatactggcttcagaactggtcatttgactgctgtgtttaattctgatagccttggtgcataa

SEQ ID NO: 1779 - DNA, 1782 bp, Glycine max var. Williams 82
atgatgtcgggaacaccaaaccttggaacaatcgaatgcaatggcgagtcctgctgtgagaattccctgcccatgtatctttcggaatataccccagagatcaaaggtttaaatgagaataaaaaaggtaaccactgcagttatgccatgattgtacaaaatcagccaaatccagatccatatcaatatcaatgtcgaaatggatatcgatatccatatccatatcaatatcaatatgggtactccaatttacttggtgttggcaaactgaaggatatagatttcgtgcctgcggtacttgagtgggagattgtgaatgctaccctcaaactccctacatctccatatgttgactgtaaaggcactaatattacatcttcacgatataattactctggtcggagatgttcctgcagatatgaagcatactactatattactccttctcctcgtaatccctacattgctgacggttgtccagctgatgatgatgcatattctccttcgaaatccaccaaaggattaccaagtctagcaaaacaggccataataggagtttctgcaagccttggatccatcattttactccttgttttatggcgaatgggtaaagttgtatggcgaattggtaaagctgtaataaaaaccatactgcataaacgcagagaaatgttctacaaaaaaaatgggggattattgttagagcaaatgttgtcttctggtgaagttaatgatgataaagttaaactcttcagcttaaaggacttagagaaggccaccgacaactttaataagaatagggtacttggaaaaggaggtcaaggtactgtttacaaaggcatgttaccagatggaaaaattactgcagtgaaaaaattcaaagttgaaggaaatgttgaagaattcatcaatgaatttatcattctttcacaaattaaccacagaaacgtcgtcaagttgttaggaagttgcttggagactgaaattcccttgcttgtttatgaattcattcctaatggtaacctttttgagtatttgcatggacaaaatgaggattttccaatgacatgggatattcgtttgagaattgccactgaagttgcaggagctttattttacttacacttggctgcttctcgacctatttatcacagagacatcaagtcaacaaatatactattggatgaaaagtatagggcaaaagtagcagactttggtacatcaagaatggttactattgatgctactcacctcaccacagtagttcaaggaacatttggatacttggaccctgaatattttcatactagtcaatttacagaaaaaagtgatgtctacagctttggagtagttctcgttgaactcttaacagggaaaaagccaatatccctcctaaatccagaggaagccaagagtttagcttcatctttcattctttgtttggaggaaaatcgtctgtttgatattgttgatgaaagagttgtgaaggagggggagaaagaacatatcatggcagttgccaatcttgcaagtagatgtttagagttgaatgggaaaaaacgaccaactatgaaggaagtcacattggaattagaaggaattcgaaaattggaagggaagtctaatacacaagaaagacatgacgataatgaacttgagcatgttccaattggagactatcaatcttggactgagtattctactgcctcaaatataagctcaactcttgatctaaataacagaacaccaaccttggaggatattcatattcataccatttaa

SEQ ID NO: 1780 - DNA, 1322 bp, Glycine max var. Williams 82
aatttaattttgaaagcacttaactttgtgtgttgtttaattagtatcaaagaagatgaatctgttcaattttgcattgtccgtgtcactctcatgtttttttaaatgcttctcaaaagtgccatttcgaaatctcaatgggagttcaattcagaccatgtttagtgtcacaaagttgcttcctttctttcttgccttggttgttgcatgtatggagtgttttgacatctggaaaacgtcatggtgcactgtttagatggattaaagcagttgtatattgctgtaataaatttttgtgatgctgatttgtgcccagagcctagaggtttgcaacatccagaagtgctagcaagagaaacagtgtttagtgtaagtgagattgaagcactgtatgaactattcaagaagatcagcagtggagtaatggacaaaggattaattactaaggatgaatttcagttggccttattcaagacaaccaagaaagagagcttatttacagatagggtgtttgacttgtttgacacaaagcatagtggaatacttgatttcaaagagtttgcacttgctctctctgtctttcatcccagcgcatcaattgatgataagattgagttttcattccaattgtatgatctcaaacaacaaggatttattcagagacaggagttaaaacaaatggtggttgccactctagctgaatctggcatgaatcttgcagatgatgtgattgaaagcatcattgacaagactttcgaggaagttgatacaaaacatgatgggaagattgacaaggaagaatggcgaaaccttgtcttgcagcatccatcccttctaaaaaatatgactcttcagtatctcaaagatattacaactacatttcccagttttgtatttcactcacaagttgatgatgtttgaggcagctacatcatctatgtcagtttctctggtgttggctgagaaggttcttgtttcccttgagagtggtgaaattctgtgagaaggatatggttaaaatggaaatgggctatttatattttcattgaacagaacttttccttccctttttgggtagatgaggtttgtgtttcgaataaatggatttaattatttatttgcttcattattattaggaatgaaagtagcataggatagaatatacaggtgtttcagaaatagcactagaaacttttggatagaaatatattttgccattatggcttctaaacggctccagtgagcttaggtgcagagttaagaatttgtatggcaggtttcagcttttgtgccttaaaaaggctaaaaccaatatcgtcctt

SEQ ID NO: 1781 - DNA, 2205 bp, Glycine max var. Williams 82
atggagaaaaattctcttgattatagtcctttgctttctcctcgtggtgatgaaaatggaagtgagacaacagcatctcctcttgtgtcagctactaaatggactctcaagactttgatcttgatgatctttgttctatgggcagctttcatcttttttctccctgcaaagcctgtgaatgagttgttctcaaaatggaatgatctcaaccgtgacactccttttggagtcacaggaagcatttttctggtcttcactgctccaattctcataattgcatttcttgccattgcacaccaaattcttactggggaggatcagcttcatgagaagaagacttccaaacttccaaggttccgcctatggacgtttcctgtgtttgtgaagggaccatttggggttgtttctgccacagagcttattgggattgtcctcgttttgttgtatgttatctgggctctctatgcttacactgtgagggcgcttgattttatctctgaatttgatgtgccatcctttagagacaagagcataatcatgtttaaagtgatgggacttcgcacgggtgcaattgggttgatgtgtttggctttcctgtttatcccagtttcaaggggatccgttcttctccgctatatagatatcccttttgaacatgccacaagatatcatgtatggctgggacatctcacaatggtgctttttactgtccatggactcctctatgttattgcatgggcaatggaaggccaccttgtacaagaattaatacaatggaaagatattggtgttgccaatctcccaggagttatcagccttctagctggtttgttaatgtgggtgacctctcttcccggagtgcggacatggaactttgagttgtttttctacacccaccaattatatgtagtctttgttgtctttttggccttgcatgttggtgactttgttttcactatggctgctgggggaatatttttctttgtgctcgatcgatttctgaggttctgccaatcacgaaggacagttaatgtaatctcatccagatgccttccatgtggcactgtggaattggttctgtcaaaacctcaaagtttgagatacaatgcactaagtttcattttcgttcaagtccgggaactatcatggctgcagtggcatccattcagtgtttcttctagtcctttggatggaaagaatcaccttgctgttctcataaaggttcttggcaaatggacagaaaagttgagacaaaggattactgatgtcgatgcacaaaaagattcatgtgtcataacaacttcagttgaggggccatatgggcatgaagtaccataccacttaatgtatgaaaatcttatattagtggctggtggtattggactctcacccttccttgctatattgagtgacattctccaccgtgttagggaggggaaaccctgtcaaccgagaaatattttacttgtttgggcggtaaaaaaatcaaacgagcttccacttctctcaaccattgacatggaatcaatttgtccatcattttcaaataaagtaaacattgatattcatatttatgtcacccgagaatcagatcctccattggaagagggatatagttacaaaccaataaaatcttcattctgtcctatggctagtgattgtggcatgtctgttttggttggtacaggagacaatttttggtctggactatatgtcatctcatctaccgttggctttgtgatattgctggctttgttgtatgtttactacgtaaccccatttcacatagaaacatggtggtacaggggactactatatgtaatctgcatggttgcaagtgttgttatctttggtggttctgtggttgcaatgtggcatatttgggaaaagcaaaattctttgaaggacaagtccaatgatacaaaggttgataagattcatcaaaatggctctttggctaccaaggatcaaagtcaagacagtagtattgcgaagtcaacggtcattcattatggttccaggccaaactttaaagaaatttatgactcgatatcagagaaatggggccttgttgatgtgggtgtcatagtttgtggcccttcaacacttcagacaagtgttgctgaagaaatcaggtcacacagtatgacaagacaacgccatcattccatcttccatttccacagtcacagctttgatctctag

SEQ ID NO: 1782 - DNA, 3189 bp, Glycine max var. Williams 82
atgaagccttttagccttttagtgttatctttatatttcttctctgtggtagggcagcttccctctcaggacattttaacattgctggagtttaagaaaggcatcaagcatgaccctactggttatgttctcaattcctggaatgaggaatccattgactttgatggatgcccatcttcatggaatggagttctgtgcaatggtggtaatgttgctggggttgttcttgacaacttgggtctctctgctgacactgacttgagtgtgtttactaatctcacaaagcttgtgaaactctccttgtccaacaattccatatcaggaacactacttgacagcattgctgatttcaaaagccttgaattcttggatatctcttataacctcttttcctcatccttgccattggggattggtaaattagggagcttgcagaatctgtcgttggctggaaataacttctctggcccaattcctgactctatttcagaaatggcctccatcaagtcccttgacttgagctgcaatgccttctctggaatgctgccagcatcgttgactaagactattagtcttgtatctcttaacttgtctcataacggcttcaatggaaaaattcccaaaggtttggagctgatccctgctcttgaaaaacttgacttgcatgggaatatgcttgaaggtaatttggatgttgtatttatgctttcatcaagtgccagctatgttgatttaagtgagaatatgctgtcaagttctgattccaatcagaagtttctaccgcgaatatctgaaagtattaagcatctgaatctaagccacaacaagcttactgggtcattggctagtggagccgcggaacctgtttttgaaaacttgaaggtgttggacctcagctacaatcagttggacggagaattgcccggatttgattttgtttatgatcttgaagttcttaaactcagcaacaacagattttcaggatttattcctaatggcctgctgaaaggagactctttggttttaactgaattggatttgagtgccaacaatctctcagggccactaagtataattacatcaacaacacttcattctcttaatctctcatcaaatgagttcacgggtgatatgccactgttgactggaagctgtgctgtacttgatctgtcaaataacaaattagaaggaaacttgaccaggatgttgaaatgggggaatatagaatttcttgatctcagtcggaatcatttgacgggggccatccctgaggaaactcctcaatttctgcgattgaattatttgaacctatcccataattctctaagcagctcccttccaaaagtcttaacacagtatccaaagcttagagtgctcgacattagtttcaaccaattggatggactacttccagctaatctgctcacactgcccacattgcaagagctgcgtcttgaaaataatatgatctctggtggcatcaagttttcgtcttctcctgaccaatccgatcttcagattcttgatctttctcacaaccagcttaatggctattttcctgatgagtttgggtcattaactggcctaaaagtgctaaatattgccggaaataatttttctggttctcttccaactaccattgcagacatgagttcacttgactccctggatatatcagagaatcattttactggtcctctaccaagtaacatgccaaaggggctccaaaactttaatgcttcacaaaatgatctgtctggagttgtcccagaagttcttagaaagtttcccagttcttctttctttcctgggaataccaagttacattttccaaatggtcctcctggatcaatcagttcacctgctgaaagttccaagaggaagcatatgaacaccatagttaaagtcataatcatagtgtcatgcgtggttgcgctcttcatattaatcttgcttgctgtcttcatacactacatacgtatatcaagatctccaccagaatatgaaacaagtaaggatatccacaggcatcctcaaccaattatctcggctcctgttcgtacgacagatgggggtggcgctttggttgtttcagctgaggacctcgtgacctcacgcaaagagtcaccatcggagataatcagctctgatgaaaaaatggcagctgtaacagggttctctccatcaaaacaaagccacttttcatggtcaccagaatctggtgattcacttagtggtgaaaatcttgcaagactagatacgagatcgccagatcggttggttggcgagctacattttcttgatgatacgataacattgacgcctgaggagctctcaagggcccctgctgaagttttaggaagaagtagtcacggtacttcttacaaggcaactctggagaatggtttgttgttgagagtgaagtggttgagagaaggagtggcaaaacagagaaaagaatttgtaaaggagacgaagaaatttgcaaacatcagacatccaaatgttgtaggattgagaggatattattggggtcctacacagcacgagaagcttatactttcagattacatctcactaggaagtcttgcaagttttctttatgatcgaccaggaagaaaaggtccaccactaacttggacccagaggctcaaaatagcagttgatgtagcacgtggcctgaactatctccattttgatcgcgctgttcctcacgggaatctcaaagctacaaatgtgttgttagatacaactgatatgaatgcacgtgttgccgattactgccttcaccgactcatgactcaagctggtaccattgaacagattctcgatgctggggtcttgggttattgcgcaccagagttagctgcttccaagaagccaatgccctccttcaagtcagatgtttatgcttttggagtgatacttttggaacttctaactggaaggtgtgctggtgatgttatatctagtgaggagggaggtgttgatctgacagactgggtaaggttgcgtgtagcagaaggccgaggctcagaatgttttgaggctaccttgatgccggaaatgagcaatccagttgtagaaaagggaatgaaggaggtcctgggaatagcaatgcggtgcattcggtccatttctgaaaggcctggtatcaagactatttatgaagatctctcttctatatag

SEQ ID NO: 1783 - DNA, 654 bp, Glycine max var. Williams 82
atggctaatctctcgttgttggtggcagttttagctctttcactttcatcagttgctttagcagctgataatagtgctctccaagatttctgtgtggcagacccaaaagggcaagtgttagtgaacggtttggcatgcaaggatccaaaacttgttgaagcaaacgacttcttcttcagcggtcttcacacagcaggcaacaccacaaaccctaatggctcaaaagtgacaccagtcttcgcaactcagcttccagggttgaacactctcggcatctccatggctcgcattgactacgctccatggggaattaaccctcctcacatgcaccctcgcgccaccgagattttaaccgttctcgatggcgccttagaggttggattcgtcacttccaaccccgaaaaccgccacttcagggtggttctacagaagggtgatgcgtttgtgttccccatagggctcgtccattaccagagaaatgttgggtatggcaatgctgtggccattgcagcacttagcagccagaatccaggactcataaccgttgctaatgcggtgtttggggctacgccggatatagatagtgatgttcttgttaaggctttccatttggacaaggctatcgtcaattatctacagtccaacaagttctag

SEQ ID NO: 1784 - DNA, 711 bp, Glycine max var. Williams 82
atggttgtgcagaactttgtagttgatttgaataaggcccttgttttccaggttgggcatcttggaggagcttatgaagagtgggttcaccagcccattgtcagcaacgaaggcccccgtttctttgaaaatgagattctggagttcttgacgcgcacagtctggtgggcaataccagtcatttggttgccagttgtatgttggtttatacataactccgtacaaatgggcctcagttgtcctcatttagctctattggtggttcttggcatttttgtttggacactgcttgaatactcattgcaccgatttcttttccacattaaaacaaagacttactggggaaataccttgcattatcttctccatggctgccaccataagcaccccatggatggcttaagacttgttttccctcctgctgcaacagctatattattgatgccgttctggaacttggtgaagctcatggcgaccccttcaactgctcctgctttgtttggcggtggtttattgggttatgtaatgtatgattgcacccattattacttgcaccatggtcagccaaagactgaagtgccccgaaatctcaagaagtaccacttgaatcatcactttcggatccaggataaaggctttgggatcacttcatcactatgggataaagtttttggaacacttcctcctaaaatggatgccaaaagtatgtaa

SEQ ID NO: 1785 - DNA, 1698 bp, Glycine max var. Williams 82
atgggactcttttcttctacaaaactgcttccaattgttgtgctgttttctcttcttttcacatcttatgccacaaattcagctgaaaacaactttgttcactgccttgtgaaccattctgagccctctcaccccatatccgcagcaattttcacacaaaacagttcctcattctcttcagtgctgcaagcctacatcagaaaccttcgtttcaacacctccacaacccgaaaaccattcctcatagtgaccccatttcatgtttcccatgtgcaagcatccattgtttgtgccaaaaagcacaacttgctgatgaaaatccgaagtgggggacatgactacgaaggggtgtcttatgtggcctcacagccattcttcatccttgacatgttcaatctccgatccatcgagatcgacatggaatccgagaccgcgtgggtcgaagccggcgcaatgcttggtgaagtttattatagaattgctgagaagagtaagactcatggttttccagcaggggtttgtcccactgttggtgtgggaggtcacattagtggtggtggatatggcaatctcatgagaaaatatggcacttcagtggacaatgttgttgatgcacaaatagtggatgctcggggaaggttgctgaatagaagaaccatgggtgaagatctcttttgggctgttagaggtggtggtggaggtagctttggtgttgttcttgcctacaaaataaggctagttcgagttcccgaaaaagtcactgttttccaagttggtgtaaccttggagcaaaatgccactgacatagtttacaattggcagcatgttgcacccaccattgacaatgaccttttcattaggctcatcttggaggtggtgaatggtacacaaactgcaacaaagactgtgagggctaccttcatagcactcttccttggtgattccaaaagccttgtttctctcatgaatgacaagtttcctcaattgggtttgaagcaatccgattgcatcgaaacaacatggcttaaatctgtgctgttttgggacaacatagacattgcaaccccagttgagattttgcttgaaagacaacctcagtcttttaagtacttgaaaagaaaatctgactatgtgaagaagccaatttccaaggagggttgggaggggatttggaacaagatgattgaattggagaaggcaataatgtatttcaatccttatggtggaagaatggctgagattccatcaacagaaaccgctttccctcaccgtgccgggaacctatggaagattcagtaccaagcaaattggtttgaggcaggggaagaggtagcagaataccacataaacttggtaagagaacttcacaaatacatgacaccctttgtgtctcagaatccaagacaagcttttatatgttacaaggacttagaattgggcatcaaccaccacggtttctatggctactttgaagggagtgcatatggagtccaatatttcgatgataacttcaaaaggttggttcaaataaagaccaaggttgatcctagcaatttcttcaggactgaacaaagcatcccgctacatagccatgtggaatttgttagaatggttactgaaaaatcgttggtttctgttttgtttggttttttcgcattaaattggattcggagaacttcaagtaacatgaactattag

SEQ ID NO: 1786 - DNA, 1314 bp, Glycine max var. Williams 82
atggtggcatcagacggtggcggtggagggagattgatgaagaaagttctgggcttggggttttgggtacaaggattcaggtgttttccatggttggtagtgagtttctacctcaaagatggtctgaatgtggacccttccactcttcaaattcttcagagttccgctaatcttcccatggttggaaaaccactctatggccttctttcagactctgtctacatctctggccagcaccgagttccctacatcgcccttggagcttttttgcaggcactgtcgtggctagtcatagcaatctctccaacaaacatgtctattttcgcaatctccatatacctccttcttagtaatctaggtgcttcaatagccgaggttgcaaatgatgccattgttgcagagatggctaaacagactccttcctcaaccaagcacccccaaccatcctcctcaggcaatctccaatcatttgtttggatagcttcctctgcaggaggagtccttggaaaccttcttggcggaatttttattggccggttctccccacagtccatgtttttatattttggccttctccttgctctccaattttttataaccatctcggttcgtgagagttctctcaggctcccaaagagtccatctggtggaataaggaaacagctttcacagctattggttgctctaagaaagcctgaaattgcatattcaatatcatggtttacagcatcttatgccattattcctgcacttacaggcaccatgttcttttaccagacacagtatttgaaaatagactcgtcagtattgggtatctccaaggtgtttggccaggcaacaatgctcctatggggcatcatatataatcaatacttcaaatctgtctcatcaaggaaactgatatcggccattcaagttatgatggcattcttaatggtttcagatttcttgttcgtgcgaggtttttatcgacaaatgggcatgccggactcgctctatgttgtgattttctcaggattcttggaggttctatttttctttaagattctgccattcagtgtcctaatagcacagatgtgtcccccaggatgtgagggttctgtaatggcatttcttatgtcgtgtgttgcccttgcattcattgtgagtggataccttggtgttgcacttgcatcgtgtattaaggtaacaggaaatgacttttcaggacttccatttggacttctgatacaagctgcatgcactttggtgccaactttttggtcatcatgcataccagacaaggtagaatcaaaagccaaaaggaaagactaa

SEQ ID NO: 1787 - DNA, 1545 bp, Glycine max var. Williams 82
atgtactgcagcagcataatcatggacaattaccaaggtgatttaactgacatactccgagcaagtggtggagcatatggtagcacaggcacaggcacaggaacttcatcatctgatcaattacataccacatctcatcatcatcatcattcttcttctcacaccaccctctctcataatgatcactggcaccaccaccaacacttctcttcttcttcttctgatcctcccatcactttctcatcttcttcttctgtgctaattcaagacacaaactttggtgatcctttctcaaccatgagagatcccttccttcaggagcttgacatgccttcagcttctgcctacttcactggtggtgccttggaattagaagcagctgcaacttttggttctgttactaataatactactagttctactactgctactactgtttttgctactgcacacaagattcttgaggaacatgacaacaacaacatgagaaggccttgcaaaaacatattctcaaacatgattcagatctctcccaatgcaaagttaccaatctcaccatatgattccaccaacacagccatggcaccttctccaaggccaattaagcctcctgctttggtttcacccaacatggtgatgaatgcaaacacctccaaggaatgccttgtagacaccacaggagtgcagatctcatctccacggaatccgggtcttaaaagaaggaagaaccaggccaaaaaggttgtttgtattcctgcaccagcagctgcaaacagcagacaaactggagaggtagttccgtctgatttgtgggcttggagaaaatatggtcagaaacccattaaaggttcaccttatcccaggggttattacagatgcagtagctcaaagggttgttctgcgaggaagcaagttgagaggagcaggaatgacccaaacatgctggttatcacatacacatcagagcacaaccatccatggccaaaacaaagaaatgctctggctggttcaacaagatcacagccatccaagaacaacaacaatgctgctgcttccaattcaaagaattcagaaggctcaaactcccaaaagggtacagcaacaaaagcaaaggatgatgaagagagcaacaattataacaatagcagtgagggcaatgtgtccccagttgtggctgggaactcatcaaacagtgtgaaggaagagaatatggaagacatagagaaacatcagattgagatggatgagggagaattcagtgatggaatcccttataagcctagtttgatggatcatcagagtactaataaccaacaatctgaggacttctttgctgagttgggagaaatagaagctgaccctttggaccttttgttcacacaaggttttggtggtgctgatgatcaaagggaatccaaggccttggatccatttcatctctttgactggtcaggaaacaacaacaacaacaacaacacaagtagttcatttgaagaacctaacaataagagaagaacagtcagggagataaaattagtagagtga

SEQ ID NO: 1788 - DNA, 2127 bp, Glycine max var. Williams 82
atggaagagacatttgttccgtttcgtggaattaaaaatgatcttcaagggagattgatgtgttacaagcaagactggattggtggtctcacggcagggttcaggatattagcccctactacatatatattctttgcatcagcaattcctgttatttcatttggagaacagttggaaagagacacggatggagtacttactgcagtgcaaacattagcatctactgcgttgtgtggaattatacactctattattggaggccagcctttgctgattcttggagtagcagaaccaaccgtaattatgtatacatttatgtttaactttgcgaaaagtagaccagaattgggttcgaaactctttctagcatggactggatgggtatgcatgtggactgccatcttgttgttcctactggctatcttaggagcttgttccatcatcaacaggttcactcgcctagcgggggaactgtttggccttcttattgcaatgcttttcatgcaagaggctgttagaggactcatccatgagtttcacatacctgagagggcaaacctaacatcacccgagtttcaatcttcatggagatttggaaatggcatgttttctttggttctgtcctttggcctcctacatacagcattgagaagccgaaaagcaaggtcttggcgatatggatcaggatgtttacgaggcttcatagcagattatggtgtaccattgatggttctattgtggactgccgtttcttatattccagctggaagtattccaaaaggaatccctaggcgtctcttcagtccaaatccatggtcctctggtgcctttgaaaactggaccgtcataaaggacatgctgaatgtgccagttctctatattattggagcctttattccagcaacaatgattgctgtgctttattattttgaccatagtgtggcatctcagcttgctcagcagaaagagttcaacttaagaaagcccccttccttccattatgatttgcttctattgggattcatggttataatatgcggtctaattggaattcccccgtcaaatggtgtcattccacaatctccaatgcataccaaaagtttagctacattgaagcaccagttacttagaaaccggcttgttgcaacagcacgaagttctatgaaaaagctagaaagcttgggacaagtatatggaggtatgcaagatgcttactggaagatgcagacccctttagttcaccaggaaccttcctcgcagggacttaaagagttgaaagagtcaactattcaattggcatcaagcatggggagtataaatgctccagttgatgagtcagtatttgacattgagaaggaaattgatgacttattgcctgttgaggtcaaagaacagcgtgtgagcaacctgctgcaatctttgatggtaggaggatgtgttgcagcaatgcctttcctgaaaaagattccaacttctgtactctggggatattttgctttcatggccattgaaaacttacctggcaaccagttttgggaacggattttattaattttcactgctccaagcagaagatacaaagtcttggaggagtgccatgcaacttatgtggaaactgtaccattcaagacaattgcagtattcacagccttccagactgcttacttgcttgtttgttttggtatcacttgggttccaacagctggggttctattcccattgatgatcatgcttctggttcctgtgaggcaatacattctgcccaagttttttaaaggagcacaccttcaagatttagatgctgcagaatatgaagaagtacctgctttaccattcaacttagtgactgaaggggacttgagcaggacagcttcctttgcagatgatggagaggttttagatggaataattactcgaagccggggtgaggttagacgtgtttgcagtccaaaggtgatgaaatccactccaaacctatcccaagagttaacaagtccaaggctcacagataaagtatacagccctcggataagccatctcagaggaaatcaaagccctcgaggtgttgggagaggatcatttagccctgcagaagttaggccatccaatttgaggaaaggtggttga

SEQ ID NO: 1789 - DNA, 823 bp, Glycine max var. Williams 82
gtagtatcgtaaaaacgcgagtcgtttcgcaaacgcagaagagtgtttgctcgtagacacaccgcggaggactcagagctagttgatcctcataatcagtctctcagactctatcgtgtcattttgaacatgccgtctcttcaaactgcactgcctcctgagctcgccaacaatgccactaggctttaccgtgaatgcctgcgaagagctaaatatattggtcatcggaaacataacacggagcttcttgttgatttggtgagacaacagtttaagaaaaacatgcatgaaacagatcccgagaagattcagaagttaaaggatgatgctgcgagggggcttatcaatcacatattgtatgagtcagagcaaatgacaggttctaaattcagcaagagcaaataacctaatttgctttatcccaaatgatccagtttatccatcagttcaaggtttggcagatcaagcataaaaagaggaaatccttttacagtcaaaccaagccaaagatgttggagttgaagagttagtgacagatggtcaatgagtctactagttgttttctcagttgtctcggttcagcatcttgtcattattttttagcaattcttcaaaagtaacaggagattccttttctaggctatagcgaatctaagatggaataaggtttgtattattcaatgactcatcttgcataccgaggagtggaagctataagagttactttccttcaacattttgtgcgactttctaaattcatttgtcaaaaactgcgcctagagttgtgtctcccgaaagttttatgcagagaattttttctgcc

SEQ ID NO: 1790 - DNA, 1023 bp, Glycine max var. Williams 82
atggaagtgaaaggaataagggcaagcaactccaccaccaccaccaccacaatccaaagtgaggatgagatggaccttcgaagaggtccttggaccgtcgatgaggaccttgctctcatcaattacattgccaatcacggtgaaggtcgatggaactctcttgctcgttcagctggactcaaacgaactggcaagagctgcagattgagatggttgaattatttgcgtcctgatgttcgacgtggaaacatcacacttgaagaacagcttcttattcttgaactccacggtcgctggggaaaccgttggtctaaaattgctcaatatttgccgggaagaaccgataatgagattaaaaactattggagaacccgtgtccaaaagcatgccaagcaactcaaatgtgacgtgaatagcaagcaattcaaggatgccatgcgctatctttggatgccgaggctggtggagcgcattcaagccgccgccgctgccaccaccaccgtggcggctgcgggttctccaacggcatctgccagtgctaccacaaccatcaccaccaacaacaacaccaccacatacaactactacgacaacaacaaccttaacaacagttttgaggtgcacagtgggaacatgatggtgagaaatccaacaatcatgaacaacaataacttttgtggttcacatagttacactcccgagaatagtagcacgggtgcatcatcggattcgtttggtacacaggtttcacctgtctcggacttgactcaggattattacaataatgtcacggctgggaataataacaacaataaccctaatcctgatcagtattaccaacaagcacatgatcaactgagtttcttagactgcatcacaagcccatcagggttgttcgatttccaacccatggaaccaaacaccccgtggattaatctgagtaatgttggggacacgtccaacggtttctggaatgttgaaaacatgttgctctttcaacaattctctgacaacaacatgtga

SEQ ID NO: 1791 - DNA, 1517 bp, Glycine max var. Williams 82
ccttctttatcctcttcgtaataagccaaaaccctctctcattctctttccctcttcaactcaaccacacacttcttagatcaaaagctatctttgttgctttgagtttgaaccttgaatctatcaatcaatcaaagtgggtggtgactcatggaagtgaaaggaataagggcaagcaactccaccaccaccaccaccacaatccaaagtgaggatgagatggaccttcgaagaggtccttggaccgtcgatgaggaccttgctctcatcaattacattgccaatcacggtgaaggtcgatggaactctcttgctcgttcagctggactcaaacgaactggcaagagctgcagattgagatggttgaattatttgcgtcctgatgttcgacgtggaaacatcacacttgaagaacagcttcttattcttgaactccacggtcgctggggaaaccgttggtctaaaattgctcaatatttgccgggaagaaccgataatgagattaaaaactattggagaacccgtgtccaaaagcatgccaagcaactcaaatgtgacgtgaatagcaagcaattcaaggatgccatgcgctatctttggatgccgaggctggtggagcgcattcaagccgccgccgctgccaccaccaccgtggcggctgcgggttctccaacggcatctgccagtgctaccacaaccatcaccaccaacaacaacaccaccacatacaactactacgacaacaacaaccttaacaacagttttgaggtgcacagtgggaacatgatggtgagaaatccaacaatcatgaacaacaataacttttgtggttcacatagttacactcccgagaatagtagcacgggtgcatcatcggattcgtttggtacacaggtttcacctgtctcggacttgactcaggattattacaataatgtcacggctgggaataataacaacaataaccctaatcctgatcagtattaccaacaagcacatgatcaactgagtttcttagactgcatcacaagcccatcagggttgttcgatttccaacccatggaaccaaacaccccgtggattaatctgagtaatgttggggacacgtccaacggtttctggaatgttgaaaacatgttgctctttcaacaattctctgacaacaacatgtgaaacattcgtaggagaattcatggtgaaaaccgtgacgaaggggggaaatattgttaaatttacagatgataaagttatataagtagaaaattgagcaaatagaataaattcatatgtaggacacacgtaggatccacgacatggacatagattttaagctaaggatattataagagcaaagagaaggaaactgtgaattactttttttaagtttaatttgtacggacttttttttgttctttgattttccttattttaaagggggtgtgggaaatatttgtaatttgagctttctcagtataagatttcattctttgaaattattaaatctatgttctgttgtt

SEQ ID NO: 1792 - DNA, 930 bp, Glycine max var. Williams 82
atggagaaccaacaagaaatgatgaaagtagaaaaggtatgtgaaatctatgaaaaaatctccaaactagaagacctcaacccttcaaaccatgtcaacaacctcttcacccaacttgtcacaatttgcaccaccccatgccaaatagatgttaccaaactaagccaacaagttagagaaaccatagccaagctaattaggctttgtgggaaagctgaagggcttcttgagaaccactactcaaccctaataggatcatatgagaaccctttaagccacatgaaactcttcccttactactccaactacttcaaacttagccacttggagttcaccatgttaaccactcacatcacacaagtccctacccaactagcctttgtggggtcaggtcctcttcctctcacctcaatcatgttggccacacattacctcaaacacacatgcttccacaactacgacatggatccattggcaaatgccaaggcccatgaacttgtctcctcggacaccgacttgtcgaagaggatgttcttccacacttgtgacattctaaacgtgtcgaatggcctcaaggactacaacgtggtgttcttggcagcacttgtgggaatggaccataaggagaaaggaagagtcattagccacttggccaaattcatggctcctggggctattttgttgctgaggagtgcacatggtgctagggcttttctctaccctgtggttgatccttcttctgatctcaaaggctttgaagttctatcggtttttcaccccactgatgaggttattaactcggttattgttgcacgcaaagggctttattcatcaccagtgttggctagcaaatgctctggagttgaagggtttaatcacttcaaccatgggaatgttattgaggagttgaccgttgacgatcaggcttga

SEQ ID NO: 1793 - DNA, 855 bp, Glycine max var. Williams 82
atggctgaagatgggaacaacaacgatgtacccttacacaaattcaaagacagcaatccaaaccctgaagagttcgatgcaaagggttacagcctcagcggaaaaatcatgctttcagcaataatccttcttttcttcgtcgtcgttttgatgttgtgccttcatatctacgcgcgctggtacctccggcgtgctcgccgccgccagctccggcgccaacgcgagctccgccgcacccagcttgtcttttacaacgacgacgccacccccgcagccgtgtcacgtggcctcgacgccgccatccttgccacgctccccgtcttcaccttcgacccggaaaaaaccgggccggagtgcgctgtttgcttgtcggagttcgaacccggtgaaacgggtcgggtcttgcccaaatgtaatcacagtttccacatagaatgtattgacatgtggttccattctcatgacacgtgtcctctttgtcgcgccccggttgaacgcgcgccggaaccggaagttgttgttataacagtacccgatccggtttccgaaaccggttcaggcgaaaatgagaaccgaaccggttcttcttcttcttcctcttcggttggattgagtaagcctaagccttcgttggttggtgtgacaattgaggtgcctccgagggacgagaattttcaaaacgagttgcaaccgagttgcgactcatcctcctcgtttcggtcgccgatgagtcgcatgctgtcgtttacgaggatgctcggcagggaaaagaaggggaacgtgtcgccgtcgtcgtgcggcggcggcgattgtagctccgccgcggagcgaggtgagcgagaggagactcagtga

SEQ ID NO: 1794 - DNA, 735 bp, Glycine max var. Williams 82
atggcagaagcgagtttctttgttggagtcataggtaacatcatctcaattctcatgtttctttctcctgtacctacgttttggaaaataaagaagcacggatccaccgaagatttctcaagccttccttatatttgcacattgcttaattgctccctctggacttactatggaatcataaaagctggagagtaccttgtggccactgttaatggctttggcattctcatggagacaatctacattattctatttctcatatatgcaccaaaagggataaggggtaggactgctattttggctttgattttggatgtggtaatcttgacggcaataataattattactcaattagcattagaaggagagactcgtagtggtgctgttggtgttatgggagcaggcttaaatattgttatgtattcctcacctctgtcggtcatgaaaacagtggtgactacaaaaagcgtggagtatatgccattcttgctttcttttttcttctttttcaacggtgccgtttggttgttgtatgctgttctcgttcgtgatgttatcctcggggtgccaaacggtactggatttttactgggagcgatgcaattagtgctatacgcgatctacagaaatgggaagcgtgtttcaaataacagattggaagaaggattacaacatgagcctctcatctcagagccgaataatgagtcacatcagagtgaagacaggcccatctag

SEQ ID NO: 1795 - DNA, 897 bp, Glycine max var. Williams 82
atggcactcagacccatcgacaacgctcttccgacaacaaccccagagagacccaaaaaacaacctaaaatcgctgttgcaacccaaaaacaacaagatcgtgcttccgtcaacggcgaaaacgtagttccattgccatcatctgaggatgccactgttgactatgtctcctccgacaaccttaaacccttggcggaccccgaagttaagattcagagtttggtggaagatttggattcgaaaaattggatcaaggtttgtgaatcgttgaatgatgttaggcgcttctcgttactccactcctctcttctattcccaatcttgggtaaaattgtgttggtggtggcgaagacaatgaggaaccctcgtagtgctctttgcaaaactgctattatggctgctgctgatattttcagtgcatttggtgacaagctgcttgaaccagagacctctgatgcatttgatggcttgctgctacagctgctgctgaaggcatcccaagataaaaggtttgtgtgtgaagaagctgatagagcacttggcataatggtgggctccatgacccctcttccactgcttaagaaactgagggtatatgtgagtcacaaaaaccttagggtcagggctaaggctgctgtttctctctccaactgtgtctccaagatggggcttgaagaaatggagcagtttggtttggctgaactgattgaagtggcggcggatttactgaatgatagacttcctgaggcaagagatgcggcacgaagtattgcaacttcgatgtacgaggcactgacaaaggactcggaagagatgatggaattgtggcagagcttctgccaatccaagttgccaccaatccatgctctttcaattttgaaaatagttaagccctaa

SEQ ID NO: 1796 - DNA, 378 bp, Glycine max var. Williams 82
atggctggtgatgcagcatttccctcttacacttccacttgcatgatgaccttcttcttctctttgctcttagctcttcacttcgccatggccgtcccagaacgaagcttctcctctttagcttctataaaagaaggtgcaaagaagaggaacaccatggtagctgcttcaactgctagagaagaaggaagcacacaaaatctcaagacagaagaagccacaccaaaagataaccatgtttctgatcatctcttgaagggtactaataaagaaggaagttctcgatctccgcgacctccattggagaggcaaaacaagatcttcaatgctagtgaacatgaagtccctagtggtccaaaccctatttcaaacaggtaa

SEQ ID NO: 1797 - DNA, 1512 bp, Glycine max var. Williams 82
atggaaatgtttcccttgttgccttactttctcttatcatcccttgtttttcttctcacattcaagctattattttcccaaagaagaaaacacaaaaaccttccaccaggtccacctcctcttcccataatcggcaacctcaacctcctcgaacgccccctccaccgtttcttaacccgcacttcaaaaacatacggcgacatcttttctctctggttcggctcccgcctcgccgtcgtcgtctcgtcgccctccgccttccaagaatgtttcacgagaaacgacgtcgccttggcgaatcggcctcgctctctctcaggaaagcacatcttctacaactacaccaccgtgggatcctgctcctatggtgagcactggcgcaacctccgccgcattacctcccttgacgtcctctccacccaacgaatccactccttctctggaatccgaaaggacgaaacggagagtctcaggtttatacgtatgttggccaaggactcgtgcatggactatgcacacgtggagctgagttccatgttccatgacatgacctataacaacatgatgaggatgttatcagggaagaggtactatggtgatgagagtcagataaaggacgtggaagaggcgaaggagttcagagagacggtggaggagttgctgcaagttgcgggggtgtctaataaggcagattatttgccctttcttcggtggttcgattttcataacttggagaagaggctcaagagtattaataagaggtttgatacgtttttggataaactcattcacgagcaacgcagcaagaaggagagagagaacaccatgattgaccatcttttacatctgcaagagtctcagcctgagtattatactgatcagatcatcaaaggccttgttttggctatgctctttgctggaacagattcatcagcagtgactttagaatggtcattatctaatttactgaatcatccggaggtgttgaaaaaagcaagagatgaattggatacttatgtaggtcaagatcgcttggtaaatgaatcagaccttccaaacctattttaccttaagaagatcatccttgagacacttaggttgcatcctcctgctccactagcaataccacacgtgtcttcagaagacatcaccataggagaattcaatgttccacgagacactatagtgatgattaatatttgggctatgcagagagaccctttggtgtggaatgaagccacatgttttaaaccggagaggtttgatgaagaaggtctggagaaaaaggtaattgcatttggaatgggaagaagggcttgtccaggagaaggtttagccttgcagaacgttggcttgactttgggattgttaattcagtgctttgactggaaaagagtgaatgaggaagagattgatatgagggaggcaaattggttcactttgtcaaggttaactccattgaatgccatgtgcaaagcccgtccactcgtgaacaagattaatctgaagtaa

SEQ ID NO: 1798 - DNA, 1497 bp, Glycine max var. Williams 82
atgggaatgttgttgttgttgttgtcttactctctccttttcctggttctattccttacactgaaatcccttttccaaagaagaaaattgagaaacctaccaccaggtcctcctcctcttcccataataggtaaccttaacctcctcgaacaacctattcaccgtttcttccaacgcatgtccaaagaatatggaaacatcgtttccctttggttcggttcacgtctcgccgttgtcatttcctcaccaacagcataccaagaatgcttcaccaaacacgacgttgccttggccaaccggctaccttctctctcgggaaaatacatattctacaacaacaccaccgtagggtcctgctcccacggggagcactggcggaacctccgccgcatcaccgccctggacgtcctctccacgcagcgagtccactctttctccggaatccgaagcgacgagacgaaaaggttggtacagaggttgctggccaagaactccaaggagggttttgcgcgcgtggagataagctccatgttcaatgacttgacctacaacaacatcatgaggatgatatcagggaagaggttttacggagaggagagtgagttgaagaacgttgagaaagcgagggagttcagagagacagtgacagagatgctagaactcatgggggtggctaataagggagatcacttgccattcctaaggtggttcgattttcagaatgtggagaagaggttgaagagtattagtaaaaggtatgataccatcttgaatgagatcattgatgagaaccgtagcaagaaggaccgtgagaattccatgattgatcatctcctcaaactgcaagagactcagcctgagtactacactgaccaaatcatcaaaggccttgctttggccatgctttttggcggaactgactcgtcaactggaactttagagtggtcattatctaatttattgaattatccagaggtgttgaagaaagcaaaagacgaattggacacacaagtagggcaagaccgcttgttaaatgagtcagacctgccaaaacttccttatcttagaaagatcatccttgagacacttaggttgtatcccccagctccaattctaatacctcatgtttcttcagaagatattactattgaaggattcaatgtcccacgagacacaattgtgatcattaatggttggggcatgcagagagatcctcagttatggaatgatgctacatgctttaaacctgagaggtttgatgtggagggagaggagaaaaagttggtagcatttgggatgggaagaagggcttgtccaggagaacccatggctatgcaaagcgtcagctttactttaggattgttgattcaatgttttgactggaaaagagttagtgaggaaaaacttgatatgacagagaataattggatcaccttatcaaggttgattccgttggaggccatgtgcaaagctcgcccacttgccactaaaatttga

SEQ ID NO: 1799 - DNA, 735 bp, Glycine max var. Williams 82
atgactgccactactgatcaatggatgcagttctatcaacaacctctaatggatagccatggccatgatcatgatcatgatcatgatcatcatgctttggcaccaaacaccacagaaggcttctctagttctcccactcctaccatgccttcatcagagagcaatagcatcttgagccaattgagtccaaagggtaatgtatccaaaccaataagaagaaggtctagagcctctaagagaaccccaactacacttctcaatgccaaccccaccaattttagagcattagtacaacaattcacagggtgtcctcgcacaaccatgtcaacactaggggtccataagggccctattaccttgaattttcaacaaggaaatagtagtactgaacaaaaggttcatcaccacaacacaagtagtagggtagtgctaccagttagtggcagaagctacaacaacaacaacaacaacaaccagtttcatcaagtgcctgcaccgtttcctaattggcagaagcaagaagaacaacagcaacaattgcctcagcagagtggttactcttttgattatgtaaagaacaatggttttcttccaagttcgggtaactcaataaggcctaccactattagcatggatcatgtctctgatggtttgctcttagataatgactttaacttggctgatctaactgttaatggtttccccaatgatgctctttatgagagtgaattatag

SEQ ID NO: 1800 - DNA, 2259 bp, Glycine max var. Williams 82
atgggaaaagaaatcaaaggttcaacttcaacagcttcaaatttgacgagtaatatcatcacggaacataattctattttgtggccaccacgttttgatggcaaaaatttcactgagtggaaggagcgtatgagaacattcatacaatctgttaacttcaagctttggcttgtgattaaaaatggaccaaacattccaacaaagctaatatacaagaaaagtgaagatgaatacgatgaatatgaatacaatgaagaagacatgaagaatttggaattagaggccaaagcaagacatattttatattgtaccttgtatgcagatgcccctaaaatattttcagagggccacaaaacagccaaacaaatttgggacgagcttgacagggaaatgacaagggccaactctccaactccctcaccagaactcatcagccactatccaagctttccattcaattatccagatctctactttttagatgaaacaagggaatcgatggacaaatttctgaagttttgcgtgccccttcacaagtatgctctaacaggcaattggccagaagccaaatgcatattaaatcaagatgaagatcatagactaaagcacgccgcaataacaaaagagtggagtacattgctgcatattgctgcaggtgcaaaccaatttgactttgtggagaaactgctgcaagaaatcaatgatgaacacattgtattgcaagatagcaagggccagactgccttctgcttggctgttgcatctgggaacatgccgattgttgatttgttgaggagaagaactcaactcttgctaatgatcagggataaaaatggaaatacccctctacagtttgctttgatgcaaggaaaatccaatgtggcatggtatctatacgaaatgctgaataattatagagtagacttcgatgatcaggacaagaactcgttgttcttcactgctatcaaggctggcaactaccgcatggccttaatgatggcagaacggtggaaagagctagcttttgcacgtgatgatcagaataatgaaacagctttacatgtcttggctttaaatcacaagatcaaccacggcaagaaacatgtgtttttccaattggttaattttctttggaaccgtattcaatcggttaattttcgttggaaggatcagattaatattgaaacagattttcaacacttggcccacgagacgaacaacggccagaaacagcatgagttttttgaattggttaattttctttggaaaagtattcttggccagcaaaacttctcgggggcaattagaatcataagtgaaccttctaaactattattcaatgctgcaaaagttggtaattttggattcttgtcagagcttattagttctcaccctagcttgatatgggaagtggatgacaaaaggcaaagtataattcacacagcggtttcgcatcgccactcctccatcttcaatctgatacatgaaatagggtcggcaaaggatgttatattatcatatattgtgcaagaaaacaacactatattgcatttggcagcaaaattagccccaccaggtcgacttggattagtttctggagcaccattccaaatgtgcctcgagttaatatggtttgaggaggtgaagaagataatgccaccatcctttataatgtttaaaaattctgatggcctaactgctcaagaattattcacaatggagcatgagggattgcggaaaggagaggaatggatgaaacgcactgctgagttttgtatgcttatttcaactgttattgccacagcagtgttctctgcagcagttaacataccaggcggtattgatgagcaaacaaagaaaccaaattacttggacaaaacatcattcctggtatttgcaatttctgatgcagctgcatttgtctcatctgcaatcgcgatattaatattcttgtcaattattgtctcaccttatgcggagtatgacttttacaagtcactgcccttgaagttaatatgtggacttgtaactctattcatctccatagcatgcatgatggtagcatttgacagtgccttcttcatcacgtacaattatggttccaaggtggttcctaatttaattgcagtacttgcgtgtgtaccaatgcttctatttatagctttgcaatttccattatggtcagatatcatctacgcggccttctattgtaggactatgtttaagtcaagtaaacgtatgattcacttactagactag

SEQ ID NO: 1801 - DNA, 2658 bp, Glycine max var. Williams 82
atggttgaaaatatcaagagaagtagctttgaagtgttgggaatgtgctgtgctacagaagaagcactggttgaaagaattttgaagcctcttcgtggagtcaaagacgtctcagtgatagtccctacaagaacagtcactgtggtccatgatgttctcttgatttctgagtcacaaatagccgatgcactgaatgctgcaaggcttgaagctagtttgagactacagggagagactgataatgaaaagaaatggccagatttaactacgatggtgtgtggcttgttactagcactttctttcttgaagtatgcatatcaacctttgggatggttggcacttggttctgttgtcattggcttccctaaggttctactcagggccatagcttccataaaggctcttactcttaatatcaacattctggttctattggctgtgtgtggtactgctgctttacaagatttttgggaggctggaatcatcatattcctattctccattgctcaatggcttgagacaagagcaactcacaaggcaatggttgctatgtcctctttaacaagcatggctcctcaaaaggccgttattgctgaaactggggaacttgttgacgtcaatgatgttaagatcaacactatacttgcagtcaaggctggtgatgctattcctcttgatggaatcgtggtggaaggaaagtgtgaagttgatgaaaaaatgttaacaggagaatcattacctgtgaccaaggagttagattcagtagtatgggctggaactattaatgtgaatggatatataagtgtaaaaactactgttttggcaaaagacacagtggtggctagaatgtcaaaacttgttgaagaagcttctagcagaaaatctcgaacacaaagattcatagatcattttgcgaagtactatattcctgctgtcgtcttgatttctgctagcattgctgtggttccagctgcattaaaagttcctaatattaagccttggtttcatctggcaattgtggttttattgagtgcatgcccttgtgctctcatcctctccacacctgttgcaatcttttgtgctctcacaaaagcagcaataagtggattactattgaaaggtggagattatattgaaacactttctggaattaagacagttgcttttgataaaacgggcacaataacaagaggagagttcactgtgacagatttttctgtttctgtagatgacattagcattgaaactttactgtactgggtttcaagtgttgagagtaaatcaagtcatcctatggcagctgcactagtggaatatggaatgttgaattctgtcaagccaatccctgaaaatgtggagaattttcaaaattttccaggggaaggagtttatggtataattaatgggaaggatatctatataggcaataggagaatcggtgctagagctggctctgaaagagttgattgtcgcacgcaatgtcaaagccctgaaatttctaccccgaatcaatgctgtggaccaactctggttggagtcttcaggttagctgatacatgcagatcaggggcattggaggcaatagaagagctaaagttgttaggtgtgagatcagtcatgctaactggagatagctctcaggctgctatgtatgctcagagtcagttgaaccatgctctagacattgttcatgcagagcttctacctgcagaaaaggcagtgatcattgagaatttcaagaaagatgggctaatagccatgattggagatggcatgaatgatgctcctgcattagccacagctgacatcggtatctcaatgggaatatcaggttcagctcttgcaaatgaaacaggcaatgcaattctcatgtcgaatgacatacggaaaatacctgaagccattcgactagcaagaaaaactactagaaagctaattgagaatgtcattatttcaattggcttcaagagtgtcatacttgcattggcaattgcaggataccctatagtctggcttgctgtgttgactgatgttgggacctgtctacttgttattctcaatagcatgttaattttacaggagaaaactaaatatgaaagaaaatctacaagttccaaatacggaactttctcggaagatatgaccacagctctacttgacaagaaaagtaatagcaatgagaacaaagcagttctctccgctgaaaagtgtggtaaagattgttgtaaaaacgacacttatcgtgaagcaactacaaacaagaatgaatcttctggactttcaaagttgagctcactgaagggaaaccacaatgggaacttggtatctatcgaagtgcacattgtgaaaccttgcaatggttgtggtctaggcaaagtcaaaatgtgtgaggacttctcatgcagaacaaataatagtagctctgattgttgccaagagcaatctaagactgagaaaagtgacactggttctattgttacacaagaagctagcattgccacattagagtctgatggctataagggcaagtctatggatatttcaaagttgtctgggacaagtgtgactcccaagtgttgcaagaacttgtgctgtaatgatagtgttaacaatattagtaaccttagccttagccagcccgaaattgttatcgagtga

SEQ ID NO: 1802 - DNA, 2979 bp, Glycine max var. Williams 82
tgatactaagcttttaagtttgtctctctttttttcctttctttctctcttttctccttttaatataccttgttttcttcctccttgtgttttgaccgttgccttttttttctcaacgtctttctctgttcacacacacttctctctctctctctcactgattccttctccacacacacctcatgatcaaaactctgtcgctttccttcaacctcattgtaaggtgtgcttctcccttctaaccttcacttttttttcttcttaacccaatgttaacatgtgtttgtcatttttttttttctttgtactggttattctccacttgtaaccaacatatacactttctttgggtgttagaagcatgaaattcaaaaagggtgtcattgaaaattttgtcttcctgaaaacggatttatgatttctttatgaatctggtgagacatagagaaaggttctccttttgtttccatttcaatgcaagcttgagacattcattcataggggactgagaagagatgggatgttcacattcaaggttggatgatgaagaggcagttcggctttgtaaagacagaaagaagttcatcagacaagctgttgaacaaagaactcaatttgccacgggacacatagcatacatagaatctcttaaaagggtttcagctgcacttcgcaattacattgaaggcgatgagcctcgcgagttctcattagacacagtcatcaccccacctttcacgcctgtgaagaggaaaactggctcaggattcattcccatatcagcaaaaccctttgctacaacaggagcaattgagtttgggatcggaccaaactctactttgaaagtgaattaccttaggcctggtggtaacccagcaatttcagttgaggaaaggcctcaatccccggaaagggttcaggttgagacgtactatggcattgatggatttttcaacatgcaatcctcaccagtgaatccctcaatttttgcttactctcccaataataggactactatccctcccccttcacctcattcccaatgggatttcttttggaaccctttttcatcattggacagttatggttatccttctggaggtagcattgagcaaactgcaatggatgatgaatacagaggacttaggcaggttagagaagaagagggaataccagacctggaagaagatgaaactgaacatgaagattgtgttggaaagagaaatgtagcagaagaaagaactaggcacgatataaattcttccaaagaagttattgttgaagattttaatgatgatgatgatgaggaggaggaggaggaggaagaggaggaggaagaaacagacattgaagatgaaactgaaactgagcacaatgccaaagattcacaagctcatggtagtgcaagttttgaagtatcaaaagctgaagctgctggtcatattgaatccagacatagggaaatgacaattggtaaacaagaagctgtggaagatacaccaggttttactgtttatgtaaacagaaggccaacaagcatggcagaagtgatcaatgatcttgaaactcaattcacagttgtctgcaatgcagccaatgatgtctcagcattgttagaggccaagaaatctcagtatttattgacatctaatgagctttcagcatctaagttgttgaacccagtagctctgctccgatcagcttcttcacgctcttcttcatctagatttttggtgaattgttcgagcactagcgcagaaggttgtggtgagggcactaaggatctctcagcggaacattgtatgttatccggtagtcaccatgccacattggatagattaaatacatgggagaagaagctctatgaggaagtcaggtctggagaacgtgtccgaattgcatatgaaaagaaatgcaagcaactcaggaaccttgatgtaaaaggagaggacccctcttgtgcagataaaacaagagcagccattagagaactagatacccagataacagtttcaatacactcaattgaagctatttcaaggagaatcgaaactctaagggacaaagagttgcatccccaacttcttgaattggtgcaagggctggaaaggatgtggaaagtgatggcagaatgccatcagacacagaagagaaccttagatgaggctaagattcttctagctggcactccttctaaatcacgtgccagaaagcagtcttccatttcaatgactgatccaaacagactggcccgttcagcctccaatcttgaattcgagttaaggaactggagaaatgcctttgagtcatggatcacttctcagagatcctacattcatgcactaaccggatggcttcttcggtgcatgagatttgagcctgacgtatcaaagttaccatgctctccccgtaggtccagcagcactcaccctttgtttggactatgtgttcagtggtcaaggcgcctagatgcaatacaagaaaaggcagtgcttgatggcttagacttttttgcagctggaatggggtccctctatgcacatcagttaagagaagattctaggagaaactcatttggatcaaaacaaagcaatgggaatatggaaatggtggaagttggtgaggtggaagaggtaatggctccagagaaactggctgaagttgctatcaaggtgctttgtgctggaatgtctgttgctataagctcactggcagagtttgctttggattcttctgaggggtacaatgaagttgttaagcaatgggacaatgggaagtgtcaaaatactacttctagtgagactagaacataaatgtctcacattttgtgttaattagtttaggcttgtttagaaatgggtgtatgagaatgtaattatgtatttaactaaccaatacaaaaggtagaatagcaagggaaattgcaccccatgttgttaaagtggattttcttttttctttttctgtttctgccttctc

SEQ ID NO: 1803 - DNA, 1125 bp, Glycine max var. Williams 82
atgagttcaagctgcggaagaacccatggattcaatttggacttggccaaatcctcatccacctcaaccctaacttcacccacctcctctccttcttcaacaacaacctcggaaaccaccaactccccccaatcaataatcttcacgaaaaaacctcgtaccctccgaaagcgaccgaaccaaaccttcaatgaagccgccacactcctctccacagctcatccgaacctcttctcaataaaaaacctaaaaaaacccgaaaagttcaccaaaccagtaacagaaaatattagccactcgtcagaaccgttattactgttcagagagtgtgaaaataacgacaacgacgcgttctcttttctccttgaaagcaaacgtggtttccaaacggagtcgaacaaggtcttcttcggcgtgcgagagaatattaataagccttgcgaattgagcacttcagtgccgaattgcgatgaatttgagagtgaagagttcgattgccaatcgatgctcgacgaggaaatagaggaaggaatcgatagcatcatgggaggaggaggaggaagagttgaagaggatgatgttaatcgtgccgcttcgtgtcacggcggtgacggcgagaaattcggttgcgtgagggctctacggcgagatgatacgaagtggtggaatttttgtgtggttgacatgcttcaaatctcgccgcggatgaagcacgctgcggcggaggatttggttccggccaccgcaatggcaacaacgaccgagaagacaaagacgaagaacaagaaaagcaaaaaggtggtgaagaaattaacagaggaattatcagaggtagcagtgagtaagggcttgcggttgaaattgaattacgacggtgttcggagtgcttggtccaatcgggggtcgccatttgccgatggttcgccgggaaatgacgtcaccctacgttgctcgtctctcgctcgcgatttgaataagtctaaaagaaaaaaggacatgtcgatttcttggtggagggagggaggagtaagaaaagctagtgtgctacgctataaagaaaagaagcagatcagacatcagtttaggatagtcaacgcacatcaacggcccagaatgaaggcatga

SEQ ID NO: 1804 - DNA, 1068 bp, Glycine max var. Williams 82
atgaatatgtaccaattgcaacagtttcatattcaacccatgatgatgaagatggataatacgatgaggaagagggagagaagcaaggccatggagaaagagaggcttcatgtgatggacttgagtggcatgtccttggagtttcttcccaaaccttcgcttgatttagccaccatttgcaagttggacctatctaataacaatctccaggaaattccggaatccttaacggcaagacttctaaacgtggaagtgttggacgtgcgttccaaccagctaaagtcccttcctaattccattggctgcctttctaagctcaaggttttgaatgtctcaggcaacttcatcgaatccctccccaaaaccattgagaattgcagagccttagaagaactgaatgcaaacttcaacaagctgagcaagcttccagacacaatagggtttgagctcgtaaacctaaagaagctctcagtgaactccaacaagcttgtgtttcttccaagctccacttcacacttaacagctttgaaggttcttgatgcacgcttgaattgcctaagggcacttccagaggaccttgagaaccttatcaacctagaaactctaaatgtgagccagaacttccagtatttggacaccctcccttactccatagggcttctcttgtcactcattgaacttgatgttagttacaacaacatcaagaccttgcctgagtcaattgggtgcctcaagaatcttcagaagctgagtgttgaagggaaccctcttacttgcccccctatggaggtggtggagcaaggacttcatgtggtgatggagtacatgcatcataagatgaactcaagtgatcaaaacaaaactaagaaaaggtggtggattgggaagattgtgaagtgtggaaccttcaataaacaaatgagaggtgggaaacgaccagaaaatgagggttacaacatgcttaagcaccagaatatcaatggccttgcttccccgggtctcatgggaatgctctcacctctgcgcctcttctctccccgtcattcaccccgtcgttccttcggttga

SEQ ID NO: 1805 - DNA, 2166 bp, Glycine max var. Williams 82
atggggaagagagagtttaatggggtggtgttgatgatgctgtgtttgtgggtttgtggtgtcacagcctctgtgacttatgaccacaaagccattgtggttgatggcaagagaagaattttgatctctggctccattcattatcctagaagcacacctcaaatgtggccagaccttattcaaaaggccaaagatggaggccttgatgtcattcagacctatgtgttttggaatggccatgaaccttctcctggacaatactatttcgaagataggttcgacttggttaaattcgtgaagctcgcgcagcaagcaggcctctatgttcatctccgtattggtccctacatatgtgctgaatggaacttggggggatttcctgtctggctcaagtatgttccaggcattgctttcagaaccgacaatgagccgttcaaggctgcaatgcaaaaattcactgcaaagattgtcagcttgatgaaagaaaataggttgtttcaatcccagggtggtccaataattttgtcacagattgagaacgagtatggaccagtggaatgggaaattggtgctcctggaaaagcttatacgaaatgggctgcacaaatggctgttggtctagacactggtgttccatgggtaatgtgcaagcaagaagatgctcctgatcctgttattgacacctgcaacggattctactgtgaaaacttcaagcccaacaagaacaccaaacccaaaatgtggactgagaattggactggctggtacactgattttggcggtgcagtccctcgtagaccagcagaagacttggcgttctcagttgcaagattcatacagaatggtggttcattcgttaactactatatgtaccatggaggaacgaactttggccggacatcaggtggcctcttcattgccactagctatgactatgatgcgccgcttgatgaatacggacttgaaaatgaaccaaagtatgagcatttgagagctttgcataaagcaataaaacaaagtgaacctgctttagtggctacagatcccaaagtgcaatcgcttggatataaccttgaggcccacgtgttctcggccccaggtgcttgtgctgcattcattgctaattatgacaccaaatcttatgcaaaagctaaatttggaaatgggcaatatgatctaccgccttggtctatcagtattcttcctgattgcaaaactgttgtttacaacacagcaaaggttggttacggctggctgaaaaagatgactcctgtaaacagtgcatttgcttggcagtcatacaatgaagaacctgcctcatccagtcaagctgattccattgcagcatatgcactttgggagcaggtcaacgtgacccgcgattcttcagattatttgtggtatatgacagatgtcaacgttaatgctaatgaaggatttctaaagaatggacaatctcctcttctaactgtaatgtcagctggccatgttctccatgtgttcattaacggtcaacttgcaggaactgtgtgggggggattgggaaatcctaaattgacatttagtgacaatgtgaagctgagggctggcaataacaagctttctttacttagcgttgcagttggtctcccgaatgttggtgtgcactttgaaacatggaatgcgggggtgttaggcccagtcactctgaagggtctaaatgaggggactcgagacttgtcccggcagaaatggtcttacaaggttggactgaaaggtgaatccttgagccttcacaccgaaagtgggagtagctctgtggaatggatacaaggatcattagtggctaaaaaacaacctttgacatggtacaagacaacttttagcgcaccggccggcaatgatccattggctctagatttgggaagcatgggaaagggtgaagtgtgggtaaacggtcgaagcattggtcgccattggcctggatatatagcacatggtagttgcaatgcttgtaattatgctggatattatactgatacaaaatgccggacgaattgtggacaaccttctcagagatggtatcatgttcctcgctcatggctgagctcaggtggtaactccttggttgtgtttgaagaatggggaggtgaccctaatggaattgctttggtgaaaagaacatga

SEQ ID NO: 1806 - DNA, 3127 bp, Glycine max var. Williams 82
ccagacttcttaatgggcaatgtcttgcagttgcagttgttacgtgtgaaggatgaggacagtgaaaaaaaaagaattagaaaaaaaagggtcccattcttccctccttttctttctttctccaaatctatataaagcagcaccatttgcatcaacgtttacctcaactcacccatcaaaccacacacctcacctattagaagtaacaaaagaccctccctctcaaaagaataaacaagtataaaaaagaaggcacttccctcaaacagaaactaccctctatctctctcttttcaagccttaaatgagtaaaaaagagtgaagaaaggaaagaaaggagcaccatttttggtttgagaaacataattagcaagagagttcaaaatggggaagagagagtttaatggggtggtgttgatgatgctgtgtttgtgggtttgtggtgtcacagcctctgtgacttatgaccacaaagccattgtggttgatggcaagagaagaattttgatctctggctccattcattatcctagaagcacacctcaaatgtggccagaccttattcaaaaggccaaagatggaggccttgatgtcattcagacctatgtgttttggaatggccatgaaccttctcctggacaatactatttcgaagataggttcgacttggttaaattcgtgaagctcgcgcagcaagcaggcctctatgttcatctccgtattggtccctacatatgtgctgaatggaacttggggggatttcctgtctggctcaagtatgttccaggcattgctttcagaaccgacaatgagccgttcaaggctgcaatgcaaaaattcactgcaaagattgtcagcttgatgaaagaaaataggttgtttcaatcccagggtggtccaataattttgtcacagattgagaacgagtatggaccagtggaatgggaaattggtgctcctggaaaagcttatacgaaatgggctgcacaaatggctgttggtctagacactggtgttccatgggtaatgtgcaagcaagaagatgctcctgatcctgttattgacacctgcaacggattctactgtgaaaacttcaagcccaacaagaacaccaaacccaaaatgtggactgagaattggactggctggtacactgattttggcggtgcagtccctcgtagaccagcagaagacttggcgttctcagttgcaagattcatacagaatggtggttcattcgttaactactatatgtaccatggaggaacgaactttggccggacatcaggtggcctcttcattgccactagctatgactatgatgcgccgcttgatgaatacggacttgaaaatgaaccaaagtatgagcatttgagagctttgcataaagcaataaaacaaagtgaacctgctttagtggctacagatcccaaagtgcaatcgcttggatataaccttgaggcccacgtgttctcggccccaggtgcttgtgctgcattcattgctaattatgacaccaaatcttatgcaaaagctaaatttggaaatgggcaatatgatctaccgccttggtctatcagtattcttcctgattgcaaaactgttgtttacaacacagcaaaggttggttacggctggctgaaaaagatgactcctgtaaacagtgcatttgcttggcagtcatacaatgaagaacctgcctcatccagtcaagctgattccattgcagcatatgcactttgggagcaggtcaacgtgacccgcgattcttcagattatttgtggtatatgacagatgtcaacgttaatgctaatgaaggatttctaaagaatggacaatctcctcttctaactgtaatgtcagctggccatgttctccatgtgttcattaacggtcaacttgcaggaactgtgtgggggggattgggaaatcctaaattgacatttagtgacaatgtgaagctgagggctggcaataacaagctttctttacttagcgttgcagttggtctcccgaatgttggtgtgcactttgaaacatggaatgcgggggtgttaggcccagtcactctgaagggtctaaatgaggggactcgagacttgtcccggcagaaatggtcttacaaggttggactgaaaggtgaatccttgagccttcacaccgaaagtgggagtagctctgtggaatggatacaaggatcattagtggctaaaaaacaacctttgacatggtacaagacaacttttagcgcaccggccggcaatgatccattggctctagatttgggaagcatgggaaagggtgaagtgtgggtaaacggtcgaagcattggtcgccattggcctggatatatagcacatggtagttgcaatgcttgtaattatgctggatattatactgatacaaaatgccggacgaattgtggacaaccttctcagagatggtatcatgttcctcgctcatggctgagctcaggtggtaactccttggttgtgtttgaagaatggggaggtgaccctaatggaattgctttggtgaaaagaacatgaagtgtgatattttatgatgctctcttaaaaggagcagcattgacaggcaatatatatcttgtaacaaatgtctaggaaatgcaaagaagctgtcaagtgagtcctatgcggttaggaccctatgatgcagcaatttaccaaatacgtgtggtttagatcatattaggttcagtatataaaaaatatttgaagttcataattggtgctccttgtcttctggttgttcaagtatacctcaaaagattgccaaggcctaatcatgcattgcctggccaaaaacaaagatttatataagagaatttggatgcgcaaagactgtgtatactgtacatagtcaagtcaggctattgtgctgaatattgccccatgtattacagggcttgtatcaatgaagattgagcccttacacatttatttaatttactatgatacaatggaaagaattgtagacacgcaaaatgtgtcggagagtatatttgctatattctgccagaaataattgtgttttcccattataattattatgtaagaacagattgaaagtaataaaatatcctttgaaatatttgtcttgtta

SEQ ID NO: 1807 - DNA, 3122 bp, Glycine max var. Williams 82
ccagacttcttaatgggcaatgtcttgcagttgcagttgttacgtgtgaaggatgaggacagtgaaaaaaaaagaattagaaaaaaaagggtcccattcttccctccttttctttctttctccaaatctatataaagcagcaccatttgcatcaacgtttacctcaactcacccatcaaaccacacacctcacctattagaagtaacaaaagaccctccctctcaaaagaataaacaagtataaaaaagaaggcacttccctcaaacagaaactaccctctatctctctcttttcaagccttaaatgagtaaaaaagagtgaagaaaggaaagaaaggagcaccatttttggtttgagaaacataattagcaagagagttcaaaatggggaagagagagtttaatggggtggtgttgatgatgctgtgtttgtgggtttgtggtgtcacagcctctgtgacttatgaccacaaagccattgtggttgatggcaagagaagaattttgatctctggctccattcattatcctagaagcacacctcaaatgtggccagaccttattcaaaaggccaaagatggaggccttgatgtcattcagacctatgtgttttggaatggccatgaaccttctcctggacaatactatttcgaagataggttcgacttggttaaattcgtgaagctcgcgcagcaagcaggcctctatgttcatctccgtattggtccctacatatgtgctgaatggaacttggggggatttcctgtctggctcaagtatgttccaggcattgctttcagaaccgacaatgagccgttcaaggctgcaatgcaaaaattcactgcaaagattgtcagcttgatgaaagaaaataggttgtttcaatcccagggtggtccaataattttgtcacagattgagaacgagtatggaccagtggaatgggaaattggtgctcctggaaaagcttatacgaaatgggctgcacaaatggctgttggtctagacactggtgttccatgggtaatgtgcaagcaagaagatgctcctgatcctgttattgacacctgcaacggattctactgtgaaaacttcaagcccaacaagaacaccaaacccaaaatgtggactgagaattggactggctggtacactgattttggcggtgcagtccctcgtagaccagcagaagacttggcgttctcagttgcaagattcatacagaatggtggttcattcgttaactactatatgtaccatggaggaacgaactttggccggacatcaggtggcctcttcattgccactagctatgactatgatgcgccgcttgatgaatacggacttgaaaatgaaccaaagtatgagcatttgagagctttgcataaagcaataaaacaaagtgaacctgctttagtggctacagatcccaaagtgcaatcgcttggatataaccttgaggcccacgtgttctcggccccaggtgcttgtgctgcattcattgctaattatgacaccaaatcttatgcaaaagctaaatttggaaatgggcaatatgatctaccgccttggtctatcagtattcttcctgattgcaaaactgttgtttacaacacagcaaaggttggttacggctggctgaaaaagatgactcctgtaaacagtgcatttgcttggcagtcatacaatgaagaacctgcctcatccagtcaagctgattccattgcagcatatgcactttgggagcaggtcaacgtgacccgcgattcttcagattatttgtggtatatgacagatgtcaacgttaatgctaatgaaggatttctaaagaatggacaatctcctcttctaactgtaatgtcagctggccatgttctccatgtgttcattaacggtcaacttgcaggaactgtgtgggggggattgggaaatcctaaattgacatttagtgacaatgtgaagctgagggctggcaataacaagctttctttacttagcgttgcagttggtctcccgaatgttggtgtgcactttgaaacatggaatgcgggggtgttaggcccagtcactctgaagggtctaaatgaggggactcgagacttgtcccggcagaaatggtcttacaaggttggactgaaaggtgaatccttgagccttcacaccgaaagtgggagtagctctgtggaatggatacaaggatcattagtggctaaaaaacaacctttgacatggtacaagacaacttttagcgcaccggccggcaatgatccattggctctagatttgggaagcatgggaaagggtgaagtgtgggtaaacggtcgaagcattggtcgccattggcctggatatatagcacatggtagttgcaatgcttgtaattatgctggatattatactgatacaaaatgccggacgaattgtggacaaccttctcagagatggtatcatgttcctcgctcatggctgagctcaggtggtaactccttggttgtgtttgaagaatggggaggtgaccctaatggaattgctttggtgaaaagaacatgaagtgtgatattttatgatgctctcttaaaaggcattgacaggcaatatatatcttgtaacaaatgtctaggaaatgcaaagaagctgtcaagtgagtcctatgcggttaggaccctatgatgcagcaatttaccaaatacgtgtggtttagatcatattaggttcagtatataaaaaatatttgaagttcataattggtgctccttgtcttctggttgttcaagtatacctcaaaagattgccaaggcctaatcatgcattgcctggccaaaaacaaagatttatataagagaatttggatgcgcaaagactgtgtatactgtacatagtcaagtcaggctattgtgctgaatattgccccatgtattacagggcttgtatcaatgaagattgagcccttacacatttatttaatttactatgatacaatggaaagaattgtagacacgcaaaatgtgtcggagagtatatttgctatattctgccagaaataattgtgttttcccattataattattatgtaagaacagattgaaagtaataaaatatcctttgaaatatttgtcttgtta

SEQ ID NO: 1808 - DNA, 834 bp, Glycine max var. Williams 82
atgattgaaacatcagaagcttcagtttacggtgtgatggcaagttggctcacaccctccaatctattcattttcatcaatctcgtcattggaaccatcgccatctcctctcgtttcgccaacacgaccaaaagacaacaccagctcgtccgttctccttctttgctagaaaggcttgcgtcctttaacctttgttatcacaaacatgaaccaacaacaaggatgatgacgacgacaacaacaatgtttcacagagttgtggacccagtcgagcgtctggatgaattcagactcgaccaggtcccctcctcgtccttgttggacagggttaggtctttcaacctggggttttataagattgataatattgaaagacatggtccggtccataattctgacttgccccaactggcccagctggatcggcttccttcttcatctttgttggaccacgtcaagcctttaaatcttgagatcgaaagacctgacctggtccatagacttgactcgtcccagcttgatcgggtttcgtccatatcattgctggaacgagtcaggtcatttaatcttggctttagtaaagtcgagatggaaaagcctgattcgatacagcaacagctaacccgtgctccctcgatcctccagcggcttaagtcttccttgtcgtttgagcctgaatccgaagttaccggtggtggagagttggcggaggaaactgaagaagaaggggtggatgcaaaggctgatgatttcatcaacaggtttaggcagcaactgaggttgcaaaggcttgactctattatacgttacagggatatgctcaaacgatactaa

SEQ ID NO: 1809 - DNA, 1618 bp, Glycine max var. Williams 82
taaaataaaatataaaaatataaaattttatttacaaatttgataaatttaaaaaaataaggaggtgcaagtgcaccctcaaatgaacctaagtccgccactagttagcataataaagaataacaacacgcttttatgatgaatccgccagaccaaaaagaaacggctgaaggaaagaaaacaaacgtcaaccattactccactcaaaagactagcactcctttctatttatacacaacacaacctccacaataacaagataccattaattcctagtttcctaattcccacactaccaatctcaacaacaaccgaaaaaagtgaacaaatgattgaaacatcagaagcttcagtttacggtgtgatggcaagttggctcacaccctccaatctattcattttcatcaatctcgtcattggaaccatcgccatctcctctcgtttcgccaacacgaccaaaagacaacaccagctcgtccgttctccttctttgctagaaaggcttgcgtcctttaacctttgttatcacaaacatgaaccaacaacaaggatgatgacgacgacaacaacaatgtttcacagagttgtggacccagtcgagcgtctggatgaattcagactcgaccaggtcccctcctcgtccttgttggacagggttaggtctttcaacctggggttttataagattgataatattgaaagacatggtccggtccataattctgacttgccccaactggcccagctggatcggcttccttcttcatctttgttggaccacgtcaagcctttaaatcttgagatcgaaagacctgacctggtccatagacttgactcgtcccagcttgatcgggtttcgtccatatcattgctggaacgagtcaggtcatttaatcttggctttagtaaagtcgagatggaaaagcctgattcgatacagcaacagctaacccgtgctccctcgatcctccagcggcttaagtcttccttgtcgtttgagcctgaatccgaagttaccggtggtggagagttggcggaggaaactgaagaagaaggggtggatgcaaaggctgatgatttcatcaacaggtttaggcagcaactgaggttgcaaaggcttgactctattatacgttacagggatatgctcaaacgatactaagaactagagaagagaagagaagaaactcttggatccaatattttccccaatagttcattccttcaccaccagctgcatgaacacgagaattctgctagctagggtgttgtttgtttgtttgtaatggtatggtgttccgcaaggcttgataaaccgttgctagttctttttttcttgtatactgatttgtttgaactgattatagttcataaagtacaattaattacaattcccatactgaaaattttgtagtttgcgttacttcttacggcgaaggcataaggttacttacgttaaatttggagaaactacttataaaacagccgctagggttatcgccattttatttattcatataaagtttttttttttaatttcttgagggaaatttatatatagtttatatgtatcatatattttaactatagtaagtcatttttgctgtttgcgtggaac

SEQ ID NO: 1810 - DNA, 1635 bp, Glycine max var. Williams 82
atgcaccccatggaaagcgtcttctctctctctgtggccgcaagggctgattttatccaatttctggtgcagtcttttggctgcagttacatttgtctatgggcatatgattccatttcaccaaatcgtttgagcttcttggatggtatctacaatctaaggaacaaccaagcaagttcaagtttggggagtgtgcaggcacaacagcttttcagtcagttccggactttgacatttgatatcaatgatgaccgtgttcctggactagcttttcggaatcaacggtcataccttgagctccaacaattggaacttctcagactagcatccacagaaatacaaacacaattttttcaggaggcaaggattaagactgctgttttcatggggtgtaacaaaggagaaattgagcttggtttcttaaatatgtcccaagttgacattcaaacaacacttaggagtttgtttcctgaagatttttccactagagtactgtcccagcaaattgatcaaaaccctccagcatcatcttcatcttctctgagatcaatctccacaggaagccctgaatactcatcacttctattcagtattccaggaacttctcaaccccacttttcacctgagacacttggagcatcatcatcatcaagactagtgccaccaatgcagccagtgccaaatagtcctcaccaacaagccattaataatattcaagcattggcacaagtcccttctctaacccaattccccacaccagaaactgaacatgatgcaatcatgagagcaatcctctatgttatatctccaacaacttctcatcatcatcataatcaacagcaccaacaaaacttgccttatagtagtaataattctcttcctgtggtgcatcctgatgctagtgcattccagaggtatagacaagacttaggctccaacaacatggtctccaatattctcagaaggcaaagcctcatgaagagatcttttgtgttctttagaaacttgaattttatgagaatgagagatcgcattcaagcaacgtctcgtcccaccaatactcagcttcatcatatgatatcagagagaagaaggcgtgagaagctaaacgagaattttcaatcccttagagcacttcttcctccgggaacaaagaaagacaaagcgtctatactgatagcagcaaaggagacattgagctctttgatggctgaagttgataaactgagcaaaaggaatcaagggttgacgtcatttttgtcagccaaagaatctacaactgaagaaaccaaggtagctagtttatcgccaaataaaagattaagtgtcataatttcacatgtacccgaatcaagctcatcagaagagagaatggtggagttgcaagtgaatgtgagaggacaagtttctcaaactgatttattaatccggttattggaattcttaaaactggctcaccacgtgagcttggtttccatggacgcaaacacccacgttgcagaagggaataatgcactacatcaactatccttcagattcaggattattcagggaagtgaatgggacgagtcttccttcgaggaagcagtgagaagagtagttgctgacttgctacagtaccaaatggaccaataa

SEQ ID NO: 1811 - DNA, 1122 bp, Glycine max var. Williams 82
atggccacatcggtgaagaacaacttcctgaaccctgcactggtttcaaatctccaacaagcactgctcagaagaaaggacagtgtgcaggagcagcagcaccacaacagggccaatgaacccaccaaagcttcttcaaaacccgtggtgctagtcaccaatggtgatggcatagactctcttggcctcacattactagttgaggcacttctttgtgatgcccttcttgatgttcatgtctgtgctccagaaacggatagatcggtttgtggtcactcggttaccacaggggagacactagctgtgtgttcagtacaagttggtggtgccaatgcttatcaagtgtctggaactccagcagattgtgtctctttggctttatctggggcattgttttcttggtcaaaacctgttttggtaattagtggactaaacaaaggaacaacttgtggttatgacacgttgtactccggagctgttgctggagctagagaggcactgatttgtggtgttccctctctttgtatatcattgaactgggaaaagaatgtgagctgtgaaagtgatttgaaggatgcagttacagtatgtttaccattaattcacgcagcaataagagatatacagaaagggattttccccaagaattgcttcctcaacatagggatcccaagctgtcctctgacaaataagggtgtcaaagtgacaaggcaaagtccgcaaagatcttctttaagttggcaagctgtgtcaacaaataagaatccttcagcaggccattacatgtctaaccagcaaagtcttggaatcatgttagcacaactaggaagagatgcctctgctgctgcagcagcgcgccgtctaaactcaaaccgcaagaatgtggaggttgaatcagttggtgttgctggaaaattcagttctcaacaaaccataaagaaatacttccgaatggagttaacagaaaaagagcagcaggacatagaggaggatttagactccagagaacttgaagagggatttgttacagttacccctttgtctttgtatgcaaatgttcacatggaaattcaatcatcagtgtccagctggctagctattgcactcagtggtgatcaatga

SEQ ID NO: 1812 - DNA, 1161 bp, Glycine max var. Williams 82
atggaagaacaagaggccgtatttcactctcggaattctggttctggttctgcttctgcttctgcttctgcatacatcatatcacaaacaatctttctctgtctgaatcgaacacacatgagtatgtctgataacgaagaccatgcagactacacggacaataattcctctgcaaagcgtaggttcagggataggtccaaggaggtattgtccaaacaagccgttaagttagccaagcaagctgaagagcatgaaaggttcatcaacaaggtgactcattttttgggggttcttggctttggttggttttgcttcatctttggggcaaggccacaagccgttcccttggtatattgcttgttctatgtcgtgtttgttcctctccgttggatatattacaggttcaagaaatggcattactatctcctggatttttgctattatgccaataccattttcttggtttacctccttttttacccaaagaatgaaaagcttttcctggtttgtttttcatttgctgaggggccattagcatgggctttgattgtttggcgttgcagcttagttttcagttcagttgacaaaattgtcagtgttcttatccatcttttacctggattggttttctttaccattcgatggtggaatcctgcaacctttgaagccatgcgaccagcgggaatggctggaagatctacatggccttatattgaggataaatcctatctctggatgtggctgtttctggtacccttagcagtttacattctctggcaggttctatacttcctcattgtcaacgtcttgcgccaacaacggtttttaagagatcctgaagtcatgacttcctacagggaactctccaaaaaagctcagaaagcaaacaatatttggtggcgcttaagtggcttacttggagatcaaaatcgcttgttaatgtacattgttcttcaaggcatatttaccgtggcaaccacggctctgactgttcccattttcttgtcatatgaattgtctgtagtcttccaattgcttaagatttctgcatcagtgtggaatgggggaagcttcctaatagatgtgatgcctaggcaagtaattctcaaggagaaaaagaaatcagagatgcaacttgttcaaaatcaaaaagatcagtga

SEQ ID NO: 1813 - DNA, 687 bp, Glycine max var. Williams 82
atgaagccatttctctttttaaatcttcccaacaccgagttcaattcttcacaagttgattgtaatcactcaatggctcattcttcttatccctacggcgatccaatttttgcttatggaccacaagctattagtcatccccaaatgatacccccgatgctgggactagcatccaccagagtggctttgccacttgatcttgcagaagatggaccaatttatgtcaatgcaaaacaataccatggtatactgagaaggcgtcagtcacgagcaaaacttgaggctcagaacaaacttatcaaaaatcgtaagccatatcttcacgagtctcggcaccgccatgctttgaatagggttaggggatccggggggcgatttctcagcaccaaacagcttgcacagtctaatgcagaatttgtcactggtgcacattctggttctgaccctaccaacagatatcaaaaggaacatctatcagaggtggaaagtcattcctcaaaagatggagataattcatctttcatcacaacctgctccgaccggccatgtttatctggcaacaatgtcaattttcggcagcaggagtgcatgtttctggggaattctgcaaacatgggtggatcaccacagttcagtgggggactcacctttggcggagcaaagcagcgcacatcagttgtccggtga

SEQ ID NO: 1814 - DNA, 1392 bp, Glycine max var. Williams 82
atgacccttatgaaaatcctatggaaatcactcttccccggttgttacaagggtgaatatccctctccaaagccaaagaaagtggtggctacaaagccaaattcttcacacaggatttctgtgacggatttgagttatccaagcacgactctttcggaggatctctctatttctctagcggggaccaacctccatgttttctcaatcgctgagctcaagattatcactcaacaattctcttctagcaattttcttggagaaggtgggttcggaccggttcataaggggttcattgatgacaagcttaggcatggcctcaaggctcaacccgtggctgttaagctcttgaacttggatggctcgcagggccacaaagagtggttgactgaggttgtttttctggggcaacttaggcatccacatctcgtgaagctgataggatactgttgtgaagaagaacacagggttttggtgtatgaatatttaccaagaggaagcttggagaatcaattatttagaagattctcagcatcacttccatggtcaacgagaatgaaaattgctgttggagctgcgaagggcctagcctttcttcatgaggctgagaagccagtcatctatagagatttcaaagcttccaacatcttgttagactctgattacaatgcaaagttatctgattttgggttggcaaaagacggtcccgaaggagatgacacccacgtttcaacccgagttatgggtacacacggctacgcagctccagaatatgtcatgacaggtcacttgacagcaatgagtgatgtgtatagttttggagtagtgctattggagctgttaacaggaagaaggtcagtggacaaaaaccggcctccaagggagcaaaacctagtggagtgggcaaggccaatgctaaacgattcaaggaaactcagcagaataatggatcctagacttgaaggccaatattcagaaatgggaacaaaaaaagcagcagcattggcataccaatgcctcagccacaggccaaggagcagaccctcaatgagcacagtggtcaagacccttgagccacttcaagattttgatgacattccaattggaacatttgtgtacacagctccaccagataataataatgaagtgcagcataaggatcaatgtgagacacctaagaggagggaaaataataataatggtcacaatattcataggaatggccacaggcatcatccacttaaatcccccaaggccccaaggtcacaatcacaatcacaatcacagtcacatttacgtccaaatgaccacaaacacagaaatggaagaggaagtggaccaaattctcctccatcacatgtgaaaataattaggccaggagttattgcttgttag

SEQ ID NO: 1815 - DNA, 1530 bp, Glycine max var. Williams 82
atgggttccgataatcaccagaacttggagttcttgaaggagatcggtttgggctcttccaacattggctcttacattaatggccagtggaaagccactggttcttctgtcacttctgttaatccttctaacaatcagagtatagctcaagtgaccgaagcaactttgcaagattttgaggaggggttgcgagcttgcagtgaagcagctaagacatggatgactataccggcaccgaagagaggtgagattgtgagacagattggtgaagcattgagggccaaattggatcctttgggtaggctggtgtctcttgagatgggaaaaattctcccagaaggaattggggaagttcaggaaattattgatatgtgtgattattgtgttgggctaagcagacaattgaatggatcaattataccatcagaacgtccagatcatatgatgtttgaggtatggaacccactaggaatagttggtgtaatcagtgctttcaactttccatgcgctgttctaggatggaatgcttgcattgctttagtctgtggtaactgtgttgtgtggaagggtgctccaacaactcctttgataactattgctgtgacaaagctagtagctgaagttcttgagaggaacaaattacctggtgcaatattcacctctttctgtggaggtgctgacattggtcaggcaatagcaaaagacactcgcattcccctggtttcatttactggaagttcaaaggttggcttgatggtccagcaaacagttaatgagagatttggcaaatgcttgcttgagttaagtggtaacaatgcaataattgtcatggatgatgcagacatcaaattggctgtacgctctattttgtttgctgctgtgggtactactggtcagcggtgtacaacttgtcgtagactgtttctgcatgaaagtatttatacagacgtactagaccaacttgttgaagtctacaaacaagtcaaaattgggaaccccttggagaaggggactctagttgggcccttgcatactcgtacttcagtagaaaactttcagaagggtatttcagtcataaaatctcagggagggaaaatcctaaccggtggatctgtattagagtcgggaggaaattttgtacaaccaacaattgttgagatttctccagatgctcctgtagttaaagaagaattgtttggtccagttctgtatgttatgaaatttcagactctagaagaagcaattgccttgaacaattctgtacctcaaggattaagtagttcaatctttacccaaagacctggaactatattcaaatggatcgggccacgaggtagtgattgtggtatagtgaatgcaaacatacctacaaatggagctgaaattggtggtgcctttggtggagaaaaggcgacaggtggtggccgtgaagcgggaagtgactcatggaagcaatacatgcggcgttctacatgtaccatcaattatggaagtgaactaccattagctcaggggataaactttggctag

SEQ ID NO: 1816 - DNA, 2433 bp, Glycine max var. Williams 82
atggcaaatcatcctttgacacactctcactctttccgcgagaggtttgatgaaactctcactggtcacaggaacgaaattttggcccttctgtcaaggcttgaagccaagggcaagggaatcctgcaacatcaccaagtggttgcagagtttgaagaaatccctgaggagagcagaaagaaactccaagatggtgtctttggagaagttttgagatccacacaggaagccatagtgctgccaccatttgtagctcttgctgttcgaccaaggcctggtgtatgggaatatctgcgtgtgaatgtgcacatgcttgttgttgatgagcttcgtcctgctgagtatctgcgtttcaaggaggagcttgttgagggaagttcaaacggcaactttgtgcttgagttggactttgaaccgtttaatgcatccttccctcgcccaactctgaacaagtccattggaaatggcgtcgagttcctcaaccgccacctttcggccaagctcttccatgacaaggagagcatgcagccactgcttgagttcctcaggcttcacagttataagggaaagaccatgatgttgaatgacaaagttcaaagcctggattctctccaacatgttttgagaaaagcagaagagtatctgatttcagttgctcctgaaacaccctactcggaattcgagaacagattccgggagattggtctggagagggggtggggtgacactgccgagcgtgtcctcgagatgatccagcttctcctggaccttcttgaggcacctgacccttgcaccctcgagacattccttggaagagtccctatggtcttcaatgttgttatcctttctccccatggttactttgcccaagataatgtcttgggataccctgacactggtggacaggttgtttacatcttggatcaagttcgtgccttggagaatgagatgctcaaccgcatcaagaaacaaggccttgatatcacccctcgtattctcattatcactcgtcttctccctgatgcagtaggaactacctgtggccaacgtctagagagggtatatgatactgaatattgtgacattctcagagttcctttcagaacagaaaagggaattgttcgcaaatggatctcaagattcgaagtctggccatacctagagacttacactgaggatgtcgcccttgaacttgccaaggagttgcaagccaagccagatctgattgttggaaactacagtgatggaaacattgttgcctctttgttagcacataaattaggagtaactcagtgtaccattgctcatgctctagaaaagaccaagtaccctgagtctgacatttactggaaaaaatttgaagagaaatatcatttctcatgccaatttactgctgatctttttgcaatgaaccacacagactttatcatcaccagcaccttccaagagattgctggaagcaaggacactgttggacagtatgagagtcacactgccttcacccttccaggactttaccgtgttgttcacggtattgatccatttgatccaaagttcaacattgtctctcccggtgcagacatgggtatatacttcccatacactgaaactgagcgtaggttaacagaattccactctgacattgaagagcttctttacagctcagtggagaatgaggaacacatatgcgtattgaaggaccgcaacaaaccaataatcttcaccatggcaaggcttgaccgtgtgaagaacatcacggggcttgtcgagtggtacgggaagaacgcacgcctccgcgagttggtgaacctggtggtggtggctggagacaggaggaaggagtcgaaggacttggaagagaaggccgagatgaagaagatgtatggcctcatcgagacctacaagttgaacggccaattcagatggatatcctctcagatgaaccgtgtgaggaacggagagctctaccgtgtcatctgtgacacaaggggtgcctttgtgcagcctgcagtttatgaggcctttgggttgactgtggttgaggccatgacttgtgggttgccaacgtttgccacatgcaatggtggtcctgctgagatcattgtgcatggaaaatctggttaccacattgatccttaccatggtgaccatgctgctgagatccttgttgagttctttgagaagagcaaggctgatccatctcactgggacaaaatctcccagggtggactcaagcgtattcatgagaagtacacatggcaaatttactcggacaggctcttgacactcactggtgtgtatggcttctggaagcacgtgaccaatcttgaacgccgtgagagcaaacgttacctcgagatgttctatgctctcaagtaccgcaaattggtatatttctttcattattacactattcaatggcttcatttatga

SEQ ID NO: 1817 - DNA, 483 bp, Glycine max var. Williams 82
atgttagcttcttctctctccttcctccattcttgttcatcttcctctttcttattgtcaatttcacttcctaatcccaaaccctctcattccctacctttcgtgctcgaagccaaagacaggacccgtagggaagacaggtccgcgcgccacactcgcatcagaaagaaggtcgaagggacacccgagaggccgaggctgtccgtgttccggtcgaacaagcatctctctgtgcaggtgatagatgacaccaagatgcacacgctcgcttcgatttcgacaatgcagaagacggttgctgaagagttcaactactccgctggccctacacttgaagtagcaaagaggatgggtgagatcattgcgaagtcctgtttagagaaggggatcacaaaggtggcctttgatcgaggtggatacccataccatggccgtgttcaagcactcgctgaagcagctcgtgaacatggcctagatttctaa

SEQ ID NO: 1818 - DNA, 1752 bp, Glycine max var. Williams 82
atgaaacaagagtcaccagcctcaccactgccatcgtcgcttccacaaccatcaccaacaatgacaacaacgaaaaatgtgatcaagcttcagaacagtttaactccatcacggttaaggcttccttccaagtacagagagccgccaaagactccaccagaggttgttgtcaacaatgtggtggtgtcaacaccatcaaggagagccaagtctgtgactccagagttgaagcacaattcaaggatcaaaaggggtcttgtgctgaacaaggccaaacccaatgaagaggttgtgggaacaactcaaaggggtagggaagctgaagagactaaggttgtcgctcgtttcgtgagacctcatgttgtggaacaatttgctaggccaaggaatggggctggggattttgctttcaagagggacaaggaggactctgatgagaagagtaagaaagaattgatggagaagctcgaggcgagtgagagtttgatcaagaatctgcagtctgaagtgcaggctttgaaggctgaattggagaaagttaagggcttgaaagtggagctggagtctcacaacaggaaactcactgaggatcttgctgctgctgaagtaaaggtggtgtctttgggtggcaatgagaaggagccaaatggagaacatcagagccccaagtttaaacacattcagaaactcattgctgacaaattagaaaggtccattgtgaaaaaggaagccattgcaaatggagggtttgttgaagcatcaattccaccaccaactgcaattcctgccattcctgatgccccaactgcaaggaaaggaagaaaacccactcccaactcgtgcctgccgccacctccaccacctatgccaccatcaatcccttcaaggcctatagcaaaagcgagtaacactcaaagggtccctgcatttgtgaaactatttcacacattaaagaatcaagaagggatgaaaagcacaacagggacagttaaacagcagaaaccggtatctgtcaatgtacacagcagcattgttggagaaattcaaaaccgttccgctcatcttttagcaataagggcagacattgaaacaaaaggagctttcattaatgacctgataaaaaaggtggtagaagcagcctacacggatattgaagatgtcttaaattttgtcaattggcttgatggtgaactctcgtcattggctgatgagcgtgcagtcttgaaacattttaattggcccgagaggaaagctgatgctatgcgtgaagccgcagttgaatatcgcgaacttaaattgttagaacaagagatttcgtccttcaaggatgacccagaaattccatgtggagcttccttgagaaagatggccagcctattagacaagtctgagagcagcatacagagactaatcaagttgcaaaattctgcaatgcgttcatatcaagagtacaaaattccaactgcttggatgcttgattcaggaatcatgaccaagataaagcaggcttctatgattctggtcaagatgtatatgaaaagagtgacaatggagcttggatctgctcggaactcagacaggtctagtcaagaatcccttctgcttcagggcatgcattttgcatatagagctcatcagtttgctggtggtctggatgcagaaactttgtgtgcttttgaagagataaggcaacatgtaccaggacacttggcaggttctcgagaacttttggctggcatagcatcatcatga

SEQ ID NO: 1819 - DNA, 561 bp, Glycine max var. Williams 82
atggaggaagttaatgtggttcaaaccaagaatggaactgtttcagtagcttctgcgtttgctggccataaggaagctatacagcaaagggaccacaaatttttaagaattgctgttgaagaagcgtataaaggggtagactgtgaagatgggggtccctttggtgctattatagtttgtaatgatgaaattgttgctagatgtcacaacatggttctgaggaacacagaccccactgctcatgcagaagtcactgtaataagaaaggcttgtgaaaagctaaaccagatagaactttcagactgtgaaatatatgcttcttgtgaaccttgcccaatgtgctttggagcaatccacctctcacgagttaagaggttggtttatggagcaaaggcagaggcagcaattgctattgggttcgatgacttcatttcagatgcattgcgaggtactggattctatcagaaggcacaattggagattaaaagggctgatggcaaagaagctaacattgctgaagaagtttttgagagaacaaaggaaaaattccgaatgtattaa

SEQ ID NO: 1820 - DNA, 1662 bp, Glycine max var. Williams 82
atgtgcttcatttattgggatgagaatactataacaaaatgcagtgcttatttctccaaacttttttccccctatttttcttctgggaaatgtactcctgttgcctctcatttttcagctatttctgtatatggtagcaacagcaaaatggcatctgatctgaattcggggttgtccaagaaaacatttgtttttggattgaaagtgtgggtactaatgggaataatagttggattattcatcataatcattctcgtggtgctatcaatatgtctcactttacgaaagaagttcagaagagtcaatggcaagcttccacttagccatgtgatatctgtttcagacgagatcaaagaaatcaaagttgatcaagtttcagcaaataatcatcctcaaaatggtgtttttaagagtctgaatgacaaatttggtgacagggagtctgaaaaggttttgaaccaaacaatgaatggggataatagtagtcaatcaggttcatttaatcatttagagaaagatgctaatggctctcaatcaggtgaagactgccgtgttaagagcatttctgcttacagatcttcttcacatcctataaccgcaccatcccctttgtctggtctgcctgaattctctcaccttggttggggccactggtttacattgagggacctggaacttgcaacaaacaggtttgcaaaagataatgttattggtgaaggtgggtatggaattgtttatcgtggtcaattaatcaatgggaatcctgtggccattaagaagctcctcaataatttaggacaagctgaaaaagaattcagggtggaagttgaggctattggtcatgtgcggcataagaacttggttcgacttttgggctattgcattgaaggcactcacaggttgttgatttatgagtatgttaataatggaaatttagagcagtggcttcatggagccatgcgacaacatggctttcttacttgggatgctcggataaaaattctccttggaacagctaaagcgctggcctacttgcatgaggcaattgagccaaaagttgtgcatcgagatattaagtcgagcaatattctaattgatgaggactttaatgccaaaatatcggactttgggttggctaagttacttggagctggaaaaagtcatattacaaccagagttatgggtacttttggatatgtagctccagaatatgccaattctggcttgctaaatgagaagagtgatgtttatagctttggggtattgctccttgaagcaattacaggaagagaccctgtggattatagccgaccagcagctgaggtaaatttggttgactggctcaagatgatggtggggtgtcgatgctcagaagaggtgttggatcctaacattgaaactaggccatcgactagtacccttaagcgtgccctcttgactgctttgaggtgcgttgatccagatgctgaaaaaagaccaaggatgagccaagttgttcgcatgcttgaatcagaggaatatcctataccgcgagaggatcgaagacgccgaaggagtcaggcaggaaacatggaggtagagactcatagggagaactctgatactgataagagcgacaatccagattataagcccagtggcttaaggaaccaacgcgtgtag

SEQ ID NO: 1821 - DNA, 1746 bp, Glycine max var. Williams 82
atggaaggaggagtgcctgaagctgatatctctgcctttagagaatgtttgtctctatcatggaaaaatccttatgttcttcgccttgctttctccgctggaattggaggctttctctttggctatgacacaggagtcatatctggagcacttttgtacatcagagatgatttcaaagaggtggatagaaagacgtggctgcaggaagctatagtgagtatggcacttgctggagcaatcataggagcttcagttggtggatggatcaacgatcgatttgggagaaagaaagcaatccttttggcagataccctcttttttatagggtctattgtgatggctgctgctataaacccagctattctgattgttggtcgagttttcgttggccttggggttggaatggcctcaatggcctcacctttgtacatctcagaagcatcaccaacaagagttcgaggtgcccttgttagtctcaatggattcctcatcactggaggacagttcctttcctatgtcatcaacttggccttcacaagcgcaccaggaacatggaggtggatgttaggagtagcagcagtaccagcattgacacaaatcatattgatggttttgctcccagaatcacctcgttggttgttcagaaagggtaaacaagaagaagccaaagaaattttgaggaggatttaccctccccaggatgttgaagatgaaatcaatgctttgaaggaatcaattgaaacggaactcaatgaagaagcttcagcttcaaacaaagtcagcataatgaagctgctgaaaaccaaaactgtgagaagaggtttatatgctggaatgggccttcaaatcttccaacaatttgtggggattaacactgttatgtactacagccccacaattgtgcaattagctggttttgcatcaaatagggttgcactacttctatcacttgtcactgcagggcttaatgcatttggttccattttaagcatatatttcattgacaagactgggaggaggaagcttttgttgtttagtttgtgtggtgttgtggtctcacttgttgttttgaccgtggcttttcatgagactaccactcactcccctatggtcagcacaatcgaaacctctcacttcaacaacacatgccctgattacagcactgctttcaaccctggtgaatgggattgcatgaaatgcctcaaggcctctccagaatgtggcttttgtgcctctagagctaataagctcttacctggggcatgcttgatttccaatgacacaacagaaaatcaatgtcaaaaagaggacaggctatggtacactaggggatgtcctagccaatatggttggcttgcattagttggcctagcactctacatcatattcttctcacctggcatgggaacagttccatgggttgttaactctgagatctatcctctaagatacagaggaatctgtggggggatggcatctacctcaaattgggtctctaatctcattgtggcccagtcctttctgtccttgacacaagccattgggacctcatctacattcatgatattcatattcatcactgttgcagccattgtgtttgtcattatttttgtgccagaaaccaaaggacttccgattgaggaagtggaaaacatgctggaaagaagatctttgaacttcaagttttggcagacaagtcctgactctaatgatataccaataaagcagaagaatcagtcagtttga

SEQ ID NO: 1822 - DNA, 426 bp, Glycine max var. Williams 82
atgacgaagctaaacttatccaatgagaagctcactaggaagaacaacggtggggaggaagctgaccgggaagaacagcggcggagaggaagctcactaggaagaacaacgccaccgcgtgcggcaacccacctctatccctttcacgaagaattgcaattccatcttttgttggaagtggtggagctcagcgagaacgcactcaccggaactgtggagtcgtggttcttccttttgtcgtcattgcagcaagtggacttggccaacaacaccttcacgggggtgcagatcttgaggccacttgcaatgcgtgcgggaggcagcagtagcagtggccgtagcaaccccgttgcgctaaacctcaggtttaacaaaatccaaggctatgtcaagtttatgaagaggttgttcctggatgaaggttga

SEQ ID NO: 1823 - DNA, 399 bp, Glycine max var. Williams 82
atggcaacaaccactgtgatcatgaccactctcccccaattcagtggtcttagacctcaattctcagctgcccctgtgaagaacttggttgctgtccaacaacctatgaggcccaaggggaagggtgctttgggagctcgatgtgactacattggttcatccactaatctgattatggtggcttctacaaccctgatgctgtttgctggaaggtttggattggctccatcagcaaacaggaaagccactgcagggctaaagctggaggtgagggactcaggcttgcagactggtgaccctgctggcttcacccttgctgacaccttggcctgtggatctgttggccacatcattggggttggggttgtccttggtctcaagaacattggtgccctgtaa

SEQ ID NO: 1824 - DNA, 882 bp, Glycine max var. Williams 82
atggactggttctcctggctatccaggaccagcctagagccatccctcatctacgaatacggcctcgccttcgcgcgcaacgagctccagctggaggatgccatctacttcaaccacgagtttctccagagcatgggagtttccatagcaaaacacaggctggaaatcatcaagctcgcaaagaaagaagttggtggcggtggggcggtgatgatgatgaggagcagcagcagcatcaagttttctatcaagaagtgcctgaggaagtgcttcagcaagctcgtttcgcgtgaagatcaccacgaagcgatgatggcgacaacagcgatgatggcgaccgagccgaattggtaccaagggaagtggaggagggcaaggcacaatgggaacaatgaggatctcaagggagataataataataataataataataacaataagggagttcaaagaagtagaactattgcattatcagggcctttggatgggaatggaagaataattcacgagaagatgatgaacaacaacaaggtgatgaaactatctggtcctcttgatgggaaaatgaatggtggtaacaatgagagagtgaatatgtatgcaagtgcaaatagaagtccattgatgagtgctaatacccctactaggcctcttgatggtaggttcatgggctcagtaaagagccctaggctttctgggccacttgatgcaagaccaaccatggttaatagtagaagcccaaggttaactaggcctttagatgataggactgagagcccaatgggttatagtccctacaataaggtcagagctgatgctgctgattatgatgatgattatgcaatgtggcctacattgtttgaggatcttaaaccaacttag

SEQ ID NO: 1825 - DNA, 324 bp, Glycine max var. Williams 82
atgaagaaggtttcagccttagcattttccattctctttttggccttcaccatagaaccctttattggcattgctgaagcagcaccagaagtagtgcttgacacctcaagtcacaagctgagaataggtgtcaagtactacattctgtcagtgttcaaaggcaaaggtggaggcctaacaatttcaagcagtgacaacaacacatgctcgttctttgtgagaagcttgaagtctcaaaggcacccagttaccttcacaccctacaatgccaaaagtggtgtcatactaacctcaatcgatctcaacatcaagtcttatccttga

SEQ ID NO: 1826 - DNA, 2466 bp, Glycine max var. Williams 82
atggccattcctcttgtaatcctacttatttgcaagctattatcactcttctctcaaatctgctacgcaacgacggacaccatcaccaagggtcagccactccctgatgatggcaacaccttgctttccaaggacggaacctttgagttgggtttcttcaaccccgggagttcaaataaccgctatgtcggaatttggtacaaaaacattgtggtcaaaacagtggtttggatcgccaaccgtgacaacccaatcagaaacaactcaagcaagttggtcataagccaagacggaaacctcgttcttcttagccagaacgagtctcttatttggacaacaaatgcatcatcatcagaagtttcgagttcgagtccaattgtgcagctcttggatactggaaacttggtaattaaagatggtaatgacaaagagagtgtttttctgtggcaaagctttgactatccttgtgacacactattgccaggaatgaagtttgggtgggacttgagaactgggcttaaccggcgtcttacttcttggaaaagctgggatgatccatcttcaggggactttacttggggggtggaaataggaagcaatcctgacattgtgatgtggaagggtaacgttgagtactttaggacggggccttatactgggaacatgttcagtggagtatatgggcccaggaataacccactttatgattacaagttcgtcaataacaaagacgaagtgtattaccaatacaccctcaagaatagttcggtgattactatgattgttatgaaccaaacactttatcttcgtcaccgccttacatggattcccgaggccaaatcttggactgtttaccaatcattgccacgagatagttgcgacgtttacaacacttgtggtcccaatggaaattgcatcattgctgggtctccaatttgccagtgcttagatgggttcgagccgaaatcgccccaacaatggaacgtgatggattggaggcaagggtgtgtgcgcagtgaagagtggagttgtggggtaaaaaataaagatggttttcggagatttgctagcatgaaattgccaaacactacgttttcttgggttaatgaaagtatgacacttgaggagtgcagggcaaaatgtttggaaaattgttcgtgcaaggcctattcaaacttggacacgaggggaggaggtaatgggtgttccatttgggttggtgacctagttgatttaagagttatagaaagtgggcaagatttgtatgttcgaatggccacttcggacatggatggtaaacacgagcatcggagaaaggtagtcttggtggtttcaactatagcatcgttggtgcttgtgatgctagtagcattctgcatttacatgatcaaaaaaatatataaagggaaaacaaaaacaagaatgtcaagagaggataaagacgaaggcagacaagaagatttggagcttcctttctttgatcttgctacaatagttaatgccactaataatttttcaatcgaaaataagctaggtgaaggtggttttggtcctgtatacaagggtacattagtaaatggacaagaaattgcaatcaaaaggctttcacgaagttcaggacaaggattgaaagaatttagaaatgaagttatattgtgtgccaaattacaacaccgaaatcttgtcaaggttttgggctattgcattcaaggagaggagaaaatgttactttatgaatacatgcccaacaaaagtctcgatttatttctttttgattcggagcaaagtaaattcttaaattggccagtgcgctttaacattttgaatgcgattgctcggggacttctttatctccatcaggattctagattaaggatcatacacagagatctaaaggcaagtaatattttattagacaataatatgaatccaaaaatttcagattttggccttgcaagaatgtgtggaagtgatcaagttgaagggagtacaagcatcatagttgggacacacggttacatggcacctgaatatgccattgatggattattctctacaaaatcagatgtgttcagctttggagttttattgctagaaattattagtggaaagaaaaacagagcatttacctaccaagacaacgatcataatcttattgatcatgcatggagactgtggaaagagggtactccagagcgattgactgatgcacatttggcaaactcatgtaatatatctgaagtcatacggtgcattcaaattagtcttctgtgtctacaacatcatccagatgataggccaaacatgacatcagttgttgtgatgttgaccagtgaaaatgctttacacgaacctaaggaacctggttttttaattagaagagtttcaaacgaaggagaacaatcttctaataggcagacatcttcattcaatgaagtatctatctcacttttaaatgctagataa

SEQ ID NO: 1827 - DNA, 1233 bp, Glycine max var. Williams 82
atgtcggagagtggtaggggacaccacggcgccaccgccgagactggcagaagggaacagttcatgacggagaatgttgccggagactcgtcgtcgtcattgtcatggagactcaacgtgaaggagtttcagttgccacgcttaagtcatagccatgatcatcatcatcaacacctccctagttacttcactttccgtgaccttctacggaaaccaaagaagcaacgcaaggttgcagaatactacaagaaacaagagaggctccttgaagggtataatgacatggatacaatgactgaaactggttgttttccaggaagtctcactgaggatgaaatgaagcaattagcaagaagtgagagcctggcagttaatgtgtcaaatgcagctaacttggtgctatttgcagcaaaggtttatacttccattgagagcagatcattagcagtcattgcttccactatggattctctcttggatctcttgtcagggttcatattgtggttcactgcttatgccatgagaaatccaaaccagtatcactaccccattggaaagaaacggatgcaaccagtgggtatcattgtttttgcatcagtgatggcaacattgggattgcagattttgattgagtctggccgacaacttatttcaaagtctaagcctgaaatggatccccatgagttgaaatgggtgatcgggattatggcatctgttactgtagtgaagttcattctcatggtctactgtcgaaggtttaagaacgaaattatcagagcttacgcacaagatcatttttttgatgttattaccaattcagttggattagttgctgctatgcttgctgtcaagtactcttggtggattgatccaatgggagctattattatagcagtgtacactattaatacatgggccaagacagtgattgagaatgtatggtctcttattggaaggacagcgccacctgaatttctagcaaagttgacatatctgatatggaatcaccatgaagaggttaagcacatagacactgtgagagcatacacgtttggtactcattactttgttgaagtagatattgtgttgccggaagatatgccactcaatcaagcacacaacattggtgagacattgcaggagaaattggagcacctttctgaagttgaaagagcctttgtgcacattgattttgagtatactcacagacctgaacataagatgatggtatag

SEQ ID NO: 1828 - DNA, 669 bp, Glycine max var. Williams 82
atgcaggcagcaaagaaagccatagagacctttaaggaaaccgcagccaacattggcgcctctgccaagtctggcttggagaaaaccaaggccactatccaagagaagaatgagaagatgaatgcagaagatcaaactcaaatggatatggctaccaagaggaaagaagagaagatcaaccaggctgagatggagaagcagcaggcccgtaagtactacgccgctgcaaaacaatacgccatggctgagcacatggcaaagggcaaccacgacaccgccgggcctagaatcgagactgccacacacatcaccagtgggcccgggactgacaatgctatgtactctaacactgggcctgggactgagactgccacgtacaccactagtgggcttgggcatgacaatgctatacccaccagcactgggcctgggactgccacatataccacaaggcctgggcatgacaatgctatacccataagaactgggcctgggcctgggcctgagactgccacctaccccactggtgactatggacaaatgggggctaaccagggccatgagcatggacccaggcaaggaggactcactgaagatgtaacggcccaaaatacccttgttgcaggtggcagtgctccttcaagtgggcctgggcctactttcaattga

SEQ ID NO: 1829 - DNA, 1314 bp, Glycine max var. Williams 82
atgaagagctcaaataatcaacacccattaaattctgtttcaaagcattttaatctccagcttgttcgcttccttccctatctcctctttttggcctttggtgtgaccattggtatcatcatcagcttctacctcaaaagctttagtcttcagcacactcaattcttacactcttcatcatcacagattaatgcaccaccaccaaatacaatgcccccaccaattgaaaaaccagaagtatctgattctaacctcaatcaagaggggccggaagaatttactccaccttctaatgttgtgcataatacacaagagtctattcagccttccatcgttgtgcatgataccaaaaagtttattcagccttctaatcatgttgtgcataacatgaaagagtttattcatccttctaatgttgtgcatgatatgagtgatgaagaactattatggagagcttcaatgacccctaagatcagagaatacccctttgatcgagtcgccaaggtggccttcatgttcttggtaaggggtcctgtgcctttggctattttttgggaaaggttcttcaaagggcatgaaggatactactctatttatgtacattccaatccttcttacaatggatcagacccggagagttcagtgtttcatggaaggagaattcctagtaagatagtggaatggggaaaattcaacatgattgaagcagagcgtcgccttctggcgaatgcccttcttgatttctcaaaccaacgttttattctgatatcagaatcatgcatccctctattcaacttctcaacaatctactcatatttgatgaactccacccaaagctatgtgatggcttatgatgaagatagtctagttggacgtggacgttacaaccctcgcatgtcccctatggtcaccctcaagcaatggagaaaagggtctcaatggttcgaaatggacagagaacttgccctagaagtggtgtcagacaaaacctacttcccaatttttcaagagcactgcacgagaccatgctatgctgatgaacactacttgccaacatttgttaacataatgtttccggagaagaattctaataggagtttgacttgggttgactggtcaaagggtggcttgcacccaactaaatatgtgagaccagaggtcactgtggcgtttttggagaatttgaggaaccagaaatgtgagtataatggacaagcttacacaaatgcttgttttctctttgcgaggaaattcttgcccacttctttgacaaggctcatgaggttttctccaagtgtcatgcacatacaatga

SEQ ID NO: 1830 - DNA, 1905 bp, Glycine max var. Williams 82
aaagccacaactccatgtgaaggctctcacagccccttgagcataaatttgaaccatacaaggctttgacagattaccttaatctctctatgtctataaatattacatagcgcgctctccctttctcttacacacgttttcaggtgtccatctctttttttagatcagttttacctttagtgagatactttatttctgaccttttttttgttttattatggtttatggctctttacacattttgattagaagataagtatgcttctgattttgttctcctaacttgactttgaagtattacaccttacacctgttccataatccataaacagatctatactaaacctcttcttataatcattcttctttaggaatatatatccactttagtacttgttagcctttcttgacaagaaaacccttttaaacctttcttatattcttattgttcttcatacccaaataacaaaactagggaacttgtctttttacaataattctttcagcttacaaaaatgaagagctcaaataatcaacacccattaaattctgtttcaaagcattttaatctccagcttgttcgcttccttccctatctcctctttttggcctttggtgtgaccattggtatcatcatcagcttctacctcaaaagctttagtcttcagcacactcaattcttacactcttcatcatcacagattaatgcaccaccaccaaatacaatgcccccaccaattgaaaaaccagaagtatctgattctaacctcaatcaagaggggccggaagaatttactccaccttctaatgttgtgcataatacacaagagtctattcagccttccatcgttgtgcatgataccaaaaagtttattcagccttctaatcatgttgtgcataacatgaaagagtttattcatccttctaatgttgtgcatgatatgagtgatgaagaactattatggagagcttcaatgacccctaagatcagagaatacccctttgatcgagtcgccaaggtggccttcatgttcttggtaaggggtcctgtgcctttggctattttttgggaaaggttcttcaaagggcatgaaggatactactctatttatgtacattccaatccttcttacaatggatcagacccggagagttcagtgtttcatggaaggagaattcctagtaagatagtggaatggggaaaattcaacatgattgaagcagagcgtcgccttctggcgaatgcccttcttgatttctcaaaccaacgttttattctgatatcagaatcatgcatccctctattcaacttctcaacaatctactcatatttgatgaactccacccaaagctatgtgatggcttatgatgaagatagtctagttggacgtggacgttacaaccctcgcatgtcccctatggtcaccctcaagcaatggagaaaagggtctcaatggttcgaaatggacagagaacttgccctagaagtggtgtcagacaaaacctacttcccaatttttcaagagcactgcacgagaccatgctatgctgatgaacactacttgccaacatttgttaacataatgtttccggagaagaattctaataggagtttgacttgggttgactggtcaaagggtggcttgcacccaactaaatatgtgagaccagaggtcactgtggcgtttttggagaatttgaggaaccagaaatgtgagtataatggacaagcttacacaaatgcttgttttctctttgcgaggaaattcttgcccacttctttgacaaggctcatgaggttttctccaagtgtcatgcacatacaatgatgttagttggctgttgctatttgcgccaaagcaaaattgttactaaacgaataataatattcaattcattcttttc

SEQ ID NO: 1831 - DNA, 2238 bp, Glycine max var. Williams 82
atgaacccaaaacagctcctcctcctcttcttttctctctttctcacaatcactttctcgttgaacgaaagatttgaagcctgcgatgccaagacatgtgggaacgggcagaacataagctacccattctacatccaaggcaagcaaaaacccttttgcgggcagccaggcttcgagctaacgtgcagccacaagggtttcccaattctgactctcatgtacaccccatacacaatccaccaaattttctacgacaaccaatctctccgagtgtccaatcccgtcttttcacaaccaaacctttcttcttgtattgccccgactcagaacctcacggtcggaaggtacagattccgagtcgctccgaaccagagggaactgttcgtgctgtacggctgcgactcagcggcgcttcagaaaacggtgccggagcggaggatctggtgttctgcggcgggaaacgaaacgacgtcggttgtggggttggataagggggatcgggatttggtttcggcgcgggagagttgtaagggtggtgctgtgaatgcgacggtggatgatttgaaaggaggggttagagaggcgctgcagagagggtttttgttgctttggaatgcgactagctgcagcgagtgcaagagtagtggagggaggtgcggcttcgacatcgaccctcgtgtctatgcttttaggtgttactgtcctgataggcctcatgctgtcaaatgtaccaatacaggtacaaaggggttgagtaaggcaggaaaactagtcataggtttaagtgttgtaatcctatgcatgttgatgattgggttgctcctacattgcaaaagaaaacacagttcctcaagtggtcaattccaaacaagaaatactttttctattccctcctcaccaaatgcagaagtcgaaagtggcagtgtgtactttggagttcctctcttctcctacaaggagcttgcagaagcaacaaaccgttttgaccttaataaacaaattggagatggaggctttgggactgtctacaatgggaaactcaaagatggaagggaagttgcagtgaagcacttgtataatcataactacaggcgagtagaacagttcatgaatgaaattcagatcctcacacgtttgcgccacagaaatcttgtgtcactctatggctgcacttcacgtcagagccgtgaactgctgcttgtgtatgaatacattccaaatggcacagtagccagccatctccatggggaattggcaaagcctggcttactaacgtggtccttacgaatcaaaatcgcactagagactgctagtgcattgtcttatcttcatgcttctaaaatcattcaccgcgatgtcaaaactaacaacattcttcttgacaacagtttctgtgttaaagttgcagattttggcctttcaagactattccccaatgacatgactcatgtctccacagcaccacaagggaccccgggttacgttgacccggaatatcaccaatgctaccagctaactagcaagagtgatgtgtatagctttggagttgtgctcattgagctaatatcatctatgccagctgttgacatgaacaggcataaggatgaaattaacttgtcaaatctagccataaagaagatccaagaaagggcattgagtgaactggtcgacccttatttgggttttgattcagacaaagaggtgaagaggatgatagttgaggtggcagagttggcctttcaatgtttgcaacaggacagggaattgagacctcccatggatgaagtccttgaggtattgaagagaattgaaagtgggaaggatgagctaaagcatctagaagaagcagttcatggttctggttctggggtttcacataatgtaacaacctcatcattggatgaagctggattgttgaagaataggaagccaccttcttcaccaatatccgttactgatagttgggaaagttctacgaatggttcaagctctgacaaacattcacctgacggtggaggaacaacatcacggccactatccttcaaggatatgtgtctcaagaaaaaaaggaatagaagtatgtccaaaattcgatatgcagaaacaaaaattgatgtagttccatgtggagcttgtaggccttggatcttcttcatcaatgaattcctttgcttcttgaggtccgattgtagcagaatggagaaggagaaagatgaatggagacgctacttcaagtaa

SEQ ID NO: 1832 - DNA, 1782 bp, Glycine max var. Williams 82
atggtttttagaatggaggggaatgacgcggaaggcgtgataaagttggagtcatttcagagtgcatggaattatggcaaagcactgttggagacaccgtgtcggctggtggatcgggtgacgggtcggtccatggacgaggtggagttgaaggaagtgaagaagcggagcgagcacgagatgaagaaaacgctcacgtggtgggacctcatatggttcggaatgggcagcgtcataggttcggggatctttgtattaacgggattcgaggtcaagaatcacgtggggcccggtgtggttctgtcctacgttatctctggaatctctgccatgctctctgtcttttgctacactgaatttgccgtggagattcccgtcgctggtggttcatttgcttacttgagagtggagcttggtgatttcgtagcattcatagcttcaggcaacattcttctcgaatacgtgattggtggtgcagcagtggcacgctcatggacatcctacttcgccactctctgcaaccaaccctccgacaagttcctcatccaagtccacggcctcgcagcagactacagccagctcgaccctatcgccgtcgtcgtgctcgtcgtcatcggcttcttcgccgtcttcagcacgaaaggctcctcccgcttcaactatatcgcctccatagtccatgtcattgtcctcatcttcatcatagttgctggcctcaccaaagccgaagccaaaaactactccgattttctcccctttggccctcgcgggatatttcaagcttcggcagtgttgttctttgcctatgttgggtttgacgcagtttcaaccatggctgaggagacaaagaaccccggaagagacattcctatcggtctcatcggctcgatggcgtgcacgacgttcttgtactgcatgttgtccgtgacgctttgtttgatgcagaagttttcggatgttgatgagaatgctgctttctctgtggcgtttgaagctgttgggatgagttgggctaagtacattgttgcatttggggcattgaaggggatgactagtgtgctccttgttggggctgtgggacaagccaggtacctcacacacattgctagaacccacttgttgcctccatggcttgctaaggtaaatgagagaactgggacacccatctatgccacggttgttatgcttagtgccactgctattgttgcatttttcacaagccttgatattctagctaacctactttcaatctccactttgttcttgttctcccttgtggccttagccttgttggttcgccgctattgtgctagaggggtggctacacagttgaatgttgtgaaattcattgtgtgtattattctcatagtgggctcttctgttgcctcggcggtttattgggccaataccacaaaatgggttggttacaccataatggtgcctctttggtttgtgggaacagtggggatttggctattggttccactaacaaagaagccgaagatttggggtgtgccactagtgccatttttgccatcagcttctattggcatcaatattttccttcttgggtcgttggataaggcttcgtttagaagatttggagtgtggactgcgattttgttggtgtattacctgtttgtgggattgcatgcatcttatgacatggcaaagatacagaagaagcagagattagaggccaagactgagtcaaagttggatgaagaaaatgttgctccatccgtgacagggtctggtacaaataatgaagatcatatatag

SEQ ID NO: 1833 - DNA, 615 bp, Glycine max var. Williams 82
atggcttcttcaccttcctcagaaaacaaaaacctagagggagtagctggtggtgccggagagaaacccattccacttggtgagaacgttctgcagaagcatgctgcattctttgacttgaataaagatggtgtcatctacccatgggagacttttaaagggttgcgtgaaatcgggactggggttttgctgtccgttggaggtgctattttcatcaatgtgtttctcagtcagagtactcgtcccggaaagtttccatctatactttttccaattgaaattaaaaatatccaacgcggcaaacacggcagtgacactggagtctacgatactgaaggaaggtttgtaccttcaaaatttgaagaaatttttaacaagcatgcacatacacatccaaatgctttgacatatgatgagttaacggagatgataaaggcaaatagagagcctaaagatttctcaggaaggattggtagtgtggttgaatggaaaattctttacaaacttgctaaagataagagtggattactgcagaaagaaacaatccgaggtgtttacgatggaagtttatttgaacaactgaaaaaacaacactcttcaggcaaagagaagtag

SEQ ID NO: 1834 - DNA, 222 bp, Glycine max var. Williams 82
atgttatttaaattaaatttcctctactttccagatacaaggaaaaagaaaagacattttgatcatgaacggtggagggacaaatttgattccatcacattttacaaacggatgcccataaaatatcttatccttctttttggttacacaaaatatcttatccttctgccaaaagttattatccccaaaaaagaaattgtggcaattaaatacattgtctga

SEQ ID NO: 1835 - DNA, 879 bp, Glycine max var. Williams 82
atgaaaacccctaacaaagcctcattactcttattccctctcttgtccctttccttatttatcaaccattcccatgcagcaggaatcgctgtgtactggggccaaaacggtggagaaggcaccttagcagaagcttgcaacacaggaaactaccaatatgtgaacatagccttcttgtccacttttggaaatggccaaaccccacaactcaaccttgctggtcattgtgaccctaacaacaatggttgcacagggttgagcagtgatatcaatacttgccaagaccttggcatcaaagtgttgctctctcttggaggtggtgctggaagctactccctcagctcagctgatgatgccacacaacttgcaaactacctctgggagaatttccttggaggccaaactggatcagggccattaggtgatgttatcttggatggcattgactttgacattgagtctggtgggagtgaccattatgatgacctagccagggcactaaacagcttcagctcacagaccccacagtgcataatccctgatgcacacttggatgctgccatccaaactgggctctttgactatgtgtgggttcagttctacaacaacccttcatgccaatactccagtggaaacaccaacgatttgatcaattcatggaaccagtggatcacagtgccagcttctctagtcttcatggggcttcctgcatctgaagcagctgctccaagtggtggctttgtgcctgctgatgtgttaacctctcagattcttcctgtgattaaacagtcttcaaattatggtggagtcatgctttgggacagattcaatgatgtccaaaatggttatagtaatgctattattggaagtgttaattaa

SEQ ID NO: 1836 - DNA, 672 bp, Glycine max var. Williams 82
atggatacttctcatcctctttctattgaaagcttctcttacagctggttagtgaacctgaagccatcactagaaagccttgatggctcccttagaacttcccttgatgcttctgatgaagcttcttccttcattgaaatggacccaagaatgccaccttctaaaagattcttcagaaactcccaagatttcaaatttgacttcccaatttcacaatcccctctcactcttgttgatgctgatgagctcttctccaatggctacctcatgcccctttttgttgagtcattgaagatggaagcatttgaggcctcagatgccaatccaaccctaccttcctcatcacatgtgccaaaaagtgcggttccaaatggtcattctagatgcccttcattgaaaaggtgcagaacattatcaaggagaatatttcgcaagtacctcaacttcttaaggcccttgtgtagaagattgaggagtggcaaatcaggctcaaaacctgaatctgttgttaagagaactgagtcagcaaagaataggggatactattctgaaacatcaccacggattagtgtagcttattctgctgatgactggcgcaagtcctgtgattctgaaagctcaatttatgaagcagttctccattgcaaaagatccattgaaagaatgaattaa

SEQ ID NO: 1837 - DNA, 1783 bp, Glycine max var. Williams 82
ctgaagttagaagatatgctgcataagaagagaggcttaaggctttttctttacactgtccaaattgtgaattatttcaagaattccttccacaccttcaaagttacaagccatggatacttctcatcctctttctattgaaagcttctcttacagctggttagtgaacctgaagccatcactagaaagccttgatggctcccttagaacttcccttgatgcttctgatgaagcttcttccttcattgaaatggacccaagaatgccaccttctaaaagattcttcagaaactcccaagatttcaaatttgacttcccaatttcacaatcccctctcactcttgttgatgctgatgagctcttctccaatggctacctcatgcccctttttgttgagtcattgaagatggaagcatttgaggcctcagatgccaatccaaccctaccttcctcatcacatgtgccaaaaagtgcggttccaaatggtcattctagatgcccttcattgaaaaggtgcagaacattatcaaggagaatatttcgcaagtacctcaacttcttaaggcccttgtgtagaagattgaggagtggcaaatcaggctcaaaacctgaatctgttgttaagagaactgagtcagcaaagaataggggatactattctgaaacatcaccacggattagtgtagcttattctgctgatgactggcgcaagtcctgtgattctgaaagctcaatttatgaagcagttctccattgcaaaagatccattgaaagaatgaattaaggatgctgcaaaagggttgcatttggagatcaaaaaatgaaaaagaaaagagaagataaagggaaaagagagagatgatcaaggctaaaccaccatgagcaactcctctgctccattgaccattatcctctgcttgaatgataaaggaatgttaataggaaataaagatgtggttggccaggcattttcaagctttatgatcaaatcctgaaagaagaaaaaaacatagtacaattttgtctgttcatctaatttaatatgagaaggaacacttttactacagatgagaatctgcctcctatttcagtaaagttcttattcaactgattttggaatcagaaatgtgtgctacaaaacaaattatgtacatatgattctaataacttggtatatatcttatctcctatgttattgcctccctattccataaacacgatctatgacatgccttgaaagagagggtttttgattttctctttctccctctctttctgtctctctcttcttgttctcttgtgtgtgctgggtgtgaatagacggtaagaaaatggtaagagggaaaaagttttttctgagagaagtgatctaagaaagtgaggagtttgaaaaatcctctgcaagcttgacaggcttgtcacttatgcaaatttcaaggtaatgatgaagaaacgacacttaaggagacaaaatctgacgacaaatgtgcggagccattgaattctatgtggacacttttagcacaaattcataataaatctaatgatgtagaaatgagtgatttttttttaattttcttttatttgtataccctcaattattattattattacaacgttaatttgagaaattgagtgttgtttctagcaaaaagttgcaacagggaaaatgtggagtgagtgtctatcaaattagtagccttacagagtgacggatccatgctttcttgaggggtgtacttgcatcttttacttttaaaaagttaaatataaatatattata

SEQ ID NO: 1838 - DNA, 1407 bp, Glycine max var. Williams 82
atgaaagactccatagttctatacccagcattagggaggggacacctagtttccatggtggagctaggcaaactcatactaacccaccaaccttcactttccatcacaatactcatcctcactccaccctccaacaccccttcgacacccaagggttgtgactccacctcccaatatatcgctgccgtcaccgccgcgacaccctccatcaccttccaccacctccctcccactcaaatccccaccattctcccaccccacatcctctccctcgaactctcccgctccagcaaccaccacctcccccacgtcatcacctccctctccaaaacactaaccctaaaagccatagtactagacttcatgaacttctgcgccaaacaagtcactaacgcactcaacatccccactttcttctactacacttccggcgcttcatctcttgcaacctttctccaactcccagtcattcacgaaaccacaacaaaatccatcaaagacctcaacacgcatttaagcatcccagggttaccaaaaattgaccttttagatcttccgaaagaagtgcacgaccgtgcgagtcagagttataaactattccacgacatagcaacatgcatgagggacagtgacggggttattgtaaacacgtgtgacccaattgaagggagggttatcaaagcgttgagcgagggtttgtgtttgccagaagggatgactagcccgcacgtgttctgcatagggccagtgatttctgccacgtgcggggagaaggacctgaacgggtgtctgagttggctcgactcgcagccgagtcagagcgtcgtgttgctgagtttcggaagcctcggaaggttttctagggctcaggtgaaggagatggctgttgggttggagaagagtgaacaaaggtttttgtgggttttgcggagcgagttggtcggggttgactcggtggaaccgagtttggacgagttgttgccggaggggtttgtggagagaacgaaggggagggggatggtggtgaggaactgggccccacaggtgaggatactgagtcatgactcggtgggtgggttcgtgactcactgcgggtggaactcggtgttggaagcggtgtgtgaaggggtgccaatggtggcgtggccactctacgcggagcagaggctgaatagggtgataatggtgcaggacatgaaggtggctttggcggtgaatgaggacaaagatgggttcgtgagtgggaccgagttgcgggaccgagttagggaactcatggactcgatgaagggaaaagagattagacagagggtttttgagatgaaaataggtgcaaagaaagcgaaagcagaagaagggtcttcacttgttgcgttccaaaggttggttcagttatggaaccaatag

SEQ ID NO: 1839 - DNA, 1422 bp, Glycine max var. Williams 82
atgaccatgaaggactctatagttctatactcagctttgggaaggggacacctagtttccatggtggaactaggcaaactcatactaacccaccacccttcactttccatcaccattcttttcctaaccccaccccccaaccaagacacacccacctcccccaccgccttcacctgcgacgccacctccaaatatatcgccgccgtcagcgccgccaccccctccattaccttccaccgcatccctcagatctccatccctactgtcctccctcccatggccctcaccttcgagctctgccgcgccaccacccaccacctccgccgcatcctcaactctatctcccaaacctcaaacctcaaagcaatagtcttggacttcataaactacagcgccgcacgtgtcactaacacgcttcagatccccacttacttctactacacttccggcgcctccaccctcgccgttttcctttatcaaactatctttcatgaaaactacacaaagtctctcaaggacctcaacatgcacgtcgaaatcccagggttaccgaagatccacaccgatgacatgccggagacggtgcaggatcgtgcgaaagaagtttaccaggttttcatcgacatcgccacgtgcatgagggacagtgacggggttatagtaaacacgtgtgaagccatggaagagagggttgtggaagctttttccgaagggttaatggaaggaaccacgccgaaagtgttttgcattggacccgtcattgcttctgcttcttgtagaaaggatgataacgagtgtttgagttggctcgattcacaaccgagtcatagtgttttgtttctgagtttcggaagcatggggagattctcgaggactcagttgggagagattgctattgggttggagaagagtgagcaaaggttcttgtgggttgtgaggagcgagttcgaaaatggtgactcggttgaaccaccaagtttggacgagttgttgccggaagggtttttggagaggaccaaggagaagggaatggtggtgagggactgggccccacaggcggcgatactgagtcatgactcggtgggtgggttcgtgactcactgcgggtggaactcggtgttggaggcggtttgtgaagctgtgccaatggtggcgtggcctctctacgcggagcagaagatgaataaggtgatcttggtggaggaaatgaaggtgggtttggcggtgaagcaaaacaaagacggcttagtgagttctaccgagttgagggaccgagtcatggaactcatggactcggacagagggaaagaaattagacagaggatttttaaaatgaaaatcagtgccaccgaagcaatgacaaaaggtggatcttcaatcatggctttgaataggttagtggaaatgtggagggagcactag

SEQ ID NO: 1840 - DNA, 1062 bp, Glycine max var. Williams 82
atgaaagaagatgaattcctatgttgtcagcttggtttctgggtgtttctgattatatgtctggtgcttgtgtcactggcaggcattgcatcaggcctagctctaggactactgtccttcagccaagtggatcttgaggtactcattaaggccggtcgaccaaaagacacaaaacatgcagaaaggattcaaccttttgtaaagaatggacattttgtcctgtgtacacttcttctaggaaaatcactggccatggaggcactgccaatttttatggactcaatcatcccaacttggtttactattctggtgtcagcacccttggtgactgtgtttgcagagattttacctcaagctgtgtgctctcgatatggactaactttaggagcaaaaatggctccctttgttcaattgcttctgctgatcttcttccctataacctatcctgctagtaaggtgctggattgggctctagggaaagaacattcagttcttctcagaagatcagagttgaagacatttgtggacttacatgcaaatgaggcagggaaaggtggagagttatcacatcatgaaacttctataatcacaggtgctatagatttgactaggaagacagctaaagatgcaatgacacccatatctgaaactttttctcttgatataaattcaaaacttgacatgcatacaatgacacaaataatgagcaaaggtcacagtcgaatacctatacattctgggcacccaagaaatattattggcctcatattggttaaaaacttgatattctgccgcccagaagatgagaccccaataaagaatttgattataaggaaaattccaagggtttatgaaagttggccactatatgagatattgaatcaattccagaagggtcacagccacatggctgttgtcttgaaatccaacaaagacacagagagcactatgggcgcacctacctttttgaatataattactaataaaatatcaaacgcggctcaagtttctgtaggtaatatcttacagaatttagccatggtgtcatatcaaatcaaataa

SEQ ID NO: 1841 - DNA, 1062 bp, Glycine max var. Williams 82; identical to SEQ ID NO: 1840

SEQ ID NO: 1842 - DNA, 795 bp, Glycine max var. Williams 82
atggagcgtgtgctagctgatgtgcttagagatcaaagaaatttgggcaataaaggtgatggaaattggaaagcagtagcatacagtactgcaactcaaattttgtccaagcgttttggagttcacctcatggcagataatgttaagaaccgttttaagctttggagaacatggtatggaattgtgagtgacattcttagtcaaagtaaatttgactgggatagcacaaagtacatgattaccgttgaaaatgaaattgcatggaatgaacatgtaaagtcacatgaagaggtcaaacgatttcgatttaaagtcattcctaattgggatgatattgttgacctatgtgcaaaggatagagctactggactcggagcagaaaatgcattagatgcagatgatatcatgagcaaagaaacaaatgaagaggaagcaattcatagtgtgattttttacttagagggatcaagttccgtcacaagaaaaaacattcacccaagtaagagtggagagaaagaagggatgatttcctcaatgaaagaagtagctgagtcattgaaagaatttgttgaagtgactaagaagaagatggagaacaaaaaaaagatggagataaaagaagctcaagaagtggtacatgaagtggtgagtgagctagataatatacctaattctaatggtgcacttccacatagaacaatcgattggttgacagaaaatctcattaagtttgcgattataaaagctcttccattggatgagaaggaggattacatctcatcttttatgccttga

SEQ ID NO: 1843 - DNA, 972 bp, Glycine max var. Williams 82
atgaacgttgcattaatatatttttttctctctctctctccctctgaaccctctctcatggctgcttccaagcttttttctgcttctctcctggtctccatggtcaccctcttggtcctttcgtcggacaagtgcctcgcgttgcaatgcggggtttcctatgagacaatcaccgtcgtcaatgagtttcctcacgatccacaagccttcactcagggccttctttatactggaaatgacaccttatttgagtcaactggactttatggggagtcatctgtccgtaaagttgctctttgtactgggaaggttgacattattcacaagatggatgattcttattttggggaaggtttaactctcctcaatagcaggctcttccaagtaacttggttgcggacaaatggtttcatatatgacccaaaacatttaagccaaattgggacatttaatcatgatatgaatgatggttggggtctggcaactgatggaaaagtcttgtttggaagtgatggcagttcaacattgtatcaaatgattcaaactgatcctcagacatttaaagctgtatcaaaacaagttgtctactataagggtcatgaagtacacaatctcaatgaattggaatacataaatggtgaagtttgggcaaatgttttaccgactgactgcattgtaagaatctctccgagtgatggcagtgttcttggatggattctcctccaagatttaaagaaagaacttgttgaagcaggggcgattagtgaagataatattttgaatgggatagcatgggatggtgagcaaaagcgtatcttcgtgaccggaaaactgtggccaaagctgtatgaaatcaaggtttcaccaataaaggaaccaattgaagaagggaccattgagcaactttgcttgcctgagccttatgtacctccatcgaaccttgtgctggctgacccagcccaaagggaatga

SEQ ID NO: 1844 - DNA, 927 bp, Glycine max var. Williams 82
atggcggcaggactctccgccgccataaccatgaaacccctcctccgtttccaccaacctcgcctccccaaaccaatcccaacaacactccctttctctcccttgagaattttccatcacacagcatcaccgataccccaaaatttttcaactttcaccgtttgtgtcctcatgcaggacccaaaacaaggcacccagatggaaattcaggcacaagaaccaccaccctctcctcctcagcaagttttgtcacaaaagttggctgagaaattggccagaaaagagtctgagagcttcacttacctcattgctgctgtcatgtctagcttcggcatcacatccatggcagtgttcgctgtttattatagatttgcatggcaaatggagggtggagaagtgcctttgtctgaaatttttggcacatttgctctatcagtgggagctgctgtgggtatggagttttgggctagatgggctcacagggctctatggcatgcttccctgtggcacatgcatgagtcccatcatcgaccaagagaagggcccttcgagcttaacgatgtatttgcaataatcaacgctgtccctgccatcgctctcctttcctatggtttctttaacaagggactggtccctgggctttgttttggtgcgggtcttggaattactgtctttgggatggcctacatgtttgtacacgatggattggttcacaagagattcccggtgggccccatagccaacgtgccctatctcagaagggtggcctctgctcaccaacttcaccattcggaaaaattcgatggagtgccttatgggctgtttatgggaccaaaggaagttgaagaggtgggggggctagaagagctggagaaagagataagtaggagagcaagatcatacaaaatagctagagagaaaagctaa

SEQ ID NO: 1845 - DNA, 1467 bp, Glycine max var. Williams 82
atggagacaccattagtggtccaaaattttacttcagaagctgactattttccagtgaaaagcttgaaggatgttaaatttgttttgtgggcagagacagtgaagatatggagaatagcattgccagtggcattgacccatctattccaggttctcacaaactcctcaacttccatatatgctggtcatcttggagacattgaactctcttctatctctgtgagccaaggggtcatgagttccatctattttcagttgttgtttggtatgtcatctgcactggccacactttgtggccaagcttttggagcaggacaaattcaatctacttgcatttatgttcaaaggtcatggattatacttactgccacttgtataatcctcttgcctatttatatatatgccactccaatcttaaagttgcttggccaagatgaaggaatagctaatcttgctggcagatattctattcaagtaattccccacatgttttcatttgctatagtttttcccacccttagatttcttcaggcccagagcaaggttaaagttattatgtgcatagcatttgttgttttgctcatacaaaatggactgctttacatcttcataaatatatttggttggggtataaccggcttggccatggtgagtaatattatagggtggttgtatgctggggctttggttgtctataccattagttggtgcaaagaagaatggagtggattttcttggatggcatttagggatttgttggcctttgctaagttaagtcttcaatcatctgtaatgggttgcttagagcaatggtatatgacatgcattatgctacttgctggtcttctagacaatcctgtgattgctgttggctcctattctatttgcttcagcgttcagggttggcacttcatgctgctccttggaataagtacggctataagtgttcgcatctccaatgcgcttggcatgtcgcagccaagagcagccaaatacactttctgtgtgaccatgttccagtctctcctccttggtgttcttttcatgaatgttattttcttgactaaagaagacttcgccattatctttaccaatagtgaggatatgatacaagctgttgctgatttagcataccttcttggtgtaaccatggttctcaatagtgcttcacaggtcatgtcaggtgtggccattggaagtggatggcaagttatggttgctttcataaaccttgcctgttattacattgttggactgccaattggatatttccttggtttcaagcagcatttaggggttaagggtctgtggggaggcacaatgtgcggcagtgttcttcagattttaatcctcttactgataatccgtaagaccaactggaccaaggaggtggagcaaactgctcatcgcatgcgaatatggaacgttaacaatttccgctcagacttggcagaaaatgttacatga

SEQ ID NO: 1846 - DNA, 243 bp, Glycine max var. Williams 82
atgtcaaattgctatcataatctaaattccaagtttgcagttacgagacaatttttctgttgtttccagatttgggcttgcggcatacaacttggccgaaagaggcatggattctgggtcaagatgtttctcctgggtgttgcagattattttggtatcgcaaggaatgatcccaaacacatcagcctattaaagagatatagaaaaagaaaaaaggagattaaagagagaatgaaaaaatga

SEQ ID NO: 1847 - DNA, 972 bp, Glycine max var. Williams 82
atgtggtggccattcagcagaataggatcttctgggttttcatcatattctactgccgaggaagttactcatggaatcgatggaagtggtctcactgctattgttacaggagcatctagtggtcttggtgctgagactgctcgtgtccttgctttgcgtggtgtccatgtgattatgggggtgatagatatgattggtgcaaaaactatcaaggaagcaatacttaaggagattcccatagctaaagttgatgtcatggagttagatcttagctctatgacatctattcggaattttgcatcaaatttcaattcatctggtctttcattgaatattttgataaacaatgcagggatttgtgcagctccttttgcactatccaaggataacattgaacttcaatttgccataaattacttaggccactttcttttaacaaatatgttgttggatactatgaagaaagcaacaagtgaaagtaagaaacaaggaagaattattaatgtctcctcaattggttatcgattcacgtatcgtgaaggaatcatttttgacaaaattaacgaccaatcaagttacaacaattggtgtgcatatggccaatcaaagcttgctaacattttacatgccaatgaactcgcaagacgtctcaaggaagatggaatagatattactgctaattctgttcatccaggagccactgtttccaccaatattcacattcatagtggtttattaaatggtttacacaaaatagcatggctatttggactcgagaagatattgggatatatggcaaaaaatgtgcagcaaggagcatcaacaacatgttatgtagccttgcacccacaagtgagtggaatcagcggcaagtattttgaagataataatcttgcagaagtatactcacatggaagggacatgaatttggccaagaagttgtgggattttagcataaatttgactaagtaa

SEQ ID NO: 1848 - DNA, 960 bp, Glycine max var. Williams 82
atgggttcttctgggttttcatcatcttctactgcagaggaagttactcaaggaatcaatgggagtggcctaactgcaattgtcacaggaacaacccatggtattggtactgagactgcaagagttcttgctttgcgtggtgtacatgtgattatggctgcgagagatgtgattgctgcaaaagctgtcaaagaagcaatacttaaagagattcccacagccaaagttgatgccatggaattagaccttagctcaatgacttccgtcagaaagtttgcattagagtatatttcatctggtcttccattgaacatcttgataaacaatgcgggaataagtgcattccctttcacgctgtccaaagacaacatcgaactacaatttgccacaaatcacttaggtcattttcttttaacaaatcttttgttggatactttgaagaaaactgcaagtgaaagcaagaaagaaggaagaattattattgtctcctctgacggtcaccaatatacatatcctgaaggaattctttttgataaaattaatgatgaatcaagttaccagaagtggcatgcatatgggcaatcaaagcttgccaacattttacatgccaacgaacttacaagacttcttaaagaagatgggatagataatattactgcaaattctcttcatccaggagctattatggacaccaatatttataaaccagagattaatggccctgtgccaactgatctaattaataggctagggagttttctgctaaaaaatatccagcagggagcagcaacaacatgctatgtagcgttgcacccacaagtgaggggaataagcggcgagtatttttcagataataatctggctaaagcgagttcactggcaaaggacactaatttggctaagaaactttgggatttcagcatgaaaacaattgattacaatacccatgagcaaatctga

SEQ ID NO: 1849 - DNA, 1076 bp, Glycine max var. Williams 82
ttggaatcaataagacggcaactaacacatttaagtagaacacacacttctcaccaaccctcacagaaaacacacagacatagaaagatagagtgaattagtcatgggttcttctgggttttcatcatcttctactgcagaggaagttactcaaggaatcaatgggagtggcctaactgcaattgtcacaggaacaacccatggtattggtactgagactgcaagagttcttgctttgcgtggtgtacatgtgattatggctgcgagagatgtgattgctgcaaaagctgtcaaagaagcaatacttaaagagattcccacagccaaagttgatgccatggaattagaccttagctcaatgacttccgtcagaaagtttgcattagagtatatttcatctggtcttccattgaacatcttgataaacaatgcgggaataagtgcattccctttcacgctgtccaaagacaacatcgaactacaatttgccacaaatcacttaggtcattttcttttaacaaatcttttgttggatactttgaagaaaactgcaagtgaaagcaagaaagaaggaagaattattattgtctcctctgacggtcaccaatatacatatcctgaaggaattctttttgataaaattaatgatgaatcaagttaccagaagtggcatgcatatgggcaatcaaagcttgccaacattttacatgccaacgaacttacaagacttcttaaagaagatgggatagataatattactgcaaattctcttcatccaggagctattatggacaccaatatttataaaccagagattaatggccctgtgccaactgatctaattaataggctagggagttttctgctaaaaaatatccagcagggagcagcaacaacatgctatgtagcgttgcacccacaagtgaggggaataagcggcgagtatttttcagataataatctggctaaagcgagttcactggcaaaggacactaatttggctaagaaactttgggatttcagcatgaaaacaattgattacaatacccatgagcaaatctgaagaatgcagatgg

SEQ ID NO: 1850 - DNA, 1557 bp, Glycine max var. Williams 82
atggatactccaatgaccctcacgggcttgctccgcgacgtcgccgccaaattcccttcccgccgcgccatctccgtcgccggaaaattcgacctcacccactcccgcctccatcaactggttgaatccgccgccgcccgcttagtcgccgccggaatcaaacccggcgacgtcatcgctctcaccttccccaataccgtcgagtttgttgtcttgtttctagccgtcattcgagtgcgcgccacagccgcgccgttaaacgcggcttacacagccgaagagtttgagttttacttgtccgactccgagtccaagcttcttctaacatcagcagaaggaaacaactcagctcaagccgcagcttcaaaactcaacatccttcacagcacagcttcaataacccaagccgaagacaaagaagccgagctgagcctctcattaagccactccgagtcagagtcaattaactcggttgagtcactcggaaacgatccagatgacgtggcgcttttccttcacacctccggcaccacgagccgacccaagggagtgcctttgacgcaacacaacctgttctcttccgtgaacaacattaaatcggtgtaccgactcactgagtccgactcgacggtgatcgttcttcctttattccacgtgcacggtttgatcgcggggctcctgagttcgctcggcaccggggcggcggtggcgctgccggcggcggggagattctccgcctcgtcattctggaaggacatgattaaatacagcgccacgtggtacacagcggttcctacaatacaccagatcatactggaccgccactcgaacagccccgaaccggtttacccgcgcctccggttcattcgaagctgcagcgcgtcgctcgcaccggctattctgggtaaacttgaggaggccttcggtgcgccagtgctggaggcttacgcgatgacggaagcgtcgcatttgatggcttcgaaccctttgccgcaagatgggccccacaaggccgggtcggttgggaaacccgtgggtcaagaaatggttatattggacgaaacgggtcgggttcaagatgctgaagttagtggagaggtttgcattaggggtcctaatgttacgaagggatataaaaataacgtggatgccaatacggcggcgtttttgtttggttggtttcacaccggtgatgttgggtacttggattctgatgggtatttgcatctcgtgggtcggatcaaggagctcatcaaccgaggaggagaaaagatatcaccaatagaagtggatgctgtccttctttcacacccagacattgctcaggcagttgcttttggagtgcctgatccaaagtatggggaggagatatactgtgctgtaatcccaagagaaggatcagacattgatgatgcagagttgctaagatattgcaagaagaatcttgcatctttcaaagtccccaaaaaggtcttcattaccgattctttgcccaagactgccaccggaaagattttgcgtcgtcttgtggcagaacactttgtctctcaaatttga

SEQ ID NO: 1851 - DNA, 1764 bp, Glycine max var. Williams 82
atgagaaagaacaacgaggttcaggaggttgttgtaatcacgccgcgtcaagaagagattcagggatcgggagggcatattcgtaattccaaggacggaatctggtggccagtgacgaagacgttgccgcgatccaccgcggttctcctcttccccgtcgtgctcatcatcgccgcgttggcttacacgcgcacgctcgacacacatcgcagcttgactgtcacagtagagttgtataggcatcgaatgactgatcccaagactggaaagaactcccttgatccacttcagttcacacgtggtactagccatcgaccgatactcagcttcagcggacgaacgcactactgtatgttgttttttggttttccaagaaattggagagttacccaagaaaacaatccatccgataagagacctacgagtaagaggacaagtagcccaccaatagagatcccactgaattgcagtgcatacaacctcaccggaacatgccccacaaaccaatccccaatcccagaaaacgatcagagccgtccatccagtgccacgtgtccggagtacttccgttggatccacgaggacctaagaccgtgggcccgcacgggcataacgcaagagatggtggagagggcaaaacaaaccgcaaattttaagttggttatattgaagggtaaggcctatttggagacttatgaaaaagcctatcaaacaagggatgtttttagcatatgggggattctacaattgttgagaaggtaccctgggaagattcctgatttggagctcatgtttgattgtgtggattggcctgtgcttttggttgatcgttacaatgggcctaatactgagcaaccaccaccattgtttcggtattgtggcaatgatgctactttggatattgttttccctgattggtccttctggggatgggctgaggttaacataaagccatgggagattttgttgggagagttgaaagaaggcaccaagaggataccatggctgaaccgagagccttatgcatactggaaaggcaatccagttgttgctgaaaccagactagacctcatgaaatgcaatgtttctgaaaatcaagattggaatgctcgtttatatgctcaggattgggggcgagaatcacaagaggggtataagaaatcagacttggcaagtcaatgcactcatagatataaggtgtacattgaaggttctgcttggtcagttagtgaaaaatacattctggcatgtgactctcccactctccttgtaaaaccacattactatgattttttcacaagaggactaattccggggcaccactattggcccataaaggaagatgacaagtgcaggtccattaagtttgcagtggattggggcaatagtcacaagcaaagggcacatcaaattggcaaggctgcaagtgatttcattcaagaagaggtaaagatggactacgtgtacgactacatgtttcatctcctgaattcatatgctaaactctttagatacaaaccctctttaagtgcaaatgctactgaaatatgtgcggagtcaatggtttgtggagcagaaggaccagtaaagaaatttatgatggaatcattggtcaaggttcctgcaaataccgatccttgctccatgcctgccccttatgatcctccaactttgcacgcacaattaaagagaaaggaaagttcaattcaacaagttgattcatgggagaaaagttattgggagaatcaaaccataacatcttaa

SEQ ID NO: 1852 - DNA, 342 bp, Glycine max var. Williams 82
atggctcagaaggttgtgttaaaggttatgactatgactgatgacaaaacaaagcaaaaggctatagaagcagctgcagatatctatggggttgattcaattgttgctgatgtgaaggagcagaagttgacagtgattggtcaaatggacacagtgaaaatagtgaagaagctgaagaaagtaggaaaagtggatataatatcagttggacctgccaaggaagagaagaaagaagaaaagaaagaggagaaaaaggaagaaaaaaaggaagagaaaaaggaggagaagaaaggggagaagaaggaagaaaaaaaggaagagaagaaggaggagaaaaaataa

SEQ ID NO: 1853 - DNA, 2853 bp, Glycine max var. Williams 82
atggattcaagagcagttcaaactcatgcgcatgaacatcaccatatttcccacaatgttgggtcacacgaagtgccacgtggtgaagaacaccaccaccatgaccatgagaagaagtcggttcttaagaaagtcaagcaaaaggctaagaaaattaaggacacaattacaaagcatggccatcatcatgaccatgatcatgaacgtggtcatgggtatcactacgatgatcaacatatccctgatgatcatgacttgggtgaggaagatgaggtggatgaatacccagaagtccatggagcaccgatttatgacagtgcacctgttagaggtgcagcaccaggacatgtcaatcctttagggaggcctggagttaactttggaggtacaacagttatgggagaacctcatcatgagccaagtgtcatagttgtttctccaactactggaattaatcaaagaggatcaactgacccaactagaacatttgttgagggagccaaagcagtgcatcctaaggtcaatttggagagaccaatgcacttggaggaagatccacatgcgccaaggcgtacatctcaagcatatgctccacccaattatcaaacaaaagtcactgatcccacgggggcaggtggagcagaaattgacatcaccacagttgagaaatctttctccaggatggctgttctcaacgagccaaaaccttacccagaaccaaaactctttccaactattgctcaaacccactacccttcttctgtaagccactcccaattcgcgccagagcattccactgcaatgaactacccttctgctcaaagctatgatcattgcatgccagaactatccagtgaagttaaaactcagtaccccaaaagccataatcagtttacgacagagttatctacaccaaccaaaactccctacccttcccccaatatccatggccaccacttgcaacaacaatctagtgcaacaaaaacctacccttcatctggaagccatgaccagtttgctccaatgtcagagttacctacaccaaccaaacctcaatacacttctaccaaaatccatgaccaacccttgccattgccacaacaacctagtgcaacaaaaactcaataccctttacctggaagccatgaccagtttgcaccagtgttatctactgaacctaaaattcagtacccttcaacaaaaatccatggccaacacttgcctcaccagtttactgctacaaaaactcaatacccttcatctggaagccatgatcagttaaaaccagaattatctttctctactgaacctaaaactccctacccttcttctaccaaaatcaatgatcaccacttgccacaacactccagtgcaagtgcaacaaatgctcaatatccttcagctagaagtcatgatcagtttctacctgaatattcaagtcaaaccaaaaccccaaaaacctatggagacaaccaaaccactcaaacaaggcatcaagaagagaacaaaggcaatgataaaccatcaacaatctctttagcaacagctgcaatagctgataaagccgtgtcagccaaaaacaccgtggcttcttcgcttggatatggatatgacgctgacactgaaacaactcaatcaagggaccacgatgagaacacccacggtgaaaaaccatcagcaatctcttcagcagcctctgcaattgctgataaagccgtctcagccaaaaacatagtcacttccaagctcggatttggcgacaacactgaaacaactcaaacaagccgtcaagagagaacacaaccatcaacaatctcattggcaacagctgcaatagctgataaagccgtctcagcaaaaaacactgtagcttccaagctcggatacggcgacagcactgaaacaactcaaacaagccatcaagaacagaacacaggcaatgaaaaaccatcaacaatctcatcagcaacctctgcaatcactgataaagctgtaactgccaaaaatgttgtagcttcaaagctcggatatggcgacaacactgaaacaactcaaaccactctagcaaggaatcaagaagagaacacaggcaacgagaaaccctcaacaatctcatcagaaacctctgctttagctgataaagatgcctcggcaaaaaacagtgttgcctctaagcttggtttcggtgacacagcaagaacacatgaagagaagagaactaaccatgctgctgctccaacagaatatggaaagagtgttgctcagtctctgacagagaaactagctccagtatctggaaaagtttctggtgcaggaagtggtgtgaagtccaaagtttcaggaactgaaaaaattagtaatgtgggtgtggaacaggacaagggtgtttctgtgaaggattatttggttgacaaactgaggcctggtgatgaagacagggctctctctaaagtgatatcagagactctacataagaaggaagtgcacccagtggaggttactgaggaaggtgtgaggaagatggtttctgatgcagtgcataagagagaggatgagccagagagaaaagtggaacatcaaaaaatactggggaaggtaacagagtcagaggaagtgaaaagaaggttaggaggtgaggatgtggagacagagaaaaagtaccaagagatgtatgtgaatagcccagggacaggtgtggttgataagcttacaggtatggttgggacgtggtttaccaacccagcagagaatcaatcctcacaagattcatctatgaatcatgaggcatcaagggcagaagtggaacatcaaggtgcagcaggtgcaagaaggctacaggagtcacctaattga

SEQ ID NO: 1854 - DNA, 3173 bp, Glycine max var. Williams 82
tagaatcaatttcctattcaaattcaatcatggattcaagagcagttcaaactcatgcgcatgaacatcaccatatttcccacaatgttgggtcacacgaagtgccacgtggtgaagaacaccaccaccatgaccatgagaagaagtcggttcttaagaaagtcaagcaaaaggctaagaaaattaaggacacaattacaaagcatggccatcatcatgaccatgatcatgaacgtggtcatgggtatcactacgatgatcaacatatccctgatgatcatgacttgggtgaggaagatgaggtggatgaatacccagaagtccatggagcaccgatttatgacagtgcacctgttagaggtgcagcaccaggacatgtcaatcctttagggaggcctggagttaactttggaggtacaacagttatgggagaacctcatcatgagccaagtgtcatagttgtttctccaactactggaattaatcaaagaggatcaactgacccaactagaacatttgttgagggagccaaagcagtgcatcctaaggtcaatttggagagaccaatgcacttggaggaagatccacatgcgccaaggcgtacatctcaagcatatgctccacccaattatcaaacaaaagtcactgatcccacgggggcaggtggagcagaaattgacatcaccacagttgagaaatctttctccaggatggctgttctcaacgagccaaaaccttacccagaaccaaaactctttccaactattgctcaaacccactacccttcttctgtaagccactcccaattcgcgccagagcattccactgcaatgaactacccttctgctcaaagctatgatcattgcatgccagaactatccagtgaagttaaaactcagtaccccaaaagccataatcagtttacgacagagttatctacaccaaccaaaactccctacccttcccccaatatccatggccaccacttgcaacaacaatctagtgcaacaaaaacctacccttcatctggaagccatgaccagtttgctccaatgtcagagttacctacaccaaccaaacctcaatacacttctaccaaaatccatgaccaacccttgccattgccacaacaacctagtgcaacaaaaactcaataccctttacctggaagccatgaccagtttgcaccagtgttatctactgaacctaaaattcagtacccttcaacaaaaatccatggccaacacttgcctcaccagtttactgctacaaaaactcaatacccttcatctggaagccatgatcagttaaaaccagaattatctttctctactgaacctaaaactccctacccttcttctaccaaaatcaatgatcaccacttgccacaacactccagtgcaagtgcaacaaatgctcaatatccttcagctagaagtcatgatcagtttctacctgaatattcaagtcaaaccaaaaccccaaaaacctatggagacaaccaaaccactcaaacaaggcatcaagaagagaacaaaggcaatgataaaccatcaacaatctctttagcaacagctgcaatagctgataaagccgtgtcagccaaaaacaccgtggcttcttcgcttggatatggatatgacgctgacactgaaacaactcaatcaagggaccacgatgagaacacccacggtgaaaaaccatcagcaatctcttcagcagcctctgcaattgctgataaagccgtctcagccaaaaacatagtcacttccaagctcggatttggcgacaacactgaaacaactcaaacaagccgtcaagagagaacacaaccatcaacaatctcattggcaacagctgcaatagctgataaagccgtctcagcaaaaaacactgtagcttccaagctcggatacggcgacagcactgaaacaactcaaacaagccatcaagaacagaacacaggcaatgaaaaaccatcaacaatctcatcagcaacctctgcaatcactgataaagctgtaactgccaaaaatgttgtagcttcaaagctcggatatggcgacaacactgaaacaactcaaaccactctagcaaggaatcaagaagagaacacaggcaacgagaaaccctcaacaatctcatcagaaacctctgctttagctgataaagatgcctcggcaaaaaacagtgttgcctctaagcttggtttcggtgacacagcaagaacacatgaagagaagagaactaaccatgctgctgctccaacagaatatggaaagagtgttgctcagtctctgacagagaaactagctccagtatctggaaaagtttctggtgcaggaagtggtgtgaagtccaaagtttcaggaactgaaaaaattagtaatgtgggtgtggaacaggacaagggtgtttctgtgaaggattatttggttgacaaactgaggcctggtgatgaagacagggctctctctaaagtgatatcagagactctacataagaaggaagtgcacccagtggaggttactgaggaaggtgtgaggaagatggtttctgatgcagtgcataagagagaggatgagccagagagaaaagtggaacatcaaaaaatactggggaaggtaacagagtcagaggaagtgaaaagaaggttaggaggtgaggatgtggagacagagaaaaagtaccaagagatgtatgtgaatagcccagggacaggtgtggttgataagcttacaggtatggttgggacgtggtttaccaacccagcagagaatcaatcctcacaagattcatctatgaatcatgaggcatcaagggcagaagtggaacatcaaggtgcagcaggtgcaagaaggctacaggagtcacctaattgaagaagtgggtgtgtgtgtatatttcttaagagctgtttctatagctgtgtctagttcttatttggaaaaaagtttggatgttcaagtcatagtaaaataaactttttatgtttttttttgtaatgtctataataatttttcaacgcttctaaatacggtcatagaagttgggtttgtattatgacatatatactattgtattatgacatatatactattattattactgttatgtaaagtgtgtgtgatctgtggagcgtcacaggaaaacagtaaaagtacttgtgtgtt

SEQ ID NO: 1855 - DNA, 1119 bp, Glycine max var. Williams 82
atggaatcagtagaaggaagagaagcagagggcaagttggtggaaaagagacaaaggagaagtaaaagaatagggaaagacaaaagtgacagaattagtgagttgcctgacagtgttctgcttcacataatagaatttatggacacaaaatctggtgttcagacttgtgtgttgtctaaacgatggaaggacctttggaaaagtctcactaacctctcttttgattactcgtacttcagaaggatttcctattttaagaaatttgtgtctcagattttgtctacccgagatcactcaatttctctacttaaccttgatattcgtctccaccgctcctctcagtccttcctgaaaagggtcatgaaatatgttgaattgcacaatacccagcagttgacaatccatatagcattatctatgttagaagttgaatttcctgctttcaaagttttatgttcatctttgtcatttcttcggcttttccatgaaaattattatcgccctttttttaaatttcctaaatctctgcggttacctgcattaaaaagcttgcatctcaagaatgtctgttttactgcaagtgacaatgattgtgctgagcccttttcaacttataacttgttgaatactttggtccttaaaaattgttgtctgtatgatgatgcaaaagtgctctgtatatctaattctaatatttccagtctgaacctgaacctgtatcatccctataaaaaaccttacaaaattgtgctttctactccaaaccttaattttctaactatcattggtcatggtggtcaccatatatcctcgacgtgcaatcatttgtttcttgaagaagtaaatattcgcggtaaatctccagccctcctgagatggctgcaacactttgccaatacaaagaaattgacactctctgtgtctaccattgagtctattttacctgctctatcaaatcctaatttagtggaaactcaacctccttgctttgctagattagagtcgttgaaagtgataatggtggatacaagtatgatatccaatgaagctgtaaacaggatggtgcagtatttacttcaatactctccactgaccagagttgttgtcacaaagggatga

SEQ ID NO: 1856 - DNA, 870 bp, Glycine max var. Williams 82
atgggggctggtgtttctacaactgcaacagaaaatgatgatgggggcactttttctttgtcatcagagactagccttgatgatatccctgagaactgcatctcttcaatgatgatgaattttgatccacaagagatttgctcattggcaagagtcaacaaaacctttcacagagcttcctctgctaactttgtgtgggaatcaaaactgccccaaaactataaatttcttctcaataaagtacttggtgaacaaaatcttggttccatgaccaagaaagagatctatgccaaactatgccaacccaatttctttgatggtggtaccaaagaagtttggctggacagaagcagtggacaagtttgtatgttcatttcatcaaaatccttcaagattacaggaatagatgatagaagatattggaattatattccaactgaggaatccaggttcaagagtgttgcatatcttcaacaaatgtggtgggttgaagtaataggggagctagagtttgagtttccaaaagggaactatagtgtattttttaagcttcaattgggaaagccctcaaagagattgggccggcgagtgtgcaaccttgatcaagtgcacggctgggacatcaagcccgttagatttcaactatctacatcggacggccagcgttcactctcccagtgctacttgcgtgggtccagagaatgggcctactaccatgttggagactttgcaatcgataagcccaatggaccaaccaacattaacttttccttggcccaaattgattgcactcacaccaaaggtggtctttgcatagatggggtagtgatttgcccaaaggagttcacacaaggattgaaacaattttag

SEQ ID NO: 1857 - DNA, 1149 bp, Glycine max var. Williams 82
atggccatagagtgcataacaaatatacaatcaatgtctcaaccacaaaagcaccaccaagagcacaaagaagatgaagcaccattggtttttgatgcctcacttctcaggcaccaactcaacctaccaaaacagttcatttggcctgatgaggaaaagccatgcatgaatgtgcctgagcttggtgtccctctcattgacttgggggggttcctctctggtgaccctgttgcaacaatggaggctgcaaggatagttggtgaggcatgccaaaagcatggtttctttcttgtggtgaaccatgggattgatgccaacttaatctctaatgctcatagctacatggatgacttctttgaggttcctctgtctcagaaacagagggctcagaggaaaacaggggaacactgtggttatgctagtagcttcactggcaggttctcttcaaagcttccatggaaagagacactttcttttcagtactcggctgaggaaaattcatccactattgtcaaagactacttgtgcaacacattggagaaagagtttgagcaatttgggagggtttaccaggactattgtgatgccatgagcaatctttctttggggataatggaacttttgggaatgagtcttggagttggtaaagcatgttttagagagttctttgaagagaataactcaataatgaggctcaattactaccctccttgtcaaaagcctgacctcactttgggcactggacctcactgtgacccaacatctttgaccattcttcaccaagaccaagtgggaggcctccaagtttttgttgacaatgagtggcattccattagcccaaatttcaatgcttttgttgtcaacataggtgacaccttcatggctctttcaaatggaaggtacaagagttgcttgcatagggcagtggtgaacagcaagaccacaagaaaatctcttgctttctttttgtgtccaaaaggtgataaggtggttagtccaccaagtgaattggtggatgatttgacaccaaggatataccctgattttacatggcctatgctgcttgagtttactcagaaacattatagagctgacatgaaaacccttgaggcattcaccaactggcttcttcaacggaaaatgagctga

SEQ ID NO: 1858 - DNA, 2052 bp, Glycine max var. Williams 82
atggcttgttcagtgcatctccttcttcttcttacttcacttctggctttgttctttaacccaacatgtgtctatggcaatgatgagcttagaacacttttggacttgaaatctagtttggatccagaagggcactttctgtcctcatggactattgatggcaccccatgtggtggttcctttgagggagtggcttgcaatgagaagggtcaagtggcaaatgtgtctttgcagggaaaaggactctctgggaagctctcaccagccattgctggactcaagcacttgacaggactctacttgcactacaactctttgtatggagagattccaagggaacttgctaacttgactgagcttagtgacttgtatttgaatgtgaatcacttgtctggtgaaatcccacctgagattggcatgatggagagtctgcaagttttgcagctttgttataatcagttaacaggaagcatccctacacagcttagtgatttgaaaaagctcagtgtccttgctcttcagtcaaaccagtttgctggagctatccctgctagtctaggtgatttgggaatgttgatgaggctagatttgagctctaataatctctttggttccattcccactaaactcgctgatcttcctttgctgcaagttctggatgttcacaacaatactctctctgggaatgtacctcctgctctgaagagactagaagaaggatttgtgtttgaacataatgtggggttatgtggagttgggttttcatccttgaaagcttgcactgcttcagatcatgccaatctcactcgaccggaaccttatggagctggggttggtggtctttctagagatatcccagaaactgctaatgtaaagttgccttgcaatacaactcagtgccgaaatccatcaagatccaaacaagcggcatctattacagttggcattgttctggttacaattgctgtatcagcaattggtatttttaccttcactatgtatcgtcggcggaaacaaaagcttggaagcacgtttgatatctctgaaggtcgtctaagtacagatcaagccaagagtatatacaggaaaaatggatctcctttggtcagccttgagtactctaatggatgggaccctttggctgatggcaagaatgtcaatggggataggcaagacatgttccagagtttccggttcaacttggaagaagtggagtcagctactcaatatttctcggaactgaatttgttggggaaaagcaacttcagtgcaacgtataaaggagttctaagagatggatctgttgttgctgtcaagagtattagtaaaactagttgcaaatcggatgaggctgaatttttgaagggattgaacatcttgacctcactgaggaatgagaatttagtgaggctgagaggattctgttgttcaaggggacgaggtgaatgcttcctggtttacgattttgtttctaatggaaatctgtcatgctaccttgacgtgaaggaaggtgatggagaagtccttgaatggtcaactagagtttctattgtgaaagggattgctaaaggtatagcatatttacatgcatacaaagcaaagaaacaagctcttgttcaccaaaacatctcagctgagaaagtgctcattgatcagcgatacaacccattgctttcagattctggcttgtacaagcttctcaccaatgacatcgtcttctctgcactaaagggtagtgcagcaaagggctacctagctccagaatacaccactactgggcggttcacagagaaaagtgacgtttatgcgtttggggtgcttcttttccagatcctcacggggaagcagaagatcacaagcgcaatgcgccttgctgctgagtccttcaagttcccagaatttattgatccgaacttgcatggcaagttctttgaatacgaggcggccaaactagcgagaatggccttactttgctcccatgagtctccatttgagaggccaagcatggaagccattgttcaagaactgggaaattgtagtagctgtctttga

SEQ ID NO: 1859 - DNA, 876 bp, Glycine max var. Williams 82
atggcttcccttgcagcatccactgctgctgcttcccttggcatgtcagaaatgcttggaaaccccatcaacttcagtggtgccacaaggccagctccatctgcttctagtcctgcctccttcaagactgtggctcttttctccaaaaagaaggctacaccaacacctccaaaaaaagctgctgctgctgctcctgccaatgatgagcttgccaagtggtatggtcctgacagaaggatcttcttgcctgagggtctcttggaccgatccgaaatcccagagtacttgaccggagaagtccctggagactatggttatgacccatttggtcttagcaagaagccagaagactttgccaaatatcaggcatttgagttgattcatgccagatgggcaatgcttggtgctgctggattcatcattcctgaggccttcaacaaatatggagcaaactgtggtccagaagctgtttggttcaagactggagctctgcttcttgatgggggtacgctgaactactttgggaaacccatccccatcaatcttattgtggctgtcattgctgagattgttcttgtgggaggtgcagagtactacagaattattaatggcctgaacttcgaagacaaacttcatccaggtggtccatttgacccattggggcttgcaaatgatccagaccaagctgcactgctaaaggtgaaggaaattaagaatggcagacttgctatgtttgccatgcttggtttctacttccaagcatatgtcaccggagaaggtcctgttgagaacctagcaaaacatctcagtgacccttttggcaacaacttgctcactgtcattgccgggtctgctgagagagctccaactctctaa

SEQ ID NO: 1860 - DNA, 1191 bp, Glycine max var. Williams 82
atccttcgtccagctagcaccacattcacctgaggcttccaaagcaatggcttcccttgcagcatccactgctgctgcttcccttggcatgtcagaaatgcttggaaaccccatcaacttcagtggtgccacaaggccagctccatctgcttctagtcctgcctccttcaagactgtggctcttttctccaaaaagaaggctacaccaacacctccaaaaaaagctgctgctgctgctcctgccaatgatgagcttgccaagtggtatggtcctgacagaaggatcttcttgcctgagggtctcttggaccgatccgaaatcccagagtacttgaccggagaagtccctggagactatggttatgacccatttggtcttagcaagaagccagaagactttgccaaatatcaggcatttgagttgattcatgccagatgggcaatgcttggtgctgctggattcatcattcctgaggccttcaacaaatatggagcaaactgtggtccagaagctgtttggttcaagactggagctctgcttcttgatgggggtacgctgaactactttgggaaacccatccccatcaatcttattgtggctgtcattgctgagattgttcttgtgggaggtgcagagtactacagaattattaatggcctgaacttcgaagacaaacttcatccaggtggtccatttgacccattggggcttgcaaatgatccagaccaagctgcactgctaaaggtgaaggaaattaagaatggcagacttgctatgtttgccatgcttggtttctacttccaagcatatgtcaccggagaaggtcctgttgagaacctagcaaaacatctcagtgacccttttggcaacaacttgctcactgtcattgccgggtctgctgagagagctccaactctctaaatcattcatcttcatgtttttctccaatcttaatgtacaatacatatcactgagatattattaaggcattttgctttgttccttggaactcaattcttgaatttcttccaatttttttgtgtctaattaaataaattcataccacaaagcactaaagggaaacaaattcttagtttcaaacttaaaacttatagtgctggagttttttcaactgcggcatagcctatgaggttatctgaatctgtttgaatgccatgatagttcatagt

SEQ ID NO: 1861 - DNA, 636 bp, Glycine max var. Williams 82
atgaagcctaccctactattatccctttccttcctgcctctctttgctttcctggctctttcagaagatgttgaacaagttgtggacataagtggcaaccccattttcccaggtggcacatattacattatgccatcaacttggggcgctgccggtggtggattgaaactaggccggacaggaaactcaaactgcccagttactgttttgcaagattactcagaaatcttccgtggcacaccagtcaaattcagcatacctgggataagccctggaatcatctttacaggtactccacttgaaatcgagttcgcagagaaaccttattgtgctgaatcctccaaatgggtggcgtttgtggacaatgaaatccaaaaggcatgtgtgggtattggtggtcctgaaggtcatcctggtcaacaaacatttagtggcacatttagcattcagaaatataaatttggatacaaacttgtgttctgtatcactggctcaggcacttgtttagatattggaaggtttgatgccaaaaatggtgagggaggaagacgtttgaatctcactgagcatgaggccttcgacattgttttcatagaagcttctaaggttgatggaattatcaagtccgtagtttga

SEQ ID NO: 1862 - DNA, 2577 bp, Glycine max var. Williams 82
atgatggcagcagatgactcctctaccaagagaaactcaaatgttcagctccttgagaaactagaggcccttagtgaaactcttaaccaatattcacaaatctcaaacacatctagaagaacagcttcattagctataccaagagcctcacctccttttgtctcatctgctgaagatcatgacaatgacactgctaaagttaacaacaacaagcaaagcaacaaaactcggtctcgccgcatgtccttgtctccatggagatcaaggccaaagcctgaagatgccaaggcacctctcactcagccagataccaaaaagttcgatgacacagaaaattcaggtgacaagaaagggatttggagctggaagcctatgaggattctttctcatattggaatgaataaactaagctgtttgttttctgtcgaagtggtcactgctcaaggccttccttcatccatgaatggactaaggctttctgtttgtgttagaaagaaagagaccaaagatgggagtgttcagacaatgccatcaagggttgatcaaggtggtgcagattttgaagagacccttttcgtaaggtgccatgtttactgcaaccatggtagtggaaagcagcttaagtttgagccaagaccattttggatataccttgttgcagttgatgccaaagagcttagcttcggaagaaacagtgttgacttgagccagttgattcaagaatccgttgagaaaagccagcaaggcttgcgtgtgaggcagtgggacagaagctttggcttgtcagggaaggcaaaaggaggagaacttgttctgaaacttggcttccaaatcatggagaaagaaggaggagttcagatatacaaccaggatgagaacatgaagtccaaaaggttcagaaatctcacatctgcatttgctcgcaagcaatccaagtcatcattcagcttgccaagtcctagaataacaagcagaagtgatgcatggactccttcacagagaaggttggcagaagatattcaatgtatagatgatttgaatcttgatgattatccacacctagttcatgatgcccctccctctatccagaaacatggtggtagcaaagagaagctggaggattttgatatcccagattttgaggttgttgataaaggggttgaagttcaagagaagaaagaatatgatggagaagaatctgagaaatccatagaagtgaagtcagctacaagtgaggttgtcaaggaaatactgcatgatcaactgcgccttactagattaactgagcttgattcaattgccaagcagataaaggctcttgagtccataatgagagaagataacaggaagttcacaaaaagtgaggaagctgattcaccaagattggattctgatgaagaaaatgtgacaagggagtttcttcacatgcttgaggatcaaaaggccagaggtttcaaaatcaaccaatctaaaatcccctcattacaaatggcagaatctgaagtgtatctctcggatcttggcaagggcttggggtgtgtggttcaaacaaaggatggaggctacttgacatcgttgaatcctttagataatgctgtggctagaaatgacactccaaagctagcaatgcagatgtcaaagccttatgtgttggcatcaaatcagttcccaaatgggttagagttgtttcagaaattggctggcattggccttgatgaactcagctctcaagttttctccatgatgcccctagatgaacttataggtaaaactgctgaacagattgcttttgaaggcattgcttctgccatcatacaaggaagaaacaaagaaggagctagttcgagtgctgcacgtatagtttctgccctcaaaggaatggccaatgcaatgagttcaggaagacaagaacggatttcaacaggactttggaatgtggatgaaaccccacttacagcagagaaaattctagccttcacaatgcagaagattgagttcatggcagttgaagggttgaaaatccaagttgacatggcagaggaagaagctccttttgatgtttctccactcagcactgaggaagggaacaaagagaatgaactattagcttctgctgtttcacttgaggattggatcagagaccaaagctacagtgatacatcaaacatcacactcatgtttgttgttcaactgagggatccaatgaggagatttgaagcagttggaggtcctgtggtggttctcattcatgcaacaggtgaagaagacacaaaggggagtgaatgtgatcactaccaagatgatgaggaggagaaaatgttcaaggtaacaagcatgcatatgggaggtttgaaagtgaggagtgttacaaagaatgcatgggacagtgagaagcaaaggctaactgcaatgcaatggttgattgaatatggattgggaaaacttaaggcagggaagaaaggcaagcatgcattgctaaaagggccagattttctgtggagcatttcatcaagaatcatggctgacatgtggctcaaaaccatgagaaatccagatatcaaacttgtgaaggaataa

SEQ ID NO: 1863 - DNA, 1014 bp, Glycine max var. Williams 82
atggcttccgaaaccccaaagccaaaacccgttctaccgtggaaaacccgcgtttcaatttcctttctctctaccctaacggactatgcacgccgttctaacggcaccgttaaccgccgtctcatgaacttcctcgatcgcaaatcccaacctaacgccaaacccgttaacggtgtttccacccaagacgtcaccgtcgacgccaaacggaacctctggttccgaatctttaaccccgcagccgcctccggcggcggcctccccgtcgttattttcttccacggcggcggcttcgcgttcctctcgccggattcgtttgcctacgacgccgtctgccggcggttctgccggcgagtccccgccgtcgtcgtctccgtcaactaccgcctcgcgccggagcaccggtaccctttgcaatacgacgacggtgaggacatcctcagattcctcgacgagaaccgcgcggtgctgccggaaaatgctgacgtatcaaaatgcttcctcgccggcgacagcgccggcgcgaatttggcacacaatgtggcggttcgggttgccaagtcgggtccgctccgggaagttcgggttgtggggttggtatcgatccaaccgtggtttggcggggaggcacggaccgcggcggaggtgaagttcgagggggcgccgctggtgtcaacggcaaggacggactggctgtggaaggcgtttttgccagacgggtcggaccgtgaccacggggcttcgaatgtgagcgggccgaattctgaggatttgtcgggtttgaattacccggatacccttgtgtttgtgggtgggtttgacccattgcaagattggcaaaagaagtattgtgagtggttgaagaaatcagggaaaaaggctcaattgattgagtattcaactatgattcatgcattttatatatttcctgaattgcccgagtcatctcagttgatctcagaggttaaggatttcatcaccaagagaatttccgatttaaaatcaaatatgtaa

SEQ ID NO: 1864 - DNA, 3027 bp, Glycine max var. Williams 82
atggcaatgccaatagctcaatcatgtaagaaatttccatgtcgcatttttcttctcttgttcttcttgcttggtcacacaagctcacaatctttgtatgatcaagaacatgcagttttgcttaacataaagcaatacctccaagaccctccattcctctcccactggaattcaacttcctctcactgttcttggtcagagatcacatgcaccacaaactcagtcacttccctcactctctcccaatccaacatcaacagaacaataccaaccttcatctgtggcctcaccaacctcacacaccttgacttcagcttcaacttcatccctggtgaattccccacatccctctacaactgctccaagttggagtacctagacctctcaaggaacaactttgatggcaaggttcctcatgacattgacaaattgggtgctaatttgcaatatctcaaccttggctccaccaacttccatggtgatgttccttctagtattgcaaagttgaagcaattgagacaacttaagcttcagtattgcctattgaatggcactgttgctgctgagattgatggcttgtccaaccttgagtacctggacttgtcctctaacttcttgtttcctgaatggaagttgccttggaacttgaccaagttcaacaaattgaaggtgttttatctgtatggaaccaatttggttggggaaatcccaaagaacattggagatatggtgaccttggagatgctggatatgtcaaataatagcttagctggaggaattccaaatggtttgttcttgctgaagaatctgacctcactccttctttatgcaaatagtctctctggggagataccaagtgtggttgaggcattgaacttggtctatcttgatcttgcaaggaacaatcttacagggaaaatacctgatgcttttggaaagctccaacagttatcatggttgagtttgtccttgaatggcttgtcaggtgtgataccagaaagctttggcaatcttccagctctcaaagattttcgcgtgtttttcaacaatttatcaggtactcttcctcctgattttggccgttactcaaagcttcaaacctttatgattgcatctaatggtttcactgggaagttaccagagaatttgtgctatcatgggatgttacttagcttgtctgtttatgacaataatctgagtggtgagttgccagaattactaggaaattgcagtggtttactggatttgaaagttcacaacaatgagttttctggtaacattcctagtggtctttggacatctttcaatttgacaaatttcatggtgagccgtaacaagttcactggtgtgcttcctgaaaggctatcttggaatatttcaaggtttgagataagttacaaccaattttctggtggaattccaagtggagtatcatcatggactaatttggtagtgtttgatgcaagtaagaacaattttaatggaagtattccatggaagctaacggctcttcctaagttaacaaccttgttgcttgatcagaaccaactcagtggggcacttccatcagatataatatcatggaaatccttagtaactctaaatttgagccaaaaccaactctctggacaaatccctaatgcaattggtcagttacctgcccttagtcaacttgatctatcagaaaatgaattctctggcctagttccttctctaccccctagactcaccaatctcaatttgtcttttaatcatttgactgggaggattccaagtgaatttgaaaattctgtgtttgctagtagctttttgggcaattctggtctttgtgctgatacaccagcactgaaccttaccttatgcaattctggccttcaaagaacaaacaaaggctcatcttggtcttttggtttggttataagtttggtggtagtagccttgttactggcccttttggcatcactcttgtttattagatttcacagaaaaagaaagcaaggattggttaactcatggaagctcatttcctttgagaggcttaatttcacagaatcaagcattgtctcatcaatgacagaacaaaacattattggtagtggtggatatggtatagtataccgcattgatgttggttcaggctgtgttgctgtgaaaaagatttggaataacaaaaagttagacaagaagctcgagaattctttccgtgcagaagttagaatactgagcaatattcgtcataccaacattgtgaggttgatgtgttgtatctctaacgaggattctatgctccttgtgtatgagtatctggaaaatcacagcctagataactggctgcataagaaggttcagtcaggttcagtcagtaaagtggtccttgattggccaaagaggttgaaaatagccattggaattgctcaaggtttgagctacatgcaccatgactgttcaccacctgttgttcatagagatataaaagcaagcaacatccttttggatactcaattcaatgcaaaagttgctgattttggactagctaagatgttaatcaagccaggggaacttaacactatgtcatctgtgattggctcatttggctatattgctccagaatatgttcaaacaacacgagttagtgaaaagattgatgtgtttagctttggggtagtcctattggaactgacaactggtaaggaagcaaattatggagaccaacactcatctctttccgaatgggcttggcgtcacgttcttattggaggtaatgttgaagaattgctagacaaagatgtcatggaagccatttactcagatgaaatgtgcactgttttcaaacttggggtcttgtgcactgctacactgcctgctagtaggccttccatgagggaggcactacaaatattgaaaagcttaggagaaccatttgcttatggagatcagaagaaatttggccactactatgatgctattccccttctcaagagttcagaaaaggaaactagattgaatgttgctgatcatagtgaatga

SEQ ID NO: 1865 - DNA, 537 bp, Glycine max var. Williams 82
atggtgtccaaaactgtggccaactcgatgctttttctgaggattgttgctctcgcagcctcagctgcaactgtggccctgctatttacaaacaaggtcaaatttgatgatggaacaaagttgagatttcaagatttctattcataccggtacgaggcggtgattgcaataattggtggtacatattgtatactgcagttaccatttgccatatattatgcggtaaagcagaagaggttgatacgcaatgggttcttgccagaatttgacttctttggagacaaggtaatttgtgtgcttctggccacgggcgttggtgctggctttgcagtgtctttggaatttaaaaagttcttggatgacatatttgactcagtgggtaccccaaagaaggacccaacaaggaccacatatgacaagttttttgttcgagggatagtggcttctgctactctccttgttgcatgcctttccatgactatcgtttcaatcatctcctccattaatcgaagccgaagcaaaggcgtttttaattaa

SEQ ID NO: 1866 - DNA, 537 bp, Glycine max var. Williams 82; identical to SEQ ID NO: 1865

SEQ ID NO: 1867 - DNA, 1071 bp, Glycine max var. Williams 82
atgtctttgctttcggatctcatcaacctcaatctctcagaatccacagaaaagatcgttgctgagtacatatgggttggtggatctggtatggacctcagaagcaaagccaggactcttcctgggccagtgagtgaccctgcaaagcttccaaagtggaactacgatggctctagcacagaccaagctccaggggatgacagtgaagtcatcctatacccacaagctattttcaaggacccctttaggagaggcaacaatattcttgtgatttgtgatgtttacacccccgctggtgagccacttccaaccaacaagaggtatgatgctgccaaaattttcagccaccctgacgttgctgctgaggaaccatggtatggtattgagcaagaatataccttgttgcagaaagatgtaaattggccacttgggtggccacttggtgggtttcctggaccacagggcccatactactgtggaactggtgctgataaagcatatggccgtgatattgtagatgcacattacaaagcttgtatttatgctggcatcaatattagtggcatcaatggagaggttatgcctggtcagtgggaatttcaagttggtccttctgttggtatatctgctggagatgaggtgtgggcagctcggtacattttggagaggattacagagatggccggagtaattgtttcatttgatcccaagcctattccgggagattggaatggagctggagctcactcaaactacagcaccaagtccatgagagatgagggtggttatgaggtgattaagaaggccattgaaaagcttggattgaggcacaaggagcacattgcagcatatggagaaggcaacgagagacgtctcactggaagacatgaaactgcagacatcaacaccttctcttggggtgtggcaaaccgtggaagctccattagagttggaagagacacagagaaaaatggcaaaggttactttgaggacagaaggcctgcttctaatatggatccatatgtagtcacctccatgatcgcagagactaccatcctctggaaaccatga

SEQ ID NO: 1868 - DNA, 201 bp, Glycine max var. Williams 82
atgaacaacgatgaaaggtttgcacaaaagggtgtcccagttcatagccaggttatgaagatcaagcaagagtcagagaaaattgttgattggtcccctggcaagccagagataagatctgttcttcgcgaaataagccggcaaatttcccgatcgccgttggggatctccggccaaccgatttcagttggtgagtcatag

SEQ ID NO: 1869 - DNA, 1121 bp, Glycine max var. Williams 82
aatcgaacggacacaaaagccttagaaaaatattgggtcagggttatgtgttgcacatattatagtgtcaacgacatggaccaatttagtcttcttcaaaccgatcccataaagatagagctttcccaccaaacttccctattatcttctcccttacgtttcaattttgaattccatttgtgctctcacgcacaaatatatataggcacacacgcgcttataatttatggtacatgagaagtgttttttgtccattgtagattgtcacatatagagaaacagaattagaagaagggtagctgggaaactttggcaattgaaacctttttttccattgagtgatagagagcatggagaacatgaagatgaacaacgatgaaaggtttgcacaaaagggtgtcccagttcatagccaggttatgaagatcaagcaagagtcagagaaaattgttgattggtcccctggcaagccagagataagatctgttcttcgcgaaataagccggcaaatttcccgatcgccgttggggatctccggccaaccgatttcagttggtgagtcataggttcagtatatggttaagggtttttggattagtgtgttgatgtacacaggtggaagagggaggttctgtttgcttcccctgctcctgttctgttttcctctgttttttggtcagagaatatttaggcatttagctatattctccactttttttcttttttctttttgttgtatataataataataatagtgttattggatatatcatatgtgttttatttttttatttttttgtttggttagctttagttttctggtttgatatgttctatcaagttgggtggggcttggggaattgattttgaaggttcctcaattttgaatggttcagtcatatacttagaaagaagttaaaagaagaagaaaagtaagatccaattggttgcttgtaactcgtactagcctttgtgtttgaagtcttccatgattgtaatttgggttttctggtcttcggggagttttttttttctcttttggattaattgttcgagaggtaccaatatttcagaattaaaaaagaaaaagaaaaagaggggaaccaatatttattgttgtc

SEQ ID NO: 1870 - DNA, 1551 bp, Glycine max var. Williams 82
atgttgcaacagtttatcaatgaaactgttatcctaaactacttgcctcacaaaaatatcgtgtcaatttatgggtgtgcttctcatcacaaggaatcactactggtgcatgaatacctatccaatggaaatctttctgctcatcttcaaagtgaaatagccgaaaacagcacacaaccttggttgaccagattagatatagccattgatattgcaaatgcattggactatcttcactattatggcatcatccaccgtaatgtgaagtccagcaatattctcctagatgtgaacttttgtgctaaacttgctaaccttcatttatctcagaaacttccagatggagttcctgtctatgccacccatgttactggtgatataattgggacatgtggttatatggactcagagttggcatatggccggcttagtgttaaaaatggtgtttatagctttggggtggtattgtgtgagcttctatcattgacgctggcaaaatgctgggttctgaatgaagaggataatcttgctacccttttaagcagaaaaattgaaaaccaagctttggtggagttgttggatccaagacttggcttcgatacaaaccttaagatcaagtggatgatgactgctataactgagcttgcacttctatgcatgaaatgcccacaagaactaaggcctaatatggaacaggtgctagagacactcgatggcataaagcaaggaagacatgaaacaaactcaataaaaggaaaacttaaagatggacaagaggtagcaataaaatgtttccatgacgagagcgagacagaaaagaccattaagcaattcatgaaagaaactgagatcttaattctgttgcaccatcaaaatctagtttcactttatgtccgcacttctcgccatagcaacaaacacaagatagtgtatgagtacatctccaatggcactctttctaaacatcttcatgaatcttcccgtggtaaattaccatggcatactagattgaacattgccattgaaactgcaactgccttggtatatcttcatgattcagctatcatccactgtgacgtaaaagggagtaacatcttattggatgacaattttacttttaaagttgcagattttggattttcacggtctcttccagattatgttactcacgtttccactgttccagtaggaaccgatcccgactactatgaatctggaagggttagtgacaaaagtgatgtctatagctttggggtggtcttgtttgaactgatatcatccaaccccccaattttaatggaaggcacagattatgtttctcttgtacagttctcaaagagaaaaatcttaaacaaggaattaaacgcggtagtggatccaagtttttggttaggtgttgacacaaacatggtggaaatgataacagcagtggcagagttagcatttcagtgtgggcagtgtcccaaggaactcagaccatccatgaaacaggtgctagataccctagagggcataaggaaaggaacatggggattcaaccagataacatag

SEQ ID NO: 1871 - DNA, 1443 bp, Glycine max var. Williams 82
atgaccaacgaaatgaaagaagcaagtgccttaggagctagaacagcacgagcatgcgagagctgcctaaaagtaagagcaaggtggtattgtgcagctgatgatgctttcctttgccatggctgtgacaacatggttcactcagcaaaccaattagcaagcagacacgaaagggtgaagcttcaaactgcatcctccaaggtcaactactcagtgacccctaaggtagcatggcacagtggattcacacgcaaggcaagaacccctcgcagcaacaacaagcactcatcgctgcaacaacaacaacaaaaaccattacatgaagaacaaggagaagaagaagaagtgtttttcaataacaccatcattagtgttcaaccccttgtgcctgagcttggaagtgaagagccattgcttaatgatgagaccgaggagcaactcctgtgtcgcgtgcccgtatttgatgctgagctttgtagcatatacaatgaagtgaaggacgaggttaatgtagctggtggtgaagtagcctttgacttggaaaacttttcttctgagtttctaccaacagatatggatcttgctgagttttctgctgatgtggaaagcttacttggaaacggggttgatgaggattcacctgtgaagaaaggatcagaactagtgcttcttgattgcaaagaagaaggagatgatgaaatggatgcatgtgttaatggaattggagccaacaaagatgcaatggttaaggtcaaagatgaagaagaacttgatgctgatgatgacacagcttgccatttggattcgattcttgacatgaatagcgaggcctttaattggaatattgctgagtcagagtcacctgcacaggcacaagaagatgaagtgagtaaagtgggaaccaataagaaggacatatttttgaggctaaactatgaagaagtcattactgcttgggcaagtcaaggttctccatggactacaggaaccccacctaagttcttcaactccgatgattgctggctagacttgttttcttatagtatcatagccgatctcatatatatctggctaaaggaggaaggttgtgttgcgtcttcagtaaccgatgtaaaattcgtcgatatacctgaaatcattcgtagggcggagatgtgttatgccttcggtaaccaatgcaaaggttcgaatggtgggggtgttcaatgctattatggggaagtgagaagcttaagagtgcatgcagatgggggaagagaagcaagagtgtcaaggtaccgagagaagagaagaacgcgtttatttgcaaagaagataaggtatgaagtgaggaagttaaacgcggagaaaagacctagaatgaaaggtcgatttgtgaagagtgttcctttgttggagccactgctttgccagcttaattatcaatcatcaccactgacatga

SEQ ID NO: 1872 - DNA, 1863 bp, Glycine max var. Williams 82
atgcatacatatctgatatctgttgttgttgctattgttgttagtacgatgggttccattggtaacagcgaggttaaaaatcataatcagcaccatgaggatggtggtgataatggggtgaatttctcgatccagagagggtttgggacgaaactgaaggaggcgttgaaggaagcgttgtttccggacgaccccttcaggcagttcaagaaggagcagaagccaatgcggagagtgatgaaaggggtgcaatactacatcccaatctttgagtggctccctacttacaattggcgcctctttgtctctgacttgatcgctggcctaaccatctcaagccttgctatccctcagggcattagttatgccaaacttgctgaccttcctcccctcgttggcctttattccagctttgtcccacctttgatctatgctgtttttgggagttcaaggcacatggcagtcgggacgatagcaggagcatcgttgcttattgctcaaaccatacaaaccgtggcagacccagtagaagatccaacgttgtatcttcatttgattttcaccaccacctttatcaccggtgttttccaggcttgtttgggattatttaggctggggatagtggtggacttcttttcccatgctaccattaatggcttcatcggagggacagcagtagctctcatcctccaacaactaaagggcgtatttggaatgaaacatttttcaactaaatcgaacatggtcgaagtggtgaagagcattgtccgcaatagacacgagattaggtgggaacctgcggttcttggcgtcatcttggttgctttcttgcaatttaccaagcacctgaggaataagaatccaaaactcttttgggtaacggctatagctccaatggtgactttagtagtttctggggttttcacctacctcgtcaagggccaagatcatggaattcaaattgtgggccatctagataaaggactaaatcccttgtccatccactatctgaactttaattctaaatatttaccagcagttatgcaagctggtcttatcacaggggtgttgtcattagcgactgcggtgaattacaacgcagggtgtaaaactgcgatggcaaacgtggtacaggcaataatagtggcactcgcactactatttttggcgccactatttggcttcacccctcttgttgccctttcagctattattatttctgccatgcttgggctcattcctttcgaagaagtcatccatctctacaaagttgacaagtttgactttgttatttgcatggttgccttccttggagttatcttagtaagcatggatattggcctcatgctgtctgttggactcggcattcttagagcacttatgtatgtggctagacctgcgtcatgcaagcttggaaagttacctgaaattggtttatatagagacacgaagcaatataaagtattaacatacccaggagttcttgttgtacaacttggttctcccgtttactttgcaaattctttatacgtcaaagaaaggattatgaggtacattcgaagtgaggaaagctctactggagatgtagttgagcacatcatacttgatttgtcaggagtgacagccattgatacaactgctattaaagcattggacgagttaattataatattgggaaagaatggaattaaggttttgttcgtaaacccaagactggaggtgatggagaagcttataatgtccaagtttgttgagaaaattgggaaggagtcgttttatctaatattggatgatgcagtgatggcaagtcaatattcacttcgttcatcaaaggcggcaaataatggtcaagaggtggtttaa

SEQ ID NO: 1873 - DNA, 2015 bp, Glycine max var. Williams 82
atgcatacatatctgatatctgttgttgttgctattgttgttagtacgatgggttccattggtaacagcgaggttaaaaatcataatcagcaccatgaggatggtggtgataatggggtgaatttctcgatccagagagggtttgggacgaaactgaaggaggcgttgaaggaagcgttgtttccggacgaccccttcaggcagttcaagaaggagcagaagccaatgcggagagtgatgaaaggggtgcaatactacatcccaatctttgagtggctccctacttacaattggcgcctctttgtctctgacttgatcgctggcctaaccatctcaagccttgctatccctcagggcattagttatgccaaacttgctgaccttcctcccctcgttggcctttattccagctttgtcccacctttgatctatgctgtttttgggagttcaaggcacatggcagtcgggacgatagcaggagcatcgttgcttattgctcaaaccatacaaaccgtggcagacccagtagaagatccaacgttgtatcttcatttgattttcaccaccacctttatcaccggtgttttccaggcttgtttgggattatttaggctggggatagtggtggacttcttttcccatgctaccattaatggcttcatcggagggacagcagtagctctcatcctccaacaactaaagggcgtatttggaatgaaacatttttcaactaaatcgaacatggtcgaagtggtgaagagcattgtccgcaatagacacgagattaggtgggaacctgcggttcttggcgtcatcttggttgctttcttgcaatttaccaagcacctgaggaataagaatccaaaactcttttgggtaacggctatagctccaatggtgactttagtagtttctggggttttcacctacctcgtcaagggccaagatcatggaattcaaattgtgggccatctagataaaggactaaatcccttgtccatccactatctgaactttaattctaaatatttaccagcagttatgcaagctggtcttatcacaggggtgttgtcattagcgactgcggtgaattacaacgcagggtgtaaaactgcgatggcaaacgtggtacaggcaataatagtggcactcgcactactatttttggcgccactatttggcttcacccctcttgttgccctttcagctattattatttctgccatgcttgggctcattcctttcgaagaagtcatccatctctacaaagttgacaagtttgactttgttatttgcatggttgccttccttggagttatcttagtaagcatggatattggcctcatgctgtctgttggactcggcattcttagagcacttatgtatgtggctagacctgcgtcatgcaagcttggaaagttacctgaaattggtttatatagagacacgaagcaatataaagtattaacatacccaggagttcttgttgtacaacttggttctcccgtttactttgcaaattctttatacgtcaaagaaaggattatgaggtacattcgaagtgaggaaagctctactggagatgtagttgagcacatcatacttgatttgtcaggagtgacagccattgatacaactgctattaaagcattggacgagttaattataatattgggaaagaatggaattaaggttttgttcgtaaacccaagactggaggtgatggagaagcttataatgtccaagtttgttgagaaaattgggaaggagtcgttttatctaatattggatgatgcagtgatggcaagtcaatattcacttcgttcatcaaaggcggcaaataatggtcaagaggtggtttaagaagaaattcatggctaagtagtaaatattcgcctttcgatcgcccaaatcaatgctgtattatagtatagtattattattattatacaattatttatggaattaagaaagtattccctaataaattattgacttttcccattttttgaagc

SEQ ID NO: 1874 - DNA, 1260 bp, Glycine max var. Williams 82
atgaatcaacttggtggtgttagcgttatccttctggttctctcagtcttgtgtttccatgttagagcacagacttctgcaccttcttcaggagatgctgtctccaatttccagccaagccttgctgttgtcataggaatccttggtgtcatgttcttactgacattctttcttctcatgtatgcaaaattctgtcatcgccgccatggcggcgcttcggccgttggagactcagaaaatcaacttacttttgtgagatcaaggtctagattctcaggaattgacaagactgtcatagaatcactccccttcttcagattctctgcactcaaagggttaaaggaagggctggagtgtgcagtgtgcttatcaaagtttgaagatgttgaaattctgagacttgtaccaaagtgcaagcatgcttttcatattgattgcatagaccactggcttgaaaagcactctacctgtcctatttgcaggcacagagtcaaccctgaggaccacacaaccttcacatattcaaacagtttaaggatgttagcaggtgaggaatctaacatagagatcttggttcagagagaagaggaagagcatcatggttcatcaagattcagtgtaattggaagcagcagctttcggaaaacggtcaaggaagaagaattactcatccaaaaaggagcagaagatagtgatggtaaccagaaagggtatcataaacacaaccacaggattactatatctgatgttgtgttcaagcacaggtggagcaacgtgagttcttcagaccttatgtttctgaattcggagatgctcaatgatacatcaagcaacagattcagcagcaacctggaatcaattacaagaggggtagtggtggaaaatgagcaaattatgaacatcaaggaggagatggagaggaagatttcctttgagaacaaagttgttggtgcactaaacaacatcgtttcagatcataaggaagatcctccttttacatcagattctgcaccaaagtatgtgaacccgggtgagaaaaggtcaatgtcagaaatcactgctgtttctagatttggagatttaggcatgaaaatgagggtcttgaaggattctgattcccttcaaaacaaccttaaagaggaaagaatgaggcagatttggtttccaattgccagaagaacagctcaatggtttgtgaatagagaagaaagaaggtctctgcaatctcagaataataaacaacagccattagatgtataa

SEQ ID NO: 1875 - DNA, 990 bp, Glycine max var. Williams 82
atgcggaacctgcgcgcagctgcaccagatctaagcccagatagtgtgacccacgtaatccagggcaacgattacgtcaccccgagtttcgtcacagcatgggcgcgcctcagcggaattcgccacgttccgaggtcttgcgcctatgcgaacgcggtgaaagaaggagaacaggttcgttgcgttgtagccaaacgcgggtttaagtcgaacacgcttgtgcggtgtgcgttgattcatatgtattcgttgagagggggagtgtttattggggacgcttacaaggtgtttgctgaaatgcgcgagaagaatgtgaaggtgagagaatgtggtgatggtgaggttgttcctgatgattacaccgttgtgacggttttgtccgtgtgttcgagattaggggaccttgagatggggaacttgtttgttggaaatggtttgattaacatgtatgcgaaatgtgggattatagaaaaagctcttgatgtgtttaatggcttggatgtaataacatggaacactataattaacggcctcgccatgcatggccacatggctaatgctttgagtttgtttgagcagatgaagagcacaggagagaggccggacggtgttactttggttgggattttgtcagcctgcacacagatggggttggcgagagacaggtttatgcatttccgatcgatggttgatgattactcgatcgtacctcagattgagcattatggatgtatggtggatttgctgggaagagaagatgcctatggagccagatgcagttatttaggcagctcgggcatatggcaagatgttgcccgattgaaggtcacgatgagagagaccgggttcaggaaagtgccgggatgtagtgttattgggtgcaatgatagtgtggtggagttctattccttggatgagagacatcctgagacagagagtatatatagggcattgcagggattgacgattctgttaagatcacatggataa

SEQ ID NO: 1876 - DNA, 1194 bp, Glycine max var. Williams 82
atgggtctctgcttctcttcctcttcccccaaccctcctcagcagtactcagggtctgcgagcactgacagcaagaacgtgggattctccgcgaccacgagcagcgccgggaagagccaattctcggagatcgcgagcgggagcatcgacagcagccaaggctctcttcctcttccttctcctcatggccagattctggaaaggccgaacctcaaggtgttcagcttcggagacctgaaatccgccaccaagagtttcaagtccgacacattactcggcgaaggtggctttggaagagtttacaagggatggttggacgagaagaccctctcccctgctaaagctggctccggaatggtcgttgccatcaaaaagttgaacccccaaagcacccaaggcttccaagagtggcagtcagaagtgaactttttaggaagactttctcacccaaatctggtcaagttgttgggttattgttgggacgatgatgagcttcttctagtgtatgaattcttgccaaagggaagcttggagaatcatctattcagaagaaatcctaacatagaaccactttcttggaacacccggtttaaaatagctatcggtgcagctcggggactagctttcttgcacgcctccgaaaaacaaatcatatacagagatttcaaggcctcaaatatacttctcgatgtgaatttcaatgcaaaaatatcagattttggcttggcaaaattggggccttctggaggacaatcacatgtaactaccagggtcatgggcacgtatggttatgctgctccagaatacatagcaacaggtcacttgtatgtgaagagtgatgtctacggatttggtgtagtgcttcttgaaatactgacaggcatgcgggcacttgacacaaaacggccaacagggcagcagaacctagttgaatggaccaaacctcttctctcttccaaaaaaaagttgaaaacaataatggatgctaagatagtgggtcaatattcacccaaggcagcgtttcaagcagcacaacttactctaaaatgcctagaacatgaccccaaacaacgtccttctatgaaagaagtgcttgagggattggaagccatcgaagctatccatgaaaaatccaaggaatccaaaacctgcaattcttatcaacctcctcggcagagagttgtgagagtataa

SEQ ID NO: 1877 - DNA, 1512 bp, Glycine max var. Williams 82
atggatgtttatgaagaaatcgaagaaactaaagctgaaattgagaaacttacggtaaaactaagagacaagacaaattcacttcagaacttaaagaaatactatgatgcacaggccaataagatacaggaatctattttcaaagttgagaagctgaatcaagaaatgcttcaaaaggcagatgatatcaacgattatgtcagcgagagtttaaataataaagagtccatcaccaaacatctcagtgctgcagatgatgaacttggagcaatttgtgatgataaatttagaaagtggaaagatgaaaaaagagggtatgtattggcgttagaggaggaagaacaaataaaatggaaggaggaacattttaaacatctagaagatgtgcatgaaaaacttatagatcagtttaaggcaagtaagaaggagtgggagttggaaaaatctacattgcttgatgagatttcctcattgaagtctttttccaagaaatatatcaatgaagagcgagagaaagcagcatgtttgatgaggcaggttgagtcctatggatttgccaatgaactgctacatttgccacacaacgaacttgataggcacaaggatttgcatatggaagatggtttcaaagaacaacttaaggaagtttatgatgctttagacagggcaaacattgaattggatgagagaatatgtgaaaaaagtgaaatggagtttgaattgagaatatggaagtcatttgttgaacgtttgaggagcggtcttgaagaaaatcttgtcatgtgcaaagaactggaaaattcactccttgcacaagtagattttactgaaagcctcaagcaagagaaagatagcttggtttttaagttagaagagaaagagaataaaatagaatgcctgcagcaacatgtttactatttgaacaagaatcaaaaggacatatctccagatcatagaggagaaggacaatattttagaggagctccagaaagggaagtttgtgataagatcacagcagctgaggttctagctacacttgaaattgaagagaagttgatgatggtggaacttgagtatgatatccatgatatggagcagaaactgaaattgcaagaggaaaattggaggcaatcagaacagcttgcattggatattgaagaggaaatggaagcaaaacaattacaaataaagaagttgattgatcaaatggagaacaagctaagaggctcagatgtttttcttcaaaaactcaagatagagaatagaagtttgcttgaaaatgttactagattgtcattagaaagtgcgctactgcagtctacagacactcaactaatggacacattgagaagcatagtgcagtgttttgagaatgatagtgtaggaataaattttaagaaggatgatggattgcttgtaaaagagaatatgataatgcattctccaacggggataaagaaacttgaaacattttctgatataaggtcactatttaaggagctcaacacttag

(The sequence listing continues in the following parts.)

We claim:

1. A method of increasing abundance of one or more arbuscular mycorrhizal fungi in roots of a plant under water-stressed conditions, comprising treating a plant reproductive element with a formulation comprising an effective amount of a *Streptomyces* endophyte that is heterologous to the plant reproductive element, wherein the *Streptomyces* endophyte comprises
    a 16S polynucleotide sequence having at least 97% identity to SEQ ID NO 2 and at least 3 polynucleotides that encode an arabinose transporter protein;
    wherein the effective amount is effective to increase abundance of one or more arbuscular mycorrhizal fungi in roots of a plant grown from the treated reproductive element under water-stressed conditions, as compared to an isoline plant grown from a plant reproductive element not treated with the *Streptomyces* endophyte.

2. The method of claim 1, wherein the plant is soybean.

3. The method of claim 1, wherein the plant reproductive element is a seed.

4. The method of claim 3, wherein the seed is a transgenic seed.

5. The method of claim 1, wherein the formulation comprises a purified population of the *Streptomyces* endophyte at a concentration of at least about $10^2$ CFU/ml in a liquid formulation or about $10^2$ CFU/gm in a non-liquid formulation.

6. The method of claim 1, wherein the formulation further comprises one or more of the following: stabilizer, preservative, carrier, surfactant, anticomplex agent, fungicide, nematicide, bactericide, insecticide, herbicide, or any combination thereof.

7. The method of claim 1, wherein the treating comprises coating the plant reproductive element with the formulation, spraying the formulation onto the plant reproductive element, or introducing the formulation onto a soil comprising the plant reproductive element.

8. The method of claim 1, wherein the arbuscular mycorrhizal fungi is of the family Glomeraceae.

9. The method of claim 8, wherein the arbuscular mycorrhizal fungi is of the genera *Glomus*.

10. The method of claim 1, wherein the 16S polynucleotide sequence is SEQ ID NO: 2.

* * * * *